United States Patent 7,365,185 (GENOMIC PLANT SEQUENCES AND USES THEREOF) - sequence listing, part 88

SEQ ID NO: 80510 - DNA, 30090 bp, Oryza sativa
caaaacacaaaaatacgattccaattcacgcatctaacccccggatgtataatatttcttttagaataaaaaaattattaaagcacaaaatgataaaccaactactgacacttcaatttatctccttatagacaaatgtgttccatattatcatccaaataaacatacttcacaatatgaataaatgttataattaaaccaatacatatagttttcaccattcagcatctgtaaggcataatatttttttatggcatctcaggattatgacccgggttattttgcgcacaatatttttccctttttggtaaattagaaaacaaccccccccttcccataaatgtttgacacggttgaatttttaaacatgtttgaccgttcgttttattcaaaaacttatgtaatatgtgtaaaactacatgtatacataaaagtatattaatcaataaatcgtatgataaaaaaagaattaaccaccatttaacttattttattaacacgaacggtcaaccatttttcacaaagagaaggacgacaaacatttggtgatggaggtggtacactcctcggatgagaattacaccaccccatgtgtgtcaccatgagtccggtgggcatccgcctcagtagcctctgtatccgtgtctacgtgcgtacagtcctcgccgaccgctcgtccatgcgctgtcctcgccatgcgtgttgtgcgagccgcgagagagaaaagagcgagagagatagataatagagagagaggaagaagagtatggcaggcgggtcctgcattttttaattaaaaaaacgctaactggattgccacgtgtgcgccacgttggacaaaacctctctgaattggttcgaggggggtaattcgtccggtttgcatagttggggggtgaagaatgtccgtttttatggttcatggggtaattcggacgaccgcgatagttcgggggatagggggtggggggttattcatactttttccatttatttttaacggcagtcttttgtctatttggcaccttgttaggatcgttcaaaaacttgtcacgtcacaattcgagatttcgatagcaaaggacacatgtacgtttttttagaagccttataaaaaattgttataaataacacaataagatggtgaatatattagtagtagcatttttgtctatggtgaagttctggagtagtgctttctgaaagataaacacatttgcaaacacatcatcgcctatgcgtcagcattgcaattttcttagtcagtacacacgtaaatgcaaaccaatgagcaaatgtaataatatatgaatgttccattgcacattccgaatacacaactgatcatgttgcaacaagttaccaagaaagaatatttaaatttaagccaaaaatttagtttcggtgatatatttggcccctctttcatctacatagtttaatactctgatcccttggtgtattctgatacaagtttcgaaaataacgatgaattgtcttccagaagttttgctggcgagtcatcctctgcgattttacctgtttacaacaacatggaattaaaacgggagaaccaagctattaaccgttggctactaattaaacacaaagcacatgactaaccattgtccagaagaatgaccttctcactatcaagaacagatgcgatcctatgtgctattgtaatcactgtgcattcgaaaaattgttgcttcagggttttctgaatcaaattgtcagttattggatccactgaagaagttgcttcatccaaaaccaagatctttcgcttctttagaactacccttcccaaacaaacaagctggcgctgacctgcactccagttgttgccattttctgtaactatatttcatattaaaatatcagttatgacttatgagtttgacactgtggagcaatgcattatagctttctgatatagatataaaacctgcagagtcaagcttgagctcattctttctaacttcatcgccaagatgacaagagttcaatgcctggataacacaacaaatataagttatgcattagtttgacaggtgcacattgaagaattaaaatgtcagtaaattaaaattaaaagacctcccaaatttgttcatcgctgtactcctccaaagggtcaatgttatttcgtagggtcccctcaaacatcacaggatcttgtggaatgatactcaatcttgtccgtaggtcgtgtagtccaatggtgcagatatcaaggccgtctatcaacacttgcccaatagatggctcgacaatacggaatagcgcttgaatcaaggttgacttgccactgccagttcttccaacgatgccggtcttcaaccctccgggtaaagtgcaagtaaggcctttcaaaacaaaaggcaattgtgttgcataccttacctgcatcacatacaaagcacttagaggaaaaaataacacttcaccagaaatttctgcattaggtgttgtatgttttccatgttaagaaagaagatatagtgttgtgagggtatttccacagtggtatgctggaagtcgtacaaaatagtatattatgaaagaggattgcaactctacagtactagaaaaaaaatctgcatgccaatttttgtggaataacttcgatataaaattaatttaataacacactgtttttctcagaaaatattatgaatagaaatgttgagagttctaatcaataattgacatagctccgacattgttagaagtgaacttatataacaacatagagttcaagagacaaacatggaggttgcgaagctcaatttcaccatttgtcggccactggcagtttggtctactttttgatattgtaaggagttgttcagaaggaataaacatgtattgaaaaattctttcaacggatatcattctattttccaaactacagagcactgcaatagcccacccttgcaacatgttcagacttaatccataagtgactgcaagaccagctgtctctgtgagaatacaataaaaataaaaataatagttagcaaggatggtaatacacataaagaactaatttgatcggaccaatcaaattaaagcccactgtacttacttgggtcaattagagcagctggcaaggtgaccagaagtaccaaggcaaatgcgaagataaaggatgaaagaatgtccaagcgaaagcacaaccattccattgaagcagaattatataaacttggtctagataaattatccatgaaatgactgacataattgataaactgtctttccttgccaaagcatctaataatatttgatccagctactgattcagcaaaatgttgcatcagcggagctctgcaaactccagtcaacctctgcaactccctagcaccatctatgtaatattgctgaagggaaggaattatggtgattaaaaataaaaacaaaacatgagtcgtattgaaaccaataatgccataggacatagttataattttgaaatatgattacaattattattggttaatagcatattttaagactaaaagtttgattgttcagaagaacatcggaaatgcacaagttctcctatatacagtagcatcaacctagaaattttattgggaacatttttgccaagaaaagaatcacatcatatatgtacctcatgtttttattatgtattatatttaattgctttgccatgcctttaaatttcaaattaaatctgtgaaaagaaaaaaacactgattttcaattttcaattgaatctgtgaaaaattgtcaataatgtcatgaattaatgtatttttccttccacatacttaaaaattataaactggaaccaaaaaatggcatccaacataaaatatataataaaaagaatacctgataccacagagatgctgcaataattgggacaaaaattacgaagactggccatgctacccgtgacattaaaataattgttccaagaagttcgataacaggaaatagaacatatcccatcaggtcaaaaatgctggtatccactgtgctttgatcactagaagcctacaattttgtttcaactttcatgattaattgaatatgaataaaaattctaatggtattccaaggagataacttcaattttctcattaaaataaagatggtgaaggtaaattacttactctgttcaagattcgaccgctaggagtggagtcaaagaaagacattgaagcctggaatatgcatcgatgcatcttatcaaatagcatcattgcagtcttacatccagccatgacaagaagatgggatcttatgaaaatgaataacgagctcacaaaagctaacgcaacatatacaagtaccattttcaagctattgactggaggattcacatctttggatattggagcagcccaagccatccaaaaattgcttccaatttgaagaacttgaaaaattatctgagcgagcaaaataagcggcacaagtgctccaccatatgccattgtaatatatttccaatagacagaaatcccaacccgccctttctccctttcttcttcttgtaccaactgaccattttgaacaatcccttctgctccttcattttcatccttttgcttatcttgtctgaaaagcatacttccactgtcaccaggaataagactactttcgggattgccacttgagtgttctaaactttctagagtagaaatgtcatccttatgggaaaatactaattttgtgaactcttctccagaattaagtatttcagcgtaattcccaacttgtattatttgtccatctttcatgacctggaacaacgaaatgaattgacaaggtaaaacgattgttgcgagtagaataaataagtagatttgatagttgttggaagctcaccatgatagcatcggctgatggcaaaaattcgacatggtgggtaacatacactacagtttttgaagctaagagtccaagtaagcactcctgaaaaatacaaggtcgtgttgaataactttcatacagtagatatactcttgaaccctgaatattgttcaagaacaggctacctaaaaactgtttagctgaaacatacaaaagatctgattaagacattaggtttctgtccacacaataaactatgcaaagagataaactgctattacttattttggaagttgggaaatgaaaaatcaaacaaaacaaacatgttctattcgtctaaggatttgataacggcactagcactgacaactgaagaaggttaaaaaaaaaccccctaaattgactgggagaaaatggcgttgaaatcatatgatgtaaatatatattttgtagtattagaagtcttaagtaccaacaataagttattagtttaagcattcagtgatgatttacacacatatagaaataggatttaaagatttgttttgaaaaataccttgaacaagtgcaacccagtatgagcatcaacagcactgaagggatcatcaaacagaaagatatctgcatcttgatacaaagcacgtgcaatttgtatcctttgcttttgtccgccacttaggttaatgcctctctctcctataattgtctgatcacctaatggtaatatttccaagtcctttttaagacagcatgcttcaaggaccttttcatacctttccctatgcagttttgtgccaaaaagtatgttatgttcaattgtcccactctgtatccatggcgattggctaacataggcaatcctaccacatgtttgaacatctcctgataacctcggtatctcaccgagtatgcatgacaacaaacttgattttccagatccaacagttccacagatagcaaccctcattccttgtcgaatacggaagttcaaatttcggagagtaggaacctcagaagatgtgttccaagagaactgaccgttcctcacctcaatcgatacatcagttgtacctcttggaagtttagttacaacatcgctcgatagttcctcgaggtgcataaaagagcatatcctgtcaagtgatacttttgtctggatgatcacagagactgtgtctgggatactattgattggtccttgtagctgcctaaacgttgctagagcagacaatactttccctgtttctaatggaatgcctagaagcaaacaagttccaaaggtgaccatagcaataaaagcaggagctccaaagaagacagatataagcatagctgaggtgtatacatctttctttagccaatgcatctcctccttcctcaactccatgatcttcgacaagaagaccatttcccatccttgaagcttgagaatgcgcatgttccgcagcatctcagacatagccctcattctagcatccttggcatccatcattttctcttggtaattttgctggatcctccctataggtagatttgctaacattgtcaaaacagtggcagcaagggctgcaaatgctgccaaaccaagagtggagtataggatcagcattgctagaataacctgcacaggaaacaaccaaagctcatgcatggacgaattgaaacccgcgacacgcaccgcatcaacgctcacggcattgatgatctctccacttgaaatgctttccctggactgatttgagagggagagacccttttggtaaatgatggcgacaagagctgagcgcacccgcacaccaagttgttgcgatctgaagagcaaatgccttgatgagaggcctttgatgaactgcgcaacaacaaaactcaacaccaaaatgtagccttctttagcggtccgtggacttcgattcaggtaatcaacaaagtactcaatcaggtatggaccaacatatgaagagacagtacggagtaaggcacaaactgcagtgaagaggattaatttccaggttgtaagaacaagagctttgaccagcttaattgttgtaacaccggtgtacttccctgaaccagaaactgagatgagcttcgcctcaaagttagggaggatgccttgaacactgtcattatcatccaaagttggcacatcatcaagatctagtgctttcctccttccaagatcaagtaacggccccatccaagaaaaagtgataacactaaagaatccagcatctgtgaaagctgctctactgcctgtggccttagacgaggaagaagctgcacggtccaatagtggctgatccatgataaactaataactcctgaacatagaacaacaaactttagcaagttacaactgattatttatgagaaagaaaagtataaaagtgttaacgtaaaaatgataatttaagtctgttcatggacattaataggattacagaaagtatagctaatttaaaggaaacaaacataactgtgagtgttaaagccatatgttgcatgaaaaacatccggatgaatccgcacgataccacagaattccattgtcacacatggtcaagatgatatcacaaatctccaagtaaacaaaatcgagacctagattacataaatagcatatgtaatatgtatgtaatctaatatgtgctaaacttcctagaagtaaaaaaaaaagaggatgtaccgaacttttaaatttagcaattgagtttttttttaaaagtatccgatctcaccatgcccatctcagcattgaagcacagacttaataaaaatagcaaaattagtgcaacagactgaaaatgagaatatatattacgcattactccttgcatacctcaaaaagaaagaaaaaaaaagcacgcatgtggaataggatggtgtcagccacaaatcgaaatctgtgcgaaatttttgtaaattaaccagatactggctattcggtgggagagatggaggagaagagaagttggcgatctcgagccctccggcaaagaggcggtggtggcggcggcgatcacggagagcctataaatgaatgcggcggtgagggtcttgagcccaccagcggggctagcgcaacggtgccgagccgaccgaagaggagcacggacgtgccgctggtggctggggcaagccgccgccgccgctgccgccacggccatccgggtgtctgcgtggtttttctcagtgatcagaagttggaaagaagccgcgtctcactgaaaaatttgataatttaacgcttttttccgttgcccaaattaatttaattgacgtttgtaaagatcgccgccacggccatccgggtgtctgcgtggtttttctcggtgatcagaagttggaaagaagccacgtctcactgaaaaatttgataatttaacgcttttttccgttgcccaaattttaaggagtgttaaattatcaaatatctccgtctcgctcgactcacgtgaccaaaggagacggaaattacctatgcttgcggtacgtgggttttttctaatttctcaaaatcttataaaacacatttgtttgttatagatttgggtggcgagtttattaacgacttaaaagtaattcctatcacaattatgaaaaaaaagctgttatagaacttatttgcaaatctgaaccccggttttcttcacagttcacacgctgtacgaccgtagcattatcaatgtcatgcctaaaggttattttaaaattgagtaaatttggagtttatttcaaacaaaacaataaaaatgttagttaagttcaaattagtgcggattacggatttcacatatgtaacgcttgaaaccaatatcataatccccgcttgttagtaacggttcccttcttccccttaccatctattttcctccatgtcataggcaactaactaaatatcttcaacgaatgttcacttgctctcgttctaggggtgggggtgggtgggcatgagttgcgcaggcagccgccctcctattcaaccggcggtgatttggagaactggtccggtatttcacgaggctcaaaatagtttgtaaggggtaaaaaacaatattaaaattcggggattcgtgaattaagagcaggtttattagtgtagtaagctaccagcgatagtatttgtccgtgtctgatatagccatcaagagagaagctcatgcgatgaactagctgtttcgctagctaaatggaaataaacaaacatttaattcatgcatgcacaaccaaattggcatgatcaaaactaaccaccatccttgtagctatgtgtgttgcctgtgctctagcgtgttagatagggagaaaaacagaaatacatgcaaactagatcgtggagatatgtcggaggcccaccaaatacgtaggtatcacccatatcagctgcaagcgagcagtagaggctcgtttcttacactatcgcccggtgacagatctagcgtccgctttttctctttcttcttttctccctcacccacataggatttcgctaatgtggaataacgtatagcctactgactcaaccttattatatatacctgctctaagaagtgtaagtcgccatcttcctcctcgtacatcgtaattcgttgtaaagaaaccacctcaacaaaaacaaacacgtgtgtttccatccaaaactcatcccaccagtaaaaccagatggatgaaactcaagccttgcaaattttccttctaatccctttgcaaagtaagggtatagcgctagtaaaatttagaagttgagttaagtaatatggactattttttttgaaaaatgaaataaaattaagatcgttctcgaatcgggtatacatggatgaatacaaaggaaaagaaaaaaaaggaccaatgtgaagaatcaaaatagagatgacaaagtctgcaggcatatacttacctgctagcttcttcgttatgcctaaaagcctaacaaatcgatcagaagatcggccgctccccttctcaacgccggctgctgcctgctatgcgccgtgccaaggccagccgtcttccacggggtttcgtagcagaaggggttcatatgtactgcactcctgtatttgtgtggggatttttttattacagtacaaagtacagatttgtttaggctaatccaatagaggtaataatcatatagaaggaaaccattgtattcgtacccttcttatgtggagaattaatgccccttttatttgacacctacagctacacaaaagtatgattagtcaattaatgaaatataatcgtacctgccatatattgaaatccaaatttacagccgtgggcctatttggcaagtttagagaatattgcgagtttatagaagggaaatagtagtgtggctgcattcggcatgtttggcgatggagaggactgatagttttgagaggaaattaattaatagtaagattagaatttgatttttaagtctagcatgttttgcgatgaagaggatggaaagttttgatgggaaattgattaatactaagactagaatttgactttcaaatcctagtatagcatgtttggtacaagtggtgcgaagtgatggaaattactactccgtcccataatataacaaactagtaccgaataggacactttatagtataacgaatccggacatgcttcctgtccagattcgttgtactatgaagtgtcacatctggtcggagggagtatcttcctagtttctctataaaagtttggttagtcccttcggatacaagaatgaatatatatgtctagattcatcaacatctatatgaacgtagatccaatcccacaaccgaaaaaaagtacaatttcctataaagcgaaaaacaaaaaaaatccataaaaaataaaaaaaatctagaaaacatctagaaaggatttatatttgtcgttttagtagtccatatatatctcttctctatctctaatctaactaaaaaatgcgcggaaagataaaaacggtttaaaaaaacacgtgaggaaaaaatatcagaaaaaagcacaaaagaaaacacgctagaaaaaaaggttttcgtagtaaaaaaaacacgcgagaaaaaaatatttccatcgtctgtaaaaaagcaaaataaaaagcatacgaggaaaaaattgtcagaaaaaaaggctaaattgatggacgcttggttggttaggatcatcgatttttttttcatctcctaggcttttgtttcatcatctattctcctgtattggagaccctgcacacctctgtagtcaattatcatactattttttgtgaagtatagctactattcttgataacatattatatggaaataatattagaaaataaacatattgtaattgttatttagaaaagagtgcacagtggctctattttgtgtagacttgaccatgcgagtcagtgtaggatttgattggttgtaagaatgagattaaaataatatttaagattatatgcatgttgtcacatgaataatccaattattttaggtaaaccaaacatcggtaaggttgccatcatcgaggttgggccattacatttaagatgttctaattttctaattttctgattgtcatcaatatggttatgtatgaaaaagtatattatcattaggttttttcatccgttgcaaccacaggtatgtttgctagtatatataaagaaactcagtcggacgtccatggtagagtgaaatgtggaaatcaactaaaacaggggagaaagaaatagagttggtttcaactttcaagaaaagaaaagaaatagaaaaatacacacaacaagggaaagacgagttaaaagaactgggacttttcctcacaaaaataaaagaagaaatcgattgggacttaggggtttagagttagcagtgatctctacgatcgatctgttgcattgccacctcgctcgtgctcttactttaatctgttgcattaacacgattgattctcaaactttggtttcaagaaagaaaaggactcaaattcacattgggttctatatataggccttgtttagttaattagttccctaatttttttttctaaaaaacatcacatcgaatatttagacacatgcatggagcactaaatatagattaaaataaaactaattgcacagttaggggggaaatcgcgagatgaatcttttgagcctaattagtccatattagccataagtgctacagtaacccatatgtgctaatgacagattaattaggctcaaatgattcgtctcgcggtttccaggcgagttatgaaattagtattgtcattcgtgtccgaaaaccccttccgacatccggtcaagcatccgatgtgacacccaaaaattttcttttcgcgaactaaacagacccataatttgtcacgcccagaaattcactagtaatttccgaactaatttgcgcataaaattcttgtccaggaatcaaccgaggtacacaaactgacaatttaatatacatattcatcaaaagaactaaagcgataaatacttactgaagaggcacttagtcctcacaacgaagaaatctgcagcggaaaaataaaaataaaatctggcaaagcttcggctccactcccacagcagctcaactggggtataagctaagcatcttctccttctggatcatttttcttcaactgagatttgattgattattgcaaggtgagtacatggaatactccgcaagccacacagcaaatatgcaagtgcacacggataccaaaggatggcataatataggctcatttgcaaaagcagcatttagcaaacatttaggagtagtaaataagtagagtaattaatcatcaatattaatcaacactgaatagcacacccatgctgcaggcccaaccaaacctgaacaaccaaccccggtcgtacagatcaaacctctaaaccaggaatttaccattccaaaccaggagtcaaattaattatcacattattatcattaatgagtagtgtgggactaatcacgaaaaacattgctcaacccacccataaccgcgggcatggctattcaaatagttttactctggccagaggtgtacaaatttacccacaagacataactccacaatatgtcaccatatcaccatgtgcccatgctgaacatgccaccatttgtgtagttgtgacaagacccctcgcatagctcaactcaaagcagcgcacctttcctggatcataatcaccccctctacaaccagaggcgtggactccccagcgacccccacggacttctcgccgcttcacagtctagcgccccacaatgagccttgctatacaaagtgtccagccgttgcccattctggcttgtgattagtacggttaatgtctcacaacagtagcttgcgaaccggtccttaattgtcatgagcatgaccttcaaaaccatgtgctcacaacccaccattatcaagttttaattatcaattatttatcacaacacgattaaccatcgtgagctaccataaagtatccatcattaagtaatagtgaaacattaatcatcccaatagtatgctagtgtttctaagcatgactaagcaattattctaatatatagtcgaaccaatatataaagtccaactagtcaaattataacccaaggtatcaaagaatagggtaatcaatgcaaattggccataacaaatgaataggttcacaccacccggtgacatttaaaaataaatgcatagttgaaataaatagagaatttaaatataggagcaacatgctcaaatgattgtgtttaggatctgtgtgacttgccttgcaataatcggtcttcaattagtcttcttgaacacttctgacgcactcacgaaccttcacaacgacggaaatgacaagctaacatttataacggagaaaaaactaataaaaaccaaataaacagtactaaaaagtaaacaaacatgtagatcatgattttagatgaatttagagacttgaacggcctcattccgacttcatatgaattagttatgaattttacaaaattaattccaattaaacctattaaagaaaacactattccaaattgattaaacaatttacaaacgatttatactgagattaaagattaaaacatcctccgaaaattattggaactaatttagtggatgatatatagtaaaaagaactaatatgccattgaaaagggataacatgatttatattgactttggatggctgagattaatcttgaccgagtcgaccaagatcggatggtttggattgatctggcaagctggcctcacgagataccgactcaacgagtcaattctacgtgacacgggatcaccgaaatgattaaccgaaaccggcggctctgaacggctctaaactaaaggacgactcaacatggacgaacgaacgaagcacggggaacacctcgttcgaacgaacgagcaaacgactcaacaatggttgcggctaaaccgatgagctagacacgattcacggtaaaaccctggtacgacaaacgataggccggtagaaacctagggatgcacctacggctttgcaactcggctaacggactacgggaagcaaacaaaccacgatgacgatgacgtgggatagaggcggcgttgcacaatttggagcaacgactaagcagcgacagtgacacggtttagcagcggcacgactgcgtcaacgacttggcaaggcgcggcagcagcaacgactcaacaatgacttagcaagatggctaccgagctacggcaacgcggcagcgacacaacgcagcagcaagtggctcggtcgctgcggtagcgggacgacatcgacttttggcacgcacgagcagcagctacacagctgtggcagggagcggtacaacggcggctaggcggctagcgcagcggcaatgctaagccaacagctaagcgcggcacggcggcggctactcaacgacacaaacaagagattaaaacctaaactgagggaacacagatagaaacctcaccaaaccaaagcgatcggagagggagagacggcgatgactacccggcggcaacacacggagacgacgatgacgctagacatacagcggattagattagattggattaataccctaggaaaaaaacctaaatcggtgaacggcatgggagcggtggttgcaggcgaaccacggcacaataatgcaaacgagggcaccgggagaaagagaaggcgacggcgattcttaccaacacttatgcgacgacgaacagtgaaggagatggccggcgacggactccaaagggcggcgaggttcgggtccacggcagcgacgattttccggcgacgagcagcggcaacggatggatggacgggcttctccccggctgcgacgctgtgggtggcgacggcaaagcttggcgacgacggaaggagcagtagggcctcgccggagatcaaaacgcgacggcgaacttcgggttgacggcgacgatggagctccggtgggtttcggctacggggaaggggtggacggggtggagcttgaccttgcggagccgagagaggcgacggcgtaggtcgtcgacggctgaggcggctgctaggggcggctggagcggctgccggcggtggacggagaagacgaacgcggcgacggcgctacaagcgacggcggagagagggagaggtggcggccgaaagaggagagggagggaactctatttatagccatgggagagagatatcgatcctacaacgagagaatcgaagccgggattttctagagtttggtttggagagataaactcgaaaacgaatccaaattcgcatcgaattcaaagggataaaaccggatttttgggggaagagatagaggaggataagggggatattttgcctcaactaattttggaaatacacgagagaggaggccggagttggagggggaaggcggcggcaatggcggcatcgggctctgtctccggccggctggaggttaggggcgactactgtagcagagggaaggaaaacagactttcagctgggcttcttttactcagcccgattgaaggagggacatgaaatggacttcggagaagggatagaaccagccgaaaggaagagagaatggaccgagaactaaaagtgaacttttctagtttcggcccggaaaggaaaagggtgtttttttattactttcccaattaaattaatcactgaaatgatctctaaattgttaaaaatacttccggtgctctaataattccaagaaaaattattaaaatacttgaacactataagtatttaaaaaaattataagaagaccatttaatgattaatttaatatgcgaatcattgctgaactgctctttgtattattaaaattagtaattgagctctgaaaaattcgagaaaattgcagagcgtatatttaattatggagaatttaataaaaattaaatgcagccatgatttatatttaggaaattttatttctcacatttaacttcacttgtaaattaatgaacatttaacataaattctaataataatttattaaataatttataaatcataaaacaaaaatcaggatgtgacataattgtacaatctcggattaattaattaatttagggatttgctagacaactgccggctagacaatcaaaaaaaaactcaaaagcttttaaaacgcacaatataagtaagaagataaccatataaaattgtaagaccaaactaaacttagtttcggagtcattaaattaacaaattaaatggctaaaaactttgttcttgagtttttatttttttttcttaactattttgttaatattatatctaataattgaagtcgattttaattaatcttgtaattttgtaggtttactaataacactttagcagtgttcaaaatacataatctatatattagctatacagaaatgtccggttttgagcttagaacatatccccctgatgagaaatgtgtaagaaacatcaggaatacatgttgtatctgacatgaaagagcaacaaagaaaataaaaagaaaaatatgtgattatctgctatatatcctcctggttatgcatggttttagttctgttccaaagagtgatgttgaacccccaccaaagaacaatcttcccaattcccacaaatgacagcagcattcgtacttagacatccaaccaaaccactcaaactcattctcaagcaatgcaactaaataaatgaaaatttaaaataccatattattttgccatggtttattaaatataaattagaaaaattctaaaccgttacgagtcattcatgttaaaatgcattttcaatcgtgtgctataaattactccctccatctacaaaagttagacatatttcacatttgagtttttccaaataaattgtttctatttgtagtctttattcacttaaggctttatttagttccaaactttttcatcaaacttttaacttttccattatatcaaaactttcctactcacatcaacttctaacttttttattcaaactttcaattttaatcaaacttctaattttggtgcggaactaaagcccaagaatctcagttactacctgttagctcggtacgacaccatttaagaatctcatcagacatctgcagcattttaatttgttgggggtgctaatgagctttcaagatggaagaaaaattgaaggggaaaaaaaagaacgcatctggcatactggatgctcaaaatcggtggaaggctgcacaacgtttgtactgcccaaattagcagcgagcagagccaatgaaaatctgtaaatcccccacagtaataaaggacatggaaatccccaaatcagctgcagcgagaggctctggcgccgtcctcgtcatctccacactactcctcgagtagtccatctgcacatgaacagcttggtggataggcagatcggacggtcgtccacgggtgatgaacgaacagtgtaacagttttactaatttgttgacaattagtaaaaatctattcgattttcaacttttttgggttcaaatttcctgaaaacttagaatttcagtctgccgattcttttaggactctgacatcttcatccttcctcagaagttagcaacaggcatgggattgcaacagtaattagaatagcttccttcactgttcttcgaaaaaaaaaagaaaaagaaaaaaaggagtcgaggacgagaagagagcacaccatcagttttattttattaagatagcagcgagagatgcatcaagcatcaatcatgaaaggtagagtagctacgatcaggtgtttgtaggaaatactctcaattggctagccacagaacatagccctgcggcatgtagtggcagatggcgtcgccacggcttgccttgaggagctcgaagtacgcactgtcccaggtggtggtgttgacgtggcacacggcgacggcagtggcgccgcccaggcccacgtcggcgacggcgtggaggtcgaccctcagcgccaccgcgtcggctggccggtggcagtagtacacctcgtatagatatggcatagggtggcacgccaccacggcgtcgccgccgatccgggcgacgccgtcggccgctaccacgtacctgcggggctccctcccgtgcacgagcgtggtgaccgcgcgcggcgcgctggtgcccagcgccgaggcggcgaagtcgagcaccgcctcgcgggaggtggcgcagcaggcgcgtggctcctcgccgccgccgccggcggccgtcagctcgctgcaggcgcggagggtgtcggcgacctgcgccgccttgtcggatccagggaggatgccgaacatggcgaggatggcgtccatggcgcggaggtcgaacggcacggcgtcgcccttgtccttgtagatgaaccttggcgccgccgcggccacgccgtggtcgccgtgcggcagcgccagcttcgtgccttccggcaagacggcgccaggatgcaacttcttcattaagaagagcatcccgcgctggatatgtatgcctgcagctgcatgaattcaaatatatattccatgaaaggttcgctgaaatgagtacaaaatctacctatatgttcttacctggatgagccagagaagacaaggcagccggtggagtaggaggcgcaacactacgtggattccagtcgactgggtaagcagcatcagtgaattgggccttgttaccatcttgttaacacaacagagtgatgggatcaatttgattgcattgctagtcaatgaaaatagcacatgcatatagcataaaacgactataatatatactacttactagaatgttgagcaaagatgcccggtgctttaggaggtgcaacactacgtggactccattttaccgagtaagcagaatcagtgaattcggccttctcaccatcttgtgaattatgtaataacagaattaattacagggtcaattttgtttatggtttaattaactactagtactagagaataccaatccaattgatgtagcataaaacagtacttacttggagaagcagggaaggtggctggttgtttaggaggcccatcagcacgtggactccacttgactgggtaagcagcatcaatgaagggagcattgccatcttgtcgatcatgtaacagaattaggggtgaatataattggactaaattactagtactagtaaatgggattaaaaacccactatgtataatattcgaggtagaacaaccctgcaatacttagagcatctccaatagcttctccaaatcgaactctccaaacacccatatagccaactctccatctgatttagctagtcaaactagatgctctctccaacagactctctattaatcctctccaaaataacaatggacccacacgtcagcctctactcctcttcttcttttctctcccccttccttctttcccctttcttttcttcccattcccttccctgatgccgacggcggccgcgcgtggtggctcgatgatgcggggaggcgggaggcgagacaatgtcgacctcccctcgagctgccagatctacaagggggcggcggcggagctcggcggcgacgtctcgcgacaatgaccttgacgacgacctggggagacgacgaccttgacgatgctcggggcggagctcggcggcagtggcggcgacggctcgcgacgacgacctcgacgacaacccggggcgacgatgacctcgacgatgctcggggcggagctcggcggcggcggcggtgacggctcgcgacgacgacgacccggggcgacgacaacccggggcgacgacgacctcgacgatgctcggggcggagctcggcggcggcggcggtgacggctcgcgacgacgacgacccggggcgacgacgacctcgacgacgacccagggcgacgacaacctcgacgacgacccggggcgacgacgacctcgacgatgctcggggcggagctcagcggcagtggcggcaacggctcgcgacggatctagaggagggcgacggcgagggcggcggctcgcgatgacctcgacggtggctccctaccgccgccgctgctcgccatcgatttttggcaagcggcggtggtagggatttcagcggcaaagggggagagagagcgagcggatgcaaagaaagagaatagggaataggtggggcccacagatggctagtgagtttggctggccaaatttggctactgaggggaaggatttggccagccaaatggcttggcaagttgaatagagaggctattggagtactttttttttcaagaattgacaaaatttaacttggagagtcttttgaagaggctattggagttgctcttactcggtagatgatgagcaacgaccagcgatggcgtggacggatcctgatctggtttccacttcgccgggtatgcagcatcagcgaattgcccttctccatcttgttatgtcacagaaacacgggttacttaaatgaattgctactgaaaacgacaaatacagcgtagaaatgacaatcaaacattctcactcggcttttctcaagaaaaagaaaattcttactcgtcggcagagtaggagaagccatcttgttattttgtaacagattaatggagtcaatttaattgatgtactacactgaaatgcagatatatagcacttaaacgacgcctgtctgatgatacttactcagttgatcaacacagttattacttaattactagaaaatcggcgtgcttattggcatgcttgcttaagttagcccgtaattttgtgtgtgtggagtatttgtatactgcttaattagaggttatttagaacgtgagaatttttaaagcaaataatccggtacttaaaaagttctatcagcatcatacctttaaagtacccttttagtgtgtttttagatttttttttgtggaatactgaggaaaaaacactgcatcatactaatatacgctaacaaattgatgaaggttgtatattagatgaatagaaaagtgtgttttatgaatatttcatctcacttttataaattcaaaagttttgcctataagctgttaaaaccatataattagaaggaaaatatgttcatgatgtttacacttgctactaattgttttatcttttctagaaatataagataaaaacaaagccaagttatatgtttccaaatctaacctaacgcaaattgtacttatttggattatttctcaatgacttttccaaagcaataaattggtataataagaaaaaatattgcatttttatattttgatttctttatactgcacattcctttttatatatttttattatttatttttttttcttttaaaataatattatataggatgctgataacatggcctatgtacttgccttgattttcactttaatctacagtaaccgtatctgttgttgaggaaatatgaatcataaaaatgacatcaatattgaacgtcgattattattaatttttccaatgtatcacaagttcccaacatataaatatgactaaatatgctaatagctttgtggctgagttttttttttaaactcatggatagctggtactgcagctggttcaggcgttcagttgcacatgcgtgtgagtgcgaatatgcagccggctcaaccggtcagcccgcattctcttgtgtatttgtgcacgcactgccatgggccaaggaccaaaggcggtaagcccattgggctcatttcatggactctgactaggatgccacgctagctatatataggtgcaaaaagttgttgaaaacaaaacttgcactattgacataataagtactgtgattaaatcatatatatttttttataataactctaagatataataattagattaaacggttaagaagtttgtttgtaataagcttttggtacgcgtacgtgccgagtgtttacacgagcggagtaataataataataataataataagcagcacctgctggagtatcatgtccgtggccgacgaacgacacctgcaggttggtgatcttgttgttcgtcctcgccgcctgcgagctgtcgtcgacgtaccggccggcctccttctccaactccgatgtcatcttcgtcgtcgggaagcgggccaagagactgcgcggggcccgggccgtcgccgcgtgcgcgcggcagcagccggcggagagcgccgccgccagcaagagacaggggaggaaggacgacgacgacgacgacgccgccgccgcccggaggctgaagcggcggcgagctgcggcgcactcgttgcccttgcccaccatggtctcgccaccaccagcttcctctagctaaacacacgtactgtgatcaactctttggaaacgaaattgaaggaaagaaagctagctagctaaacgcttgctgctgctgctgctgcgtttggagcgcgcggctatttataggaccgtgagcggcgagccaggcagccagagatcgatcgatcgagccagctacacattatattacacacacgcgtgttgcgtatacgtgcatgcttgcgcagttgcactgcttccgccttgtgaggcagctgatcaggtgagggactcggtcggtctctggttctggctgggtacgtctcgccgtgcaacagagctgcaccgtacgcacttacatatcctcatgcgtgcacgcgtacacgttttcatgctctctacctagctatgttgccatacaaaagtgacgcgacctgcatgtcagtaattaatgatatatatcaagtgagcgacgacaaatgggtttttgaaactgaaaatccagaaaccacatgttatgtcaggctatatatatacataaacgacaaattcccaaccgctatgctatatatacgtgtactcaaatactttatttaattttattactagccttttaaccaagtcagtcattattactgccatgtgtatatatatgcaacacattttgtgctcctattgtactttctcatctcacatctttatatgaatgaagggaaatggtagtttttaggtgactgagatttggtgttcacctgctccctacccattggattgaaatccaacgtttagagaattgtcttcaaccacttctcggcgatggcaacagtgatgaagagatcctcgccgatccctttatctttctcatcgccagagacatccgattgcggtacatgacctacggattagagttagggttttggggctagggttgggggaagccgtggggttttgggaagaaaggagcggtttctcccaggattagggagatggccttctggggtggcctgatcgacgatgagcggcgaggcggcggaggcgctgctggagacgcggagttagaggcacgcaggtgggtagggttggtggcaggggtgagggatgtcatggggtttggaggatgtggtcatcggcagtgaacccgatagcaccacgccgccgccagaagattagagaggaagagagaggtggccggtctagagggggctcgccggcaccgttgatggcttctggctagctagtgagccatggggcgaagtgcggtggcagtggaggcctcagtgctcagtaagaaagcaaggcgtggcgatttgtcctgagtctcatgtgcgtgcatgcgaactagaaaagagaagaatcgttaagggagagataatgagtatgcacaaatcttgatgcgatcctagtcgtccaaaaaagtgactgaaatttttcggatttttcatcagttacattaaagctagacaagaccttatataaatatgttataaagtatacttgtagcatatcttatgtgttactatgatattggattttcccctgtaactcacctgtttatgttttactgggatatatatatgtaatatgctacagtagacatgccctgtagttatgacctcactttatgttgccatacaaaaatgactcgacatgcatgtgaactaatcaagtgagctacaaatggtatttgaaaactgtccatcaagaaaccacatgttatgtcatgctatatctatacatctatgacaaattcccaaccgctacacatttctaaagcaacaaaatgctatatatacgtactcaaatactttacttatttttgttagtaatcttttttaaccaagatagtaactttcttcaattcaaaaattgaaaatcagattggggaaagctgtatataatactctcctaccgctttactctagtactctcctaccgcttgtacactataatagtgaagcgcagcagcagagaagtagccagtattaatgatactactcaaatgtaaatataaaaattatagggactcaattagaaaagtacaaacccaaaaattaaaatcatataaaaatggaatgctctcgaccggtaggttccgtttttgcacacagatctttaatccggcacatcaattttttttcaccaagatatatgagatatcacgatatagattgaaaccgagaggagtgtccctgggatctcggactcaaaccgatgccgaaaggagtggtgtgttttattttccgtttttaaggaggaatccactagaacggataccctcatctcaattgggcggtaagccccatctcaatcgggcatggcggccgtcacaggctagaagtcactgatgtgaagagttatctcaatcgggaaaatggccgtcacggatgattctatctcaatcgggccctaagtaaagcccgtcaccgatagctttgacccagacgaccagtcaaactatagcctgtcacagatgaactatctcaatcgggccacaactagcgcctgtcacagatgaccctgatctgtgacgggcattacctatagcccgtcacagatgagtcatctgtgacgggcattaacccgtcacagatgagtcatatgtgacgggcgttaactatagcctaagttaatgcccgtcacagatgagtataattaaaaaataaataaattttattttttggctagccctcactcgtgtgcacccacgcgagaagttcaaacttaatgttaaagttctttaaagattggcttccgaaaaagtagttgtaacatgttggtatgagtattctattaatcctattatgccctaggccaggatgtcaaattggggttattaaatgatttcaaatggaaaagtcaccaaaaccaaagttgtagaactcatcgaggtgcaaaatttttattttgatcatttctccatttgactctatttaaacaatttgaaatttgaaattcaaagtttgaaaagttcaaatagaattttagatcagcgaacgacttcaactgaaaaagtcatcaataacaaagttgtataactcatcaaaatatataacttttattttggtcatttttctatataacattttttgaaccgtttgaatttgaatttgaaaatatgacaacttcaaacaacattttcaaatactaaatgatatcaactgaaaaagtcatcaaaaacaaagttaaataactcatcaagatctacaacttttattttggtcatttcttcatatgacaaagtgataataacattgttcacaaaattgacatatctcttatctggttttataaactataacacatatatgtaaaatttgtgaataatattactaacattttatcggatgaagaaataacaaaaataaaagttttagatcttgatgagttattcaactttgttgttgatgacattttcaattgaaatcatttagtatttgaaaaatgttgtttgaagttgtcatatttttaaattcaaattcaaactattcaaaaaaaaatgttatattgaaaaatgaccaaactaaaagttgtaaatcttgataagttatacaactttgttgttgacatttttttcatttgaaatcatttactacccgtaaagttattctgacttataaaatgaattattatactgcactaaattattttgctatagtcaacttacaaatataaacatttcatatgaaaaatggaaaaatagtcatcggtgaggggatttagttaatgcccgatagagattaagtatattggccgtcactgatgagtcatctgtgacgggcctaattgttatctcaaacgggcctcaagttggtgcacgtcacggatgatggtcatctgtgacgggccacaacttgaggcccgtttgagatatggaatgttatctcaaacgggtctaaagttggtgcccgttacagatgatggtcatctgtgacgggccgcaactttaggcccgtttgagatatggaatgttatctcaatcgggcctaaactacggcccgtcactgataggtgtcatccgtgacgggctttagttttatactcatctaacatgtctgtgcaaccatatctcaattgggtacttttcggcccggttgagatgacttccttgtgacggcccgctatttctaagcatattagagcccgtcacagatagaaggatctgtactagtgatcggatatagagtcggactttttttttcgtttctgagagagagtcgaacttttttttttattttttcgctatttattttgttttgaggaatgaaggaaacacctcttttttacatagtagagattaagtagtagagaatcgggctgatttttttttgattttttttcgcccttttttaccagagttggattcatttttcttttcgtttattttcgccctttttctggatcggacatatttagtttttcttttctttttccggttttttcgcccggtttttagatcggacagattttttttttcttttttcgcccggtttttttacgtttggtttttcttttcttttccggtttttcacccggtttttttatcggaccgatttgtttttttttcttttttttttagtttttttcggacgatggaagcaccttttattttttaagtagtagagacagacatagagatctctacttaaaaacaggaaattcccgtcctccgtaaaaaaaagaaaaaaatgtccgactcaaaaaaggtaaaaaaagagaaagaaaaaaaagtccgacttaacgagcgaaaaaaagcttccatcgtcagtaaaaaaaaagaaaaaaaacatctcttgtccgactcccgtagaaaaaggaaaaaaatctcctagtaaaaaaacaaaaaagttcgtttggttttctttggcaccggtatttttttctgttttttctttgcacgcaaaagagtttttttatgcagcgcacacgctaagccttttggttgtttgtcccctttttttaacccgatctgttcaccgcgcgtctcccagacgcttttagtttttttcgtcaatcttttttgtcaccggttttttctcccgtgagctttttgtttttctcatctgattttataatcccatctgttcgctgcacgcctcccgaggtgaaccctagcgctgtgcagttgccatatcgatcgtgtgttttctcctccaatttgattgcaaaaatcgattccccaatcctctctcatcattgtctccatgattttcccttcgattcagctttaattgccggatttaatctctattttacacttgcctctctcatcattttctccataattttcccttcgattcggctttaattgttggatttaatctctgttttacagttgccgatgatgacggcgatcttccccagtcatttttatcctgagttttacgctctgattttggggaaaacggaaagagtagatcgagtggataaaaaccctcgaccaattttggctgatctagaaagattcggctagatttgatggggcgatttgattcggcaaatgtacgggcacggacacaggattatcttcgggaggttgaagatggtagtcatattcgggaagttgaagatggtagggtcgaagagaagcagatcaaatggagggaggtagcgcactagcatagggctgaaaaggaaggaaggctttcgaccgaaaacccaggaaatattttcattaatttttttaattataattatagcgatcccaatgttatgatttttattaactttttcaatcatagtgtatagtgatcccaatattttaatttattactcagctcttaatataacactgaaaaaagtcgttacccgttgcaacgcacgggcatcttttctatatattgagaactcataaactttatcattatttgagaaacaggtaggagtagatgatttatgcaattcgctgcactgattgttttcaaagatctagcatagcagaaattgttagattactgaatgaactttggaagccatagtaaaaaaaagtgacttaacaaaggagacaatagttcattagcccagttaatttattttcaacagcagacttttgtatgttggtagcttgttaggatcgttcaaaaacatgtgacctcacaattttagatttccatagcaaagcacgggtacttgactagtcttataaaaaaaattgatgcgtctatgaatcttatataacctatattagtagcattcttgtctatggtgaacttctggatatagatgcaagcggggcgggcaagcggccttttttgtcccgcttatcccacttttagtttttttgtttttctgaattgtgtacaattatgcgaaaaatagactagcaagtgggtttttatatgggtagcggaactacccacttgcatccgtacttctggagtaatgctttctcaaacataaacatctctgcaaacacatcatcggctatgcatccagggatttccgaacaacattgcaatttcttagttccattgcacattccgaatacacaactgatcatgttgcaacaggttaccaagaaagtatatttaaattcaagccgaaaatttagtctcggtgatagacttggcccctctttcatctactaatcatggtttaatactctgatcccttggtgtattctgatacaagtttcgaaaataacgataaattgtcttccagaagttttgctggcgagtcagcctctgcgattttacctgtttacaataacatggaattagaacgggagaaccaagctattaactgttggctactaagtaaaccttaggcacataactaaccattgtccataagaatgaccttctcactatcaagaactgatgtgatccgatgtgctatggtaatcaccgtgcattcggagaattgttgcttcagggttttctgaatcaaattgtcagttattggatccactgaagaagttgcttcatccaaaaccaagatctttcgcttctttagaaccacccttcccaaacaaacaagctgacgctgacctgcactccagttgctgccattttctgtaactgcatttcatattaaagtataagttatgagtttgacatcgtggagcaatgcattatagctttctgatatagatatgaaacctgtagagtcaagcttgagatcactctttctaacttcatcaccaagatgacaagagtccaatgcctggataacatatatacacaagtgaactcttttgcccatcgaatagcagatatgagttatgcatatttttttttaaaaaaaacataggtgcacatacgaagcattacaaattatactacctccattactaaataagtatatttctaacactcaagttttgtccccaaaataagtatgattttaaagctaactaccctctctcttcaatccatccctcatttaatttggggtatgaatgtcatgtattttctatagaaatttgtctcccatatgttatttagggatgaaggtactagtaaatttaaaataagaat

SEQ ID NO: 80511 - DNA, 15611 bp, Oryza sativa
cggcaacgggagtccggaagagtagcgatcgagagagatcttctcgttcccggccggaaaagccatagcccatcatgcctccttgaatccagagctgcatctcatcagagtactaattaatttattacttgattagttaattactacctctgtcccagaataaatacagtcgtgagtactcgtgtccaacgtttgaccgtcagtcttatttaaaaattttattttttttaaaaaaaatagtcttacataaaatattattcatgttttatcatctaataataataataataataataatcacaattttttttcaaataagacgaacggtaaagcgttgcaaaactgtacttattttagaacggagggataattaatctctcggatcatcgattaattaaggtatagtacttccatctagctaagctctcgttccaaatgaatatagtgacctagatcacacacacacacacactttaacagagagctacatatcggatggccgagtcccttaaaaaaatcgggtggtcaaatattttagttgaccatctgattaaacattaagtcatacaaggttaaaaaaaaatcaacaattgaattttttttttgtgaaacatggtaaaaacacacaatgaaacatgtcgctatagcgtatgaaacattgagtttcaacggtttaaaatacgtgttttttagttagaatataatcatgtgatatcttgttataaagattaattacaacggatatagtgatgtaatcggatcgtatatcggataagtaatttatgagaaaaaaacattttaaaaaataataatatgtgtgtgtgatagcgtggggagagaagcatgtagttggttgggaaattgaagcgtccgatatttttcttttgatcgctataccgataagaagtgttctacatgtgacaaaccgacaggtacatatgagcatttcgtctaaaatgagagagcacttcaaggaagaaaaatgtgggagatcgacggtgatattcttttgcatctttatttcgtttatttttctagctacttctccgctagccataagatagaggtagaaagtacaacggtctgtgagcactatatgcaaaagagcgtggcctagctggctactggggatctgctcctatggcagtagaaagtgacctatcctcagcatcttcaaatgggaaagagagcctgcaatcattgtgtgccatgccatactttacctatcatgtttgctgtctgatcgagcaagctgatgactgatgagctgagctgagctcgctaccaatgcactctgcatttctgcaatgcacaggggggagagggagagatcagagatagatagagagagaactaacttttttacccctaatggcagcttttccgttctgcgcttttacttcctttaacgacgtaacagaaacaatctgtctctactgattaatttttcttcttacgaacttatgatcagtaatgatttcctgctacgagattagagatgtcatccaaaagcccacttaatttcataattattgaaggcacaaaactgcgcacgttgcgtaccaaacatgatttgtcatgagagcatgagagttggcaggggagagatctaggagcatgcaaaaacaagagcatctcatgacaaatcattatgtaaaggaaaaagtacgaaatacccttgaactatcacggttgactgaattaccccctgaactagaaaaccagatattgatcaccctgaacttttagtaccaggagaattacccccctcaactcaatttagagctgttttcttctacattgcgtccgcgtggcaatccagtcagcatttttcattaaaaaaatggtgagactcacctgtcatacctactcttcacttatttggttattcccaatctctctctcgcgtcagtcgcgtggccgcaggcacgcacgggcacggcggtgtgcggcggcgacgacgcgaaacgaggaggggaaccggcaggagctcgtcgccatgcgcgacgccagccgcggtggccgcagagaccgggctacgctcatcgccgccgacgtggcgttcttcttctcggcaacgccgtggccgtccgcctcgtgaagcacctcggtgccaaggtggtggtctccgtcgaccgcggctgcgaccgctccgacctcaccttcgcggcacggaggggcaggcggcggcgcgagacgagggagcggcagacggcggcgcacgggccgggcagtgggcagcggcgtgagacggtgtctcagggctcacccagtccatgacggtggagccgctggcccacgacaccgtcgacgaggccacggacgacgaccgacgacgaggaggagctcgccttggccagctgccggcctctccccttcttcctcctctcgccgccggcttgttagtcttcagaataacttttgcactgaaggtatcatcacataagactctaagactgtttgcattactggtgtgctttgctaaagtatgaatgaaaagaactttaaccgttggcactcactttaaccagaattagcacagcatatggaggacgagataatcagataggaaaactctcacttcttttactaaatccatcactctgcccttcgacctcgcaagaatcacgcgtggctacatcgcatccattcgctgcaactcccatgacacgaaagccatccaccgaaagaaaaatgtggcatgaaaatttggtcggagcaaccgcgagggaaattcactgaatcctcctccggatcatggcgcccgaatcgttccaaaccaataccaatcaatcccccaatagcacgcacaagcatggccaatgcagcacgacgaacaccaggaggcccccgaggtcgagcaggaacgccgtcgtggccgccacgcgcgcgttgtgcgcgaatgccggctgcgacacggaggacaacgcccccgcggcggctcctccgcgccgtcaccgccggacctggaggaagaaggggaagggaaggggtggagcggctgtggtgaggaggtggcgtcgccgccgccgctcgccacccagccgcgcccgccgccgccgctcgcgccaccgcccacctctccccctgcgcaccccgtgagagagagaggaagaggggatggggatgtatgacagatgggtcctacaactttttaaaaaagaaaatgctgactggattgccacgtgtatactacgtaggacaaaaccactccggattgggtcgaggggggtaattcgtccggtattgaaagttcggggtgagcaatgtctggttttcgggtttaggggggcaattcggtcgaccgcaatagttcagggtggtaattcgtactttttccttctgtgaaatgagtgaaagaatgtcgttttgggttattcatggcatattgtacctctatggactgtggtacatttagggtttatacattgtcaattgtggtggaaaacgaagaattgagcaaggtggtattatttccccaagcgtgcctcctgcttctttgtcaaccaagaaccgtttgttgccccacaccccccccccccaaaaaaaaaaaactaattaaggcgaacacaaatcactaccatatctatcccctccaccgtgttatatatatggtcaaggttgacatgacaacaatcctatcgcccttatcctaatcctctcttggttaagattggttggattatagaggcttcttttgcagcaataaccatattgaattctctgtttgggtagagcacatgccatccgtttgtctgatcattgtagtcaatgctctacatatttgacagaaaactccacgacaacccttttattgagtactcgtgtctagtaaagcttacacaaaatctacagctcatcaacaaacctcaaattatgccctttcagtgaaggtagctgaagggtcactggtttacaaacaatgtacatgctagtagtataggccaatggatgtagtcgatgcggtaatattgcaactccgacccctgctggggcatgcccaactcaatctattggtatttggatgaatatccaagatttatttttttacaaaaaatatatatatggtatgtaatgcgtatgtgtatgaaaaaaggttgtatttaacctaagagcccatattcatattcagtacataatacgtatgctatatattccattaatactatgtgattctatacatgccaaatactaggggttttacctataaatatttatttttaccctattatatttcgtcaaaaaatcctaggcccacccttggctcgaccttatacttagtatggtcctgtgtactataagatgttctatccaaatgatgtaccggggattaattatttccctgaacttggtctttaatctaccatataataactttaagtcttaaaaaaggacaatcatgctttttggcaaaatttacgtttttcctccctgtggagaagtggtcctacggctacagcgctaggcctcaagctacgatcgagctgatgatcaattaagtctagagacttggcagctttaagctcaagctaatcgatcctacctaggatagactaggtttgtttgagcctagctcatcaacatactcactttgtcaaataaaaacaatatagtacgatatgtgacatatatagtactatcaatatggataaatattaaatttattttatatggtacatatgggatatatgacatagactcccttatatttcatacatatgacttgcgtatattatcattaaggattctgctggcttgatttttgaaacaaatgaggttcaattctcagacatctcttgtaatttagctataatagtcatcaatctcacgcaataaagacatgttattttctgaattcgtggggatcatattaaaagaaaagatccatattagtaattagttacaactcaattactacgtaccgattttcgattttaaaactataaactaataaaatgctacatcgagaatccaagatggaagtatctaaaaaaataccgcaagtcttttgagtaaaaaactttcagatataactatagtataattgaagtgtaactgcattgtaactacactgtaacagtataactgcactgtaactactatatagtttatgtaaaacttgcattcaactatggtttgattagctagcactaaattcttacacgtgacatgtttgaaaatttatttcttgcaactttttctcttcacgcacaaatcttaaggcgatccgatggtcacaaatctgaaagttttttggggggcaaaaaacttaagaaagttttctagcaaatccaatccaagataggttcaactccatatcgatctatcaatatcaaattttggagttaggaaataaaataaatctaaatagtccaaggtacctcctagaaatcacatgttttgtttaatacagattctcaataaaatctacagccatgataaaatgacctacatttaaagcctaaatattatgtgatcatatatcatatatacttatatagttcatcccactaactgtagttaatgctatttctcttttctctcattaagccacatcaccccaattatttctagcctttagatgatatatctatggtccaaattatctcttatttcttaaaaacatgcaatctcaattatttttagtctcaaaattgtatcaaattgttctcgtattgacaatcaaattacatcttatttgtctatattatgcaacttaatttttcgcagcaacgcggcggtgtattcatctagttaatatgggagttttctcagagcgcccatttagtaaaggtatgcatatatagatagattgtcatacaaaactaacattagttccaaccatgacatgcagaaaattatataataacttatgtaaataagaaatgattatttatctaaaagttgaggagggagggggatggggccgggagtcagctggtagctagcctggtacccatttggtaaaaatccatagtttttgctttcaaccacacaaaattgtttctctgccaaaataatagcaatcttcctttattgaaccgtcgtgcatttttttttaaatgttactatatatagatcttcgagtcatatttggccacaacatatatagcaaaagtcaatatgctaaaatgaacaatgtactcaaacagtagccctttttaatttttttagagaaaagaacattttaattaatggtccggctatggggagaaagttcgaacacaaacatatgctgctgcagctagccctttaaaaggagtaaatattatcgtcaatgatatgcatgcatgtaatattttcatgaatccgcaagcaaattcagagaatatggaggcttacatgcaaaacaaggaaagtcccagcctagaaacaagaagaaacaaacatgacaagctactgcactactagccactgccgaattagatggtaggatgttgatacgttgttgtcctcagcctctttcatactacaattgtcagaagtacggtatgacattcaatttcagaagattcagtctgtgaatgaaaaggatctatacccaaagcagtgaaagaaaagaaagaggaaaggtagagataaaaataccattcactcttccaataatagaggagcgtagagtgatagttatagtagagagcagatgccccccttgtgttcctgccctgctcctatcattatcaccatggaaatacaacagaagcaacagctgcagtggtctaaattctttcttaattagccaaacttttttcttaatctgaatcccttttactgctttcatcctcctgtacctcccatattgccgatatattattgcaaaaaaaaattggcgcctttatggaatcaggatctaggacaaccttcgaattggctaaaggccggaatcttcttcagaataatcagatataagaaacattaaaagatccaaaggggggaaaagccatcaagatcatagaccatatcatctcttcatcatcacatcttgtccatgccgagaataaaggggaaaacagcaatagcaactaatgcaacagcaacagctgcctagttccaagggaacgtactcttaataattaattaagccttggttacacatgcatgaagacagcagataataatgagggaaatttcatcagccaaaatcctacatgaaatgacatacacgtacccttaagcagatcagtgaagtgtgttaattaatagaaagcacacacctcctgcatgcgcgccatgcatcaattcttcagtctcttctcatcacctgatcacctcacttccgtgctcctcctcgccctcaagccgctgcgccgccggcgcgagaaaccccataaacccgccgccgccaccggcgccgccaacgagatggccgaagccgacctgtccggcagccattgtcgacggctggtggtggatggctgcgactgcgagggggtctagccatgcgcgggctgacgcccacccgcgaccgctggactgaaggggttccccatgcgagaagagctggctctggtccagcccttgccgcgacggcatggcgaacatgtagccgtcgccattgccgccgccgcggccgtctcctgtgctgttctccggggcatgccatgcctgcattctctggctgtggtcgggccaacctggaacgcctgcactcgagatcataccgtggtggttcgacgagacatggctgaagatctggtgctggttcgactgtagggtgaggcacagctcctgcggctgctggttgcttgtcgtgcgcgacaggaggtccggcggggatcccctgtactcgtcgtgtccggcggaggcggcgccgctggctgtggacgaggaggggaacagggacttgacgctgtcggagactcgatctgcccccagcgaatgtggaaggaaggagccagcagcggccgacgcggcgctggtcatggtgccgccggtagtgttgccgaacccgtaggacgtcgaggtcgcctgctcggtggcctcgggctgctccgtcgacgccgcggcgggcggcggcggggcctcggcgcggtcggggagctcgtcgatggcggccttggcgttgcgcatgagccagtcgacggccttgctgggccggtcgtagccgaggcggtcctgcacgtcgtagaaccggatggcggtgtgcgcggcgaggcggacgcgccggtcccgcagcccgcgcgccgtgcacaccttgctgtgccggtccttgcgcccggccgcggaccgcacgatgcggcctgccccgaatgcagtggccagcgcttcgacgggcgtcgactcgccgctgctgccgccgccatcgccgccgccgcctccacctcccggcccccggctcgccggctgcctgatccggtgttgcaggaagctgccgaatccctgctgctgctggtagatctgaagctgctcatgcgcttgctgcgccctctccttctcctggagcaggtagtgcaaggtgctcgcgctggcggtagggttgctcgtccaagggtctaagcccttggacaactggttcttgtcttcctccagcttgagctccctctcacccacagttaaccggaaaggagaagagcgaaaattaaaacaagaagctaaattctattcctgcatggggtttgccaagctcagctcagctcagctcagctcgccatcctgatgagagggaaaaaagatacagtggccatgggaaccccacagctccatgggcagagcaagcacgcacacacacagtcgcagcagcttaatagctatagcggcgcccagtgcagccgcccggccggcctctcttttgtgaaagtgacaagaaaagagggcagcgcagcgtagcgcagctagcccagtgcagatcttatcttggcaatctagcgctttgtgcttgtgcgcagctcgctcttgctagctcagctcgcagtactggctacccttagagggtgccaaaagaagatcaagaaaaaaaaagagctcccaaaaggcaagataattgttaaaaagcatgtgtgttttttgcttaattatcactattcaagcgatcatatatatatatatatatatatatatatctgtactcatttttttgttctctctttttttttctccttcgtgagtaaagtggaggaagagagagattggtagggtggggctatggaagtatagatcgataggatgatgcagggagaggggggcgccgcagacaggctcacaggggcagcaggagtcagggtgcaggagcagcaggacagaagctagctctggtgagatcacgcccccatctctccaatttccctcaaatttccccaaccttaattgcgtgggagaagcccacattgaattcctcctctcaatctctcatcactcgactctttctcgagaagactgtgctacaccaataggagaagcccacgcatgcattgtatcgatagatcacccacccgctgattgtgtactgtttcgttgtgtctattcagttgcaaagctgagcacaactgtgatggagaataactatagtgatggtcatgcatcacatcttttttgggtgggtttcatcttcgttaagctagctagcatatattcggattcagtagatacactgcaccttttaatatatttgtactatgaaacttaggaatggaaaagcttcaaatacgcgagagttaattgtttttcatgtgaaattcctgagcaaaatactgtcaattctagacaggatggagcacaggacctaatgtttgaagttactgactatataaaagtttttcatgtgtacaatacgttcagttatttagcacttctattcgtaagtctatgttactctatttatactcgtctagagttgaagtgttccctgtgaacgcagggatttaactgaatctatttcaatttcagttttgtaggcctagcgttggatcttcataggaattttataggaagtagttcaattccaacaaaataaaaagcaaatccagcgttccaaacatggcctagtgttcatataaatatatatgatggaattaatttccatttgcgtggatttgttttttactccctccattttatattataagtcgcttgatttttttcttaattaaagtcttttgggtttgaccaactttataggaaaaaatagcaacatttagaacatcaagttagtttcattaaatttaacattgaatatattttgataatatgtttttttattgaaaatgttagtatatttttataaaaacttagtcaaacttaaaaaaatttgactaagaaaaaagtcaaaagacgtgtaatatgcaacaaagtattatatttgattgcaccttaagtaacgggtctgtatatatctatatatgtacaaaaatgcagacttgagtagtagcaaatcttcaaaagaaatattatgatgtaaaaaaaacgtttgtaacattttgtcggttgatttgtaactattttttttacacatactatatccatgctgaaaagcttttattttaagctacaaacctggacatatgaacctagataactacttagaattagagcctttttgatgaaggtagtatgaaattccattcagtttcatgttggctgggcatctagggttttgttagttgttacttatagtatgctatacagtgtggcaggcaattagacggtagaggatagtatcgcagccaacataggagatatttaaggcaattttgaggaaagaagacatatactctctccatcccaaaatataagtttttttatatgaatctgaacaactgtttgtctagattcatagctaaaaattactatattttaggatagagacagtatatagtaattaatttggctataaatatgtttttgtccttttgactccgcaatatatacagaaatgtgactggatttcccaaatgaagttagttagttcggtattgactattcatgtgaaaactaaccagctcctactaacaatgttacgctcgactttttacacatgatgacatgaacatagtattactatgggcagatcatccccagtacttatattaaagactccttatatatagaacttatactagctacctgcctgccatctttgttagtaaatcccgacatcgcaatcacacaggtacagtctttttctttctccaataactactacaagtagcaggctgcaacgtgtgctagatccatcaactcttgcccgcgtgcactgaatgcatacgcaccaattatttggaccagacaattggttttattgggggtgtcctctgtgttggccgggttggtttagggtccagggcgtgtccggtttgctaaactgggttaatctctccttgccagatataaaacgtgtcccatgatcggttttcccttcggccttatcctcccatttgcgatgatcagacacatctatcgtcctcccatttgcgatgatcagacacatctatcgtcctctgaagatcgaacacatgtacacttgcccatccgtctctgtctcggcatcaatgcaaaatatgattgatgaggacatgcctatactgaatgaaaccagataaacgtggttagttgcatatcagcatatgcatggcacgaattaatgaagggtttcctctcgccgtgcaggtacatatatatattaactgtgtatggattaagggggtcatacctttaattaatttattggttttgaattgatagatcttgaaacgactgtaccctccaaaaggaggaaaaaaaggatctttgtgtagtatcgttttcttttgtggcgtggttgtgtttactgtggcggaatcggagcttttgtgtcgggtgtggctagccgaacaataataacccataacaccttcatgtccgtttttgcacatgtgattgatggttgacggagctatgggcgaaagccttacccccggtctctgactggtgttggcaacattggtgcttgtgggcgtcgtcttcctccttgaagtcatcattaagtggctctctctttatccgggtgaaaatctagtctagtgttctcaatgggtgttggcattattctagatgtttgttttccttcttcgaggcttcatgcctactccattagtttatgctccacggtaggggtgtttaggtggtttgagatagttgtttgtcagtcggaactactcatctgttttgtggtaagactggcaacaatgacatgtgtcagtctcagtagtggtgccaccacaagtttatcttttttttttctccgtgtgggtttaatttgctggttttcctctaattaatagtgcaattgttaggttttcacgtcgggttttctaataaaatggaccacctattttttttcttaatttaaaatagaaaaacttcatatcctgtttcttgaggtttaccttaaaaaagaaaagaaataagatcttggaatcactttggtcttatattgcatcattcgtaggttcatgatcgatatcgtgtcctccactgcttaaataagcgtaggttatccggccaaatcatcaagtccttggcaaaaattatttgtgccttgatctttttgttcattaaggactacaatcggctggatctaccatgcacgtacaggtgatttatgacactgcagtccctaactagttggtacccggattatatattattacttgcgagttattcattgtgtgtagttatatttataataccatatttttcactaaaataaatagtcagcttgtatttatattgtaagtttctaaattatatatataatttaaatgcatttacaatgtaagtcccaaaattacatatgtaaagaaaaaatcacagcaagcagcacaattgcatgaaaagaaaacgcaaaagaaaacgatactgatcagtatcacagcaaggagtacgaactaagcacgcgtgcatgcataagtacaaactagtgtttgcacgcacgatggcaaagcagtcctgcacaaaatctataaggaaattggagagctaacaaactgaactttaatcagagaatatttatggcgatataattatagcaaaaccgtattctttttgcgaaatggaagaatccgatcgagctagtctccccacatgcgtaggcccgtaatatagcggctgggtttaatattgtaatctgcaagaaacgatatgattttacacgtgctgaaatcgcagcgcttcgatgtttataattctcgcgagaggacaaatgttcaaacaaatatatgtgaagatgattgttttttttcctccctgtagatcagaaattattacctctcggtatacggtaaacagtaatcccgatctcggctttgtctgcatctcaatgtctgtatatatagtcgctgtagctgtaaatgctgatcacatgaatcccgagcaagcaatggctcactttcatcataccgatcgattaattatcaggcgacctagacatacattgaagctatacacctacagaaggaatgacaggatttcagaatttaatgccactgatgatacctttggttgcagaattgaatatacggttaacataagtatagaagccggccaacagttaggatagcagccaacccccctgactggtacgtagcttgctagttgctagatgtggttgtgtatactacgtatgtagtacaagtctcgatatgattaattaagcgcatggtcagtataagcttaatcgttctcaaaatttccattgcgttaacacgtacagtgcccaacaggtagaaaacgtaccagccgtgttgatccgttatactagtactaccactagcttcggtggccggccggcctcctgcgccgcgtttcttttcagccttttcctggtctccaactgtcccgccgggcttgcggggccgcgcggctagctgcaggctggcaaagcgcgcgcgcgctcgctgccactgcgagctcctgctcgctcggtcggccggcccgtcgctactcgctaggcgtcactagcgccaacccgccacgccagctcgtacgttcgtactgctgctcccccaaaacccaatgcaacgaacctttctactagctccgcctccgcgaccggccgcacgcctcgcgctcatgtgacgcgtcaccctccctgtgtactacgctgttggctcgctcgatcgatcgtcatgcatgcgcgcagcagcagctgcagccgcagccgcgcgcggccgaggaagaaaggacacatgcatgtgtccaattattgagactttgaggcggggaaagcgcgcgcggacacgccggacagcgccccgggcaggcacgaggtagaccgcgacaattcggcacgaaagaggtggccgatggggtgagagagggtgaggccggcggctgtcccacgccacggaacagtagcgcgcgcgcgcgcgcgcgagtacgtcgtcgtcgagactggagccgggcgggggcgcgtgacaccggccggcccggaggcggggcgataccgtatagtaccgacaccgagtgcgacgcgtcacggccgcgtctgcatgcatgcctgcgcagagaccgggccgggcgcgaatgggaggagttttttggaaacgcatgccgatttacggatctggcgcgctgggcccgcccgcccttttccctgaagctctgtagcgacgcatgagcgagcagagagggtgtggggtgatggcgatggatgcgggcgcggccaccgccgctcgtcgcttcgctggtggcgtgcaggcaggcgcaccgcgcaccgcgcaccggcaacatccgcagacgcggatagcaacgggcgtgcatgcggcgcggcgcggcgcggataaaaagggttgttgccgccttgccgggggcccgacggtggtggatgagtgtggatgtcgggcttctcggccttttgcctgaaggaggcgccacatcatggagcccagcatggacagaagaggctgggcctggcccgtttgaacttctcacagcccaggaggcaggagcaacgggccctaccccattgtgtgctccacgcaccgcaacaaggccgagctcctgaaagggaaaaggaaaaagagggggcccaacctcaaactactacaaccactgttctaaaatataacaatagcataatactataagcattacaaattataatattagattgtatctaatccatataagattacaatattttaggatggaggtacttttttacagggccagcgaataatgttctagccaaatttactaagagcgagtggagttttatataggaaaaagtacgaattacccctcgaactatcgcggtcgaccgaattacccccataaacccgaaaaccggatattcttcaccccaactatgcaaaccggacgaattaccccctcgacccaatctgcggtggttttggtctacgtggcgtacgcgtggcaatccagtcagcattatgtttataaaaaaattgtgggactcacctgtcatactcctcttccactcttcctctccctctcacccttcctctctctcacgggtggtaggcgggggacagagcagcggcggcgacaacaggggatgagggtgacgtggacaaggatggcgacggaggagtggaggacgatgctcgggcactggcggcggtggccatggcggagaggcggtggctcgcgtggaacggatggccacgggtggtggc

SEQ ID NO: 80512 - DNA, 25135 bp, Oryza sativa
aattctatgaaggattcaaactctgtcttctttatttgcttgatgatgaacctgtcatccaatgtttttgcaaagaaagccttactttttccaccttgagcatcccacttcatgcaccggctcaaggaagtgatatatgcaagctcagatgggcagcatttcttccgaagggtgtaaaactgattggcatgtacacaaataaccgagtatttccctttgagagatgatttcccattgacagatacttcaggatgaagtaaggatgacagaagtgagctatcatagctggagaagaggtcgtcagatgaaaagcttgcatctgagtctgaagatccaatagatgaccacgacgaagaggccgaagaagcttcagataatgagctgtaagatttctccatcttagagctctcactccccctgctgtaggctgcctcaccttcaaccatgagagcatctagtaaaagatggcgacgttcctccgatatggccagtgcgcgggatattatgctggatatttcatcctctgatatgcacaacacattgccacctggaccaactatgaactcagcagatgattgtttgtgcaggggggatagatgagatggagaatagttgttgacaagttcgaatctttccaaatacccggcctgcagttcatgcctgtaactctctcttaactcgtgcaatggactccaaatccatgtttccctgttatccccacattcaggatttatcaactgcgtatctgtaccttccaagactctgaaagaaggcacttttgtgatatgttgctcctcacgccgtgaattttcatcagttaaggtttcgctgctgtactgcatttccttgatatatccattctcaaagggcactgcactttcaccagttgcagctggttcaccggcaaattcagcagcttccttcttgccgacacaattagccattcttccagacttacactcaacaatttgatggaaacgacggtcccacacgtacagtcgaatcagaagatcctggtagagacaatttacaccaagaatctcattcacagaggagctagacatcccgctttcatcaacagccttcaccagagaatcctgtttgatgatattcatattggaattgacagttatcggagatgattagaatgcacacttatctctaggcttaccagttaccacaaggtaaagagaagaaaaaagaccagaaggtttaccacaaactgagctttttcttcaattagcatctcttcaagttgggaaacttctttgacaggaagagagtctccacagttaattgccacctcagagaaaatcttcatgtgctgtattaagctagaaacttcatagaaaagcttaactcctctcgcaagaaccttaaaaagtgcaacacaagcattaggcccaatctgacctatgaatgttcacaagataaatcatgtgatgaaaccgataaataaaatagtacatacatttcttccctcttgctcgaaccactcacgcatatcgggattgtgaaactcaagggttcgttgcggtttgcaggcagtgtaaatttcaactgatgaatattggaactttgcaactttggaacccaacctgaagtcaccattttttccaacaaaagaagaaagaaataaagaagggctaaaggatgtttagtatgtactacctccatattttaatgtatgatgccgttgattttttatccaacgtttgaccattcattttattcaaaaaatttatacaattatcatttattttattatgactcgattcatcatcaaatgttctttaagcatgatataaatactttcatatttgcacgaaaattttaaataaaacgaatggtcaaacgttggtcgaaaagtcaacggtgttatacattaaaatacggagggagtattatatagagagaacttttacacgacatgttcaaaatagttcttgagaaatgagaatacatacccaaaatatcgcaagcagtccctgttgaccaaatgcccacaaactgatagccttctagcagcagagtggcttgagaaactgagttcaaggaacttgccaaaggagagattacgcgcttcagttgatattagcactctccgagatgatttggatatccctctctcatgctcacatcttagacatctagtccacatccaaatttttccttcagattcaccaggcaaatgatgctgaggcagcaaacgcctcacattaatagttagatttccattgcggtgggtgtaagagtacatgtgagcatctggaggctctccacatgaggaacagcttaggttctgccacagttcagtaaaaaacatcacatcctgactagtagatatacaattgacctactatgtcatgtgttatcgaaattattcctaaaaaaatagataggtacctgattctgcaaaatgtcttgcaaatatcgtcctaaggagacatcgaaattcccataatagtttatgcggtatagatggctctcctcacagacaacctgcttcgtaacacattggctggataacaagatgagtatgctctgagaatccattacatcatcagcctcatctgtgtctgaatttatattttcgccggccctgtactgttccacattctgctgatgtttttcagtaccgaaaggatcaggctgtgacattttttggttggttttggcgaatacttgttcctggagatcatttaactgatccatatactcacaagaatgatcctttgttaaggtatcagacgccgtttcttggctggtttcagtatcttgttcattctgatgaccagttgtatcttgagaagaagttacaggtaaataaatattctgataacggaatatatcaatgaatcttctgagtgatccggagactgaggacagcaggttttcagatggaggtgcttcacagtggatggctgtaccctcatcttgtgtgtacgagtctggtttatttgtgaaaggaactgtagccttgtgatccccatcatggtattccagtaatgatcccctgctagtacaagtgacatcataatcagtaggaagtgaacgatttgagacaatggaagtctgatgagtgatttgtggtgtcccgtcaacatttgtatcattcaagaataccctctgatcttcaaagaaggatgtctcaacaaccagatggtatgcagcgaatattgtgtagtgcaagacttgcttgattttcttcagttcttgggtgcttgcgcctctgagcagtatctgcatgcgcgcgcgtattgagaataatgcagagtaattgatctaggtaattgaatgaaatggagtatttgatcgagtgcttacggtgcatcccaatgggttggaaaagccttccaagaacatcaatgttttagatggcttgttcagggcagcagcactagtagtggtggtggtgttatggtcctcgaagaacttgtcgatgtggaagtagtcgcagtgcttgaggtggttggggcaatcatggagaagctgggagaaggagagcaagggagcaccggaacagcgagcgattctctgcaagcggtggagcttcatgtcgagcagcagagtgacgccgtggtgcaggaggagctcctgaatgtcgcgggagacggtcttctcgaccatgacgacgttggggctgcaggtgtggatgatgtgggagatggaggctcggagaatgagcttgtcctgctccatggagtcgaaggaggagaagccgagatgggagtcgaggccgagggcgccgtggaggaggaggagggtggggcggtggcacttggtgggcatgtgcttgtgcgccgcgttcttgcggaacaccagcccccgcaccacctggctttgccgccgccttccggacgccacgcacttgatcttcacgtgggaggccgggtccatgtcgttgccggcggtgcaggcgtgggtctggatcagcagcgccgcctcccaggacagcgccgtcaccacctccagccactcctcctccacgcccgccgatgccaggaaccggctggccagcatgttcagctgcccgttcatggcgctcaccatctgcgccctctgccgctcctcctcctcgtcttcgcccctgctgccaggactaccagcaggagtcggatcgccatcgtcgtcgtcgtcgtccgccgcagcagcagcagcagcatcagcagggggtgggggtacccagtcccagtcccagtcgtcgtgggcgttagtatgatgggccgcaggtgaatcatcgccggcggcaacggaagaacagtagtaccggccatcctccggcgggtaactgatcgccatgatctctactacactattcatctatatatgcatgcacttacttgagttatttgctcgatcgaaagaagatcataaaaagaattgaaactaatgcaattaattagctagcgaagcgttaattaccttatagcaggaggagcaagtgtctaggtatctcttagaaatcgatcgagaatgagtatatcttgttgcagttggctcctgtcctgtccaccatcgataatctggaacaaaatatgcatgtactcctagctaggcacactcgtacagtatatagactgactagaagtatatattattattactcccctgtggctctgatcctaattaaattgcatgcatgatattgtttggtggtgttggtggctgggctgccttaactgtcatctatcatgcaattaggaagtactccagatcgatctggtactatcaatgttatataaggactcaaacgaaggactagctgatccaatcaaggcaaagcactacacacagactctaccggatctgccccctctgatgctcgatctgcttctcacactcacacgtcccattccagtgagactagagtatcttcgatattattattgtactccacctagctaaattaatacagtatatatatatccagcataaccaaaataataattcagacttttctttcctggctttttcttcaaattctttctttcttttgagcctaattaatgatttgttgtatagtatttgaccagaagaagaagaagataaagcagggcatgcatacgtggtgtgctgacaaatgtgtactagtagtacattatgtaagttccatccgatcatatatatgtgttgatgattgagtggagataaacatgcatgccgacgcgtggatgccgctcaggcttgactgcacagcagctacgtgtccggatggcaacaaagccacatacatacccccaatcagctactactactcatgcgtacatacggccggccggaggagtggacgactagtctgcattcatcatcatatgcaggtgaagcaaacccctagattttatattagtggagtagtaccacttaattactagctagtttatttaaactaattattactagctagctactagtagtatgtatgttatttcggcgaatgggggctgaattattgatccacatacacaatccaatcgaatggatgcaatgattgattagcttctcaataattctcacaaatacggacggatgtactacatgattaactagcaacgactaataccctgtttctttcagcttaaaattattataatctagattattgagccagattactataaactagattgttataatttgtaatataataagcagttagttgtttctttcctagattattgggtttgcaagtctaaagagggagtggggtggcatggtgggtaatttttcacccaataatctgaaaaaagctcatctaaataagcttatcagattataataagctgggctccagattataataagctacttcaataagttgtctgtttctttcagcttactcccaataatctggattataataatctcaagctgaaagaaatagggcctaatactagttatactccctcccagctttttaatggatgataacgttaaattttatcagacgtttgactattccttgtaaatatacattataagtaatatacataaagttactttaatgataaaccaaatcacaacaatataaaaggatatttacttaattttttaactaagataatgatcaaatatcatgcatgttaaaaatcaatggcattgtctattacaaaaggagagagtataagccccgttcttttctccaacaaaagttgaataaaattttggatacttgtagcatgcttttcaaactgctaaatggtgtgtttcgtgcaaaaactttctatatgaaagttactttaaaatatcatattaatctatttttcaagtttgtaataattaaaactcaattaagcatacgttaatatcacctcattttacgttaaaaacttaatcttcatctttatgttcattttcagaagaaaagaactcaattaatcatatatagataagtcgtaagtgattcttggatggaaaatcaagtgggcattaattccatgtattctccatgtgtgaaacagagactaataaggaattactaggttttatgtatcccaaatctcaatcacacgcttcatatccgttggatgtcagccaaaggagagggagtagtgggattcaggatggcttttgagggagggccaaggaggtggtggacatagatgggcgatggcagcagagttacgatgttatttaggaggataatgtgtaaggtcgatagtggagatgtcagatttgaagctgttaaaaggttggggcatctcgacaacgtgggtcggtagacaatgaagtcgagcaaggtaaagacatattggtgtcgtctaggctaaggtaggagaaataaggggagagggaaaggagagatgagtcagtcgggtagtgcatatcgacaccatcaaagccaaggaattggggcaggggagacgaggacgacgacattggtgtcgtagggtttcttatgagggtaatgggtgaggtttgtgctgggatgtcagacctaaagtggttaagaagtaagggtatctcaacaacgctaggtggcaaagatgggtgagacaagggcacctttgtgctgctaaggcttagggaggagggagcagagaagggaggagcgagaaaggaggcggtctgacatggcacgccggcgccgacgaggccgcagcatggagtgagaggtgaacggaaaaaaaaagaaaatataatattattgttctgcataaatcttcgcatatgatctgaattttctgaaatttatggttgtttttgtgtcactgaaaactaggcacccaaagtaataaaactcactgctgaacgtgtatatatctaagttgatcaatatgattcaggcgaatgtattttaatcagttcagttgatcgtgcgtgcatcctcgcggtccaagtgtacatcgtctggatatgccatgcaatcaggcaatcggccaacgtagcaatcagtaatcatgtatgtatactccagggcagccgaggctaattgtcaaattaattatcggacgacctcttgtggctatcgatagatccatcgatcaatggaatgggatgttgattcgccatcatcagaatagatcatagatctagctagcaagcaagcgcagaaattaagagagagacatggtaatataatcatgtatgcatggagattaattaatactcctaggtataactccaaggattagattgtaccacacatatggagtatgtagcagatagagaggaaaaattgtggaacatacattcagctggaatggaatgatgctgaacccctggaatcaactagaattcaatcattagctactgccatcgatccgattgctttcgattaatcgatggatggatatgattcaacattggtctggtggactatatagctagcttctgcagacctaattatcatcgtcgtggaaattggaattaatcatccgcatgcattgaatatttgaattcaagaaaatgtacatttagtgccatcgttgattaattacagatgaggatttcgtttcattttctcacgtcgatccagaaaacgggcgatttaatcttcaaagttttggggccttaatttgtctaaaagcgtaaatatatgggccaaattattctttatatgggctggattttgggccatatatctctgtgaaatatacatatgggctggatttcacatctcgaaaacaaataagtccactttgtcacatctcgaaaacaaataagaataccagatatcttatccgtaactattaaaaccaataaaaataaccctcttgatgtttttaaaagtggctttgaggttggttttttctgatgtggctcactaatctagtccaaccaactaaatcagcatgtgaaacccacatgtcatcatctctcttcttcccttcctcatcctcctatctcttgaaaaagtggacctctaaaaaattatcctagtacgcatgattgcagaagccagtccatgtatatgagactatccttcatttgccatattaggtcgatttggctcatgttcaacgtcatgggccaaaaatttagtatctcttctattactccaagacatatactctaataaattatttcatccgtttcaaagtataacaacatgtaacattcaatcataatataacaacttcttaacctacataatcttctcaaccaatcatcaatcacaaactgctatgttttagggctagttcactttattgctaattttaagcctatcaaattttagtagggtaaccaactaaacatagccggctagctgcaccattaccaccctatcgaaaattggtagtaatttcgaaagtttcctcctcacagtaactccaccaaaatttagcaaagctcccatccaaatacatccaatgcttctaaattttagtagcaccaaaacaagattgattttggtaataaagtgaacaagctattaatttattcacatattttctcttttcaacaaatcgtaacattctttcatttaaatcttcatactttcttaatacacatatccaactccagaacttcttatattgggtagtagtaattaacaaacacacgtttaaaggaagggagaaaattccttatatgaatgccattgaaagttcaccagtgtactagctcatatgccactgaaaatttgatattttcatatatgccacttaacgaatttttccttccctcatatgccatccttcatgtgatcattttagttagcatggaaagtacaaaatcaccctcagtttcctcctcttatgttatgcactagcactatctcccatttttgtcattgccaaggctcccatcgggcctaataagggcagttccaacccatagtggccataagcagtgtctatggtgacatgtcaataagacatcacaatagaaactacactctacaacccatagtttcttaaagtgtgccattaataaatacatcatctatcttctctactaatcatatttattctttatctattatgaagacactattctctcacaatgcaaaactttatagtgtctagtgcataggttattgtgttgaaactgtgtcttgcatgagacccagtttctttctctcttcactctctctcttaattaatatagtgtcacataagctaaaagtccgacatggcaatgtagttaatatcttaggtggagggttgggactgccctaagccaaggaaaaagcaaaaatttaaattttcaaacttaattttaagattgattttaagatatttttaacgtaatttcttttacagtattggcttttaagtcatcaagaacacatatataaaagttttacccacaaattcatttttattccctaataagtcgttttgacttattaaggaaaaggcaaacgatggagcctcaaatcttgtatggtactccacctccctccacatggctcaagaatagacaggtaaatagtccgaaatgactgctatctaccttaattttctcgctacgaataaatataaaactatctgttcaagaggttcggttggaaactcacctcccgggcacgtaaaacggagcgacatgttttcttataattaattaagtatttattattttttttaaaagaatatattaataatatttttaaagcaatttttgtatagaaaattttttaaataaaacacacaatttagcagtttgaaaagcgtgcgcgaaaaaataaggaagagagatgagttgggaaagttggggaaagaactcagccacccatggtgcaattcaattaagcattcaattaattcttcagttaaaatacaataatttgctaagtcgagaccctgttaccacacctcaattgctttgtaacgacatgaaaatggaataaacgaatgaagagaccgtaccgacgtaaggtggattagccggccgggcctgctactgcatatacacttatgttatactgccctactgtagaagtacgtgcagagagagagtcacggaggggcatgcatgcagggggcatttctacagttgcaggtagagacacgcacgtccaataattatgattctcttgtcgatccatcagctgatcgatcgcacgtcgctttctgatctctagatcaaagccccaaataacccacatattacatcatcacacatgcatatactccccgtcccataaaaatttagggccctttaaatcacagaaatgagaaaatatagaaatagaaaaaacgcagatttttataggaatgtaagtgtaaaacagaggattgcaaaacataggaaaaacagaggaatgaccgtttgatttgaccacggaaaaaacgcagaaattagaggagagataaagactcaaaggaaagtttccaagagattttacctaatgttagaattcctccaaaacttgtatggcattaggcaatccatgggatttttatatgattccataagatccattcctttgattcaaatggctatataggaaaaattcctatagtaatgaaatcctctaaaattcttatgaatttcctttgaatcaaaggggccttaacctaagataggatgttagatccttcctagtacaacgaatctggatttacgccgtgtttagttccaaaataattcttcaaccttccaacttttacatcacatcaaaacttttctacatacacaaactttcaacttttccatcacatcgtttcaatttcaaccaaacttctaattttgatgtgaactaaacacagctttacagtatgaggggttaagtttttttagatggagtatatatgcaggggtaaatgctctcgatctttcttgtagtcgtaattcctcacatatactccctccgtcccaaaatgtaagtattttttactatgaatctgaatagtaaaaaaatgatatattttgatatggaggtagtagaatatacttgaccaacaaaaggtcgattgatatacatcaagtggaagctagagcctagagctggggtatcgtgatgtacgcatgacatgtgcatatatatgaccaggttgatcttggccagttcttgacaaactcgagaaattattttgcacaagtatcacaataagcaagcaaaacattcatcatcgatcattcatgtgtgatctgcgtatacttatatactccttccatttctttttattatttcgattttttgggatttctcctgtgttgacgaggagaaggcacaggagcaaatatataatttcacagctttcttaattttgagggaaaggtcggaaacgtcaaataaaacgaaacggagggagtatatcgtccatcgtgccctgttaattagctctcggtcattaatggctgccctggcctgctgctggtacaatacaagtcggtcattgtgtttgttagcatgtcattctcctggcataaagagcacgcacccaatgccatgccgtatactccagtttgcatcattgcacttgcagactgcgtaccggccactggtggagaaagcgtttgtagtcccggttcgtaacctctctttagtcccggtttttaaaccgagactaccaatctgggactaaaaatcgctatctttagtcctgggtgaaataactgggactaaagatggctcagtcacgtggccggctgagccatctgttaccaaccgggactaaagatcgagctgaccttttttttgcatggccctgttgctgcatggtttatatatatatatatatatatatatataatatatatatttttatgtgcatatatatatatatgaccaaaatatatatttatattaaagaaaatatgtacatgcatatagaaaaatagacatgtattaattacaatccattatgatgtcctagctagctacgatttcgacgtagtagtaggcgtcatctcagaagctaaggacctatgaattgtatttccgtcgtagtagaattcacccttgggatcaaggatttgttcgttgatgaatcccatgagttgttcttgaaccgccgcgataaattccttgtgtgtgatcaggttatccctcatgcgaataaactatatgaatgtatgaaattaattagtaattaaacaaaaaatcgatacatacgcaatgaaattttgaatttatttgtacgtacatcgagctctcttgtgatgatgatttggtctgcaagacagtggcaatactcgcacacgtagtagccacacaagttagttccctgcttttgctttgcacactataaataaatgacaaacggcgagagatgtaattaatatacacttgtatgtatttgaattggaaattgaatataaatgtagagcatgtgtactcacaggaaaattgaacttccgcctaagtctttctctccatttgccgcggaccaaatgatggaaccgataccaagccctacatggagtttaaagctatgattcgtagtagcaattaattataacaagattcttaattaacataggaacttatgacagtacatgtctataagttcgaaaaccttgtcaaacgtagactcttttttatccattgagtcatatacgttgacggtgcaggcctccaggtcgaagagtaaaaggacctagtggaatctgcaatgtgcgtgggatgcattacatatgaaacacttagcatgttcgtacaggaatgaaatttgttataggaagacagtaaaaactaactctgtgttgtacggcaatagtatgaacgtcttgtaatgctgcgccttcaggagatggacgagattgtcctctgtggcttgcggatactggtcgagcattgcgacgtttactttccgagggtcgatgaatccagtatcgaaaaccccccaccgtcgggccctttgaatctccattctacaacgataaaaggaagtatatattatatatattctacttatatacaatgacctaattaattaaaggaaacgtaataagaaatctaactgaacgatacttacaatatccagtaactcataatagagacgtcgagggcatccagctggtatagttcgtagatacccttgaaattgatccagagaatgtcatctccttgcaagaagtccgtgtccctgatcctcactccgatcatctctctaccggtggcgctcatctccatgtacagttgatggaacttgtacatttgtgtgggtagggactacagctgcttaggcttgacaagcggtttactgagttcgtacatgtatttcactgacaggccctaacagcatttgaaccgggactaaagatgatctttagtcccggttatgcccgttaccctttttaatcgggactaaagatcatctttagctctggtttttattgcaaccgggattattgtagaattcggccgaccaacgaaagatgatttctccaccagtgggcctgaaggtggaggctatatatgctaattaacccatacctggcgaaatataaattgccgtttctaatacttcaattcaaatttacaaatttttaaataatatttttcctttgttcatattgaacacatgaaaaatatgttcgtaataatatacagcacgatgatcaaattattttttaatacatatatatactacatattttggtgaccgacaggatatgctagctaatgctaagccaacagttttcaaaccatcgcatcagcactaagtgtgtgcgtgcttgatcgcagaattgatatcgcgatcgatggtcctgtaaatgcatcatactcctatgtaataatggatggatgtgcacaggaattaataagatgggagcaactcccctccatccaagctatagaagatcactactagctcaggactcgtgttttcaaccgatcgttgatcgagcaatcacttcagatcgagtgtgtttaaaaaagattcaaattttgcctaaaaagggaactccaaatcgaggtggattactactacttatttgcctcaatgtatcatgtacttcatccattcgaaaatattactccctccgtttcaaaatatttgacaccgttgaatttttagctcatatttgaccgttcgtcttattaaaaaattatgaaatatgtaaaactatatgtatacatgaaagtatatttaacaatgaatcaaatgatatgaaaaaaaaataattacttaattttttttaataagacgaatggtcaaacacgtactaaaaagtaactgtgtcacatattttaaaacagaggagtatcatttctagctacaaagagcatcaatgtataattagcttacttatttgcctcgaccaaccgtggtagcaaataggaagagcgaagtaaacaagagctgtgcatgttttcctatagacatggattgaacgcttttcgaagatccaaaaaaaatagtaggagtaataagagcaagtttaatagtttaatagtatagccaactactagctccaattcatttataaacaatctaatagcttatccatacaatagttacatactacactattaatatatgatcccacctgtcatacacacactaagttttagagtccgtgctatagctggctacaaatctgtagcctgctacttttctctctcattatttatctcattaaaatatatttgcagttggcttatagcctgctattctatctgctctaagaagcatgagccagtggcatgtttgaagagagaaaatatggtgtagctagctaattaattgacttgctgtgcattagtgtaggtacttttgtgagggagaggaaagaaaagtatggcgcataggagtagaatagaatagaagcacgcgtgaagcagttggaacaagaacataggatacacaagtgcatttttggtaccacgtacgccacacaagtggtttatttatagaatgagtcgttagagtagagcaataccattacaggtagaactttattaataaagacaaaattattcttgtagtatgatgctagtactacacgtatgtactactagtatatatggagagatatgtcatggtacacacagtggcagtggcagaatgttcaatttctccacagagacgaccaaagggatagatgagaatatacacgcacattccacaggcacggaatgaaagaaaagagaaggaaaagaggaaaggcagaagaaactgcaggcgggcagcaagataggaatctcatcaagaaaaaaaagagaaaagaatggtgggcgaacgaaaagaatgtagcaacaaccaactttgctccttccagacttattagttgttcttcttctcttgcgcgcattatttgagcgcgaatgattgcgttggctcgccgggcggatggctgcctgtctgcgtctgcgtctaccaccgcccgggactggactggacctcgcgcgcgcgccttgtgaattttgagagtagaggacgggtaaaaactccccgtatgttatgatgcttctgctgcacgtacttggtccagatgacgagtgaattggcaaggacggacggacggacggaagggaacggaatgggtaggtacggtagtagttgtgttcagaggaggacgtcggacttggcgggtagtcgcttgtagaagttgaaggggacggacggctgcttgctgcggaagcgcggatggcggaggaggtacagccccaccaccaccgccaccacctggaacggcgtgacgtagagcaccaccgcgatgatgagcgagagcaggacgaagatggaggtggcacgggggtcgcgccagctgagcagcgcctgggcgcgctccccctgcgtggccaggtcacccaccaccgtctgcaccctcccggccacgctccgcagccggtcgtacctcatccgcaccacgtccccgggcttgctggtggggaacgtgtcgaactcctcgtccagctcgtccgggtgcacctgctccgcctccgcgtgcgacagcgccgtgtccatgtgcgccggcttccgcggccgcctccggtagttccacaccccgatgacgaacaggtagaggaagacggtggggaggatcagctccgggtagcacaccaggatgaggaacagcacgtgcaccaggatggtggtcaccgggttcttccacttgcagatcccatccatccaccgcgccaccgccaccgccccggagaagagcgacgtcatccgcttgaagttggccttgctccgacgcaggctgaacatgtgggagtccacgtccagcatgtactccaccacctcacggtgcagcgggggctccgcgcgacccagccgcgccgccaccatctgcatcgcctggaaccgcaggtagtccatctgcagcaccgagatggggtgggtgtagtgcatcttgggcagcagcggcttcccgtacatggccagcatgttggcccacgccgtgcacgtgaaccgcaccgccaggtggagctccccggtcttcttcaggccccccggcgtcagcgtcatcagcgggtagaagtgggtgtacacgcgctccgtctccagcgtcgacagccgcacccgcaccttgccgatccgctggtccttggcgtccccgccccccgtcaggtggcagttgtcgaacaccgccaccgtcaccaccgtgcacaggtcgaacacctcccacgtgtactgctcgttccaccggggcgccgccgtccccaccagcgtccgcgtccgcacccacttcgccccgtacttggccacgcagtaggggctcttcccgcccgccaggttccgcgccccgaggatgcccagctccaggatcccgatcgggctcttcctcagcttcttcgccgccggctgcaggtcgctgctgtagtgcgtcgactcgtccaacacgtggtacgccgtctccaggctcagccgcaggtggatcttgctcgcgaacgacgacttgagcttcgtcgcctccgccgccgcggcctcgtccgccgtcagcgcccgcgacaggctgaaccacttggcctcgatcgacttggccaggtcgttgcgaggcacgtagggcgccgccaccgggatgatcacgcgccccaccggctcgtcccgccccgccgccacgcgctcctccaccgtcaccaccagcggctcgtcgaacggctccgcggccacgaacaggaactcctcgttccacatcgggttggccgacccctgcgaccgcgtccgccgcgtctgcccgcccagctgtatcttgacgatggacggtgccagcgggcggcccttctcggcggggatgaggtcttgcgccgcgatggccaccaccttgaggtagatgagcttgggggagtagtacaccttggagcgcgtgctggcgaggctgtcaagggagacggagtgggcgtccgagtgccaggcctccgggaacgcctcgtcggcctgcgtgccgttccagacggcgagcatgatctcgccgtggcgaatcttctcgccggagcggtcggcgaggcggtaccactgcggggcgagggggctgtcgggcgggacgcggttggggatgtcggtcatgtcgaagacaacgcggccgacgaagtcgtccttgaggacgtccttgtccttgacgaccacctcaagctggctggactgcaggtgatcgcgggagaaggcgaagacctggcgccacaccgggttggggttcttctcgaggtggcgggtgacgcccttgaagttgccgagcctgacctcgacgtaggggtcgagcgcgccggtgatgtccatgttggggaggtcgcgcgccttgaccacgctcacgtacaggtacgacatgggctccaccatgtcgtaggtggaggcgatcttggccgcggcggccaccgcggcgcgtgggcccatcttggccggcagcggcggcttggtctccaccaggccgaacgccgaggggggggcccgggggcggggccgggagggcgcggcatgatcacggtctggcctggcggcggtggcggcgcggccaccgcgtggagcgtggcacgcctgggttgagaggcggcgggggcgggggcttggacggggacggagcggaacacacgaggaggctcgtggtcgtgggtggtcttgcccttggactccgactccgggggcggtggctgcgcctgcgcctgcgcctctccatggggaaaggcgggaggaggcctgctgtcgggttgctcggcggagacggactggggaggctggtgctggtggtggtggacagcgggagcaggaggaggatcaggggagtcgttggcgatgaggtagagtcggagggcgatgtcgccggagacgcgggagaagaggccgcgcttctcgagcgggtagcgctggaggagggcgtcctgcggggagggggcgagggaggcagcggagatgcggacgcggccgaggaaggtgtggaggcgggtggcgtggtggtcggtgaggctgcgatcgtggtggacggagacgtcgacggggagggaggggaggcgggaggggtcgcggacgtcgaacacgagggtgtggttccattgcggggaacgatcggcgggcttggtcggggtgcgctgcttctgcccgtcgaactccacctctacgaacgcgttgcaggcgccggcgccgtccttgggcgcaagctccgacgcgtccaatatctccacgcccaccttcatgctgcctctctgcttgctctctactctagtgctattccctcatctgcttctgctggaatgttgtggtctaatagcaggaggaattggagagggatgggcggcgtgggagagcatatcaacagggcagagcggcaccttccaacactctgtttggcggtggacatgatctccatccatccccaataatactccaaaacataatcaaggaggaagctaagggcctctatctaattgattgctagccattactgtacttgtactccttttcttatttatttatgggagtacctatacatctttcgaaagatttttataatcgtatcacacagatttttaatctttgtattaaaatccgatagatataataaaaagcaaaaagcaattaagaaacaccataataaacattaaattaccatatcctcaagaaaaagaccaaatccaatacaaaatttaaaatttacatgtgaagatttaaaaattacagtgtaacttacaaaagttacagtgtaagtttcataaattacactgtaacttacaagaaaatgcactgtaaatttgagtgagaaaatcgagtgagagataagaaaaaatctttcgagtgagatatagcaaaatcgtttatttattactactatacgctaataacaacaggccaccccgcccaggggaaaacgatggagtgacgccacacacacaccggtaacaaactctacttctacttttcatcttttcgtcggcagaatcgatcgggtcgggggggttttttcgaaccaaagaggccccttttccacagcgcacgctccctcccttggttctagaccatggagtaatggtcatggaatagtaaaaggtttactagtcctccttttcttccattccattcccttcccttccgttccaccaaacgcatgcatgattggatcaaattttatctctttcttctctatacatatgtatacttcaagataagatagatagatcacgcatggaaggcatgatcagacgatgtcatgttttcatttgcatcaatctcccaaacttgcttattttcattcattcctactgatacttttgcgagcacgggtagctttggaaagcagcacgacacgataagaaagagtatactagaacattcagagaatcaacctgctgctactacgactccagtagtattactaaaaaaaaggcacgcatgcatgccgagttgcctaactgcagcacaccgcgcagcgcaatccagcaaacccaaaaggttaacgttctaatagcagaccggcttcccgcccccccccccccccccctctctctctctctctccccctcaagtcttaactaaccgactagtacaacacaattccaaatcagataaacaaacgacttcgctctttcacttctccaaacctcacgattgcccagcaaattaacatccgcttatcaaactagttaggtactaatacatcgtatgttagctgtaggagaactatatatgaattataatttttttcttaggtactatacgattttttttcatgtgtttatatatttttgcaccttgataaattatctgaaggttataaatggtatatatgaattataatttttttacttattatatgattatgatttgctttcacgtgtttatatattttgtatcttgataaattatctacaagttataaatggttgtgttgtatggtgcgtttttagggagaacatatgcaatttgcatacttgataaatcatcaaaggctaaaaacaattaagatgacatgacttcttgagagaagagataattatcactaacttcacttggcaaggatgaactttatagatatatagcattatggagtatattttatcttgatcaattatctgaatgatatggtttgcatggtgtggtacatttttcaccattgatgaatcatccaaaactagaaacaattgagatgatgtctttacgagagaaaagataattaacattaactatacttattaggaaataacttatagatacataatattccaattacgtggaggtacctgcggacgatgcctccttccagcggcgcagtcacgacggtcgacagctaccaacacctccatacccgttgactagcagacgcacagaagttagagcacctcaaaaagcctctctacttaaatggctacttgagtgtgtgtgcgtgtgtgagagagagagagagagagagagaggagaatggacgagtggcgatagcggtatcgaggtgggagaagggagacgaggcggcgtgaaggagcggcggcgccagcgagatgggagacgaggcggtaaagaggccggtgcggtagggctccgtcgtcacctcacgcacgtacaaatccattgtcgccttcgctgttcgtcgccatcgttacctcacatggctcgaggaaaagggggagaaaagaggaggaagaataaggggtatttgaggctgacacacgggtcccactgtcatagacttataatagagagtgtagatggaaagtatgttggagtaagtaacgagtctgacttgacaaatcagatggagagttagctatattggagagttttttttatagtatgttgaagatgctcttagatgaccctaacaaattaccttggcgagcatgacacatgggttccatggagaggaagagaaaagaggagagggaagatgatatataggtctcactgttttttcagtttttttttctctggcttacatgtgtgtcacgtctatttctatcttttttaaaatatgtatattatgaaaaactgagtcaaagagccatgtaagcaccatatagcacgaaatcaccatagaaaaccacccacgaggttaaggaatgttaataaaactcggatcacagttgggggatatggaatagacttctttccttctagagaagtactgtgtggcgaagtatgtggtgagaattccataaatggcctaacccagtgaaagtccaatccggcccaacgtgaatcatcttaggctttaatatgtgggcatgcctgcctgccagcatgctttggattgctgagcatggccttctctaaactggccgtaaggcctgcataaatctgagagacagctttcagagacaaacatacatactaagtagtagtaaataagtctatattgcctccctcctctctttcaagccctcaaccgtaaaatttggttataacgtccatctttgaagctcggtgcaaaacgaatcattctatggttggtttttgctgacgtgaaaggttgaccatggttaactcgttgagtcagcagggggacccacatgttggagactcacatgcaaatctcttgggaaaaaaattagtagggtcaacatgtcattctctctacttccctccccttactctcttcccgtttttcttctccatctatcttaccgacgagagacagagagagggccagacgactacgagcagtggtagagcaaggcaacaacaattcgtggttgacgaggaggagaggagaggcaagggagaggggtggggaggatgaaggcgagggcaataaggggatgttctgtcaccacatgcaccttggtgtcgtgtgtggcagcgacgacgtctggcgcaactcctggccacgtgaaccctggaggccagggttaccgtgagcggcgggcgagggatcgcgctgatgcttcagcccgtgggtgacgttgtggtcctcctctagccaatgcggcgatgttttgcggttgtggcagcagcttgaccacaaggctactgaggagcggtgcacggggccacgacaccgacacaacggagtaagggtagtgtgggcaaggggaggaggagctcatgttgtcgaagtcagagttgaatgtgtctctgccacgcagccacattgatgtgttgtgtagtgcgcatgtgactagttgtcgggataacttggtccgagtcgctcgaacaaggcatggaggtgcgtgatgaatatttggattccatcgctgtgatgtccaccgccgcccacgtaggtctcacttgctaacttagtgagacaaccatatttattcaacctgccacgttagcataaaccacttcccaacccacggaagaagtatttgtaccgttttttgaagacggggagacactataccccggttttacaattgagggagatgattcaatgcaagaaacaagggagacggaatagacttattccaatatacgagtgatttggttccttaggttgtgtttagaggagaggttaggaacatttctctcgtgcacggaaatcagggttacttatttgcacatgattaattaaatattagctaaaaaaactgagaaatggattaatacgattttttttacaaaagaactttcttatagaaaattctggcaaaacaaacaccatttagtagttcggaaagtatgcgtgtggaaaatgagagagtggaggttaggaatctacgcttgcgaacatagccttagctactattccaaatggagtaactgcacttgtgtataaatccactcattttgcttacatcctttagtcataaatatttgacattttgaataaaattatatcaaaattttaaaattccaaccataaataacttctcaaatgctaagtttctttttttaaaaaagctaaatgtaaagttaacttgaaaagtactactgtaatattatacagtactagaagtattactcgctccatcttaaaacataataaaatatcagattggacatgtcgtactactacgaatcattggaaagacattattgtccgtataaagtttatgtacttaagaaaatgtgctgcgataaatccatctagggaatgcgatccccactttagatgatggcctaaactcaggtcaaacccaataagcagctcatgtgcaagtagtactgctatgcaactagtagtagtactgaaaatgagggcaaattggtaggtttggagcgcaaaagcgaaattcaaaatttgacctcatatcgtcatccaatcacacattttgaggaatatagaattttcttcttcttttgcttatctttaggaggatatagatttatttttaaaaaatagtaaagtgagagaggagtgagctgtgagcgaatcagggaggaattgtccccaagtccaagtgaagagaagaggtgtgagagaagagaagagaagcggcgcgggggagctctgctctgctcactactagtgtttctctactcgccgacggggcgccgggcgccgccaccccacccccccgagctcgccgtcagccgcaaccgccggggctggggctccctcctccactctaagcttgctgcaagggaagggttccgccggccggctgcatccatcccatcccctcccggccaattggggaactggaatcccgatttcatccaggtgagtgagtatcccactgcatctgcatctgcatccgcatctctccgtcgccgcctgctcatctgctcatctggatctgcagctaaattacctgccaccgcagatggccgccgcccacaagctagggttcagggaggaggacgccctcaggttcctcttcggcgaggatctcctcgccatgcaccactccgccgcagcctcctccttcgacaggtcgcaacccgaggtccaggtcttcagggacgtcttctctccgtctccacctcttcttcatgtggccgagacttcatccctgctccccactgctgctgctgctgcgcctgcgcctccgcctccgcctgcgcctgcgccttcactccaccaccacctgcacgcgctgcagcctcaacccgcgcccgtggaggtcgacgccgccgccatcgatcccaaacattctcacggccccgtgctacatgggaatgggaatgggaatgggaatggaggcctcgagttggacgccgcattgcagggcttcgttgcttactggcaaggcggaggcagctctctaagtgtaaccgacgctgacctcttccatgacatgatgcaaccaacgccgccgcaacactccgctggacctcctcctcctccccctcctgctgctgctggaatgtgcaccgccttggctgccagcagcagcaacagtggagtcgaagatcctttgccttcctatatggaggcactagcagacttctctgatttccacaatgacgctcttctttccgatccc

SEQ ID NO: 80513 - DNA, 7588 bp, Oryza sativa
cccgccgccactcgcctctctatcgccgctcgcgcccgccccctgcgccgccttgccttgccgccgccccgcctcctccgacgccgcgctcgtctcgcctcatccgctgtcgcgctctcctcgaagccactgccgtcgcctcgcctcacctcctcctccgccgcgctcgcctcacctcactgctgcctctgccgtcgcccgtgatagagaagagagagagagagtgagagattgggaaagagatagaagagagagagagactggcaggtagggtctgcctacttttttataaaagaattgttgactggactgccacgtagaccaaaaccaccgtgaattgggtcaaggggggtaattcatccggtttgcatagttgggggtgagggatgtccggttttcaaatttagggggataattcggtcgaccgcgatagttaggagagggtaattcgtacttttcttttatatgtagtagtaatacatttaccaacaaacatggtttgtgggaaaaaaaaataccgcgacatgatcgacgtctatcacgcattgttggtccggatataatgatgctagttcctatgctgaggtgctcaacgaggggttaaatgccctctctttcagaaagaaaatgctacacataccatgttttcttaccacttttgctacgcatacccgtgaatttcatatatttatactataattttgcttgcttaaggttttggcacatttcatgtaatgggtatgtatgtcttgggatataggtgcccgatccccttatggaataactggaaacgtaagctgtaaatctgacgtggggtgcagaagattttgattcctttttggtcttagatcatattttttcaatgcttgccgtataggaaccatgaaaaaataattacctattcgattaaaaaatattagtttaaataacatataagtaaaaaggaaaaataattttaaaaatattataaaatggatcaatatttcatatctctggttgaccaagtacccttgcgtaatgcctaagaagcaaaagaaaatcatcgtcctggatatcccgaggatatttcctgttcgctcggccgcgactccgactccttgtgtggtgtggacctgtggatccctcggagatgttgctaaaaccatttggtgtaattgtaaaatatcaaccatccctttatttctaccggctgatattaatttctcctaattaactctcttaagcagtgttgatttggtgagaaaatatttttattttcaccaatgagataagcatcacatatgtgtatatccctataagatcggtttattcttatcgggtatgtggtatccatatccctgacaagcattacatatgtgtatatccccataagatcggtttatcctcattatgtattttgaatatatttttttttgtctcggacaacgctacttgaaatcgatttaataaaaacaagaagaattggatatgtgttctagattacattgtgcttgcatgttattttgggaaatgagtatgttattttcttttacgttagttggagtgcaatcgctactatggaaggaaacatctttaaaaaatagtttcccttctaatcaaattaattaagtgtgaccgaggtgtcttaattgatctcatatatagaaatagaagaatggctatgagtttgccaaatcctcctatagattgttaaatgggttgtttattttcgtgcacgcccgagcacgcgtgtatagttcatgccccagtaacaacacgacccatttagttgtgggtcgtgctggtacgactagtctaatcatggtgtgcttgggctgctaccaggctagcgtaccaacacgacaattgcatatagcaaaccagcacacacatggtctaggaatggtaggacgcaacctggcccttgtgacatgatggcgactgacgactggtgaacaattgctagttgagcaactgtcgtccgaacaagagctataaagaaaggaaaacgaaagaattgagaaagctagggcttgtgttagaggaaacaatggtgtgagcttgccgacgtaggtctacacgacaacgtggtaacgcggtctacccttttcgtgagcacaaccactaagcgtgtcagccattgagagctcactagttcggggtgaaggaaatagcaagtgaagggagcttgacgaggaggaagatgaatgtgctattgtgagcggaggatcttaccatagttttgttgaagtttatgcgataggatgcaagaaactctttcatagttttttccttggtatattatcaattttgtgctaacgggttttcacacagcccacgtacccaaatgatatctcacaaggttgtgcctggcctccagcttcaacacgtgggtcaatacagtatgaccgttcgctgaatcgtgctactgattaatagggcattgcccaaacatatctatttatccaccatttcaaccctataaaataataaaaataaaattcaccgtcttaaaaattcagctcagaagttccgtttgaaaaatgggattatttccattttttaaatttcaccgtttggtagtgtggggatgggatgtgcaatccgggtggcggaattactaaattaccttcgccattttgacgtgtagttggcctctgtcgtcagtttgcccgccgccgccgccgcctccgcctccgctgaccgcgagcgagcagggcgccgtcgttcgtcctgttgcttccgcggttccgccgcatcctggtgagtacatcctccgccaccgccgtctgcgccgatccccatccatcgcgcgagcgagcgagcagggtcgccgtcgttcgtcctgctgcttccgccgcatccgttatgcacatcctctttcccatctccctctacccacgcactttttttctcgaatttgcgttaaccctagcttctgttctagaaatttgctttaaccttaatactcataacagtttgtttgttccccaaaagtttgggggtttaactgaaccacgatgtcccatgttagatccgccactgcatgcagacaccttccctgatgtttctctgagaaactaccccccccccctccctcccttccctctgttctccagagctacatagtgttatctgaatagaagtattgttctagagagaagaaggttttattgaaaatttgatcatctataattcatattgttctagaattcatctgtgatttgtcaagttttaagtgacgtgtaggtggatatagtttcatcaacatgtacaattttttttttggacgttctgcatgtatctaacgatcatataactaccaaattgaatctatagtcacacttctgttttgtgttattagtggttacctatatcctttcctattgcatgcagcccaagcttgttggcaccatggatgaatcacgaaaaagagccgcatctactgcaaatgctaaaagttcatcccttggtatgatacaatagagcatcatatgccttgttgcttttatgttgcaccttaatcaaatttatctgattcatgtaagatgaatactcctggtatgtaactgtttttgaatcaagttcattgtacttacatatgactgcctgcaggaaattacatatgttgctcatgaaatgcatattttttttaattttgtgcagtagggtaggaaatatttcttccttttccatcgtaacaacttgaaatggtgaatgctttttaatgtccgcaggtgaagattttggcaatgattttctttcatcttggaaattaccaaaatcaggaaatgacacgattgactttgacgttgagtcagttccgaagaatagcaagaaattcagctttgacaacctgtgagtattaggcttgaaagtttcctttagcatatgatgccgcagtaattgggaatgacagtatgtttcttttatcagggatgattttgggcttgatggagcctttgacaaattgtcgtcatttaaaatgggcatgtctgatctagatttctctggtcctctcaagaaaaaggtgaagcccaacaactcaaatggcaacgatctttctgaagggataaaagggactgaaaaggacaacttctccttttcctttgatttcaatgagtaagtttttcagtgaataattttagtgagtaagttatattggtgaagaccaataaatatgacacaaaatcatgaatttagttgcttcattttctttgttttgtttacttgaaggctgggcaagttcaatcttgatgctaacttgggaattgaggagaatggtatgagtaaatttgtagaaaaggtcaaccctgtctcttcagagggtgacaaggatccaagaaaaggtctttcagttaagggctctgatgttctgggaggtaacattagtaaggaacaaaagcaaacacatgatgcttgtactctgaggcctactcatttgggaaggtagggtaatgtaaagaacgataactgtgcagcttcaaacattattcctctaactcatttgacggtatgcatgattttttcagctttagccctgcaagaatggaccaaaataaagtagatttgctctcaactgatacacatgaagagaaatctaatgagacacacccatcaagagcagctgttaacaagccttctcagaatcttccttgcagttctacacctggtgaagatcctacacacgtgactacaacagcagttgctgagaactgtagagaagctcctttggtggaacttagtaaagttcatatatcaagggggaataatgatagtgggcaatcagttagttcacaattcatgaacaccagcaccacgtgcccctccatctcaagaaaattgacggcccaatcagattcccaaaatgaccagaatgagattgtgggggaaagtgcatgtcttaatgcacaaagtcctgataaccaaaggtttagaggaacttcaatgaagcttctgaagaaaacatcatgtgaaacaaagaaggctgaaaaggggacttcaggtccaaagagtctctcttcatcaatgcagaggtttgtctttgctataagtttctttattaacaacataagacctttattcttccattcagtgcttacccagtgattattttcattaacagataatgtatcttaaatcagatatcagtaatgtaggattaagtgtagcatatcataattctgcttgtacaagggagttcttttcctttatgtgagccgagatgtaattttgtacagtgatttgttaccatgtgacactattatgataaatatcatgcagggatatgagaaatgtcaaacccgcatcattgaatgaagcagggagtttgtctcttccgccccagtcttcaattgttaaagcaagcaggcctcctcaactaacttctgaaacaaccttaaatcaattaagtagtgccaataacatggtaaaaaagatgaatacacattctactgagttgaaaaggtagtagactgtagacagattgatggctagcatgtactcataaaatgttaatactgtatcaaataatgaatgtgctttataaaatgcagggaaagcacacaagctaatgcaagatctgaaaggcctaaaattgcttcgtcaaaaacattctgcaagccagcattacatgagctgttgaccacctccatgaatgccaaagatcataagaattccaaacttaggtaagaaactgctgcccttcaaccttgcaacatcaggaatgtgtcggttcaaaaactttattataatggtgtttacttaatgtatgcacaatactgctatgttttcttcataattctgatctaacattttaacatggacatgatagttccttgataatttttgtgtcccgtctagtataaacttgagtaaaatcaattcacaagaaacccactataaaggtttggtgtgtttgttagcgtatttcatggaaactgtaaatacctcacatacttttagtatgttttcatggtggatgtgtttgcacttggaataggtgtattgaatagaatgcatgcgcactgcatccattctacttgttttcttgtttccagtacagcagaatgctctatatttaccgtattttatccccttgatccttccactgcattgatggttaacaagcttccttttcccagacttgagtctcctagcacaggcaatgtttctacactgaatgctcctagcagcccagcacatagcaatggacataagaccgttgcgagtcggtcactcttgggaagtaccaatgtttttgatgcaggaaaaggcactcctaaagctgacaatagaccactttctcaactgaaagcagcaaagtatagtatctctaccatattgcataaattaggaatttgaactattaactgtgtttttctaaacatattgcataagaagtgactgaaatcatctatatgaatgtagaattactaaagcaggcaccataagttcaaagtctgacttgcttctggagaaggatatgatggaaacgagcgggaggaagggttcccctgtaacaacatccaataacccaaagtcctatggtgaaggaaaatatgtgttgcctagcccatccatgatgcaaaagactcctaaggttattcactggtgcaacattatgttttaaaaaatcatttcctttttctcctattgcttgtatccctgtgtggtttaaccctcattgtcttcatctgaggattacaactaatactttttcttaagcttacattttccagactcaaaaatttgatttgtcaattcatatcaagtttgttgtttgtaactttgtatgtgcttatttcatatcaaagtttgtgaggaatgttatgcccttccacggcataaaaattcaccctggatataccaagtgttaaaaagtacatgcagaagacgatatccactcatggtaagagtggtagaccatatgtaatagctcaaattcctaatttatgaaattccatgtcatactgaagaaatccatcatgcccttatagaaaatttctatgacatctactgacttctgtcatcaactaatctatcaaattaacagacgtgttaaaattgtccaatcctaaaagcatgaagcattaatccacagatgtaacatttaagttgtactgttttgagtcagtgattatattacgggtggtagttttttacttgttcatctttaagcacagtttcacagggttttaatggactgatttgataaatgaaatatcctgcaaaagtcagtttttaagcaaggtttttatctgcagcaaatttactaagctattgataaaagaatacaattttttatgtacatttttttaggagaattcgctattgttagttttttgtagtttgttcatattgttaatttgccttctcaggaatcagcttcagatccaaaagctcctgctatgctgaagcacatcatgaaatctccagctgtgaggttgttgtttcgattgcattttaatgcataaaaatgtatcttgaatattctagttctctcttttggaagtaatagatttattttaccatgcagaacatcaccagaaactgtttcagagttgggaaataaaacagtaagtgccatgaatatatctgattactgcat

SEQ ID NO: 80514 - DNA, 19362 bp, Oryza sativa
ccccccccccctaagagcaggtacaatagcaggctataagctagctataaatatattttaaagagataaaataggagagagaagagcaacgggctacagatctataaccagctgcagcacggactttaaaacgtaatgtgtgtatgataggtgggaccaggaattaatagtataataagcactattgtatgaattgactattaaattggctatagatgaattggagcttgtagttggctatcctattaaacttgctctaaacaccccctaagcacaatgaatatgcagtcagcaaaatgggaagtacgaggagaaagctaccagttcattaaaaacgcgaacattatgctgtaggatttttagtattatacaactaacattataaaactaaccatggtgagccacaatttcatttggaagatttgaaacatacaaacagctttatgaaattaaatcaaatagtagtagtactttttcaacactattcgccttatccttacaggtttaaattaacctatacaaaagagaaccgcgtattcagattaagcaagacgagatgggagatatctcccagtccaattatgttaacaacagtcacaagtaattataatccctcccctagcaagctaggattgagattctcagcagtcactgtaccgtgcatttgtcactgacatatgggcctgatgatctatgggcccacatgtcactgataaaggcgcggtgcagtcgactgcagaggatcctgatccagcagtgtcgatcctgatccagcaagctgacactgcctggttttgctcccggcgccgtattgatcaaaagtcagatgataattacaggcaataaccactaccttttgacaattgcaaagctacatgaggcatgtacagattctgcacaagatcagcaggtcaaatgaaatgcctctcctgctgtaagcctgtaaagtacacatatgtagtattatttcaaaaacgtgctatacatttagtccctttaaatctatctcttttctttgtcagaaatctctttaaacatcgattgaacatgtgcaatcaacatgctaaaactttgctacaaaatagtttcttacttcttagcttaaagccattggttctgaacatgataccaaacattcagaattgcctaaacaacaaaggttacagagttattgcacaaggaatatgcagacagcaacaccgggaattatgaggaaggtaccagttcatcgaaaacgtggaaattatgctataaaattcttgagaatttactacatgttgggcgccgtgtgctaaaccacccaagtacagtcagtcgatcaggttaacacaaagagagcagaatagcagacaaagatagcatcaggtaatatatattcttgatgcatagtacattaatcttcgacctcatcttaaaagacagagatacataacataagcagattctagcagtgagagatctacaagacaaattcaggaccatacttgcaaggcaccagacaaatgcgccttcgaggatcactgatcttgatcatgatcattcctaagttgtgggaaggtgggaggccagagcatcatgaatggaaatatgtcaaaatatctataagcctctggtgacatctcaaacactttgtttaccgtcctgttcatgatatgtatgtggaagatcacacggtctacccgcaagaacacctcagcattgtcctccaccctatggagcgcaaccagagcatcccctgattcccaattgggctctgcaaactgaccaaacgattcgcccaagcagatgttatcaaccagctcccagttgccaccaccgatgtcggaatcggaggcgcggaaccaaacatgaatctgaaaccccttcagatggatgagatataagccggaatcgcctgcgcgtagcagctcaatgtttcccatccggtgtagctgctgcacaccatctggcaatctgaacaagaatagcctcatggatgccaaattcaacccaagaacatgccccttccctcccaacagatagagattgccattgacaagcacatcacgccttatgctcctttcccagctttcctgaatctctatagttgccgattcacggacactgttcagatccgaaatttcagcccttacagaaactgccttggccaacatctcctgatctttgcgtagaaattccacgaaagtgtaggacggatcgtcgctgccgacatctgggaagaggagcatacacgaggcatgcagaatctgccccggctggcgagggagttcgtagaccagcgggagagccggtgggtggcgggcggggtgcatcgggctgatgatgctgacccgtggcccatcgggagggaactccgcggcgaggacgcggccgttgcggcagctcaggatgacgggcgcgtcggggccggagccggaggagccgggcgccaggcggaggcgggcgccgcggagcgcggcggcgagctccggcggctggggcagcggcacgaacgccgggacctcgtcctggaagcgcgccctggccgtgtggtagaagccgaggaggcgcggcgggtggcgcgcgcggaagcggcggaggaaggccgggtcggaggcgaggcggagccagcgggtggagacgagggcggcgcggacgagggtggtggggaggccgaggcggagcaggatctcgcggaggaggtcgtcgttggcgagcaccgacgagatcgccgcggccgcggctggctccggtggctgcgtccccttgtcttccatggcgttcccgcgaagcgcagctgagagggagaaggggaagcggtcgtctggtccagcttgtgacgagtcaatttccacgcggatttttgacttttggctgactttattactccttgatggaagtattaactaattataaattttgaaaaaatggatttatttgatattttttagaaaaaagcttttccatttttaaaaaaaactgcttagcagtttagaaaacatgtccttttttcctaattaaaatagtctcggattgtaggtcggagttgataacaagaaacctatatatcgaattgtaggtcggagttgaagtttagaactcggccttttttttcatgccaagtggttttagttgtgttctaaacattttgatatgcaaaccatctgtttaaaaatcaaaatgttttaggggctatcctcatttaaatgttgaaatagtcatatcacccatcttatgttgtttggagaatgagatgggttttgcacctactgttgtgtactctctctgttttatattattacaaatcacatgacatttttcctaattaacgaagtctctctttggtccatatattagatgaatacccttgatacaaccgaattttcgctgggttgtttgtaagtaagctaggtaaactatattaaatatttgattgagtttataaaaaaacatttagcaacatctactacaacaaattattttattaaattcaatatttatatattttaataattgcataggtaactaatcaatgtttagtcattgcagtgcttgtcacggtctcacagaccaaagtacatgcgcatttgatatgctagcttcgagggtgtgtttagtttcacgttaaaattgaaagtttgactaaaattgaaagtttaaagaaaaaagttgaaagtttatttgtagaaaagtcttgatgcgatgaaaaaattaaaaatttgaagaaaaagttacgccgcaagagtctatcgatgggctgtcacttgacccactcgaattctcatcaccaaactgcacaagagctcacagtgagccagcccccacattcattcaaatcgctcggcaccgacaccgacaccttacagtgaaaacgtaacaaacaccgctagaagcctagaacgatgcgatgtatgtaaccgcaaaattcgccgcggtgaaaccgaaattccaaattctgaatgcaaatcaaatcgctccatcccatttcgaatctactacaacaaatcaatataatcccaagtacgtacgtgcgtgcacatgccaacgcaacaggtatatatatatatgcgcatgcagcatatggttgagctagctacagcgagaggccggagaggaaggagacgccggtggccggcagccacgacgcgccggagatgaagcgcgccaccgtgaaccgctccgcctcggcgctgtcgttgatgacgcggtggcccggccacgccacgcgcccggcgaccccggccccggggccgtagttcatgtactccccgtagtagagcgtgtcgagcgcgaacgtcgcgttccacgccagccacccctccggcggcacgtgcccgccgatgtacgacatcatcaccaccaccctcgagtacagcttccacggcctccccaggtacgtcggcgccaatggcgccgccacggccggcgccgtcgacggcggcggcggcgaggggacgacgcggcaggcgtggatgacgaggccggtggattggccgggatcgcggcggttctgggcggtgacggtgttcttctggccggggagaggggagcgggaccagaggttgcagcgctggaggacggcggcggcgttgccgaagacgaagtcgacggtgccgtagacgtcgcagtcgcggtagaagtggcggttggagtgggcgtagagggtgtcctggtagccgatgatgctgcaccggtagacggcggcgcggtcggcgctcacgcgcagcgccaccgcctggtgcctctccggccccgcccagttctccaccgtcatgtccctcatcatgaacccgctccccgacgccgctgccacaaatttcacacaaattaattaagctgctttcttatactagtacgagattactaatttgcaacaaattcttgtcaaatttcagcagtgctcgcgacgtgccatgtcgcgccataccgctgcctgcctgcaggctatccgatttctggttcagttaagtgattaagtcccccacccactacactacgccatgttaccgcaatgacgcaaacacagcaagaatgcaggtcgagtagtccatttctaccgtttcttttcaggaaatttaccagcttttatacccagtcatctacagcagctattagtacgtgcctaatactacgagctaatcctactcgaagtggtcttcattgcggaacagtagaagcgttaggagattgcagaagtaacagcaggaataacgatcgatcaattgcccagcaaaaaaatatataaaagaaagaatccaccaatttaatagaactaatgaccgcaaaataaattggatggttccatcatcagacattcacaacaggctggagtagatcattattgtgattagtgaagtttcttctgttgttggcatagtgttgtagtatttaacttcggtagcaatgaattaattgtgttttcctgtaagctcattgcaacccgtcactgctcatatcactaaaataattgcaatttaataacttgcctctagctagtttttactactaccttcttgcgttgagcgcaaaagtaaaattagtttatttagacaaactaggaaatcgtccctatttgtaacacttaatttcttgtgcaaaatcagcataggtctatctatggtgaagacaggggatgcaatgtcagttgaaaagtaaaaagtgaaaaaaatatacttttataaaatataattgtttttaattattactccctccattctaaaatataaggcacaaccactcttaatccaaagaccaagaaatagttattatcatcttgtagtttgaatcatcctaataaatataatgcatgcatctaataggattagataagatgagagtacagaatttaaaaagtaataatttaatggagaagatgtcatagttaattgtatgcttgcatatatgccttatattatcgaacatataagaaaagtggttgtgccttatggaatggagggagcaacagcgttcttttctaaacttatgtgatatgaaaacagtacaaaagaaaaatgcactaatggtagcaatgaaaagtttagtttcagagaacgtgatagatcaaaattgtttcttcttgacaccataacattatcttttttaaaaaaaaaatgttcgatgaaatgacaatggagtgagtaaatcgtggcgacaaatgacataccgaaggtggcggtgtggaacgtggtgaagttgtcggcgacgctgcggccggcggacacgacagtgacgcccttgccgtcgccgacgaacaccaggttcgtcttcttcctccccaccttcacgttctcgtcgtaccgcccggccttcacgtgtatcaccgtccgccgcccgctgcgctccggcgccgccttcaccgcgtccgagatcgtccggtgcgtccccgtcccgtccttcgccaccaccatgtccgcgctctccaccaatggcgccgcggggaccagcagcagcctccggtccctcgccgacagccacctcgggaagaggcttcttcttcttcttctccctctcttcctctgcttcttgctcttcccgccgccgttccggacggggacgccggcgaggccgtccttgttgctggttgccatggccgccgacgcggcctccgcgtacattgtgaggcagtcgcggaccatggcgcgggcggcggcaaggtggggcgcggcgtccgcgccgtgggggatgccggcctcattgaggctgtcggcgcaggtgtcgtggttggtgagcgcggcggagagccacgtgaccgcgtcgtcgtgggcggcactgggctcaccggcgccggcaaggaggtcgagggagtcctcgagcagctccgcgcagtcgtcgcgcgcggcggcggcgaggggcgaggaggaggaggagcccgccgagaacggcgttgtcatcacagcggaggccggcgcgacggcggcgcccgacagggcctcgagcgccttccccacgtgcaccgccgtcgcgttgagcgcaatgcggagccggtggtggcgcgccgccacagcctccgcctccagcgccgaggccgggaaggcgtgcgcgccggagagcggcagcaagaagcaggggaggaagacgaggaggaggatgaggcggcgagcgacggcgtggcccatggcgagccgagctagctagctatggaagctggaagaagtcgacgaggtgctggactaccagcgatggcggcgcggccatttatagggcgattgggggtggcgagaatgatgggacgcgcgcgggcggcgagctgggaagcttttgcgtctcgcggaaagcgcggcatgtaccgatggtttgcctgccatcgccggagaacgatgggctcgctcagctccggcggcggccgcgtccgcttggtttgttcgccgatccatgggcgcggcacgagacgagagccgcgtgggctgggctaccacagcagcacacatgcagatgcactgctcgtttggcccccaccccacctggctggcgcgcccaccgcgcggcattgcgcttgcgcgtgtgcgcgcgctagctagcgcgcagtgcgtcagtgagacgctgcgtggtctcgcgacgggtacaaatcctgctctgtgtgcacgtacaaaccacggctcacagatcactgatatgtgtcacttgctcttgggcgcatattttcggtctatattactactcatggagtagtagtagagtagtgcacctctcaactaccgtctcacacgaagcttacgaaatgagataaaactaaaaagatgatgtggctagtgaactaacgttattaggtgcatgagtaacatggaaatcaagagattatatcataagtaatgttatttgaccaacaacatctataaaactaagatgtttaaataaaaatagttgcatattattgtagtttgtttaatgataaatatagtaacatcaattttatatgattgaccttttaatattttttttctattaatagtcatagttaaaaaaatgacttgacaatattttaaaaatgcttacattctgtgacggagtgagtactatggatatataaactacttactatattacggtagtttttattcaccgtgtattatctatggtagttttatttaccatgtattatcttagaaacaacactgaattttagtttggatctaattttcttatgaaagttaaggctcctttcgaataaaagaattttggaggattacatttctatcgaaataaattcctatatgatgctttagaatgaaggtattgaattccttctaaattccttataattgtctcaaatcataggtttttttttgcaaaattggttatatatcatcaaaagttcactttttttttctttttatagcatcgaaagatactaaatagcacctaaagctcaccacgttcccatttttaacactttcgttaattttcaatcgtttttcgtccgccttgattactattgactcagccacacacacaatatgatgtttctacccctgattgtcatgcattctacttgtgagaggtagttaggaattcatattcctctcttcttaagaaaaaaaaagtgcgctcacaactcgtatacattcatccatataatatatacacgaacatcttacctttatatgaacaccttgcaaagatcggacatattctttttatctttacacgccttattaacgtacactaaaaatgtgaataagtgaaccctgcatagccatacatgtttataaaagaaaacaaaatagaaaggcacgaggagaacagtgggacagccaaacgtgacggtgatttcacttgaaaaagaaaaataaaatactgtgtgccgatttagacaatgcaaatgcattattccaggctatatatatagctagttagctctgtcgtcgatgcttcttctttttttgtcatttacaattttgctgcacatttggatgtgattttcgtattgtattgtacacgtatatatgggctcacgaagagatagctaaagggaatcgtgtgacattggcacaatggcacatgtgacgagcgcagatggagctctcgcctcgtggaaagaaacaaaaaaagtcgcggcaccgatgggcgatcgatcggtggctgggcgagtcgtctcgtgcgatcgtgtgcggttggtttggttttgctggctgcctcgccacaccggcacaccgcccgtccatcataccacgctctggctgacgcgctgcttgtttgccgtgccgtgtgccggctgcatatcctctcgatcgccctagtacatgccgcacactccattttcagctacctttttttttatgataatggatcttattaggactaactgcaaaacacgtgaccatggaataataacgtgggttcaataaatggaaagctagcaagcttgaaaaacaaaggaaatatatatattttgtagtactaagaaatttgatctacagtaatattgttttatttcatactccctccatcctataatataagagattttaggtggatgtgatccacctaaaatctcttatattttgggacgagtatctcctatcattcaattcatcttgtgacaacttttttctctttacctttctctatattgttgccgccacattaaattgcttctcttgatctcaagcgtattttccgatcataaaagaccgagagatgatcttgatgttattactttgaagttgcacaaaccccaagccccgaattctcgattgggattcacagatccgatttgttttttagaatcgcttggttttcttgaaaccaatggcggaggcatcgtctgggcaggcgaaaactccattaaaattttatattagtgagtaaattggtgatgaaatttctataacaaatactagttatatttatccggttttaaaaaattttctagctccgccattgcttgaaaccaccctgacccaatttgtgaattccaattgattttagttagttttcatacatagttaacaaaaaaaaaggtcaccggttctatggtttgtatcggctttcgcgctgttttggtaaaacctaccatgatcggttttcagttttcacctcgatctcctccgggcaaaccgcgacatttgaaagaactttctcctttacgaaatgcccaaaataaatacaacaagtaaataaaaatggaattcgaaccgttagcgtacgctacacccggccccacgcgtcagtgaaacccaacagtctcctgaaatcaacccgccacaaaggcccaaagcccacgccgagaaccccgccgctcgcattcgcattcgcatctcccccgcttcctctcctccgccgccccaaaaccctagcggcgagcgagcgagcgagccatccatcacccatggcccgcaagcgccgcgcgccgacgcccccgcccccgccgccgccgcctcccgaggccgagtcctccgcggattcaagcggcgaggaggaggaggaggaggaggaggaggaggaggagagggagtctcccgtcgccccaccgccccagaagcccagcggccgcggcgccgcctcgtcggatgaggaggaggaggaggaggaggactccgacactgacacctacgcccaaggtttccagcttcggaaggttggcggcggcgacgaggaaggggaggaggtggaaggcgactcgtcggagtcggagccggagccggagcccgtcaagaaggagtcggcgaagaaggccaaagccgaggccaagaagaagagggccgcgcctgagcccgcgccgtcgggcaaggccaagaaggccaagccggagaagtcgtcgtcggcggcggcgcctgagcccgctccctcctcgggcaagtccaagaaggcagccaaggctgaggctgcgaaagcggctgccgctgagccggctccttctaccggcaaggtgagcaagtacaatttggcgccggagccctcgccgtcaagcaagtctgggaaggccctatcgcgatggacgacggatgacgaggtcaagattcttgaggtcctcgtggcccatttcaagagccacggcactcagcttaaagttgaggggatcatcgctgctgtcggcgatagcctcgagaggaagagcatcaagtattcggacatgtatgagaaggtgcggaggctcaagcagcggtacgaggccactgccaagaaagttgaacacggcggcgacctaccagctaaagaggatgacctgcggatgtatcagctatcgtcggaaatctggggaaagaacgcaaaggatgctggcaattcgtcaaagaacaagaaggggcaagctaagaaagataaggtgagtggagattcaaaggaagccgccaaggaagataaggtggatgaagccgccattgctgtgaatgaaaagggtggtactctggcagagaataagaaggggaaaaccaacaagcagaaaacaggtatggaaacaaaggttggatcatctaaggaggctgctcttgctgctagtccaaccaagggtaagaagaagggaagccacaaagacaaattggatgaagaagcaaagagtggcacggcaaaggtgacctccacaattgccactgatgatgatgatggaactttgggtgggagtaagagggagaaggctggcaaagaggaattggatggggacacacatatcgtcatgccaaaggaggccaccacaactgccgctagcgatgatggtactttggttgggagtaagaaggggaaggctgacaatgggaaattggatggcgacacacacagtgttatgccaaaggaggccaccgctggcacccaaaatggtggcatcctaacaggaggggaaaatcacaaagaaaaagtagataaagatgctaatgtaccaagcatacggagggagtatgctgaattgcagagtttgtatcccaaccttgcttcctttgtgaacggaattgaggcccagcatccatgtggatcaaccttcaagagagcttttgagttcattagtgatgataaggcttgcaccctggaatccaagatcaagaagcagaagatagcggaagtgagaatgcagctccgtctagcagacacgaagaaggaagtagccaatgctttgttaggattgctggactaaaacattgcggtgctgacatcctttttgtgcggtatacattcttcttacttgcgttattatgttcccatttgtatattaaagttctgttatagctaaatgcatttaaagtgtttttgttgcttctaaaatttgagtgtgacttctgaactaattattgaaacaaccctgttcttatgtggtcagtttagtgtgaaacatgtgcaattaaggaaagtgtagccaatgaaagatttagccatatttgacacgtacaaaccatctaaatatttgattggtttgtatatcaagctaacttacactttgtaggtgttgagagggtgagtttgtcatacgtagcaacataagggagtgatttgaatatatcatctgttggattctactattcttgattggttgtaaattaaactgtacctacactttgtaaggattgagaggtaggagtagtgaacaagggaacactatgaataaagcatctcttgcattctactcctgaaatagttagctttaccttattcaaacgcacagttgttgctttgctaggttgtcattgtaatgttttgtacctactatactctactcaccgtgaatagtcattttttggggatggttttcctttgcagaactgagttataatgctttttttttaccacaactgatatatgcaatgtttactggtagtttgtccatatgaatcttgtgctgcaaaaggcagcatagtttattttcaagttctttgtagttttgtttgttaattgtagcttaggttgatataaatagcttaatgtttgaagttatgctttatatttttcaaagtaaattattgtgtgatgtccattgctctagtgaatttagggtttctcttgaagaattttgttggctgctccaactgctcccaataatgccactaaaagaacagttgcatttttacaagccacctgctagtactgacatggtattggatgtgacatttcctagtacaacaaatctgtcaggagcttatccagatttgttgtattagggaatgtctcgtccaatactaggttggttttttgtgggacggagggaactaccttgtcttgtatagatgacctgattttgttgactgacctcatcaactccactaaagaacaacagttgcattctgttcaagctacctgctagtactgacatgggaatttgagtagctaccttgtttgtctagatgaccatcctaattatgtactacctcattttcaaaatgtgtgacgccgttgacttttcatacaacgtttgaccattcgtcttattcaaaaatttaacataaatatgtaaaagtataagttaagattacattttatttgatgataaaacaagttacaataaaataaatgatatttatataacttttttgaataagatgaatggtcaaacgttatgcaaaaagtcaacggtgtcatacattttgaaatggagggagtatatgccaccacacttgtcagtttggtcaagcacagaggattctatgctaagcctgcatttatttcagctgaatttggagccttgatacgtgaatattgatttgtttatgtgagcctgtgaggctcgctcagggatacatgattttttctgagtctctttaaccaagtcacagtagcaactcaggaagttgttcatctagagttaacatacaaatgaaatcaatggtcaatccaaaatccatatatgaatatcatatttaatctttaatttggattttgttgagccttgtggggctgttggcatgaagattataagttggcaccattttagttagttcactgcttaaaggctgagccaatacaaggtagcttagtgtaacagccgtacataacttttctcaatatctcaaatctgctttatttgttttcaaactacaatgatgagcatatgagtgcattgctaagactttgatttgtctgtgcctggacaaaacatttcttttcgttgcttcaattttcttcttgcatccttagtagtactaatttatattgcttcattatccatacacttattctgttcactgttcacaagcagatggttgtattgaagattcaagttgcagaagatttttggcttgtggagctaagggatatgacgtgacgagttgagctactgggttttctgtctctggttctcgagagctattctgtgaacggttgtttatgtgattagatggtagtatccctttaatctatgagttagcaatggagctgatgacagtttaattaactcctgtatctatgatggcatttggctttaattaggaggtgtgcctaattaagggggttctataactttgggatatgcgtgatgctgatattgacccgaaatcccgtaatcctgcttattttgttgcccggtttattcgacctgcaaccgtttcgttttgttgtaatgctccaacatgatctcagtctcgtacaattctgtgcaactaagtcatgcttattcatgaagtgaaaaatatttcatttcattacagagagtgaagaatttcagtttccggatgcatgatttgcacgctacgactacgatcatcttgatcaacctgtacggttctccaaatttgattcggcaatcgacttgcaatgcagatagctctgaaccatcatccctcatttatctctttagggttaagtcttatttacccccttcaactatcatgaaagtaaaaaataccctcatcaactctaatactagataaatagctttggccgatgtccaaagtgtgagcttggtgttgtcttgcttgtttaggcggtgcctccaacgatgtcgcgatcgccatggagtcggagttgctaggtcgctgggcggcaagctcggcaacgatgacacgtgccttgtaatatcaaacttgtatgccacttcttcagcatctcaacatcgacgttcgctcttggattccgccgttgtttctttggtagtttggctagtgttgtttggtgcttcgtgtgttgtgtggttgtaccagttgcggtggaggaacttggcgagtctctacttgtcgagaggttgttttatttttctgtaacccgtctgggtttttactccagcgagaggttgttttatttttccgtaacccgtctgggtttttactcatgtttaattgaaatataattgatagttgtcctgccggtttagtttcaaggacgtgactagacagacagtggtagctgatttgtctaaatcaactaccactctatctaagaaggacacaatccacttatactttaaatacaattttctcttaaactactcatccgatctatgatccgattgcactgttgtattcgtaacaattaaatctttataacaagatcttacatgattatattttcatgaaaaattataaattacttttatcatatatctaaattacttttagatttcactaaattacttcttagacatataaaagtaaattcaataaagtctagaagtaatttacatatattatagaagtaacttataaaaaaaagtaactttaatgaatgccttttttcatcgtacgagaagtcatatttttatccctacaacgaatttagttactttcattttgttttaagttacttttataatataatatatgtaaattacttttagactttattgagtttacttttatatgtttaagaagtaatttagttaaatctaaaagtaacttctatatatgataaatgtaacttacgtatataataaaagtaatttacaaatataaatattttttcatcataatataatcatgtaagatcttgttgtgaagatttaattgtaacaaacataatggtgtaatcggattgtagatcggataagtaatttgagagaaaattttgtttgaagaggaaaaatgacatgcatgtctattaaaaaaatgcatgcatgtagtacgatgtagtaaactccacgtcttctccatattcaggtatcaccggttaacgcaaaaatgagaggcctctccgaatagattttacgtttcaaaaactattcgatccggatagagaaaccccccttcctcccatttaccggcggttttgggctaattatagagattaatctcctaatgaggactgaggagacgggcccagcctgtcacgtgaggagcacacgatggagttagctactgcatgtagaggccatgtcactctgtaattggcccaaaatggttcaagagattagtttaatagtatagccaactatcagctctaaatcatttatagtcaacctaatagtcattcatataagagcacccgcaatggtaaagtaatgtgctctctataaaacatgtacatctcagcaatatactcgattaatagtaaaccaccttaatagtatgtctacattggtatttatagctctctcatgcattgcctcgtttttctctatagactatctctaagttagtagatagctttgctctctctcttcatttaatacctttcaagtaggaaaatatgctgacatggatttcttgtagagagtatatagataaccattgtgggtgccctaatagttaattacaaatatatactatatcattaataactggtcccatatatcatatacacatagtgttctagagttcgtgctgcagctggctacaaatctatagcccctgtcggctattttttttttcatcctctgcgaaccgtctcaccggaaggaagctcagcgccatgctcaccggaaagaagcagtcgtgccgtccggtgcctcctgcaccctagtgttagggatttgggctctagaggatggggaatttgagggaaagagagacgagaggagggaattatttaattttttgctatgtcatccgtcggagtgtcatgtgagataactctggaacaaaactggctataaatgggaatgagggggttgtgtgtccggactgaatagttatggtgaaaatgctcgatcggtcgactgggggaggggggaaattggttgtttcccctcccccacgcgcgcgccccgctggacccacccacttgtccctacacttgtttcacaaaagatgtttcacctagtgtacttataatgtctcactatgtatagatctaatgttgcagtgaattaaaatattcttttgcaacaaatcacccacatattttagaaaccctttattaagggaattcgtttcatttttttgttccacccaaaatatttcatctagtgtactcataatgtttcactatgtatagatccaatgttgcagtgaactgaaatattcttttacaacaaatcacccatatattttggaaactctctattacgggaattcgtttcattttttgttccacaaaaaatgtttcgccttatataatgtttcactatgtatggatcaaatgttgcagttaactgaaacattctttcgctatttgctgaaacctgtttttatataaggcgaaacaacgcccgatttaaacgattgaaacattttcgatctacttagtgaaataattccgatatacctggtggaacatcgtgcaacatttaaaaaatatcaataataagctaaacttttttcgtcggaatatatccatgggtggttttgttttgaagatttaattgcaacaaacttaatggtgcaatcggatcatgatttggataaataattttaaagaaaaattagtttaaagtggttttgcacatatgggtggcgctgatgtcagcgcccgctttttggagatttgtatcgggcgaccgatccctagtcatcccctagttacggggtgtgacttgtttggaattagagttgaggaggctaaatcatattttcgttatagttggaggggggggggggtcaatcggacttgagccttatttctttatgcttagctctctgttaatattcaaatttcgatggatttaagtttgagtgtattcttcaaccgtttttgttatagacgtcgaattatttttttagcctgattagtcgaatttatggctggttgatctacatcaagatttttcttttgcagggaaaatagactttattaaatcacacgggacctattacaatcgtttttgataaattatgagttctcaatatttcaaaagcccatctcagcacaaatcttgacaaacaaagctagaagggactattactcagatttgagtgggtttgagtacaattctgctttgcggttatcgaaagggacaattacttatttgactctattttagagtctaaatatcaatttggccctacttcttttaatttgcttatttgactccgcatttgtaaaacgaagttaccgtttggtcctatttccatttcgctgttaggatttcatttagaaaaaaaagaaacaaaaattcaaatcatattcaaactgaccaaaaatacgcttgaggactctaccctatccattcaatccctaaattttattactacttcagaaacaggcacatgatttatgcaatttgctacactgattgtttttgaaagatctaacctaacagaaattattaggacaagctatatgcgagatatattgatggaatgatgggtcataaaccggagaacttaattactgaactttggaagccatagtcaacgtgggcccatatttgaagtgactttaaaaaggagacaacagtgcattaccccagttaatttattttggaaaaaatacaaattaccccccgaactatcgcgcctgtccgaattacccccatgaaccacaaaaccggacattcttcacccccaactatgcaaaccggacgaattaccctcctcgaaccaattcagagcggttttgtccaacgtggcgcacatgtggcaatccggtcagcctttttttaataaaaaattgtaggacccacctgtcatactcttctttcccctctctctttattctctcactctctctcgctcttttctctctcgccgctcacgcagcgcgcacgtgaggacggtcggcgaggacggcgcggggacgggcggtcggcatgggcggtcggcgacggaggaggcatcgagcgcggcggtgacaaggcgaggcagcggtggaggcagcgagcgcggggaggcaagcggcggggtagggcagtggaggaggcgagcggcggcgggagctcgcgctgctcaaggcgaggcgaggcggcggtggaggcagcgagcgcggggaggctagcggcggggcagagtgatggggcaaggcagtggaggaggcaaaaggcggcgggagctcgcgttgctcgaggcgaggtggcggtggaggaggaggcgagtggcggcggggtgtggcgaaggaggcagcggcagcggtggaggtagcgagcgcggagatgggacc

SEQ ID NO: 80515 - DNA, 19297 bp, Oryza sativa
acccctcatgggtttttgctccgcgtatgggttaggtgagcacagtggggctcacctaaccacatttattgtggtttggttgagcgtgtcacgccgcatgtaacgcagtgcagtgcactcgtttatccggtctgtgaccagtcacagaccggtcagatcgcgggttaggtggtgacaggcgatctgacgcacgcctcgccccatcccgtcaggacgagggcttctaggcgctcgtccccagctggagctagcgtgttacctcccagagatggcacgttagtcctggtcagatatatgccaggtttcatcctaaccattacaggcaagatgttgtgtgaagaagggtgagcatgtaggttgctaagctgacacgtagtggacaagaatgaccgacgtgactggtctgataccggtcatgtcgtcagcagacagccacgattccacgtcgcgcctgcttccggcggaagtggaggtaggtatgggccgtcccatcagaaggtcattcggacggcaaccatacaagtctccgtctgtttatgaaaaggtggggtaagtccccacaaaaaagagagaaatggtgcatgtggtatccccttaagatataaaaggaggaccttgcccactgagatgtggaactggatttttccagattagaaacccagaacaagggagaggctggctcatactttgtagctcctttatacacagatcttccaaaacacaggagtagggtattacgcttctcagcggcccgaacctgtatacatcgcccgtgtcttgtgtgtttctggtctcgcgagccttccacatacagagagcttagaatctctccctgagtccccggccgaaccggcaaaggggggcctgtgcggtctcccggtgaggagccccacgctccgtcactcggatataaccatgactaccttatgtattaataaatcaaaggcacatatgttctacattagatttacttgttatatatttgaacaaccgttgctacacaatgagtttcgtgtgtttttgtttgcagagatacttgcttggacgaaagaaaagagaccgagcataagaaatgcatggatgattgaagaagttgattggggaccaaaccaagaccttttccaagtattctttcatctcaccacgtcacttttggtccatagaagacaagagataaagttctatacgttttggactcgggcctcctgacagcatcaacttcaaacggacctagccgctgatctagaagaaatttcggggcccatgagtacttgttggaaagcttatgaagtctactttcagatggttttggttccacatcaaaactcctaccgagctgccgggaatctgcaaaacaagtcatgcacctcatccagtccgaatctgattttgagttttgggccttgtaattgtgtcgtgggcttagcccaagggggtgtgcgccctatggaaaccttaggacgttcctaatcatatttattcagtagccgtcatcgtttagagtcgggttttgcttagattaatctgtcgagaatagtttcgccgctagatcggtttgtaagaccccaactcgtgagcttaatcattcatctgcaattttggttgttttctatctcgctcttgtttgtgttcttcgattggcaaacagggattagccttctcggcgaggtcatccgtgtttcgacacgggtgataaccagagaagacgtggtgttgcgattgcggggctcaagagcgtgcgcgttcaagaagccggatcgatttgtgtcgcgactctgcccaaatcgttgtttatcagaacctttcggaagatcgggaaccccagtgcacatcaccaaatcccctttcttgctcactcgggagcatcggctctcccctcctctctttgctgatgtcgacaggcagcacggccggcgagccctgacaacgcagatcgaggggcggtgcggccggcgagctctggtgggcgcagattggggggcgatgtgtctggcgaactctgactagtgcagatcgaggggcgtgtggccaacaagctccgggcggtacggatcaggggtggcgtggacggcaagctcttggcggcacggatcaagaggcggcactcccctgaggtggagccgacgagctctccggctgtcgctacatcaagtttccccagtgaggaatcgagtaagctggcggagtggatcaacctccttgccctagtcttcatttcgctcattcctctccgaccgctcctccttcgccatcaccgcgacccgacctgccccccaccactttttcccatactccagcttctccccttcctcgtcagcactcggcagcatcgccaacaagctccaagcctgctcggatcttgacatggcggcgcagaagaatggggaagatttgggagcagcaacagaaaggggaccgtgctcgcaccttctttttcgggcgtgaggaacctgaaccctagctaggagccgcaaaccttgcaagggcacgggacccacctccttttctcctccacatcaacgttcagcaacgaggtcactcgccacgtcgttgcactgcgaaaggcctgaagaagcgaagcttcgtgtcaatatccataggttgtcaggtgggcaatgggacgactacattattctaagaggacaactggttgcagggatttggtgttcgttctcttgcactggctgtgcatgatcggatccttgctagcattaggaggcgtaggacagtggccgaggcgctactcggccgcagatggaataagggacatcaatggtgctatggggattcaaaccatcctggattacctcaatctttggtcgctcgtacaatcggttgatcaactaagtaaccaaccagactcaataatctggaaatgggaaagctcaggtgattactcttccagatcagcctaccaatcattgtttctcggtcgaatacctttccaatccacgctgatatggaaatcacttgcgccacctcgctgccactactttacatggttagtggcactaaatagatgttggacagttgatcggttgtgcaaccatggactgccacacccaaattgttgtgtcatctgcaaggatttaaatctccggctatagctgccgttatagccggagaaagctgctggcaatagcaaccgctacgatatgttcaatttaccgctatgttttctttgacgctattagctgcttttagctgaagattgccgctaaacagaccatctattagctgccgctaaaggccttggtgggctgaaattccaatgaacaagcccatattaggtgaccgtgtggctcaagtgctcaacaaaacctaactctctcgctctctcctcctctccgtgattgcagcagcagcggcggcgacctgcagtggcgacggcgacggatgctgctgtggctgcgaccggcaacggcggctgctgttctcagaggcggcggctgcacaaatccctctccctcctcactcttcttccccaagtggtggtggcagctgcgcccggagaaggcagcgatggctgcgccaatccccactcttttcccccaaccccaagcaacgacggcggcgaatgcatatgaaggcccactcctctctcccccaagcgccaccaaggcaccaagctcgaacggcaggcaccatgtcctagcggagtcagaggcaggtaggatttcttgctttgatgttgtcgagtgttgaagaattgaagtgttttgaactattttgaatctctgatgttgtcacgaatttattatgatattggcaagtttatgttcaatttttgcaaatccgctaaatggcttaactgcagctatagccggccatagctggccatagctgatgaaaagcccagcagctaaagggcttagccagagattttaaaccttggtcatctgtgatcaacacgacgagagcatcgatcatttgttggtcgcatgtccagaatccagacaactatgatggtgggcgctcagagcaattgagcaaccacattccatctttggctctgtaacagtcggaagaaaaggacggatgctaccgaatttacatgttctttaatgtaagacttcacttatatggttaaacatatccatcatattttgcatgtagggttgttttggtttgaagccccaccaaaagtttattaatgtcaaataagatttggcactaacaaaattttggtaggattgtgttgtttctaactctattgaatggataagattcgatctccatccaaatagctaacaaaaactgttcaagaataccaaacaattgataggagaagaattgacttcaatccaaacatgcccgtaaacgatgactctccggtaacaaattgtaactgtccactcacaacggggcacataaggaaggtgcatttgcaacctattatggacaagttaggctcacgtctggcaggatggaaaggaaggctcattcagcaggcgggaaggaaaacactggttacctcagttttgagttctataccaacatacttcctcactgccttgaaacctcccaagcaattcattcaggacatggacaaaatgagaagaaaattcctctgggcggggcatcaagagctcagtggtggaaagtgcaaagtgaattgggaaaaggtgtgctcaccaatcaaattaggaggattggggattcttgatctcgacaagtttgcaagagcgttaagactgcgacggttgtggttctagtgggaatgtccacacaaaccgtggattggtacgcctccgccctgtgatgatcttgataggaagattttcgctacggccacaatggtctcaatcggtaatggtaggaaagcagatttctgggaatcaaattgggtgggacaccagccactcaaatatcttgcaccaacgctcttcactcattccaaaggaaagcaccgaacagtacacaaggctttgagcgataatcaatggatcagggacattaggcatgacttaaccttggcgctggttcaagaatttgtccaagtccatcaacagatttgggaaagtggaataactttagtagaggacaccgaagacactatcctttggaaatggacaaacaacgacaagtattcagcaaaatcggcatacatggctcagttcagcggcggaactggatcaagagctgccaatctgacctggaagtgttgggcaccatcaaagtgcaaaaatttcatgtggctactactgcaaaacaagatttggacagccgatcgtctacaactccgccaatggcccaacaattacttttgtcagctttgctacaggaacttggagacaacgcaacacctcttcaaagactgcccctacacaaaggaagtatggtagagggtcctctcaagattaaattgcaatcacactcttgcaccacacaacgacgatgagggcttgctggaccggtgggaaagaagaactagccacggcgacaagaacaaagcgaaaggaatgcgctccattcacatgttgctcggttgggagatttggtgcgagcagaaccggcgagtgttcaaaagcaaagaggccacaatgtcgtatctggtgacgaagattgtggatgaaatcaatatttagataggatgcggggcaaaagatttagctagaatagtgcacaatagcgcctgattgtaaccatcccactcctctgtagtccccctgccccctctatcttcctgtatccaccccccccccccccccctgttttccttttcttctctgctcctcacctcttggtgaatctgtacagttcttcacctgcttaatataaacccagcagaagctggcttaaggttttttttaaaaaaaaaacaaattgtaactgtgatcgttcgaaagccaaatcgaagggcgaaagatgcttcacaaaccgtccaaaccgctgactccttgttgcctgctcgcccgtcacgggcacgtacacgctgttccgcttgctgaaagacgggaagcacaccaagttttcagcggccgctcacatggagagtggcaggaggcgccaggccgccggccactggaccaacacgaaatctccctcgttggcgagacaactctgacatgacattgcttagcacgcagaggtcgtccgtccatggcagagagctcgcttgcacggatacccaagcaggcacgagctgccgcagcgccgggcaggggtcacaggccctctcttgttctccatctctcgtcgcgcacagttctcccgaaagcgaccgccccgcccgcgtcgcatccgtccgtccgcatgccaaccaacggcccgggatctcggcacggcccggtccatcccgcgctttcgcaggacaaaacatcggaaaccgcgcgcgcacccgcgcacccaccctttgaaacatttctcggcgtgagcccgtgcctgctcttcgcctctgcgtccaagagcatggccgccgccaccaccaccaccgtcctcgccacgcacgacctactgctgctgctactactactcgtcgccatctccttcgccggagcggcgccgctggacccggagcagctcgtggcgctgcgggcgctcggcctccgcccgcaccgtctcgacccctgcgacgacgcggccggcgccgtgggcgtggtcgccgcgtcctgcgacgccggggtgccgtttcggcgcgtgacgtccctcgtgatggccaactgctcggcgaccacctccgtctcggccggggcgctcgaggcgctcgcgccgtccctccgggcgctctccttctccgactgccccgcggcgccgccgcggctgcttccgccggagcagctcgcggcagggctccgggccttctcctgcgtcgcctcgctccaccgcctctccgccgtgtggctctcgcacctggagaacctgaccgagctcaccgtcgcggacactcccctcgccaccggctccccttcggagctcgcagtcgtcgtctcccacatgggccacctcaccagcctcaccctctccaatgccaacctctccggcttcctcccgcaccactggcactgccccaacctcacccacctcgacctctccgggaaccgcatcaccggcgccatccccgacaccctcaccctcctcagcgccatcacccacctcaacctcagctccaacgacctcaacgggaacatccccacctccatcggcgatctcatttcgctcaccaccattgacctgtccaacaactccatctccggccgcatcccggacactgtctccacgctgcccgagctcgaggtgctcaacctgggctcgaaccggctcaatggcagcatacctcagttcctatccgagatgaggggcctgaaggagctcaacctcgagggcaacgacttcgacggcatggtgccattcaccgccaagttcgtgtcgaggctgcgagtgttcagggcggccgggaaccccaagctgtgctacaaccggtcggtgctgtccgccgagatcgccatcggcgtggcgccgtgcgacaagtacgggttcccggtgatggcgccgccggcgacggcgacggcgcggtcggagcggagcgcggactacgacgacggcgcaaaggacggggacgcggacgagggcgccgacgcgcggggcgggcccagcgcggcggtgctcggggtggccatcgggctgtcctgcctggcgttcgccgtcatcctactcgtctgcctctgcaaggtgtgccggtgaggcggcgccgcgcgcgcggcgagcgagccgagcaagcgggaaacgaggggatctcgtcgaattcttttgcttctttcgtgttgagttggctggttgatccgtgccacccggtgtcccggtgaaatcgtgaattattccctagctagctcatgatcgattgatattctttctcatgtaatttttgttgcggttctttgctcttgatcgggttcaagatcttggtttgagagctaagaacagccatatacaaacgacagcatcagtttgagcattctgcagagccaagcaggcaatgttttggcaaatgttgttcccctgtgtctgtcaacacctgcactaatggctcgtgtgccactgttcgtatgtgctgcactgacattcctgtagacttaaactattctgagtagagaaaatccgtaaaagttctaaccaatgtacggcaatctaggatttgttactgaaactacggagggcctgttttgtcacatcgaatatttgattgggagtttttgggcgcgaatgaaaaaaaattaatttcataactcgcttgaaaactgcgagacaaatcttttgagcttaattaatctgtcgttagtatatgtgggttactgtagcatttatggctaattatagactaatttggctcaaaagatttgtctcatgatttccatttgatgtgatgtttttagaaaaaaaatttggagaactatggttgtttggtttacatggacttattctaagtccctgtcacatccgatgtttggacaataatttggagtattaaacatacactaattacaaaacccattccataagcttggactaattcgcgagacgaatcttttgagtctaattacgccatgattttgccaatgtgatgctacagtaaacttttgataattatggattaattaggcttaaaaaattcgtctcccggattagctcttatttatgaaattagtttttttattagtctatatttaatactctaaattagtgtccaaacatccgatgtgatatggactaaaaagttttagcaccatctaaacacccgtgaaccaggccggagtgatgttactggtccttttggctagtactgagcactgaatgagagatcagttcctgtctgtatagcgtgtactgcatgttcgagcaccagttgatccggctgtgcaaagagattagagatcaggccagtatttccttccttgcatttgattgtggcacaaacacacagggggtgcgttgttgggtggccgtgttcattgcgtgaggtgtaaatgctgtcatctgatgaagaggaaagtccattttctgctcctttctgcttggacctttcgagtcggactgcaattttctactagccttcaacctcacgttgccaaccgcgcgcaattcggatgagccgcacggctatcatgtacccctcggtcccgcctcagcgcaaccatccaaaaagacggaacagctacgaagctacagcattggtaagcttttcagttgggctgccagtttgggcaagcgcagtgatctcgcacgtacgcgttgaacattttgcctgccactcaaatggtggtactagtaaggcaaggccaatgtatgatgcacatacacatcttaagatggaacccataaatagttagtcttttttatggtatgatgcataatgttatggtctttaacatgggtcccactataaaataaaaaattaagatggctgccagcttctttgagatagtagggagagagaggatgtataggagaaaaaaaatacttgtttattcactatggctagttgtaagcttaaggtgcatcataagaaaatttttcctattgctaacttgcacaatatataaggtgtgtcttaagaatatatttattccttaaggttacctttttagcacattgtggttgctaatactagtagtttagtagttttctgtatatctacacgtattctgctactcgaatggtatgatgcctgaagaccctgaagtcagatttcactgctttgccacgctacacttgtagtacaagtcacaacagacgagtggacgaccacgatacattggttatagtagtagagatacaatcgagtactgtgacgtactgagtgtcttgatgtaccttggaaaatgaagtttcacagtgttggtgcataagagcagtttaatggtatagcccactactagctccaaatcatttgtagccaatgtaatagacaatttatacaatagttgcttactatactattaatacatagtcccacctgtcatacacacattacgtcttggagtccgtgctgtagctggctacagatctgtagcccactgctcttctctctcttcctttatctctttaaaatatgtttatagctggcttatagtatgctattgtacctgctctaagagcaagttcaatagtatagctcactgctagctccaaatcatctatagccaatgtaatagctaattcatataatagttgctcactatactattaatacctggtcctacctgtcatacatacattacgttttggagtccgtactgcagctggctatagatctgtagcccgctgctattctctctttctttatctcttttaaatatgtttatagctggcttatgcctgctactgtacctgctctaagtacatatacagttcaccacgctttgtgatgacaattttccgatgtgatgatcgccgctaatgagcatccatgattgcaacagcatcatatggaaggtgttgattccctcctcgatcgtgtccctacgtctatgcaagacagcacgggccaccatgggttccaactcaagttagtcaggtcgacacagcaaactatcataagcttgcccatgtaaacaatcaaatcttattttacatggtcatcatccagtcacaccttgcaccacattgctgattggtagattaatttatctacgttcttctatcagtaggagtagtagtactaattcgtggcaattaggtcgtagtattgattattgtcaagatgcaaaggcaaggaagcgtgctcgaattagcagtcattagtgctgtttatcatgaaaggatgcagtactagccgaaaagggtgttgtttatcatgaaagaatacagtactagccgaaaagctggtgctgaaaagttagtgcaagaatatggtagctagggaattttgaaggctaagcaaaatcttgtttgctattattcgcaagacaacggcgtaccttttttctcttctgcaggaggctacgcataagataagattcagtagcatatagtcatataacattacaaactgatcagtagtccaatttcaagttcaccgaagaaaaccttttctttccccctcttttttctacaagtatgattaaacggatttaacggtgccctctcatagtttcagcggcttcaacatcaaaacttcttatatcacagacaataacaatacaatgaacattttcatgcggagtactaacctacaacacctctcagatcgaggacaaagcccagagagaggaaaccacccatcgtcttcgtcgcattagatacacacatttgcaataccggcaaaacaccgccaaacgggatgctcctggagcacaaatgtcgctcagcagtcgaagttggcgcagctgttggtggtggtggtctcggagctgccgatgaacgggtcgatcttgacccagaggagggagaagacggaggcgagcaggacagaccagagcacgacgatggtgggcgtccggttctggcgacccatgagacccttgaggaaggggtacaagtgcatgatcacccacatggcgaagaacaccttgccgaagagcgggccccaggactcgtagccgctgttgagcgcgtcggagaacccggccaccacgccgacgaggttgagcaccaggatggaggtcggcgggatcagcaccgtcgtccacttgaacacgtacagctcgccgaactcggtgtcgtccgtcgccttggccgtaacggtgaagttggtgtccagcccagcaatcatcttgaggataccctggaacacggcgaagaggtgggcggagacgccaccgatgacccagaactgctcgttgcgccaccagtcctcgatgccgatgccactccaccgcagctccaggacgctcgtcacgatgatggagatgaagaggccaagaaaccatatggttgcagcgttggagagctgaaattaagaacgacaaatgaataatgtcactaagcaatgttcaacatcagaactcaaaccaaaaacatgtatagagacaggcatcttaccgtgggaatgatgaatttgcctgtgagcaggcaaatggcgggcaggcaacagtatgcaataagaggaagagaggtgaacgggtagacgatggtgttgatgtaggacaatctctggagccatttcagacgaccaccaccgtagccgtaccagagtgggcagtgccggctgaggaagatctcaacggaaccgagagcccaccggagaacctggtggagacgatcagaaaggttgattggcgctgatcccttgaacgcgggtcttatcggcatgcagtagatggatcgccagccacggcagtgcatcttaaacccagtcaggatatcctctgtgactgaaccgtagatccagccaatctatgacaggacagaaccaagaaatcacgctttgagttttaggaggaatgaacttcaacaaaggtatagataataaggggagaattaacacctcttttccccattcagttttctcttcatatccacagctaatgacatgaatggcctctttgatcagtgtagatgggtttgcggactcaggaacgcctccattctccataagagttgattctatgaacactgatgacagtccaaacgacttctcaaagctcatctgggagataagcatcgagcgttcatactcatcatagtctgcaaaacaaaccacattataatgaacacaaaattattcaaatttcgaactacttttatctctccatgtttgtgcacttactgtcaatttcccgaagattgaaaatggcggactcaaggtcttcacgtcgagagtctctatgcatttctttctcacttttttcagcttttttcttaggacagcagcagcagcaccatgaacagacagaagactttggaagcgcaggcagtgatggtggtccataaccatagagcgcttgcctatagaaacaacaaccagttcccacataaaccggaccttggaggccatcaagccctttcatgttaacctgcagatgataagtatgaatatataaattgggtaaagataatagtcatgcaatacatagtcactctcttagtacttacgtcaaagaacacaacattcctattggcataacgatcgctgcgatcaatgccatcgaacctttgtgggaattggacatagcagacatctctaccaacagaagggtccatcatgaaacacatcgcttcacgaacagctttgctattgttaacatagtgatcacagtcaagattaagaatgtaaggggcatttgtcagaactgcggatactcgaacctgaaaaattagaaaggtgaccaaactttcaattactatatccacatgataagtttgccatactttaaactaatacatatatgtgtaattttctctaggagctatttttaccaaagcgttcatggcccctgctttcttgtggtgttggtaccctggtcttttctctctcgaaacatagactagccgaggaagctcatttccgtcaaagtcccgagcaccggtctcaccaaggaaaacctgttacaaaaagccagtggtatgctaagtgtaagtttgaagaataggctatcgtctgcatgttatctatgtcttggttttgatgcaagtataaaaagccatatgtgagtgtgtgagagagagggggctccacaaaacatttgaaccattttactaataaatctgtaaaaccttgagttactctaatgacataattttaattaactgcatcctgaagagtaggatagaatttatgcacaatctcctggacaacaagaatgagcatatcgataatcaattgaagttgtatgacatatattatctgcgaaaatcttaaagtggaactgcataggattagactttctctcctggttttctgcatgcaaacaatagttaacacttgacatattttgtttcaaagcagaagtcaatagaatctctactccaagtggcaacctaaacttcatttattcttaacttttgtacaccagaaactatcccgttttcaggtgagaattacaaacttgcaaatctgtaaaaggttgcccggtatgaatacaagaacaaatatccaagattgatgttttggtaatgaaaactgaattacctggatcattccagggtggtcacgagggttgttcccaggccatggtgtcccatcttgcataatccagccttcctcaggtgtcttctgagccttagcaaccaaagcatttatcctcaccttgtattcttcgtaatccctctgcacaaaatgtgatagttgctttaatattagcaaaagtacaatataacataaagagcaccatcaaactgtataaactcctatctaccttcatagcccgacgctcccttgacgaaagatgggtgtatcttgtccttcaagtagtcaatcttctgtgagaagtagaactcaggggcacgtggctcaatggagtacttcttgcaaaatggaacccatctcctagcaaattctgctgtttccgcaagtgattcaaatgtgagcatagccgaaccatcgtctgacacgtaacacgaaatcttctcaactggatagtccacggcaagaatggacagaacagtattcgcagtgattagaggaggctctttcaatggatccactgtactgacaaagaaatctacaggtgccaacccagaatcttctccatctccatatctgaaacaacacatgagcaatgcagcttatgagacacaaattcttaatgaatagtaatgtatatagttttcatatacaaattaggctttagcgaacacaccgtgcaatcagcctatcaacataagtttcgcgattgataggacaccacttggggaactgatccaggatccaggagaatccaaaccagatctcacatatgactgatgtcatccagagaccaaaggcgctgtaaacagggttggtgatacggtagtgaaagaagagccccagaactaccagacgcataatgattactgccctgtaaggtgtgagcttgttcttcgatataggaatgatccgagaaagtggctcatatgcatctgtcaagctgcaaaagggcaaattgcttggtattacaatcaattctccaagtacagtgttatgtcaacaatcagcatttaaaacctgaagtaacaagagtttctgaaactgagactttactggcacattatcaggatatgaacacgaagttaaaaaggttgcataataggctaggatagtatactggaggaacaaagatgaacatgtactgttcgcatcacaaaataagaaggcctagtgttataccagaaaaagataagctgcaccaaaatgaaaccttattaatgaagtatgaaatatgatgtgttaagaacttaagattgactacatatgctgatctcgaaattagctaaagggtttttctgtagtaatccaattagacgttttatattttagcattgtgagataatatctgcattagggatttattagttcagttctaaacgaataacgtctgcataagacaacaagttcagttctaaatgcacatgatctggcatctagtacattcaaagaaaaggttagatatagccagattctaaatttacccaaaccataaagtttgtttttttatatgtcaacaaggatcaagagtattcttagcctattgatctaatcagatatattttaatatacacaagaattttcatttgtaactgtaaataatgtatatgaatcaagaaatgttaagtttttgatggatcacatggatctatgaaatggttccatgttccttactctttttcatccataatctgttcttcaacaggtggagcttgagcttttgctgcagctttctttgctgaggctttcttctctttctttttctccttccagctctccaccctgttcttccagatgggcttcccagattcatcattcaattcttcaaatccataacaagtgaaaatatatatatatatatatatatatcagtactcagttggaataatgcaaggaaaaatatgacagacaacgagacgagttgcttaccactcccaactccagagacactgctaattgtcctggcatgggtgctcatagtcctggcatgaactccttcatcctgttcccacaaaatcccacacaacattgtcaacaacgtcggagcgctcaagctgttctacccagaattgcacgagtttatggagagggctattcacctggtgatcgctgagttggctggccatggtgaccctctcgcgaacaccgccggccgccggctcgtggctctcttccacttcctcctccacgaccgccccctggccatgcgctgtgacagagatcaacctcgtcagaaactgctacttcatcccccgcatcgatcgaatcccgcatagggcaaaacagtaacccgcagcgcgcgggggcacctgggtcgggcgcgccgtactccccgccgcagcgcgcgcaggtggtgcgtccctcggcggcgtcctcgtcgaggcaggccttgcagagcgcgtagctgcaggcgcggcaggcggcgtgcgcgtcgtccccgcacgcggcgcagggcgggacccccgactccatcatggctcacccccctctcctctcctctcctctcctctcccccaaaggagacgctccggggcgccgcgagcagcagcacgcgaccgcgcgcagagagcaatgcgcagaatgggagggggagagagagagaggctaagcgtaccggaggttggaggcatggtgatatagccatagccgcagaggcgcgaggtggggtggcgctggcaggcggtgggtggggttggggcgtcggcatcgcgtcgatcggcgggtggatggaaagaatggaagcaaggttgagcggacatggaacgggagagaggaggagaggcgggggaggaggaggcgtgcgcgcggcaggtgttcggtgttttcttccatggggttttgcggggtttcgaagcgaaggtgacgggggatttggtttggtttgcgttggccgcggcgaggcgcgtaacctgcaaggcgtaggggggatgaggggtgggggatcggactagcgaacggccggttggtgcgcgaggtgaggagggtgggtccgccggatcggcgagagcgctcgcgctgtggcgtcgtttttgacagcccgcttgctgcgacggcgacgggccggacgcgaggtgggaggtcaggtgctccgatctcgcgcaagagttcttcgtgttccacatgttcacggccaccggcacggcacagcacggcaagagctttggttcacggcgcttttgcggatgcggtttcgttgtactcgttagagaagttcatgtgctgagatattggttgacaatgtcgtggggcttttaactttacgagtttacgaccgacaaattgttaagcgtggcgtcgcaccagttttttcatgatgtggcccgtggagagcctagtactgtttcatgcttcacttttttacgcatcgtgattcgtgaacgtcgcgtataacagtaccggcctagcctctgataatgtagttccgcgtccttacggggcaggtgcaccgtgcactcctctcagtctctcacatcaaacacacgtatcgaactatcaactaccgtagaagagagaacaatagcttttggattgcgactgttctattcccctaatttcattttcctcctccaaccatagaaacggcaccttgacagacaaaaccatatcaatttaactccctcgtttgcactgactcggcgcttacttttttttttaaaacctaagtcagcctgagctgattttatattaagcagaggaagaactgtacataatcacccacggtgattagagaggaaaaggaagaggaaggccgagtttagttccaaactttttattcaaacttttaactttttcatcacatcaaaacttttctatacacaaacttttaacttttccgtcacatcgttcaaatttcaaccaaacttctaattttgatgtgaactaaacacacccaaagtatataaaaaaaacagcttgccacaacgtatagttttaatgtgctattctcacaatgtctttagccccacaaacagaccataactggacctcatccagcaccttcgccaccacctgaagcattgagagttatttatccttgaagattcgtctatttctttcacaccatacttcccaacagagaagcacgtgtagcgatcgcaatccctttgtttgtctcttgtcctgctgggatgtcctcttttcccaccattcaatcagcttctcctctggattgtgcgctagaaataattgactgcattccagtctcgcagctactctgttccagacctctcgtgtgaacgggcaatccttgaacaagtgctgcgccgtttccaggtttctgtagcaaagctgacaaaagtaacaatttggccactgtctgatttgcaatcgatccgctgtccgtaatctgttatgcagtaataaccaagcaaaattcttgcacttggacagtgcccatgatgtccaaatcacggtggctgcccttgattcctctctgccagcgaactgggccatgtatgccgattttgctgtgtatttgccagtattcatccatctccaaatgaccgtgtcctcagtcccttctgataatgctagttcgctgctccaaacaagctggtagaccgcaaagaattcctgaaccaatgtcaagttcagatcatgcctgatgtgatcgacccatttttcatttgccaaagctgcggcgcttacttacagtagtaactattagagaaaaagtaaaaaagtacagtctaatctatcttttatcgcctaagttttactttggaccatccataaactaatcttttcactttggacctgggtaactttaccatattttcggtttggaccacctaactctctttactatttgtatccacccaccatgctgctgaatatattacctgcatatagacggggaagttcaacgttgtatcaaaattgatttgattgagattcttgatgagtactgaagaaattgtttgggggtgatccaaactcaaaagataacaaagttactcggtccaaattgatcagatttgtttacgggtggtataaagtgagacttgggtaataaaatatggcccaatttgctattcactcaaaaataaaaaatgtttgagaggcccacatgtcaacgagggttacttcttccgtcccttccctctctctttgtttgtagaggagtgtgcgaggatagtcatgactcatgattggatgtgactctagggcaacgccattaagaggacgaaggtcatgcattggaacaatggtggcggcaacgaacggtgttatctt

SEQ ID NO: 80516 - DNA, 610 bp, Oryza sativa
catcacgatcgccagatgcctccccgtcaccaccacctccttgaaccttattatgttcgggtgacgcagcgaacgatgattcacgatctcccggaacacgttctcgtcgatctgtaccaatttcatttcatgctatttctttctttcttttcatatatcattccaaaagtaatagttgcttgcttaccctgttccctctctcgatgaacttcatcggcaccagctcccgcgtctccttgttccgcatcagcttcgctaccccgaagttgccctccccgatctaccgaactggctcgtatttctccatatcctacctccttttcttctacagtcacttaaaatcttgctttcaattctgcttctccttctgcttctgcttctgcaagaggaacagtctctggaggaaagaagcagagcagagcaagaagatgaggaggagatgacagacgacgacgcatataacctgcagacagatagacgacggacaggctgaaagaataagaggaaagccaaccggccggtcttgggcgaaaaggatggatgcaaccagcgcacgactcggtcggaattaccatatttcttctcaattgcatgctcattaattttcaac

SEQ ID NO: 80517 - DNA, 697 bp, Oryza sativa
aaactcataacataccactgccttacgtgttactcgagataagcggcttgtttggtaagcagttggctgagacatgaaaatttaaattttgtacaatcatatggacaatataattttgtgaaaaaggaaaggtgaaacaatgcagagtttagaacaaggccttagcataaatactgaagatttgtgctccatcgttatttctttttctatagtacggtcaagacatgcatgttctttttggaccaaagtattgattttatactgagataccatgttctatattcgttggatgttcttctcttttcttcgaaagcctgatgctgagttgcctccacgtgcaaagtgttcttccaagagaagttttaagtgctaatttcagccccaatttcactcatgacacacgtacgatggaatcatcatggaactggaattgttgcgtcaagatcaaacgcagctctccttcacaccatcccggatcttgagaccgatctggcatgagtaacacctacccgcactttggcggtagaaaccggctacgctagggagaaggggaaggatcagaaggaatagttaccatcttccacgcgagtccctagagccaacggatgttcctctcgcgcggccgcggcggcggcggcagcggcgacgacgaggcggcggcggcggggagggaagacacactttgggctgcaggaat

SEQ ID NO: 80518 - DNA, 647 bp, Oryza sativa
ctgatgtgagagagactaaaattatccaaaccgaagtattggcaggcatacatgcacggagagttggagacgggctggcatggcccatttggggagacagtagcggagtacggaggagcgacggggcaagcggagccagcgcgcgaattcccgtgagacgcgtacctgcatgcaaggcgtggcgcgcccaggtaggctcgcgctgccgcggggtgacctgtgtactgtgatctatatcctctcgctgccgcgtgtggttgccgactgtacggacaccccagccagcggcgcgacgccccacggccttactatgcccttctcgcattggaccgtcgaggagtagcccgtagttactcggtaccctagtacttgccctttccgtagcgtgatggttgcgttgggttaattggccccccagctactcgagttcggacacgtcgaagccccattggcccacaccgccaggtcactccacatcccaaccaacgcgattcgtccacgaccatgacatgcgatcaccccaccccctccctcaagtccacgcacgcgcgccgcgagccaaaaaaaaaataccccaaagcgaccgcggccaaggaatgaaaaaggtcgcgagaacttgtggctgggagggtccagggcgcgcacac

SEQ ID NO: 80519 - DNA, 62935 bp, Oryza sativa
aaatgctagaatgacctacattatgaaacggagggagtacattccatgttcaaccttaaatgataataggagtatattgtttacacatattgcaatggctaaggtcagacactaaacccacacaaaccttacattgtctggagaatttctaaacttccggtacttgagctatgagaaattcataactttaattagctcacagcaaattaaaacattgaacaatatttagatgcttgtcgaagttcagattctaaattcagatgctcctacatcataaggacaagtcagaaactaatatgccaaatgctcagaaaataatatatgaaatgttcaatcactaatctggcaaatgttagacatctatggttcacacatattgcaaggacaaagactccaaatatagaaaatgaatagcatgtttgaggtatatataaagaatttgtcatcagcatgacagaaaattacagcatttttttttgtttttttggaggacacaacatgagatgtgattggaaatttttttgctcctaggaaatttgtaacaaaaaaaaggaaagtgttccacatttctaaaggctgtcaggaattattaactcagtacataaccaatagttcacagggaagaatagaaacaatacattaattacactacacaggatgccatataatgcaaggacaatttcagaatgttgtcaaccaagttcttgagcaatgcaagcccaagttcagaccatgtaaaactaaattcaaattcacatataaagttgtatggcacacaaagactataaagcctcctaattttggttggagcaacagcaaacatggttgggtagagttcagcgaatataaattcaataggaacttaacagtagattataaggaaaatgacatgtaactctttgaattgagattgagcagagagaaccatcagcatacataagtaaaatgcaaatttcagataattcacaaatagtcaatagtgttgtggtatgcatgtggcaaacaagaacattcaggtagataattttgggatttcatatgtgtacaagcatatgaatgtcaaatattattctgacagggaattatgtgtaagtaatggcgtccttcaaacctgcaatcgtgattaacttgctccacttaagtcatgtgcatcaccttccctgatgccatcctccaaatctacaaccccgattaactcgcttcattgaagtcatgtgcatcacattgcctaattccatcctccaagcatgtggtcagagatgccaccaggcttatatgaaggttgcctcctctcacaaagaaggaaaaaaggaccgcctcttagcagcatgtgacaatggctaggataatcccggatcaatgccaatataaagatgaaattatgcatgttgtagcagtgctagacttctggagcatcatggaatgtgttttggtcgtgtgcccctgggtagaggttggggctatagcacatacttgtgcctcaaaataaaatatcttatttttctttaataaaagttcatctgtttggagaatatatttgtccttggatctacccaaaacaaaatttgaagcgttaggacaaaatcaccaaaattttatcaattcaccggcagctgctagctaggagcacataaggcttgttaatgaaaaagtaaacactcaaattcctagcccagaaaaaggaagaagttattcctattcagaatcagagttgttccatgcccccttgcatacactaagctgagtttctttaatatgtttatactacgcaaatatatgtatgtaccttatctgaccagtgaccaataaccatagtaaaaattagtaaaaacttaaagcaaagaaataatcctgcatatatgaatattacctttttgttgtgcctatggagtatattaattcatatatatcaaccaaatgccaatcaatgataaataacagaacaaaatctccttgacccttctcatagagcatcttaaagccaaaagccatcatctgacaagggcctataaaaaatgccttccatcctgttcacccatccccagcatatccgtataagcttgtattacgacaattttatagtatccctagctaaagaaatcaaatggtggaatgcagtatcacttgaacaattctcaaacctgtacaatataatttctctataaagtaatctggaagagacgcagcatggcaactacaagtctacaatgttagtctgaatggagcaacaccagtcaccttgataggatatagcctgcaatgatgcacatatggattgataagaaccgaatcacaccattaagaggagagatttaatatatgtgcatacccttcagctgaataagaatccacacagaagactaatggggattcagaagagtcaatttgagtcaatggggtctcactcgatctcaccagcagaagaaattttgacgcacggctggaagtacctacggcagactatgcccctcgtaacggcggcaagaccggaggcgcgacggaaagctggaccaccggagaacgacggagcagtggcgctggcggaaggctggaccaccggtcggcgacggggctgtggcgccaacggaaccctggaccagcaggtccaattgtggtggcgagcggcacggaggcggggcggtggagggagtcaccggcgtcgtcggcgaagacgggagcggcatcggtgacgacaggagcagcggaagcggcgacaggaggcaggagccgatgcggcagcggtggatggaggcaccgcgcggaaggggaagaggcggcgacgagagtattttacctccatgccattaagaaagttgaaggttacctatatgccaaaaaaaaattttgagtcacctatataccatgacacaaactttcgtttacctatctgccattccatccatcttttgttagataataagctctgacatgtgggacccacgtatgaaaatgactaaattgcccctgaagcattttcatctctgctcctctcccgagcaatttcaccctagcctagccgccgcctttatagccgccgccggtcgtcgccggcgccggcacgccgccgccgctgcctcgcctcgtctcgcgtcacctcgccagatccggcggcgcgcctaggccggctcccccaggccggctcggtgccgcaggagtacctcggcaactgcctccgcccttgcttgacatggccggcctgctcggcgccggcggcgtggtgacggcggcggcgggcatcggcgccgccatcagggggctcgacaacggcgttctggacggtgccgatgggtggttccagaagatcgtgtcgctgatgccgcaccggccgatgtccatcgccggctcgcgcggtacgccgtgtacgacaccgacttcgggctgggccggccgatgaaggtggagctcctgtccatcgacaagacgcccggcacggtgtccatggcggaggcgcgcgacggcagggtcggcatctagatcggcgtggcgctgccggagtccgacatggcgcggttcagctcatgcttcgccgacggactgaagcagctgtgaggacgaacagcttgttgcatttattgctttcttgctgctacatattgttgcagagttcagagtttgttcagtttgggtgtgattctgtaatgctagctgttgcttgaatgttgatcctataaccaagtattatttctgctttttctttttttttttgcattttcttacttatgcacgcattttttttccttatctttttacgaattttccttattttttcatatgttcatatttatttatgattttttaaaatttatttacgaatttttttcttatttattcccagttttctatttatttccataattttaaaattatttactaatttttccatatttatttcttgttttaactttattttcaattttttagaatgtttactttatttcattttccttcaacctacatttcagcctttatgcggtgtgtgagccgatttctctttcaaatgttcaatgtttcattcaaagtggctgaaatagagcaagggcaaaataaacctttaaacctccattagtctccgttagtgctgattccatccaaagtggcgcataggtaaacgaaagtttgtgtcatagtatacaggtgactcaaaacttttttgtggcacacacgtaacctctaactttcttaatggcacaggggtaaaagactccggcgatgaaggcggagaaaattgtgtggtggaggttggagaaaaaggacagcatgccactccatatggtgggtttcgacaaaatgccacccaatatattgcaaaggataaaatgccactcaataggttatctttaggatattttaccactttgaggaggtttaagacaaatatgcccctactttggagagagagagaggaagggagagagagccggagagaggagtcgaacggcagcggccgtggtcgtcggcggcgggcagcgacgagggaagaacgagcaccgtccgtgctcccgctagcagcgacgaggagagaaagaagacgccgataagcgcacaggggtggcaccggagggggtgagcgcatgcgcgggcagcgctgcagagccctccacgtcatcgtcgtcgcctcctcctccctcccgtcggcgttgcccttctccccgatcgccgccgccgtcttcctcccaatgaccacggccacaggcagcgacgagggaagaacaagcaccatctgtgctcccgctagcggcgacgaggagaggaagaagacgccggtaagcgcgcgggggtggcaccggagggggtgagcgtacgcgcgggcagcgctggagaaccctccgcgtcatcgtcgtcgcctcctcctccctcccatcggcgttgccctcctcccccatcatcgccgccatcttcctcccccatcacagtcgtcgtcttcctccctctccgccgccgtcttcctccccctgtccacctgtcgcagcccacccccgtgcgctcgccacccgccgccggcgagcattagcgtcgtccgggtcaaccttccgctcctccctcttcctctctatccacggccaggggtattttggtcttaaaatctctcaaagtggcaaaatatcctaaaagtaacctattgagtggtattttatcctttacaatgtattggatagcattttatctaaacccaccgaatggagtggcatattgtactttttctcgtggaggttgggaggaaatcatgcgattttgtttatgtattcgagtcatggtatccacagtgtgggcaaggcgatggtgggaggtgggacagattttgtttctgtatccgagtcatggtatccccagtgtgggcaaggcgatggtgggaggtgggaccgtgggagggccgtgggacgctggggatggagtatagttgatttggcctataggatcggagtggtgaactcctggattggagtggtgaactccttctttttatattagtatagataaaaattcaaggtgtttttgccgaaaaatttcataagtcacccccaaatggaaatagcgctagggttttttttcgcatggtctttttttcaacttcccaatggcgcacggttttttttactccgcctccagatcgctcccaatattttttctcagatcgatcgcatccgtagcacccaaattttatgtccgattcccaccccgatagctccctcccaaatatatacctaacctaattaaaaaaatttcgtccgcaacatcataagtccaacaaacaacaaatcatccagagtgcgcatcaaataacacacaaagttttaatccagtttatgttagatcccaaatataagaatagaagaacagcaaacggagataaaaaaaacaaatcgaacagaaatcgagcagatttttccatagccgcctctgctgccaccgcctcccatggccaaaaccggtgaaggggcgcggagtggccgccggcagtggcttgccgagctgcgctgccgacgcccgccaccaccgtcgtttcagccgagggagggaagcgagagggggcagagggagccgccgccgctgtcgccggatctgtcctccgcagccgccaccaccactggatccacccatggccgccgcgaggccgccaccgccgctagatctgccgcaggagggaggcgagagggggcggagggagccaccgccgccactgccggatccacctcctcccgccgacgccgccaccgccaccgccaccgccgccggatataccgcgggagggaggtgacaaggggttgagggagccgccgccgccgccggattcgtgccggaaggagagcgccgccggtggaggaaggggggagtggccgaggggaagcggcgctgctggtgggtcccctcccagtcgccgcgccgtgccggtgagacaggaggaagagggggagatggagcggtggcgccggtcaccggtggagggagggggagggggagcggcggcgctggtgggaggaaggttggggagaggcgctgccgccgacgttgttttgagtgagagagagatggggaagaggaaatggttttagggttagggtttgggctgctgagtatttgtatagatcgggatcaatcaggaccgtccatcagatcggatggctacggcttctcccgcgtcgggccgggcgccgttcccaggccgcccacactattgggccacatgtacgctccgcacaaataagtttactttatgtcgctcaagttgtccccgaattgttcccaggccgcccgcactattgggccacctcatggaccgcatgtacactccgcacggaataagttcactttaggtcccttcagttgaactttttttatttcaatatgtaaaactaaaccttaatcatctaatatttttatatttgttataattttagtttttcgttgcaacgcacgggtatttttatagtatatacagaaatcagaaatgcatgtactggtacaaactcttcctaggttgcaaatttgctcgactatatatgaattcttgtagccgcactgttagctagcgctaaggccatgattgagatagctaaacacgttggattgatggataatctattttttttatgatatctatttaagggataaacgaataaattaactacaacaaagttgaaaagatgctttagaaaagtattacaataaaaattatattataaaaattttgcacgaaacaaaccatctaagagcttggaagcatgcaaacaaaaacctagaatccagaatcatgaaagaacagggcctaaaagctaaagctaccaacttggggtctctcagccttgaaacataagaatgtacttgctctgagagtttgattgaagaatcacagatctctgatgccatcaaatagtactgctagacttctcttagaaaacaaaaaagaaacactgtgtgctagattagcctgttgtttggatctaccttaattttaattttaattgtcagggagataaaaaaaagaaagagaaaaggaactgtgcacgctgcacacgggcaatcagggagggagggaggtttgggatgtttttctgaatgattaatctaatgacctaaaataatgggttggatgtttaagttaaaaccaatgataatatgttttgttttcctatcatcatttttaggatttcgtctgatttaagagaacaacgtaacatagcgtttatagaatgtataatgaacttttaaaaccgcatgctgcacggaggaggaagtgagggaaggaggtttaggattttttttttaaaaaaaaatagatctaacgacctaaaataatgtctcaattgatttaaaataatgtgtccatcaatttgagtcaaaactgattgttggatgttttgtttttgtccataattaagaacatcatgtagcggattagaagcgtttatacgatgtttaatggacttttagcatacgatgtttaatggacttttagcactgcatgggggtagagggaggggaggtttgggattttttttttggaaaaaaatagatataccaacctaaaataatgtgtccatcgatttaagtcacaattttgtggatgtttttattaagaacttaccagattcttctctaatttaataatgttatgtagtggcttagaagcatatataagatgttaaatggactttaacatcatacacgggcggagggagggagagatgtttgggttgttttcttttattaaaggaaataactaacgacctaaaataagaaactgatagtcgaatactttgtttttcttagattttctagtattttatctaattcagtatcaccacgtagtgagttagaaaacattcttaaaatgacatagggagagccgctagacatagtagatagaggtctatttatgggttttttgcccataaaaataattttaatttgtcatgaagataataaaacagatgaagtaatgcaaggaaagttcgggatggggtttccggttttttttttacaaaatagatattactgtctaaatggttgaaaatcgatggtcgatttaatttattaaagtgtcatttagcgaattaaaagtgtttgtagaatagcacttaacgagtcaaattttattatatgctagcaaattgcccgtacgatgctatggaaagaattaaatcaatgcaacaataacattcggaaacaataacattcggaggaatcaaagtcctgctttaattagctattacatcagtaacaacccgcggcccccaaatcccgtcgccctcctcacaatcgactccctcaccccgattcaccactggtctcctcctctccgctgcacaatcctccctctgtcaatcgcccctcccaccccttgccctcttccaccgccgactgtcacgtcgctgccgtcgtgttatcccgccgccggtactgtagatccccgatccgttgcccgcctccactcagctgtcgccacctccacatccgggaagacatcgtcaccaccgcctccgtccgcgctgaccccatgctgtccatacccacacaccgccggtccagtgcatgggcaatgcttacagcgtagccctatactcctatattaatcacagtagggtaggtagtacaaacaaggtgcatatcagaaagcgctgaccccacgctgtccacaccgacacaccgctggtccagtgcatgggcagtgcttacaacgtagccctatactcctatattcatcacagtagggtaggtagtacaaacaagtgcatattagaaagtgattttgcacttcaaaaatatctatttgtgatatattatatagtgtaaatcaagtttaacatatatgagtcagtggcggatgtaggattttataaataggggcacgataaactaatctatttataaaacaataaattatctaagtgttataaaatattatctctaaagaaatgtaaaaaatccaatacatcataaaaaaactagactagaaataaactaaatcttattttttatatgtagatttcattgtaactagacggtaccccgcgcgttgccgcgggtgcgaacatagccatatatggacatagatgttatattcaattttatttgcaaccacttatccaatcaaatgtgcaaacatcacatagatgggcaaacatgctaaacttgattaatttattttatatgtataactgacttcacaagtcccagagatgatatgaagggaactcattttacatgacaaaaaggcaagatatatatgaaaggatatattttttttaatgggcatcaaagtgcctaatatcaagcacagaggtaacatggaaaagaatcaaagataaaactcttacattccatgatacttaaggtctccagaatcatgaattaacttggaacagggaattacagcttcaattgttggtgccctaaccattaaaatttcctttctgaaccgctgcagtttaagaaaagaacaaaaataaactcataatggtgggtattggagcaaagaaagtattaatctctcctgtagttcctcaaagcagtgcttgattatgtcaaacattacagtttcacttccagtcaacacagagccaaagaaaatacctaagaatattgcaaggtacagctatgttacatgcaagccatgtcatgccactttgctgggtcctctgaaagcagttcaagtgttaattcatatgtaaagattagtatctattttagtttttctctttatacctatagattagtatatatgttataatatcagtaattcacacctaaattatattagtatctatgatatgttctaatttacacctaaagattatactacctccatcccaaaatgtttgacgccgttgacttttttaaaaatgtttgaccgttcgtcttattaaaaaaatttaagtaattgttaattctttttctatcatttgatttattgttaaatatacttttatgtatacatatagttttacacatattacaaaagtttttgaataaaacgaacggtcaaacatgtttaaaaaagtcaacggtgtcaaacatttagggaaggagggagtagttatgtaaattaccaaaaagggaaaaatattgtgcgcagaaaaacccgggacataaatctgagatgccataaaaaaaatatatgccattacagtcgctgaatgttgcagaactacataatctggtagaaatagaacaataagttagatagtggagtcatgtttcatttgactgataactatgcaatacattttgagctataaggagaataagatagatgctgctagcagttcagtagtacctcattgggcttctatcactctattttagttcaaaagaaatagtacatgcagttggctgctacgaagccttgatgtgacaaacaaaataatttcatatttctagtatgaagatatcagtagtttagcaacagaatgtaaggataattagtacacgtgcttgaagagaccacgaaattgcagcatgtcattcttgccgaattcctgcgtttcacctcccatgcagctgcagagaccaagacagtttgctcatgagtgaaattaaggtgcaaaagataagtagaataaaccttcagtgtttgaactggattgcacaagcagtggaattaatcctaacacatagatatgcatgtttccatatagagaggtggaaagcaagtcgactaaactgcacatatggctgtgttctgaacataacctgggtataagaagcatcacttcagctgcataaaggaggcaggggcggagctaccattattcctgggtattcccaggaatacccaactttttttatcacaaaacaagtatacttctagtatatacacatgtacacatattagtgcacctaaatcctcaattcttcaatccaaacacagcccaaccggcctcttgcgacgcctccaccaacccgacccattccgtcatgacccatcagacatcagttgacccacttatccaccacccttctagacggccccctcttgctctctctccgtgacccatccctccctggctcggctcccctcgcgccgctccccatttccaaaccctaggcggcggcgcggcgaggcggcaaccggcagcgggagctggaccgtgctatcgcggagggggaggccattgccgtggcgagcggtggccgacgcccgccactccgccaatctcgggcggtcaggccggttgggtggccggtggccacgaggggcagggccagcgcctcagcgcttagacgggaatacccaactttgaaatcctggctccgctactgaaaggaggaagatgcacatgtttttttaatttgatgttgttgccccgattaatcaaaaagaaactgaaatagcaatcccacaccatttgctagacccatgcaaacagatggacttgctttctatgcataagaatgttgtggagaacaaaaatgtctgcatactgaatctataactattatttttacttttatatgtagatagtacttaccttggaggtaaaccaaagaagttcaattctataggtagaaagcactggcaacatagctgaataaattttaagaccgcatatatgtgaaccataaaagtaagcacaaaatagaaggacatctgagcaagcattttttcctgtcaatccaatctaagtgctgttttggcacaacatatctaccagaagtgtttcttcagtggaataaacctatttatcaattcataagagcacagctgaatgtagcacctgtactatagcatcagaaagttgaaagcatgaggctacgagactgtatggatagaagtaaaataaagtaaaactaaaagttatagttagatcaaactaccttcgtcaaccaaaacaaagccacgagtcttgcactgcaaactcaccagccaatcaatacttgcagatcacatttagcagagattaagtgatagaaaataaacacaaattaaatcactgtgaaaaataaaggcataaaggatggcacaaactcaacctgaaccctaggagcaactacgacggtgcgaaatcaggcaacggcgtggcagccgaggtagacatctaacgtggggaaagtttataggacaaaacaatagggtttattaagcgaatggcaacacgggtgaataaatttgagcgctgcatagatggaaactatggaagtaagctcaaacataaaaatatatctgaccaagtaacttctttgttgccaagtcagtctaagtgctattttggtaggtttctatgaaaagggccaaaatatggtctaacattgttaatgttatgataggacactctgcatagatatcgattgaagaacacatctcaacaacatatggatttagaatataagaacacgtgaatataactctgatggggtgacatacatataaatggtaggcaattgctattatatggactgatagagaggattttgacattggactcataaatcccttccataggaatgtgccatcgccgcccatatatactctttgcttgtctgatgcacactgcagacatttttataactataaatatacataaaaggctagtgaattaccttcagtcacacttgtccattgtactttgtgatacggaccaatcactgtagtaaacattcactaaatcagttaattaattaacatgtaaagcaagacataatggctatgcacattccaactggagcatgtgtatctgaggaaaaggtaatcaacaaacagaacatacatatgtgatcttagtgtttgtgcttaaaaaaataactgcaggtatcaacaaaatatgtcattctaacattgaaagttcataagcatattgtaggtaaaacatatgtaacctcatatctttagacttgatttacctcatatctttagacttgatttaccaacaccatagaaaaatagaaaaataaagtacaggctgccgctagtcatgcaaagttgatatgaaaaagagaagtgagaaaaaggattgcaaggagaactgaacaattaatttgaggaatccaatcagcaggaacacccacgtgaattttcacgttttggttaccacgtgcttatgggcggtcgatgcaccataaatcttgcaaaaccaagcctgcgaggaatgcagggaggagataaaacaacggctacagttaacactgtgacccgcaagaagacaccggcatccgcacctagcacgatgggaagcaacgatggtgatcactggccctgcacggagacagcgacggctggccctgaaagcctgagaagaaggcagcgactccggatccagccccgcgaggtcgaggggagtggaggtgctgaagagatgccggaggagcgacgcgagatggtcaccgggggcgtagaagaagctcacccggccagccgcggcggtcaagaatggcggtggacggcagtggcgttggccgcgacgaagcaggaaccctagcaggcggcggcgaagaagaataggtagcgcggaaggggatcgacagggaaaccaaaggagaaactaatcgcgacctcatgggagggtagaagcagaagaggagacggatcgttgacgcgtggcagatcagacaagaggggacggatagttgacgcgtggcagatcacacaagaggggacggatcgttgacgcgtggcagatcagacgaagtagacacgctgactagctgttggctgaacagtagtatagtaaaacagtaccatgggcaaaacttgtaggcaaaaactataaggtttatatgatgtataggcatgtactccctccgttcctaattgatcatcatattatatggatacaccaaaatttcaaatatgaataaagaattcatggtttaagttgaaagtttttaaatttaagttgaaaattttcaaatttgagttgaaagttttaaaattttgacttgaaagtttaaaaatccgagttgaaagttttaaattttaagttgattttttttaaataattgaaatttaagttgaaagtttttaaattttagttaaaagttttcaaatcttaacttgaaagtttgcaaatatgagttgaaagtttcaaattagtgttgaaagttttcaatttggaatatgaagtttctaactttgggtaatcgaaagacttaaattatatttgaaaagttacaaaaaaaacaacattgattatgcctaattatccgggaaaagaaaacaaatccagaactaaccaagctagtccaaatgctaatcgcttttttttgtatcggttttttccatagcaccgctcgtgcgttacactaacgacacatgtccgtgcgcgccagtaactcatctcgcgcgtacgcgctaattagtcttctcgcatttactcggataacaaactcgatgcatgtaccatcccattatttcctagccaatagcaaatcaaaacattgcatgatggttataaatactttgtgcaaatcaaaacattgtataatggttataaatacttgtgtgcatggatatcaatgtacatttatcgaatgcacaaataacgaatagacttaatgaatgaatacaaatatgatgatcatttggaaatattctaaaaaaatatatgatgatcaattaggaatggagggagtaactagtaaatagtgaatgtcataactcactcgaacaatatatatagtgcattatgattattggattcataacaagtgttgatcactagttcatccaaaaaaaaatatgactatatcgtttaatattattaacttttatagcattctagataatgtttagcaaaagtatctttctcttaaaaaaactagtcaaataccttttataaatataatatcattaacaaagataatagttattgtttcctcatgtaaaaacatagataatatatattatggagcacacacacatgagctagttgctactccctccgttcctaaatataagggattttagttggatgtaacgtatcctagtacagcaaatctggacaggctttatgtctagattcattgtactagaatgtgtcacatctaaccaaaatctcttatatttagagacggagggagtagtattcatgtgcaagtaatagtgctggttgtagtaatattattatcaaaaataaaaaagaatgagaaaacaagaagaagatgaaacaacagaagaatagaatataaggttaaagtttttagtttcacaccatttactacaaagaacaattttaataatattagtatattatcgattaatgtgagtatataccataccatgaatgtgagcaaccaccctcatgtgtttgcgctagtgactaacctcctctttttcttacttctttcgaagttctttgaacatatttaggtaataatgttttgttttgaataaaaaagaaacaattcaactagattattttttagagagaatccatcgtgtgccgctgactttgtccctgttctataatataccactgagtttgttaagttctacagtatgtcattgtattttgcttaaattctataatataccatcaccgtccatttaaattccattagtacttaattttgtcctaatgatcgaaatatccctaggaaaaaaatttccaaaatttggccgaaaattccgaaatatcatattataaacgagacagagaagttgcccatctcaaactttgtaagttttactatctgtatgataaaattgtataatgctaactgaggccaactagatgacaatggtatattatagaagttaagtaaaatgtgatgccatattagaacttgagaaacccaacgacatattgtagagcaaggacaaaatcagtgacacacaatgaattgtctctgttttttatagttgttcggttaactacctatctactatgatgcggcaattttagaaaaaagttaaatcttatactataagtccatatcttacacattaaattacatacacttataatataattttcaaaatataaaataccctattctcattttataggagaaatatggaaaatgatttattatctatttaattatgagaaaaatattagttcaaattaacatatatgtagaaaataaaaaacaatatgaaagaattatggaaatacctactaatgtagtcatcatatatcatgcaatgagaaaagaagaccatagtcgaatgctttattattgagcaaaaatgatggtattatttttatcatcttttagaggaatctatctaaccataattaattagcccgtgtgagtagaagtctgtatcgtcatgcatcaatatatcatgagattattagttatagctaagtacaccgacccaaccatacttagcatatcacaagactatcgggtaatggacaattatctttaattgtgctagagaaaaaagtactccttccatcccataaaaaaccaacctagaactggatgtgacacatcctagtaaaataaatctagacatgcatatgttcagatttattgtactagaatatgccacaccagttctagattcattttttgtgggacaaagggagtaaattacagtccatactacgtattcttaaaaattcttaaaagcttcatataatgttattctttaaccattctttatatttacacaatagctaactttacatttcaatttggaccaccttattctatccatctccaagtccggtgactcagcaattactccgcacattaactatctctctctctctccattttctttttccctccgatagttggataaccgatagatctagcaaggagcctagatatagttccttcgctctttgttaggtcagctcctacctcccaaagtccatgtaagcccgacatccccgacctcaacagcaaccataacaatagtgtgcatcacgataggagaggagaaaaagatttgtcggttactaaagggtaaggctgcgcatgtaaaggcaaagaggaggaacgatggtggctcatggagaaagagcggtgatggcggtgcagttagtggttgctggtggtatgaagaatttgttgtcgacacaatcacttaattttttcttaagtattgatgatacatgggtcaccagttatataaagaaatagtcctagctagttttaaaataataaaaatattgactgaattgaccattgtttcacaatggaccaggtcatggttagtcttttcaatttaggccatatatctttgcaattatttgcaacatggaccaggctgagagagttgggctggctgctaagatgacttttctactccagccatgtaattaacatcacgataagctcgagcgagcctcgatcatcacgcaaaccagaaaggggatcggcggcgctggtgaagttaggagaggaggcggtggccaggagcacaggacagtacagcttagagaaagattagagccacatacatttgggaggagttaatggattgattcatgcttgctttctcggttattttcccagcctccacctccagtggctgttggcgccgctgccggaccgggacaggtaacgggattacgattttcatttgggcagaagcaacggatgatatgattaacaggatgttatgcaggctgtagatcgatggtggaagcgcacgaagtagaagacattgccacttaattcgcagcgtggccttattcagttcatgatgcagctcacactagcattacaagaagatcaacgccattgccagtatgcctggcattacctgccggctgccgccatgcttcggagtggatggttcaccgcgcccgacagcgcgtcggcgagggtgtgaggctggataatggattggctaatagggattggtacttgccgtccaccactcacgctgttggcacaatctcctccggcgttgtcgacgtcggccttgagcccgccctacgagagccacttcatctctctactaagtaaacgcgatgttggagccgcgctggcagtgaaaaacctagattgctatacctggtccaagcaatgttaagtgaaaagtttggtatagacatggttcattatgcaacttgggtaatagttccttctttttcataatgtaacttactataccatagtgcaatttactctaaaaatattgagaaaagggcgggtatcgcgtaaaagaaaaagaaaaatctaagtctcctccgctccttgtgccgccgccaagacgaacaggggagggccgggcggcgagacgagcagagcagcggaggggaggggatcctggtgagcatccgcgtgccctttctgattcatctctctctctctcccaccccaccgggactggaatttgcttgcgttcgtgaaccctactagcttctcttctagatctggaagaagctcttttcctcctccttaatttgatagccttaaacctctcttaattcaagtaataacagtttgtttcttcacccaaacccccatgtcccaagttggatccgccgctgatatgagtttgtggctttcttcagtatagatgaaagttctcaaatatttacctgcaggggatcttaagtttgttgttcagttgagtctaggcagagtagctccgaccatggtttttctgccatcatgatcaactaagattcggttcttaaatagtatattttagaatcaaccaaaatacagtttttgcttatccttcttatatacttgatctcgtacgtttccaacgtgcacttagatatttgatctctcaagttctgaacaattaatctgcaagggggaaatgacttaactttttatcacttttctctacatgtttataattaaagctgccacaatatgaatgctccatatgtaaatgaatctgctgagtccttcttaattggtcataaggatatatttacaaaatatgtccactcatagttttttcagtgtacatgtatgagggaataacatattgagatgcttatgctgagggaagaagtgctatttttttttaaaaaaaatcgtacatgagtcatggctgtacctgacttgatgtgtgtatgatcggttttagcattaatattcaagcaaattagtgcataggtcaagttgattttttcctctataatgatagtttgtggcatttctggtgttcttgtgtgagttgtgttgttgagatgattgacaatttggtacttcctccgtttcatattataagactttctagcattgcccacattcatatatatgttaatgaatctagacatatattaatgaatctagacatatatgtgtgcctagattcattgacatctatatgaatgtgggcaatgctaaaaagtcttataacctgaaacggaggtagtactacattgaagtttatggtgatcttgtggcctgctgttcgagaagctgaaaaataaagtttgcatcacgtaccatgagattatttaacgagatggtcacattttcattgcatcaatgatttgtttatgtgttgcagtcatggaaattaatactggtgatataaggggctatgcttatgttccctctcgcaaggccgccgggtcgccattatgccgacgccacgctccgcagggggcagtggcggctctcccaccacctccgcgccgcagccgcagccacaagcggtggtggtgcgcccgacgtgttcgatgcagtgcctgccctggacgaccgcatgcggtgcagcgcgctgctcagggagcgcgcagtgggaggggaccactacgggtgcacctccctcctccggtggatgctggcccggggacttcgccccaacaggctggcgctcgctgcggcggtcaaatcgtcgtccgcgctccccgactgccgcggcggcgcggcgctcgggaggtgcctccacgggctcgctgtcaaggtcgggtacgcggatggcgcggtggtggcaaaggcggtcatggacatgtacgggaggatcgggtctctcgcggacgcccacacggtgtttgatgagatgagctgctccgacgcggtatgtaggaacatcctgatcactgcctcctcccgtgctggactttacaacgatgtgttccatttgttccgtgcaatgcttgctagtggtgtagatgagagcatgccaactgcagtcacggtcgctgtcgtccttccggtgtgcgcaaagttgagggtgctgagggctggaaggagtatccacggctatgtcatcaagactggtttggagtttgacactctgtctggaaatgctttggtatcaatgtacgcaaaatgtggtgggagcatagctatggatgatgcgcatctagcattttctacaatttgttgcaaggatgtggtttcatggaactcaatcattgcgggatattctgagaatgggttgtttgaagaagcacttgcactgtttggtcagatgatctcagaggaatgccttccaaactattcaacattggctaatgttcttcccttctgttcacttgtggagtatgggaggcactatgggaaagaaattcatggttttgtggtccgacatggtttagaaatggatatatctgttagcaatgcgctgatggcacattattccaaggtttgtgaaatgagggctgtagaatcaatatttagaagttcaaaaatgggagatatcgttacatggaacactgtcattgcgggatatgtgatgaatcggtatccctcaagggcattgaaactgtttcaggggcttttgtttgccggaatggctcctgattctgtttctcttatcagcctacttactgcttgtgcccaagtaggcaatctcagagtgggcatcagggttcatggttatatttttcgacatcctgaacttcttcaagaaacatcattaatgaatgctcttgtcagcttttacagccagtgtgacaggtttgatgctgcttttcgatcttttatcactattcagaacaaagactcagtatcctggaacgcaattctctctgcttgtgcaaacagtgaacaccatattgaacagttctttagactccttggtgaaatgtggcatgacgtaactcagtgggactctgtcacgatcttgaatattatccgcatgagtacgttctgtgggattaagatggttcaagaatctcatggatattccttgcgagtcggttatactggtgattcttcagttgcgaatgctattctagacgcatatgcaaagtgtggctacctgcatgatgcagaaacactcttcagaagccttgcaggacggaacattgttactggcaatacaatgatttcttgctacctaaaaaataattgtgtggaggatgctgagatgaccttcaaccatatggctgagaaagatttaactacatggaatctgatgagccggttgtatgcacagaacgatttgtgtgatcaagctttttgcttgttccatcagttgcaatctgaaggactaaaccctgatactataagcattacaaatattctttcggcttgcatccatctgagctcagtgcaacttgtgaaacaatgccatggttacatgcttagagcatccctagaagatattcatctagaaggagcacttcttgatgcatactctaagtgtgggaacatagccaatgcatacaacctctttcaagttagcctgcataaggaccttgtcatattcacagccatgataggagcttatgcaatgcatggaatggcagaaaaggcggtagaactattctccaaaatgcttacacttgacattaagccagaccatgtagttctgactgctcttctgtcagcctgcagtcatgcagggcttgtcgatgctggaattaagattttcaagtccatcagagagatctatggagttgaaccaacagaagagcactgtgcatgcatggttgaccttcttgcccgttctgggcgtctccaagatgcatacagttttgcgttggatatgcctcctcatgtggtcaatgccaatgcatggggctccttgctaggggcatgcaaggtccatggagaggtcaaaattggtcagcttgcagctgatcgcttgttctccatggaggctgaggacatcgggaactatgtgatcatgtcaaacatctttgcggctgatgataaatgggaaagtgttgagcatgtcaggaaactgatgaaatccaaggatatgaaaaaacctgcaggatgcagctggattgaggttgagaagacacggcatttgtttgtagccagtgatgttcagcaccaagataggttttctatctacgatgtgttgggaagtttgtatcagcaaatcagaggtacacagggagggacagaacatttagttgtgacttatgagctgtgacataaaacactcagtaaattacttggtgttctggccccgtcattgttttgggttgccaaagatctccatggaactgagtgacctttccatcacatcttccgtggtgagcttggaatctcattatttggtttgattctgttttaaccttcttgtcactgttgttcttgatgttttggtgtaacactttttctcacttatgcttgccattgtgcagagtaataagtaacagctactgatgtttttcttggaatacttacactacatatcacttgcagggattgcaatctcatatctttccaatttttttcaggacaacaaatggagacatctgcttacaaccgtgaaccggttggagtgtctttgtcagctcaaaaaaagattggttcctggcgatgcattgttcttcctgaggtaagcaatgctaagcgtgtcatttggaggcgaagcaaaatcccctccacccacaaaccgtgcgaagaaagtatttttcgctccccggaatccgctgtgacccatgagcggttgatggatttcaggggaacagctgacgcagcacagacgtccgaagctagcaaggcatcctcgtcctcacgtacgtccgatctgcccccttccacgccgtggttccgggagctgtgggtcaacgccgacaaatagttgcagccgtcgcctaaggtatgtcaaatcgagagaggagattggacgctgtggcgctgtgttctgtgtggttggtggtgcttcttgggtcatttgcaaacacctcctctaagatagcctgtctgcaaacaccactttcttaatcgagaaggtggtacttcttgattctaattgatgaatcaagaaagatggagtctagtatatacaaaatgtggtcatttgcaaagcagacagagaaaagggttgaagatctatattcagatgtgaaaaaggtaagattatacttcctctgattccatgcataagtcatctttgaattcctaactcatttccaaatataagtcataacttgaggcaccttttactctcattttttttccttctttgtcctttatgaatacatgttaccactcgtgaacatgtccccactgtgtataaatgaagggcaacgagctgatttcatcactttcttaatccttgtgcacaagtataaaaaaccatttgtatttggaatcagagtctcagaggaagtatatattatcatttgttttgacattcatgtgaacatagatctaaggcagaaatgttgtatttcttctgggtacggctgctgctcagtctgaactacttattagctttatagttggtggttaatttacatgtgcctgacaggaggttgctgttggtagccatccttactttttttaaataaaacaaatgttccagatgagatataatttttggagacaccagggtaaagagaactgtgggaaattctagaataatatacccaaaaataaaatcccttttgtttcttgaaaacacaggactacgcttcattttattaagaagaagaaatatgtacaaacgagggatccaaaaggacccctcaatacccccaaaaaaaacgtcacaaaaggtgttgcttgactaaaatcccttatgagaaagctaataagtgaaatataaaatagtattggccaagtggagtactttcacgttcgtctttcctatatccaattcagcactccactggaaattctgtgtgcccctacttcacttcagcttggtagtttcccccacctttccaggaaatctgggatagaatactttatgcccaatcattccaactaactatttcatcctgtcttagcgtagcttttggcacaaaattagctgatgcttattcctcagataatattcctctgaaaacatgaaaacattccatctaactatttcagatggtcataatccttttgtatttctttggcaagccgttttgtactaaaacctgccctaatgtgcttgtgtgagtccttttggactcttttccttcttattaatataatgatgtgcagctctcctgtgtgttcgagaaaaaaaaacttgaaaacattgttgggtttgaccaatgattaaggactgccacgatcatcaactgctacagtttaactagttaagaggttccgagatactccctccatacccataaaggaagtcgtttaggacgcgacacggtctccaaaacacaactttgacttcttgtttctataaaaatatttattaaaaagtgatatatgtatacttttatgaaagtatttttcaagacaaatatattcatataatttttacattttcaaactcaacaacttgagagttatttatgatttatattcccaaggtttgacttaaatattgtcctaaacgacttcctttatgagtacggagggagtatgtaattgccaatttgccaagtgctattgctctgtgaagtgttctgaaatgttcaacacctcaacattcaaagtctctacatatttctatatgtactggcatggtagttttcattcatactatggaagctaaatagaactgtgtggcatctgcagataacagtgtcctattgcttgcatatgagagtagtaaataatttgattttgttgcgaaatacatgtgcttgacatgtatgcttgctgttaggttgatatcacccttatacaatgttccagataagataattgttcgatgcaccacattagaatttttttcctggcaacttcttttatgatatagcaaaataaaagtattaaaagtaaataaaatgctttattcatcaaagaacttgaaaatattcatatggatttgagtagggaagtgttatgatgatctccaacattcctgcagatattaaaatttctaaatttatattgtttctttttctttgtgcaattttctccaactacttagcagctaatcatgccttatctatgttttcgttaaagcagtgaacagaacatatgagcataatctgaacagttacttcagtgttaagggatgcttttgggcatgtgtttaacagtactgatttcattccatttcatttttataggcgaagatgaacttgatgaaggaatctaaacattcagtagatccagaagctcccttgctcatagcatagacccttgaattttattgaatagttagtttatgaaactttcgttactgaatatatgccagggtgtgcccccaagaatcacgtatttttggaatttgaaatgaaatagtaccaaacaaatttggagagtgatgaacttttttctttagtgactaatgttttatatttttgtcaagtgccatgtttcgtgctaactttcctaaactttacatatctctagacgtgagagaatgttcaaataactgatcatcaccgtaaggcggcaaagccgcggcaagttttctacttcttccgacccaaaatattgctagtagtatatatgtggttgttttttaagaaagaccctacgtttccctgttttagagcgctatccttataagcggaattttcgcttcttgggattgtatttctgtcaaagacgagtagttttccggataaaacacaccggtgccttagtcggttcgagggtatatgcatattcagtgtaaatgtgaggagttttttttttgcaaaaatactaccacgcgtcttttccttcgcggatgtacacggccgtgcttaggctaacccacgaaacccacttataagctaaaataagccgcaagtccgtttattttgatctataagtgggttcgcggctgacccacttacaccccttgcgtgctaaaacagcgcaatgaccagttgaatggcgtgttgccgattcctctcacccgatcgagtcatgctccagagcaatacaaacgtggcagcatctcaagacgccaaaaaattttaaaaaaaaagaaaggagaaaaaaaaaacgtggcagcatcccgaggcgcccaaaaaaataaaataaagagaaaaatggtagctttagtggtttattaattcatgattacatgtgaaactttgataatatatcgtatattaatatatttatattgttttattgaactgtataatagtacaccagtatcgactgtactagaacactatattccaagtaggtgtgggtattcggtctgaccgaaaatttcagtctcggtatttggtctttatgttagttcgtctttaaaaagtgaagaccgaatttcaacacaaaaatatcagtcctgaccgaaattcagtaacattttcatatatgcaaagaaataattgaaattttcaacacaaaaatcacaaaaaaaatcgcaaacacgtatgagaagactcttattaggttacatgcctgaataagtagagatgtgaaaattagagtttaatcctattgaacttagtggattataggttgtattttgacaatttttttaaatttggccttttcagttaaccaatgagactaaccggatttaccatacaaaattcagtcttttattacttaggactaaattggtctcggtctttcagttcagtctttttctactaacccctaattccaagagccaaacctcagtctttttggtttgttttttttttctcacccctaattccaagagccaaaccgggatggcctcccgaatggaattgacaaacttggatcagacggcggaagcttagcaaaaatttacaaatgcttgaaataagcataacaaataggcaaattttgctacaggacatcgcaactttgtggttttgactgtaggacaccgcacgaagtcacttttgggaaagaatactctcaaaagttgaatatttgctggtggacatcgcacccattaaaataatattttttggttgaggagacagaaatcacgtgaaagtaatgaatgcccttgggccacatgtcggatccctcctcctcgattctgagctcacgcgacaagtccaaccaccgtggcgatggatttctccggcggcgccggcgcgacgttgctggagatgtaccagaacgcgtggctgctgctgctgctggtctgccggtgccacccggacgcgtgccccaccctcgtcgctacccccagtatggcagaggccttccgagcccacctcattgcggatggctgttgacacgggttttggctcgtgtcctaaatataaatataatttgttaaattataaactaatatattatcttaaatatagtgcgtacaaaatatatataataataaataagaattttattgggagacagatggtgaagtaatttaaataaatagcggccacgaaataaatggccatgaaataaaatataattcacttatattggacaaaaataatttttggcttaaaataggaatgcatatacgcgttccacataaatatagcgtgaacaaatatttttcatgcgcttttcgtcggaccggcgaacgctaatacttagctttctcgtcgtatccgcatacgaaatttggcctaaaacatatggccatgaagtgggattttctcactacctcgaaatagtcacaccccgaatattttcagaaaaggcgtactcaccatataaaatagcatacaaaaattaaaatgtaagccaaaatagatgtttagctggctagtgaaaaaattatactctaaatagtcgtgacttaaaataaaaatgcatgttacatgcgcgccaaattaaagggggtcgcgtttgacattatccaatatttttatctcgatgtctagatgttggcttgagaaagccaccgtgataatatgcatgtcaagacgcgatgcgtgtcgtataaaataaatttacggcagtgacagtccgctcgatagaaaatgatgcactagaatatatacgtgtgcctctttaaaaaaaagagaaaagactcatatccaaagtgtttataaaagtaaataaataaataaattgaggcgcccaattaaatgggagtatatgcagtcaaaatataggacatacagaatagtcatgcatgcaaaaaaaataaaatttgaaatcaagaaagagacacgcatgtatttacaaacaactgaaatttaaagaaaaaaaatcagtcaagtccaaagggcccacacgtcagtgaaagcaaagagacaagtggtcaagcccataacctacccacgatcaccactaatcatgcatgcatgcagcaaataccagcacattcgtcccgtcaaactgaacgggcccacatatcagccaaagggatgtgcatgcagtcaagccattgcccacaaccaccccacgatctctgcgcgcgcgcgggatcctgttcaaaatcacataaagcaaattaaccccctttaatcctcctcgataaatagaggatcagggctagaggcaaaggggagttcgctggggagaggttccaagaaggttggtgtgagggctggctaaggcgaaaggctgctgtgctgaatcgctgctattacctccgtcccatattacttatctttttgagtttttgtttgtcaatgtttgatcattcgtcttattcaaaaaattttggaattattatttattttgtttgtcaatggctttattatcaaaaatactttacatatgacttatctttttttatatttgcactaatttttcaaataaaacgaatggtcaaacgttgcaaataaaaagtcaaaaacgtcacctattatgggacagagggagtagttcgctactgcaaagcaattgccgccgtgctagtttctcgctctgctgtgccggaagaataagaggtgttccaaggtgggaatcatgatcctccttcgttcttaggctcggccattgtgtacgagtcgaggaatctctcaattctccttcctctgctcgtgttaatgtatttttttgctgtctttcggttcggccaatgagtacgaactagggaattatgttcttgacatgttcctaggcttggccatcatgagtacaagccaaaggaatttttcctctttgttgtgtccttcgtctcagccaacgcgtatgagacaaggaagttcgtttcatttgatggcttttaacatgatttcacactttctcctatggtccggccagatgaatacggacctaggagtggtttccatgcatattcttttcatgtcatcctaccataccctctgatttggtcccgttagcagatacaagcctaggcgagattctcgctctcaggttcggtcctctacgagccgatacaaatcacagatacaaacataaattttgcataattcaccataagttaaataagcacttgcttcggtcacgcttcatagcttcaagccgtgctagtagtgatacaggcatagtgataaacaaaattaattgagcatattaattagcacacatatttgctagttttgaacatatgttcagccatatttctctaacaagaattaaaataaaatggcgtttattttctttcccgtcatcaatggcatcggcgatggggctagccggcgtccacgcgctcccgttccacccacggagtacagcttcccagccggcgtcgagctccatcgtgctcccctgcgctcggaggcggaggggcgcggtctggtggtgtggtgttgggcacgccaccagcggaggagcgccgctgtggatgtggccaaggtaggccgcgcgcgctcagcggcggggcgccgccgctgagcgggtcgctcgtgctccaggcgccgccatcgagcaggctgatgtcgcccaagggagaagcgagaaaagaggaagagagaggaagagataaggggtaatttagtcaacatgaaaacattaatttaatggatggagtgtgagtgtctcctgagaaataaccacatttacaaagcgtgttcctccaaaagtgacttcgcgtggtgccctacagctaaaaccacaaagtcgcaaatgtctggtagcaaaatttgcccaacaaataaaattcttttgctcgagactatacaacgatttgtcaggtctatcggtttctggaattgtagggacaaaccaaaatgatatcaggatgcttcgccaagttcagagtacatctttgaaccaaagatgaattgatgattagttactttaatcattggcatttggtaccccgtcaaggaataaaagactacacaacgaaaaatacaaggggaacaataaatacctctgccattgaaaagaaaagggttagcattgtgtgctttctaaaatacaagttaagttgattaaagattacatgtacaattctgtaattacagcatcgtgatgacttgacagcagcaacatggttgtgttgatttacatcttccaactccctctgcacagacctgaattaagttgcaaatggcaatccattaaaactagtcactttggcgggaaagaatataatagcacaggtgtaacacaggtcagctatatggtcagtttgcaacaaaaaaaaaagtacccaatgcagaaacgttagcaacaacgtatataagtttgtgtccttgggtatataattactatatataagctcataattattattccttatataattactatatacaaggaataaagggcaatttgttcctgaacataccaagccgtgctggcaaactggtcgcgacaaaattcccagaacaaaacagctagcctgtttcactgactcctttactccctcgagcaaaaattaaaaatattgatttgaagcaggttttatatttctgggccatctattattctgtgcagggtaatttctacttttagcgtggcagaaattttattgataaatctcatgcacatacaaagataatgaattcatattaatcatacccagcagcagagaagcaaatacatacacctatatagcatgagtattatggtatattataaggaaattttggtttggtgacaccaaaagattaccgtctttgttttataccactgattcacatgagcactttaataccatccaaagatcactcatgttcctcttaacatcattccatccaaataccattccatccaaggctaagctcgcaacagccataaaacgatttcggcactacaatttggcctggctaatccagacagatcaatttaagtgtgaaagctggtatcggacctctcaagacaaacctttaccaaaaaaagatctggtaaccggagaactttgtaatgaagactaagtttgaagagaaagatattagattggggggtctatggtaatcggagaactttgtaacgaagacagagtttgaagagaaagatatcagcttggggggtctaaagtgtgtgcccaactctgaccaccctcatgttttgtctgtctccactctacattgttgcagccaaccctagggagaggatgaggtggtgcagagacatggcaggatgcttaacatgatggcaaaggtgaatgggtggtgctggcaattaagagggaagagatgaggacacgtatccaacacagtcttcactggcaacaccaagatcaaggacctctgcactgacaagctttgacaagcttttcacctcgctgcagccatgaaaagtaggcatcccgcatgaagacccaccaccaagcacaccatcgccattactccgactaatgagtaatgtgtggtatgttcatcgcctcactgtgcatagagatcgagcagctccagaaactcaagctttctagcacacagtggcactgcacattgctaacaatgagtaatgtgtggtatgtttgtgtttcaatgtccatctgcactgaagataggagggaaagccaagatgccaatgaatgttatttcatctaacataattgcttttggtaaaaagaaggcttggatggaatggtattaaggagcaatagggatcttttgatgatatcaatgtcggtgggtttagtggaacaaaacaagatgggtaatcttagactgtcaccaaaccaaattacgcaacagttccatacctatccccaaggcactctagcaaactcatttgagaatctgccatgactttgctgaaatctgatgatttccttgaggctcacttgtacaatgataaactttgcagaggaaaattcctgtagtgacaaccaatcatgatttcagtcaccagcaagccaaccagaaaaggcatatttggtcatagtatcacctatagacagaaagtttgattatacttcatgaccaaaaggaacagaaacagcaaagtgtccctccaaccagtgaactggataacgtttgaggccaggaatgcaacagacacagaaaaaaaattgagatgttgataaatggtaattacctggagaagtacacataacacatggcaaccaatcgttcagccttccagcgcatatctctgaatctacaacaaagaaaggaacataccgttatatcgattttattagaccgaatatgagcacataatagcagcactatcattatcaaacctgttgacacaatagcattaaattaaatgaggtacaagcaaaaggaaagattttcacggaaataaataaactcctaacaaggcttgtatctggacaggtcacaggtgtctggttgctgcccctaagtttgccctattaatagataccatattaataaaatatgagataggacactaatttatgagaatcttgctagtttcagcagaagtgagccaaatgcatacaatctgattaaaattgcaaaagatctagcaaccataactgggccaccattggcttcaaatgtattaagtagcaaatcatacaggttatcaagtaaaactaagtttgtggtggctaaatgtccacgacaaaagtcttaactattaacatgaatagaagactccaaaaagtgatgattgcccaactgaaaatccatggtcaataatttatttacagttccctggaaataatgaggtaagacaattttgacctatttgtgatggataatgccaatttctgtactccattatcgtgtgcttaaagatatattagagttatcatgaaaatcggagtgaactgttgcatcatttatgacttgttcagaaaacatccccgttgttaaatttcggcccattgttaaatttcggccaattgtcatgctgtttagttccaactttatttcgtaccagattactgtaaagtggaaactcgctgatagcatggacttggtaacacatgccccttagtgggttggagctcggacacagacccagtaaaactctaaagggctgtttggtttgaggaatggccgaatgagattgtcaattgaccacttgatcctaaataagtttggtttgcggaatgaaatgtggtcatcatatatactaagtgggaaaaatgaggaatactagtcattgaaccaaatttgaggaacgatcttacgatggaccgaattctgatcaaaccaaacaacccataataacatggactatcttgtcttagctttgcatatttgaacctatagttacttataaaaaaaaagtgattgaccttgataaatcaaaaaccacataactagtttaaaaaaatctgcatccatatggcaaagtgccactcaaactgattatcttaggctcaacaaccaagataaagcaactagtttatttgtgaagacaacatgattcgtgctttgtaaatttcttaaagcccagagccagcattgaacgagtccatgcataatagcaactagttcatactttcatccagacataacccatgatagttaaatccagaattcctacatttagaaatgtaaatgctggttaaacatccactaaacttccagtgtagagaatgaaaccaccaccagacacatgggccacgagaaatgcataaaatatggctgtggtggtacaatataagactaagtaaaccagataattaacaaggtatgaccagggatcggaatcccggcgataaccagcacagttaccgctccagagccaccagctagtatccaacgtacaggccagaataattcaattttaaattataaatcatacgaactgtatatattcttgcaacatcatttgtaacagagaagtgtaacaaccgaaaaggagagacgcattcaataggggaaatctaaaaagagccttgttgcttgtttctgcagctcgaggcagtctagtcaatgtcacctgccatcatagatcggaatcccaacagtaaccagctggtaaccgttcaggatctgctggctagcaggtatctggcataccagccagaataaaacaaaattttaatacaaactgtatattttcttgcagtgacatgtgtaagtacatttgaattatatgatagagtaggaaaaaaataggcacattcaacgaggaaaataggaaataaaatatgaaactcccatcactcgtcactgcagctcaagcccttttcaatcaacgcctcttgccgtcatacggttagatacaaccgatgtcttggttatacatatatttcacaaaaagaatatagactgttggatttgatacaaaccatttcactacaaaagattgcattttgaccattttggtcaaattgtgatgcattgatgtattttatgtgccaaccggttttggaattcaaatatttggactcaaacatgtcccataactggagggaccagtattttcttttcgaaaccggtattcaaaatgttatgttagatgaaacaggtatcttggttatatatattgtgcaaaaggaatatggaatattgtagtattaaatatgcatgtcactacagttttaattttgacagtttcaatctaattgtgatgtattaacgtatcttatatgacaaatctatgaaaattacacattacacatgccaattaaattgaattcaaaatacgactgccagtctttaggattcaaaaccttggatatgacaactggggaaaaaaggactacctcaagcatattttcctcgataaagcaattcaaccctgtgcttgtgatatctgcaccattgtgctgcaagatcctgagctttccttcctgatgcaaatgtgtgagtgcatgaattagcaaagcaaatatatgttgtgtactgttgattgatctaatttgctatttaccttggtcccataaacaagaccacctccaggggaaggatgaaagcatgcaacgtttacttcatcttcagcactaggaagaactcttaccagctccatgtccgatactctatagacctaacgtgatgaataggaataatgagattaaggcttcattcataagtaagaactgagcttgtaagtggcacagaaaccggagcaagcaattaacacatgattaattaataactaaatattataaatttgaaaaaagggttcatttgaatttttaaagaaacttttatataaaaacattttgcaaaaaatacaccgtatagcagtttgggaagcgtgctaacggaaaatgaggaagttgaagtttagaacagggcctaaatcatattgttagtcatacagaaacaaaaggacactaggagttacaaactataataagaaaattgttcagactgaaatatttaaaataagcagcaaaaacagaatttccagtattttcactgatatgcttatgcataatctaactatatgtacctccaagatagtatatacaggaattccagtttccccatccatcacaatgctcctaagcatagagttatgacgacgaccatatgccaatagtatgtgctctgaagtgggtgagaactgcagaaaaacaagtgctcaccaaattaactgatgaagaaagttgttgaatttcatatcaatatttctcaagtttaggtcaaaaatgcaaaagccagtcaactttataatgctgctactggacaatgcttgagacacaagccacaagttcgacagcaattatctgaggtatataatatgtttctgctcccagtagaagggtggcagcagagatgcctgcttatcttttgcagcactaaaaaaccaacaaacacacaaacaaatgagatgttaacctggatggaagttaagcaatgagctgcccttatcgctcttgatgtaagaactttgccaaacctgtaaggaaaatacattcacaatttcaaaataactagaacgtttacaaatgagaaacctagcaaaagagcatactatgtaacaagactgttgagaaaattacgttgcctcctcaagagagtaaactcggagctcataaataactcggtgagaagggagagggtgacgagttggtgatgttccggcccctgcagaatcatactgcacaggcaattggctaccacggtcgccttcagtttgaggcagcaaacaggcaacacatgctaccagaaatcgtccacaaggggaaaaatgggcacccatttcactgcaataattattaactttagagtaagcaaagaagggtcaacaatccactgcacagtttgtcaaaaataaaatacgcacttcatgtcaaacatctaaaagatactccctccgtctaacaatgtttttccacagcaccccatgcgctcaaaccaaggaagtacaaaatctaagaaaaatttaacgagaaaaaaacatgcatagcaaaatgcaaccattttacccatttcaaagcatttaatgagtgaaaacattgtaataaccacattcttggttttcttaatggacaaacattgtgaaacagaacagtaagtttttgttgttgctgcacaccataacttatccacttatgtacatattcaggcaaagcaatacaggaaacaacagaaaggaaataaaagtttgtgttgtgcaggaaaaatgtgaatacaagaaaaccaaaagtacaatgaagcacctgcagagaacggcatgagaaattgtcaaccggcatgcctcgggttccaatgtaacacatggatccttgatatcatgccgccatattctaagcttcactgtgcaaggtaattcagcagctccagcagcaagcagtgaggtagtaagttcagatccaacacctaatgatgcagcatgaacctcagcttcatcaatttgggggcctagaagtgaactcccaaccccacgtaatgagcccacaacatgacgacgagaagcatgatgtcgatttgatcctctagaactgccgacatcaatcggaatagatggagaagcacctgcaagttcaattacacagtttaatcagtctcagcagtgccagtaccacaagaaggtaggcctccagtacaaaggcatcatcatttggaaggtgcagggtgcaaacctgtatgattttgggccatgaaccagccctgcaaaaagggaagctcccagctacgcgagtcactgaagagatcatgatgatgatttccaccctctgaatttcttaggatcatgtgaacatctaatccactagaagtggtaaacgaattcattggcataccatgacggccatcatgttctgaaggctgagatgttgctggaatcggcacgctgttgctcagggagggcatttgcacatcatctctagcagtagaactctcatgattactagtggagctactgcccagtaatctggagctaggttgccccctgtcaatctgcatttcaactccacttaaaccagatgcagaagcatgagaagtagatggttctccagggcacacatccataggcgtgacaagttggtcaggctgttgattttcaacatctgatgccaatggattttgagctaaagatgatggtctctgatgcacattggttgaactactaaccaagtcattgcgaatcagacataaacttccatcatccctgaggtatgcaggccaaagcaagcaaggtgatgatgaattagcctcatgatgtggacagtttctggaattaatatttgcaaaaaacacagccgagggatagtttgaatagcccgaagaggttgcaagggtcaatggtgagtccgcagaatcaagattattaacctgaaattgaatatctgcataagatcaatcggtacatgaaattatgcaaagaaagcaaaaaatgcagaaaacagtactacctccgtcccagaatgagttttagggttggacatgggtattaagaaagcaggtggaattaaatgtgggaaggttgtgattggttgagaagagaatgtaggtagagaagttgttatattttgggactgagggagtatattatttctacctctgcagtaagaagatatggagcaccatgggggtgaaaatggacagctcttagtgagcggcgggttcttaatataatggttggagcagcagcctcatctcttttattgtagttccatatgtacagctggcacaatacattgcattgagcactatatgttatttgatcattgttcataaaacaagcacagaaagacttcctttttttttcaaatttaacactataatctcactttgtgacctgatgcaactgccagaatctccccccttgcatgaaatgctattgatgcaattggccgatctatcaaataagagaacatcactgaaaaggttagtattcagatttcacccatggaaggagacatactcattaggatctgcttagatatattacggaagtcctgagatccaatacagtctgaggttttagcgtcccaaagacggacttcctgatccaaactaccgctagcaaggatatcaggaagtaatggatggtatctaacctgaaatagaacagaagaaactcaaaataataagtggcaaataagactgcaaaaacagcatttatgcatttttatgtaaaacatatataaaatgctccctatggactaagctgccaagtggtggataaggatatgggtacaaacatgacatgctgatataaggcctgatggttagtaaaaatatcagtacttgagttgtttatttaaaggtcattgtgacttaaccccaagtcattttggtttatcagcaccccctgtaaatcattgtaccatccaaaagtgcaactatatcccctacaacagtgccccccaaccccccaatctatcttccccttattgcgctacgggtggtaatggtaaattagtaggacccatgtggcgtgcaacacatgatgatagcagaacagctgattgtgacgatttgatgaaatatcccccaacaaattggtcaagtgaatcgtgaaattacaggcaacagtgagggacagggttattacagactgaaacgactttgagggtgccaataaaccaaaattacttgtaggaaggtaggtaacaaaagcagtgacttgtagcagggacagggtaagatttatcctttatctataagagcttgtagcacacattctggaacatgatgacagtgttcataatcataccacccaaggcgtgcgccgatgtccactcagcactttcaaacatttcccagtttgatagtcaattattttaacagtatgatcaccactgctcaaaagagatggagttagtccacatgccttcactttaatccttatattccgcaaataataaacttactgtgtagatgcaagtgttttcccatctgggctgaatgcagctgcgatagtagacctggggggtggcaaaagaggacaatatttggcagaccagtgatgcagggactgtgattctgccctgtatacagaaaaggtttcattccagggaaaagttaggtataagagtgagagtacaaaactatgtaactcaacagttaaaatagacaatgaagaatagttcatagggtttataaatatttaccaaagaaatattaggtgtaaaatcgaaagtacaatatatgtaactcaatcattactacagacatgacaaattgtgcttaaaccatcctggtaaagtaagaccccgtaccatgaatatatatcatgtttagcatctgtagctgcatatcttagttcattggaatcagcatcatttcctggagatttgctccaaagttttttagcttggtgttttgttcgaggggaaatctctcgctgagctaatagatcgaagatgttcctgacaataatgggcaaaccaaaggttatatatttaacaagtgatctcatattataatgccattagaaaacaggttactgaaaatgtttttatattatccagaagatgacccctcatgcagtttatttttggagggggccatggggataccacaatggctcaatggtggcattaacactgatggtgctactctatcagggagttgcatttgccattaagctattcccgcagtacttaagtattatgataacaacaatgtgttggtcaaaggagcttttgcaaattacattcaagatgaatgttaccctgaaattggttaggcataatgctaatgttatagtccaataggccataacattatcaaaatactaatgctaattcatgtggtattgaccttttgacatttctaccagtggagacgacacttaatccaacacagctgacctctaggtgaagtggtgtaacagtatgcagaatatattcccatagctttggtccattttctggaacaaatatgtgaggttcttttcacaaatgttgttttaaaagggctttgtatgctaacaaatactgtaccaagagtagaagaagataaataaggccagggtgctaatcaaacttaataagtcacaagagggtttgcagatataattccacctttactgtgtcaaatattgcacatggatgcaatattggttccaaacacagaatcaaaagaaagaatacattttatcaattgaattgtaacagttagtttctcataggattgtaccaacttctctagcagaaaactaaatgatgatgttaagtagacaattacctttgcctagatcttgcagatgttgcttgatatctagaatacgatgcttgtgcagaagcatgctttgaaccttctgcccaatgttcagccatttcaggccttcaatatatatatgcacctaaaaattaattgaaccaaccagatacaacaagatgtaaaatgttaatgaaattgtatgatatataacagaagttaagtaagaagtttttagaacaattcttcagaaaaacactgacacaaacatcccaaaatccaacatatgaaaatcagaaaatgcagtatactccaattaaaaattagaaaacagcacatcaagagtgactggacacgaacaacctaccatttgatagattccctatggtaaccagtgtgtggtagatataacttgccacagatgcttagattatcatttgaccttaggtcacctcgcacaatgttcttctgtttgagatattcacaaaattgtactacagaacatccagctccagcagcagtgctgccaaaggcaaacaaggtgcacacatgcacaatagcgagatgcagcaaagaaaatgcatctcaaattatccaaagcacggtgcactatgcaagtcatgctctactagcagccaggcgctaaggcaccaaagaacatttctcatcaaaagactgcttagaatataaaaccaagcccaactagaaacggttgcttcaaactaccaagttttagtgagtctgctagatagtaagaaaatcatatttatgacataatattgccaattttgataaaaataaaagtgacatggcatgctatatatattcaacggtttagttatttctagtaggttaaaagagctaaggtttcatctcattagattttattttggtgaactgtgcactcgttggaaatactctctgcacatgatatttcagggatggatcacatctttttgtgctttgagctgtaggcaattatggacctagcatattaagtgtaaattttgcaaacaggcttgtacagcagtgtgcatattcattaagatgggtttttcattgaaaaatttgaaaacttgtcatcaaacacttgctctttaagtttattctgcatatgttgtgtgtttcagggatgcttgccattgccaacagatttcataacacatttgatgtcctgctcttgtgagttaagaatgcatgggaacaatgcaaacaaaaagaatttcaattcttacttttggacaagtacaatttattcattggtaaaaacatggagagcaagtcagtccaaggaaggcctacattctgagctcacatcctatgccaaaaatgcataaagcaaggatagatcaacagctcagcaatgaatcattaagggtgtgtttggttgcttgcattttcctagcctggctcatctctctcatcctggttgagtctagcctggatgaagagatacacatgcaactgtttggttgtttgcatcagtttagcccggttgggatgagattttgtttggttgagtgcatgagagatgcggtttggaaaagattttgtttggttggttggatagatttgagtctagttacctcttcatttagttgggtgaggttacctacaaaaatttcaaatctagacaataggtataaacaatttttcacatacaaagaataatattggcatcaaaaatcacccggcattctctgcaccaaaagtgaaatttcttgagttctcaaaaaataaaaagtcaacaaaacttcctccaccatttgatagcaaagcgctggaaaaaaaaaagaaaaaaaaagagagagaagcgtttgtcctcctccttgttgtcgaggagatgagttcttgcctcatcgccgccagccgttcccagctcctctgtcgccggccagtaccatgctcctcgctggcctctcatcctgatctgacatgcgcgctcctctgctcttctctcagtagaaaatagaacagagaaaacaaaaaaaaaaaccctcaatctcatcgttgacttgcttcatcggcgctcccagctgctcaacgccaccatggtcaccggatctggtggcctggcggtcggagaaggcagttgtggcgacagaaaagagaggcagcgcatcgacgcgatggagatggcaagggatgtaatagcggcagtagcttctccactggggtcggccgagggagctcgaggtcagctgccagtccaccaccggagaagacgccaaacgagcggtgaccgcaggggatttggtggcggcagcggcaagggagagaggggaagaggagagcaattgagaatgggaagatgaaaatgagagggaggaggtgagcggatgctagacccctgccacgcacgtgcacgcactgatgcaacgcttgcacccgcgctgcatccaccttgcatcgagtgagccaggctgaggagcgaagaagaaatcggccgtttctctcgggcctggctaacctacttttgcatgaactcagccaggctccaaagggcatgcagttaaccaaacaagcggacgcgtctgcatctcccatgcgagccagggtagatccaggcaaccaaagagcccctaagactaccaatatggttcatatctgatatgcacatgaaaggaaaattgatacagtaatacaatatgctaaaacaaccagaccgatgaaaacaaaaaagttagatgcattgccacacaccaaaaaactaccgtatagattcctataggggtgaaagagtctagcggcgaaccaccaagatcaaacccctacagttagttaacatcatatgccaactgccaacatgccaaaaatacccagcttacaagtcaaaacagctccacaagaacccaatcaccatgtaacccgatctcgcctcgccttctacctcgagcttgtccgcttggggctggcggatgcatctaggaggctaggatcataggaaattcaggaaccctccgcacgcccaaaacagaacatatctgccacgaaccctacggacggattgcatcctagcatcgaacaaatccgggggaccaatccaatctaatccaatccaacagcgcactccgacaacgaatcgcacgggatcccaaaacaagtattccatttctcagcggggcacacgcggcggaaccaaacaatcagaagctagggcttaccacgacgaggggatgcctggaaaccgggcggatctggttgcccggcggtgcggagaggcaggggggacgaggggcgggagaccgaggccgcggcaagggaggggggcgcgggggaacggaaggggtcggttctgcggtcgccggcgaaagacgccggggagcgggcggcggcggcggcggcggcgaggtgggggtgggggggtgggggggggaggaggggatggggtgggggcaatcgggtgcttttgccctcgtctctttttctcgttgcgcttaggacgctttggtgggagggcgtcaagagcgagtcgagccgagaaaggggagacgacgcggctccaccgtggaaggggcgatacgatagcgcgtcctttcccaccgttggatggtgggcatcaacggctctcttttttttctttttcgatctcatatggggagtatattttagagaacgctaaccatattgtgataataaaatatctatatcgggcttttttccattaactcgcttacacttgtgactccctctctcttggacccccttacctttctcccacactcacacaggagggcggcggcgtcccaaccttcgtctccatcgacattgtttctctggtctgccgtcgttgccgccaagaaaccccgagcgccattgctcccgcttcgtcggcattgacatcgtttctcccacctgccaccgctgggcgggaatcctcgagccttgtcgcccctgcttcgtcgccagcgatgtcgtttcttcagccttgtcctccgctagtggcaaagttgtttcagagctctttagtttggcctacccctcctctgccatcactacaggataggaagaagacaatgtattttttatgggtggtatattttgcgaattttttaatgtttcagccaatgtatcttgatgtttttttttgtgttggattaaatgttgcagtgggattttttatagtgtttcaatttgtctctgattcttgtggatttgttgatgtttcagtaattgaagcttgatgtttcatattcaatccatggttcaaccgtatttcatataaaatatgtgttaagatagtggtggaatattcttccacaagtactggaaatagagggctgaaatagcgccctctgtatgtttttctatatttctacaacaaaaatgattttacatgagtgtaagaccagtgaaactgatattttcctcctcatagataaaaattcaattagtaatcaataatatttgctttctatactatgagcacacttataaagacagatatagtagatacgaattctctaaagctttggcttttttctcgtgacatcctatgtatgcatgtgatagatatcctctaacatcaaatattatcaaatattatgtctcatcctcgtcatcctctagtttttaaaggctatagctatgatggtagcatcggcaagttaaaacgaactacaaggaggtaaatcgtggatttgtatccttgtagacttgaggatttgttttcatgattatcggcctgtagcctgatcatcagttactatattattaacgtggttgttcatcaattactatattactaatgtggttgttttagcatactatatacttactttatgttaatatagtaccatgcaccgcgtggtatttttgaacaagtagctagtagctcgtaaaagggacgaggtacatgctctaagatcaaaagggatggagagtataatggcaagtcattagaccacatttgcgcaaaagaagtatggcaaaatgtgctgggtcctttaaccctatattagacatgctcaaatgtggagttaagctcaacttagggatcaggtggaaataaaaactcccaaacccgatgttgggacaatagaagaagctttttctcatgtgcaccatatatctcgctctcggtcacaaacactaccttgaacatccacaacaacataggaatcatgaacttttgtgtcatcaggccaaggaattcttcacagcacgaacatcacaggaatcatacatgttcacctcagcgccatggcactccctttccctagaatgtctacctgcccacttcccttcacttccatcatgtcttctacatgaaaacgaccgtccatctcatgcaggtggttgcagttaatacacaaatcatggagaagaaaagcgttgctacaacataataggaatttagaagttgtttgtcaaattctattggtccaacctttagagggtagcggagtaatcccatatggaaccgaaagggtcaccatgttggatcaaagacgcaataagaaaccaattcaaatgtgacaattgaacattgtgaagatccagcttttttaatatataatgattaaatttggatgaagggagtttgaatatagtcacctccttctaaggctacgttcggaacaattgcctaacttgactctaatgttttccatacacacgctatccaaacggttaaacaatgcattttttaaaagtaatatttatagaaaagtgcttaaaaaaccatattaattgattttttaagtttattaagctaatacttaattaattatgcgttaatggatcgtttcgatttatgtgctagtacgaaaggttgccagccttagcttagggtgtgtttggatggagggatttgggtggataggacatggcggcccattatttgtgggtgtttggttggtgggcggaagtgggatagggcggcccggaggggaatattccctctagatgccggatggtggtatctggccgatttggccggatggagccgcccgagcgctcgggtgagcggggcgagcgacgacgtgggtcgtgtcacccttctcaccatgcgaaacagcgatgtgggtaagcggcgatggcagcgggatgaaggaggcggcggtggcagcgacccggtgcacggcggcggcaacggaataaggatgaggggacggcagcggcaagcccaaaggcggctgcaacgggaggaggaaaggagacgacgacgacgatgacgaccggtggggggacggagacgacgacgacgaccggaggagacggggacgactgtgacgaccggtggggacggagacgacggcgacgactagatttggaggatacggggcagcggccggtggggaaggagacggggtggcggccggtgtagaaggaaacgacggcgacaaccggatctggaggagaggtgagacgagcgtggcggagaccggtggggaaggaggtggggcggaggccagcggtcgagaaggcggggcggcggccgtcgagaggagcagggcggcggccgttgagaggagcgggcgaggcggcggccggcgtgcaagaaggtgaggcggcggccggcgtgaagagcaagaaggaccaactttttttctttttttctcctttttccccttttatttctctttagattttttattttgcagtacattgataatttttagtttggtgaatttgaaggggtatactcaccacctctaatgatgaggtgattgtaaccactcatccatcctactccttctaaccaaacaaaaaaatggatcaccaaatccatcttcatccctggaaccaaacaaaagactggattgccatattcactctaccaaacaaaaaactggctcgtcatatcccatccaaccttgactgtgaaccaaacacaccctaagcctaaatacttatacaaatttagttctagttttctccttctaaatattatacaaatttattttgccaaaaagtctcagctgtccattaattggatgagtggctcacatcactcgcagtatttacctccggacgaagaagaaatcgccgccaccctctccaaaaaccctagctttcctccccctcgaaaccccaccacaccactgcaacgcgtgcgagcggcggcgagaggaaggaggagaccgatggggcggccgtacgcggtgaaggggcggaagaagaagcggaagctcgacgacggcggggcctcccgcgagcccccggtcgacgaagaggcggcggaggagctgccgccgccggagggggtggaggaggaggaggggaaggaggaggacgtggcggcggcggcggcggccggggaggttgctgatgggctacccgtcgtgccacggccggtggacgggaagcggcggcccggcgcgatcttcgtgctcgagagggcctgcctcgaggtcggcaaagtcggcaaggtatggggcgaagcttcgccaacaaatttattacacctttttcttgcgcttttttttcgaccaatccgtttctggctttggatgtacagtttggatagttggattagttctgttcttatgcttatcttgataaatttgtttgcgctagaagataattcagctgtatactttgttaacgagttagctgtattgtatctgaacatatcattctgtatacctgatgattgaggagcttaatgctacacgaatgatacttttgacaattctttgttagctatattgtatctgaacatatcagtctgtagctctgatgattgaagagcttaagctgcacgaatgatatttttgacgattcttttgactctttgtgtagactatgcaaatcctgaactcggatgaccatgctaattatttgaggaagcaaaacaggaatccagctgattacaggcctgatatcattcaccaggtatttcgaatttcttgtatttccggagctcccagggattaatggcacatgattaaagcctgtcctctctcacatctgtacaacccctgtttgaaactgaacgaaagcagacatccaattttctgtttgaaatcattccgtaccacatcattatctgtgttctattttggcttcccctattgaggatatatacattccatggcatttacctcctcacttttgggggctaaccacagaatggcccctctggtaaaggatactacctccgtcccaaaaagaatgttattctggctatgcatctagacatactcttatcaggtgcatagttagaaatgcattctttttgggacagaagtagtagctgatttctgtagttggtgctgtgcacataacaccagaatgaagtcattcttgaaagagcctcgtggtgattttacaaagaacatctaagtgattaatgaaaaagaaattgttcaagccagtcattcatttctctcatttgttttatacctgctttctcaaagccaacataatttgtattcttaatattttgcaggctcttcttgcaatatttgatagcccactaactaaagctgggaggttacaagctgtttatgttaggactgaaaagggagtattgtttgaaatcaagccttacgtccgcatgccacgtacattcaaacgtttttgcggtttaatgtgtaagttaataatggctgtaattgcacatatattgtgtttttagtgttttctgtgaactgtgctgatgaagtatttctacaatattgcagcacaattattgcagaagttgagcattacagcagttggaaagcgggagaagcttcttaatgtcattaaaaatccagtcacccgctatctaccagttggagcaaagaagattggtaagaatccatattcttttagtggtagtgttaatcttaggtataagtaaatccagagttccttaaactagctagagtaacatcctaaaatcatctttggttagactaggattaaatttggatgacagaaaccaaaattttgagaactgaatgtcatgacatacaattttccagaacctcgtttactagttttgtgtagagaatttctactcatttttttcctatgagaatcacaacataaagtagtatttgtaaaatatacctgcaaagatgcacttttagctaggtcaaatagtataattcgtgacccaatgaacatttagtagcacatttttcttgatcagggcatcaggtaatggtccactgttggttgttgctaattcatgagtttttttatacttaggtctttcatatagtgctgagaagtcagtcaatttgtttgactatgttgccaaatccagtgacgatgtaccccttgtgtttgtggtgagttaagctatgccgtcgagttgatttattttttgttccattctttcttcctggtccatctcttatagtctgcacatgatttcaggtaggtgctatggctcatggaaagattgacaacgaatactcagatgattacatacaaagtaagttaccttcaattaaaattagagttagagcaaacagtttgcaggatcatggtgatatcatctatttgctgcattcttttgttattgtctactccctccgtttcatattgtaagactttctagcattgcccatattcatatagatgttaatgaatctagacacatatatatgcctggattcattaacatctatatgaatgcgaacaacgctagaaagtcttacattgtgaaacggaggaagtagctgttaaaaatattattacataaaggtttcaagcaagttgcatttatcatatgctcgctcatttgtaagacaggtttacaatctagctctgtaacacaaatgccctgttgcctttcctgagatgcctggaatgttgcgtgcatttactgtctcaaagatgttttctttagttcgtaaaaaaatgtttttcctttgtgacttatgtaaatatagacagtctcagatttttttttccttttacttgtgttgatatccattgtcttcagatggtttcgtttgactcgtgttgatattctgcacattgttcttgcagtttgcaattaccctctcagtgctgcctgctgtttgaatcgaatatgcagtgctctcgagcagaagtggaacatccagtgaaaggaaattttgaaaacgaacactgaaaaacattatgtgaaattgttgtgtactcgctagctaatgcaattttgcggtctcctcccatgctgagtgtgtactgtattctgattgtggagacttgaaaactccggtggtaatagtgttaaagttcaatgtttgtcgcaacaatatgttacatcttgaggcatactgttgcttatgattaccaccagccttgagctaggttggttgaaaaccgaactgcaacgtttgtcctttgccccaaaattttacgctgagctgagatttacccgcattaacaggaccatttcactcccgagatctcatgacaagcggttttttcgtttgattccttggttttatttatacttctactcaacgcttggtccatatatatatagtatcacagaaaattttaagatagtgggacagttcaatcatgaatcagatcttctaaaataacacaggaaccataccagtcaatgcctgcgagaatagaaaaatggttacggttgcataaaagcaaatgctttagctcttcatgttcagtccagcatgatagaagaagacattgcaatctctagagctgtttggttcttacccaatcttaataataccaaaaaaaaaagttggcaatccaattaatttgttgccaaataattggcattccctttcaaaaaaaaaaaaggtggcattgccaaaatattggtaagcaaattgaaatgtagtgtgaacacatttccaagtggaattttggcagcaaaccaaacaaccctcaccaaacattttcatcaggtttacattgacaatgatccaaacattgttctcaggatttggcaatgccaacactttaaacaggtttacattgacaatgatccaaacaagcttctcaggtgctaggttttgctgaaattaccaagcagaaagaacactcgatgcaactacagtctacattacaagtacaggtaaaaaagtggatgatccttgttatattcacaaaatgttccacggtaatgagttcaacggccaaactcgttatttcatttagtgactacgatacatacttacaaccgggcacaattcgagtaactcgatcagttattcagaacttctttaacttcacagcaagcttatcaaggtgaaagtccatgatctccgagatggtctccaagaatgtctcctcactagttcctggaaggatggcatcctctgcttcctctatgatggcctcgatttcagattcttttttgactgtttgcctgcataagatgctgccgatgtcataaggcgttaggcctctctctgcccccttcttcaaaagcattgtgctgatgcgcagaactcgggcacactggggagatagcgcccacccgtggaacttgagaagcgcaatgtctttgtcagcatctagtgatccaatgtatgctgcggtttctggaccgaagggttcgcgggcttggggccagtagagccactcaaaggtacaatcttcaaactgcaaaggggaaaaggtaaagactcgtaaactggtacagaaaaattgattgaactaagcaagatagcatacaaggaattaacttgtacaaaaataatgccagctaacaatgattcaaatcaaatgaatattaaggacacacggccttgtttactggatcagtgccgaaattgtcacattaacatagacaaaaacattgagaaaatacgaggatattactgacattgtttaaacttccaacaacactaaataattactagggatctctaattactatgctaaggacaaaaatagcagtttaagtttaccaattcaagcgagtgaacataaatacaattgtttcacatgatagcaatgatcaaataccttctctggcaggcagtacccatgatcaattggaatcaacttcaagtgatcttctccatcttggcacactaatatgttcccagcatgacgatcagcatttgccaacctaatatccagtatggcaatcttctgaacctctttaactgggaaagctcgagggcccatatcctcacaactgccattgttatctacaaacagctgcaatgatccaaccttattagatcccttccccatatggaaacaacggaccaacgctgtgggtggtacaccagaaaatccaggaacatcacacgatttacatccataaactggatggtcaagaatatatgctgcaacctcccttaatgcaccttcccctactcgcgttccccttttcaacccctcaccatcagttgacaaaggaaggcccctgggattattctttgccattggttcctcatcaataggcttgaatactgcaacattgctttcacctgaagagtccttcatgaaatagactccccctgaaccctctgttgacatcacgggaaggtacccgttttctataccagaaattgttgagtagatcatttccatcacagcaggagacaatttcacctttccattagcaatgattggctcaactggagcaggtttacccttagctggtttcgcaaggttcaaagcatctgtttggaggttatcattgtctttgggagtaacaactgtaacaacagtttccttatcaccctgctgtgtctgaacctttgctggcctgcggatgaacaagtggataactgcagcacccttcttgctaatatctgcaatcaattggttatcctcaagctcttcaccgtcaaacacaagcctttggtccttgagactcccaagttgctgtccactctcagctgagagcttgtccttgagatacccaacattgcagcaactctccacctggaactgaaatttcttcccattggcagtctcaatgcttatcgcacggaggtcagccaaccgcacgacaagatgaagcacatttccatcggtaagtccataatccctgacatgggagttgtttagtgacagctcatgcccactgaacaccagccgctgcttggtagtgacaaagcccttgaactgctggatgcggagcttgaccgaggcaacagagtctgagtgcaggacacgcattggcatgggtgccacccctggcatggcaagaaaaatgacaatagaatccagctgctgcaaccggggctcgccatggggcgcaaaacaaaactggtccagcagggggctcagtgtggctataccggctgacgacatctttgctgatctcaagcaacacagccaaggcagccaaagctactgatgcaacaagcacaagtgcacagccaccagcactagagaagcagctatttgcactatgaattagtggatgtgacccattgatgaaaaaacaaaccctagggtctcctatcaacaaggaaaccctaggggccaccgcttgacaccaatgcgcctataatcccttcttggcccccaatgcgttcaaccctgcacattcaagagaaacaaatcatcaaaccctaggtgagcaatcgtggtactcaaagcagcaatttcagcaaaccacatagcaacaatctgagcatttcgcacccgaaccgaaggaatcgtgcagaggcggcaggatcgtctctgctactactccaatggcgcagcagcacagcatctgtagaagttcaaaaaaaaaaaaagaagaaaaaaatataaatcgagtaggaactcgagttcggccaggggattcgaacagcacaagcaacagagagacccctcaccggaattgatataaacagattggatccgaggaggcgcgaagacgaagcctcccagcctcccttctccgtctccgcctccgcctccgcctcggcctccgacgggccgcgaacccccgcgagattccgcttccgaagtcgcgcagtctacgatcgatcgccattgccaacacgcgttagaaacacaaacccgaatccaaaaaatcgcaccacttcctcatcgatcctacccatcaataacacaggaaccaaatcgctcccgcgggagggagaaatcgcggaaagtgaatcggagaacgaatggatcatcttaccacgacggcggaggcgcggattggcggtggccggagccgatcaactgctccgcccttcggaagagagagagagagagagagagagaattgttgaaaagaaaaagaatgggtgagggtttaattgggcgaggtggtgtgggtttagcttagcgtggtgccgtggtgggagtgggattttaacttaagtaggatttggatttggatttggagttggaaggcggtggctttggcttcgggttgccggcttcgtggggaacacgttggaaaggagtcggttactgtttagaataagtaactccggtaattaattataattattaattaattaattgtctgtttgtttccagtaatgaatgacttacaaaaaaagaaacccggggttgcaacttgcaagtcaggccaacggtgagctggggccattaggtcctactgtatttcgaatttgaaattttatgagcttttataggctgactatttctgctagttaaacttatttaagtttgacaaaatttatagaaaaatttagtaatatttttaatacaaaacaaacatattttatattaaatattagttttaataaagctaatttcatgttttagatgctgttaaatttttctatatttaaataggaaaataatcaaaataacttataatatgaaaaataagagagtagttgacattagacattgctcgtttcaaaatcgctagtagatcttttctgaaaataacaaatactttagaagtttttgtaaaacacgaaccctgctatatgtacaacttctacattcgatcggtgtacaatcgaaacggcaaagcagcacagtacatgatggcgtgaggcttcatgtgacgtatagcatgttgctgatgccgcgtacgtcgttgtccaaaagtcggacgctccggtcgtttgtatattattttcggtaaaacactttaatatgaaaatggaggaagtaaactcgggtatgctccaacgctcttgacggtggtactctataacatgcgcttgtgaaaagtgaaaacccaagttgggttctaattctagataaatagaaaaggaaatataagaattgcgttataagggaacatgaagttttttccgattggtaataattgaatagtttcctatgaaaatggtaaaaaaaatcttgtgaaacttcggagttacaaatgatacatccaaaggtgtcatattataagcctataaattatgtagatcgaaatgtttacaatgcaaccattgcacaatgatccccaaacaaggattatataccaagaaaacaaatattacaacgattgatttctaagcctgtgttcgagaggtgaggcccacacacgcaaaacagagcgacgcattttcttatgattaattaagtatttaatattttttttaaaaaatggattgatatgattttttaaagcaactttcatatacaaatcttttacaaaaacacacagtttaacagtttgaaaaatatgcgtgcggaatacgtgggaggtgagttgggaaatgtgggggaagaacacagcctaattcttctttgctagcgcttgaagaaagtacataaattaaatgggagaaatttgtaattgattaggaagaaaaagtaggtgaagaatttgaatggtgaaagattgtgattagttgataatggaatatatgtggtgaaattattatattttagaataaattttaaatgctaaaagttgatatattttaagacactaaagtaacaagcaagttcgcagaaaggatcttgaaacaacaacgacaagcagtcaagctgctgccaatgccatggatgttcctgggctcctgtgaagaattctagaaaatactctatccatcccaatatataacaattttggactgccaatgccatgaatttgaagaatgatatgtccagattcgtaatagtaggcaaatccgatactaggctacctccttcggtttgtcacaaaataagttatcttttaataatcattacatcgaagtttatgaaggtaagagataaatggattgggagtaaacaaaaggagaaataattttattgagatttgataaagtgaaggtattttagtttttgtattggtacgtgtgagatgaatgaagaataaacttattttagggttggaagtataaacttagggttggaagtatgtttatagtttaagtcttggcgtaaatattgaagacgaccgactagttgaaatcgtggatacgagttacgaccggcacagatcgatcagcatgaatcgacaccgaaggtttggtttggccagtgcaacctgtaacgttatgtactagtgctttcctgccgtaataaaaattttcttgattcctactggaaatataccacaaaattccggcattctagagcagcagtaattacattccacgtcacacacaccaagctgtgggtgaaagagaaaggcaatgtgaaattaacatctatctgccatccttatcacagccaaaagaatcatatccctggagtctgcggataactacagatgatgatgatggaaatgaaatagcttcaacatactgtaacaacatcccaagtcatgcccacagcgagcaaaagatttatacaccacaggtagttctctctctctcttcctctcttcacattcacaggttcctctctacaaaatcccagatcctctcttccatatagatccggtcccctaaccggcgcggcatgtgcctctcgtcggggaagaggaggatatcgtagggcttcccctccgccatcagcgagttgatgagcctcgccgtgtgcctgaaatgcacgttctcgtctatcataccgtggatcagcagcagcctccctcggaggttcttcacatgatgcatgatcgacccgtatctgtaagcgtcgcgctgctccgagggcagacccatgtacttctcggtatagaaagtgtcatacccatcccatgctgtcaccggagcgccagaaactgcacaactgaacgtgtcgggaaatctcgcgaggcacattgccgagagaaagccaccatagctccagccgtagagacctatatgtccgggttttgctaggcctttctttattagccactcggcacctgctaactgatcttcagcatcgacacgaccgatgttgtatttgagctgtccctcaaactgcaaaccgcgtcttgcggttcctcgattgtccatctgccaggagacagtcagtcattcagtgttacaaacaacttgtattgccatggctcatgagcccaatgataaatgtagtgacaaatgcggaaatatataggcatatgattatactccataatgagcaatcaacaaatgcggaaatatataggcatatagcagccagcataaatttatcatatatgaataattctaagcaaaaaaaaaaactcatgtaaatatatgattatagaaacatccgttccaaaacattttgcttccacttcaaaattcccaccttaaaactttagattatttttgctcaagaagcaatatggttagtcatgatggattgtatcatcaatcttaccacttgccatagtcgctagggatagggggtagtataattgtttgcttgcaactgacagacattactacaataaaaaatattggctgctggattgtattgggcttttcaacccacacgtcacttaggataattacatggggcttttttggacacttgtaatgttttgctaattcctaatgacaggaaggttacaggcgccaatattttccagacatagttgtggacgcaggaacccttattagcttagtggagtggtgctaatatttctgactcaacgcaaattttatgcttgaatgcactattgcattatctgaggttgagtccatgttaactctcaaaatgacatactgatgtgctttggaaaaattaatggatgagatgccatgcattgcacagcataccttgttaaacaaaaagaaattaaatggtgctatcttggccataagtttatttaaaatcatttttagtttagaattttacccatgcaatgcattgcacagcataccttaagattggtgacattatggaccaaagtgaaaacagaaaaaaaaaatcctcaatcggaatctatcttgttaaacaaagagcaaagaaaaaaaaatagaggaaagaatagttaccttccaaactaatatacccttactacgcaggaactgagctctcatgtcaactgtacttatccatgagtcacttacaagctggacactgggaccgccataaacgttaacgagtgttttgtatgggggtggtccatattttttctcatcagggagataaagagttccatataaagcagtcccatcctttccttcaatctgtactatctctggagacagctgctgaaactttttaagcggctgaacagtcagaggctgctcatatagaggcattatcacacttccatcaagcaaagagcatagcaggatcacaggtggagattttattgagtcatacacatcaataaacctcagcaactgatggtcaagaattactgaatgacgtcctgtgccatgagtcaacctcttggggacttgcaagggaaggctccaatccggaaataggttggtggagtaaagatttgtctccaatggcccatccaatgtgcctgtaaaatatataactccagaactctcattgacaccagcaatttggtcgatcatccaatcaccttgtgtgaggggccccaagcacacaccattcttgtcatgaagatacaggtgtctaaatcctgtcttctcactggcccaaataaatccacctggatgtttactattcactcctttatccagaggagtaaaacaatcgtgcaatgttatccacgtatcatgctcttcctctagtatgacctcccttttacctgaagcgatgtcaaacttaagtagcttaagttttgagtgagttctattgagaacttgaacagcaatagcactattatgcatccagtttactctagcaagatattcttcatcaccatggatactatttggttctccacataggagatccatccaagttatttctcctccatgggaagaaacaactccaaggcgcactttgacattagcagcccctgcaaaggggtaagcatgatcttcttgagcatctggaccaaccgaacttttaccctggtgcataattctatacagtgggatttcagatgagtcaacttcagtaaatgcaaggtgtttgctatcaggagaccaccagaatcccatcttcctttccatctcttcctacaatgggagatacaaaatattaggcagcagccatcaaaacaaattccataccaatcctaatggatcaacatgtgcacctgtgcaatatactcagcaagtccgtggatctgggaaaaaaagaaacaagtacaaatgttagattctgaagttgcagtaacaacacatgatgtatgatcttgcatactttatttaatccccggtatatatttctgttgatcatgcaactactaatgcacaactcagcatgttttgaatgttagaagaatactgatagcataatatacatgctacatgggtaagctaataaaaactatgagatattattggtaaaggggaacataaagttcttttagcaggcaagtttatcctagaagcttatttgagccatagcactaatggcggcagttaactagaacaccctctaaagtttggttaaaagactaacttataaaacttgtagtctttataaacaccgccagcctcctgcaatagtttcggctgctgtgtgtctttggaaggtaaatatcccactgtttggactttggctatggattaagcttactttggttcaaccaaaaaacaatccctaccaagaggtagaaagaaatatttgaactataacacattgaatatattgttgacaaaaaaaatcaatatattgcttagttccaatgatagtcatgttgggttacatgctagttccaatgatagtcatgttgggttacatgccaagaataaagctaataaacttctagaaagtcaacatgaaacttttctttgcaacctgctcaacaagacttggtatgataacaaacaacacaatgcacacatattcctattaaaatgtgagtatcattaacagaactccaaagaagtaccttcccactttcgcttgcaccataggtcaactgggtagtttgcccatcagagaaccccactgtatgcaactcatcatcccgcacatacgcaatcatgctcccatctggagacagatgtgggtcaatgatgggggatgtggctgaactttgcagcttgagtacaggttcagcaccagacaaatcctggaagtaaacctatggaaatagaaaagatatatttccatgaaactcatgatatttagcatccttgaaaatttacaaaggttatctgaaacatcaaaaactaccagaaaaagaatatccatgatacgctgacaacacaaaactaaccatagatgacaataatcaacacaacagaggagttttatttctttgaatcagtagcgagatcactatttaggaacatgtcagctacctaatccaccaatacaagatgcagcactataccaagaatgcaggaagtgcgatctcaagcacagacctgcaggcactgataaactcaacttcatagccatcactaacgactacagagcaaatatggctcatcccgcgacatccaaaccagaaccataataatggtcacccaacactgccccacaaaaccaataccagccttccattaattcaacactcgaaacggaaattaatgagcctaagcctatccatgtgcagttgctgatagcaaaatcagaatgtcaacctcataccaaatccttaatccgagaaagtggtccaatacacaaggataaaagtataaaactaccgaatttgattagggcaatgcgtatcatctaatactaagttactaactcaactgaattggtaataatataaatcaaggaagaactaaatgggggaaagggtttgcggtttgagagatacgaaccccagaggggagcggcacgacaatgccggcgcgggaggcgggggtgccggggaggcgggcgcgccactcgtagcgcgtgacgccgaggccgcgctcccgtgcgcgctcgcggcggaggcgctcctcggcggagaggttcccctcctcgaggccgccgccgtcggggggcccgaagaggagctcctggcgccgctgcgcggggtcgaaggcgtacacattccggtgaagcgtgccgtcggggctgtacaggaaggccacccggcggtcgtcggggctgaagctaagcgccacgggcgccccgtagcccgggagcgggtgctgcacgatgtccaggagctccacgctcggggcggcggcgcaaccccccgcccccgccgccgcgccgtccccgtccccgctgctgccggcgccgacgaaggcgtcggcgagcggcatccgggcgagctcctcctcctcctcctcccccgcgtcgaaccgcggcttcttgcggttgttccc

SEQ ID NO: 80520 - DNA, 47203 bp, Oryza sativa
catttcactatgatcatgtcatcgttgccaaacttgttgccaaaacgaacaaccaacatcgactttcccatggtggaatcaacccaagccagcaaagcaccacttactacacacggatagcaacaggacccataaaaaaagattgcaacgtataaataattttgctaagcttcattgcactccaacaacgaaataacttcgactcaacccaataaaaacaaacaaataaagtcggtcatccaccacaagacaagaatgtagaaaggaaaggtgaaggcctccaaaagtccaccaatgacaaaagctgcatcaggaatattctccaaagccacgctccaacaagagattttttactgtccttgaggagaggaggtaccatatcctggccgttcgttacactccatctaacggctgggaaagtttcggtacctcgtggtaccgcaccaccgtgagagcaggtaccgaatggcttttgatggtgggagggcacgattgtactttcgcatgtactagtgcaggtagcgaatcgagcgaatccccatcggtctgggcgatgagttcagcgcggtagatgcaacagcctcccgagcagggggaaatcgcagcggcgaccctaggggaggtaggaaaatgcagggacgccggctcaactactactcgacctccttggctcctcctcccttagaggcggtgatcgtcggagtggacgatgacaacggagacctattagatgacggcggcgacggactgtagtcagtgccatgctcctcccaccttcctcatccttcggtgcccaactcccctcagcgcctccactcaggtcgggtcgtcgggagatgttgaaaatgattaacccgcccattgattagttcaatcggattttttccttttccgatataggtgtatatgtttgtttgcacaagcagtatcgcagagggcaagatctggtttgggaggtattcatgtgtttccctcgaatccctacccattcaatttttcttttgttttttctcctctttctctcgtgctcatgagaagacacatgtcgcagtccatggcgatggagattcctggcctcgatgcgcgacggcggcgcgatagcggcaacggcctccatgcgtgacgacggcgcgacggcctcgatacgatggcgtggcgggctcgatgctcgacagcggtggcgggctccctgcgcgacagcggcgcgacgcagacggctggcatggacggccgtagatggaagagatgagaccttatttttgttagcccgatcatacccctgataaactaacagttagattaaattgatatctcgtacctcatattacctcgtggtacctcctcaaggattggaaagatgctcctcccacaaaggacgcgacgtgaaacgttgcttttttttttttttttttttttttgcaaatatgccgttttggccattggtcggttagcttatttcttctcgcgaacataatcttttatcgagcattatagaggttcaaatcagggctggcatttctaccactccaaccatcatagacaggatattcaagtttgttactactatacattgtttttccctcagcatcccaccaaatcggcacccgaggaaagttttacaagtgcgcgatgatgtatccacacgagtacaatatatatcaattaaccagtgcgaacaaggtgatagtaataataactcaggctcgcatcaacacttcgcatcgtgtgcttgcaactcacggctcatatcatgggaggcatttaaaaactcacgctgccaaaatgctcagtggcccagtgctgaacttatcacttgttgctcgtccttgttcgtagctcatggcttcaatcactgcgaggccgaggcctacgctaattcctcatagatctcgcatgcaggcagcagcgtgtcccaattaccatcgcgcacagcggcgccatgcacgcacgcacgctctccccacaatccccgccccttcacgcgctggcgagtggcgccttttgatctaacctgcccgagtttgcctgattgcttctctgttcccattccctttctacgcacactgctgcgaaaccagtgctcctcactgcaattgtaccacaccgctagtgggcacagatcggcccggctatatatcagtgagtgcgcacggaaacaatagacagtagtagtacgagctgcagcgctgtaggctagctagctgccaacccaccgacgcttccatggcttccacctcctcccctcctcgccacctcttcttccttttcgcgctcgcgttcctcgcagctggcgccgccgacgcgtggccggcgtggggcaatggccgcatgttcttcagcaaggcgacgcgccccgaagccgtcgagcttgacaaggtggcggtagcgacaccggcagcggcagcggcgccggatgccaccaactccaaccgcgcgtcggatgagttttctcggccgtccagcggcggaagccacaaccgcgggtacggcctctacggccgcccggaggagagctacccggaggcctacttccgccgcggcgtgcaccacgacgccgataagctgacgaccaccagcgcggcggcggccacggccgagcaagaaaaagaggaggaagcgacaccggcaggcgacgacgacgcctggcttgggtaccccgcagacggcagcggcagggggcggccgcggccgtacccgcgcggacagcagcagcaaacgaccaccaccaatgcggcggtggccacggccgagcaggaggacgcggcgccggcacgcgacggcaccgggcttgggtacagcgaagaccgcagcggcagggggcggccgatgtcgtacgcgcgcatgcgcggcggacagcagcagcagcaacagccgcagcagcaatacgggatgagcgacacgaggctgtaccagaacggccggtacggctacgacgtgaacaccggcaagtacggctacggccgcgagtccaacccggtgcggacgcggcccgaggagttcaacggcgggaggaagtttggcggcaatgcggccggcgggcaagagtacgcgaacggcaactatcaggaggagttcggcgtcggccaccgtgccggcgagcaggtgaggaggtatggcaatggcaatgtggccgggcaagagtacgaaaacggcaacgatcacgaggagtttggcatcgggcagcgcgccggcgtgcagacggggaggaggtatgacaatgcggcggcagggtactacgacgcgaacgggcagtacattccatgagtatctcaatgatgttatactgcgaagcgtttgtagtacagtggtagtatactcgcgttcacctccttgtgtgctggaagtaagttatgttaggttacttcgaaggtagatcgagctggtcgctcgcccgctctcgtacgtgcgcttgttatggggtgattgaagggatgaatcacttttgtcggataactagtggaatgtactcgtctcactgtacaagaaataatgcatgctacagtactatatgtcactacaacttttttgccattgccgttcatcgtcggtgcaagaggcgcttctgcctgctactatgggtaaagagtaaaaattaggccccactacgcaaacgatgattgattaggagcatcttgtttgtctctgttttgttgggttacacagacagccctgcttgtagcacgtgattgctctttcagtagcaatgccatttttgctggtaacatctctgcagtaaactgggagaaataggagttgtgccatttttgccgaacattactggagtcagtattctatcgtggactcccgctggatagtgcacagttgcacactataatttgggccattttgacgaactaactctatgtaggccatgatttgttctccccgatcgaggcgcatgcataacgaaagtcacggaagtattgcccccacttggatttggatgatccggatcctgctgtctgcaccaaacaacgaaccgaaaccacgtacctaccggggcattgcaaacgctgcgtacgatacaaccaaccccgtcggtcattaatgaacgtagcggccattgagttatatttccagactcggctgaaaaatgcttccaaggtagagagaattggagcacggggcaacgggcgcagtgtcccagcggcatctcgtacacgagtacagtaataatgaatcggcaggctgtatgtaccacggtgtaccaatgaatcggcaggctgtagtgaccaccgtgtaccgctacataagagcaggtgctatagcagattataaaaaacggagcgatagattaagatgtgattaattaggtattaattataaaaaaaaattaaaaaatagattaatatgattttttaaagcaacttccctatataaattttatacaaaacttgtaccatttagtggtttgaaaagcgtacacgtgaaatacgtgaaaaacgagggaggtgggatggaaacccatggggaagaacacagcctaagagcatgtacaatagcaggctataagccaactataaatatattttaatgagataatagaggagagaagagcaacgagctatagatttgtagccagctgtagcacggacttcaagacacaatgtgtatacaacaggtgggaccatgtattaataatatagtatgtaactattgtatgaattgactattaaattaactatagatgatttggagctagtagttggctatactattaaccttgctataaaagagtagagagaataatagtggactaaagatttgtagccagctgtagcacggattccaagatgtaatatgtgtatgacaggtgggaccatgtattaatagtgtagtatatgtttaaaggtaactattgtatgaattggctattaaattgactttagataatttggagctagtagttagctatactatatattaaacttgctctaaggctgcgttcgttcccatcccagccattcccaacactccctcctcgtttttcgcgcgcaagcttttcaaattgctaaatagtgcggattttctgcaaaaagtttctatacaaaagttgcttaaaaatcatattaatctattttttaaaaaatagctaaaacttaattaatcacgcgctaaacactgcttcgttttacgtgccaggtctaagagcaaatataatacatagtagactactcactactccctccttcaaaaaaatctgagacctatttcctttttgcatcaataccaagaaacaattaacttactcatcatgtggcaaaaccaatgaacatgcaaccaataagtactccctctgtactcgtaaagaaagtcgtttatgacaatgtttaagtcaaacattagaaatataaatcatgaataactctcaagttgtggagtttgaaaatataaaaattatataaatagatttgtcttgaaaaatacttttataaagtatacatatatcacttttcaataaatatttttatagaaaaaagaagtcaaagttatgttttggagaccgtgtcactgtctaaaacgacttcctttatgagtatggagggagtcctagaataacttcttggttttcgattaacaatttaatttagcacgtagtaactacaaataggacttagatttctggaaaaatcaaagaatgaaatatgtctcagatctttggaaggagggagtataagccaactatagtcttatgtggaggaaagataatttgaaaaatggagagagttggccctcatgcaagagctagttaggccattcccaacccaaaacactagacataatttccataaattccacatcatcaagaaactagtactagacactactcttccaatgcaaacaccactattccatacttaaatttaatactacttacctcacacgatgtcttggatattgtgtagaaaccatgtctcatgcaatatatggtttcattctctttcctcatttattcactggccatattattttttatcctaggtgacagcttatttaatactatggacaccatcctagtcattgggttgggaatggccttattctagtcattgagttgggaatgaccttattcacatccttcaaaataaatacattaaatgtataggtgagaaatagagagacgaggagaaaaaaaaaagataaccttatacttatggatggctctattattaaacttgctctaaattgaccgtgcgcctccgtaggaaaagcccaccaaacctcttttgttccgcgcccgctagcattaacgaccccgcctttttgttaggacgctgattggcattggctggaccgcaaggtaggtggctagcgggtgccactgccgcgcttctccttccccacttatcctgtatcatccactaatcccccgcgcgccagcgcgtctctcccagataattgctgcccgttcttgctcgcaccgtcgcacgcacgcacgccgagtcacgcgtatcacggagcggaaaaagtgcacccaaggtgacatcgaattacaaaatcgttcctcaaccacaaaaccggatatacggcgtcccccaactaaccaaaaccggtcataataggtccctcggcggttttaacactggttttgtcctatgtggcagctgactcaacatgggacccacgtgggccccatatgtcaggctgccacattagcacatactctatttccccctcttgtctctccgtgttctctccttccttcctcctcctcgctctctgctctcacacgagcggcaacgcgcgcggccggcgatggtggctcccgagtggctgcgcgcgggctcgctagcctccccattcccctagtgcggtcggcgatggccgcgtgcggctgctgccatcatgcggagattgactcgacgacgccgccatcaagtcgctgccgtcgggcgtcggcgatggtggcgcgcggctgcggccggcgggggaggcggaggaggtatgcacggacgccctcgccctcgtcgtcgatgtcgccaccgatgaagaggtccgcgccgctcaccagttcgtaggcctcgtcgtcgtcgacgctcgccactccgttccggccgcggcccagcggacaactgacgagaagccggcggcgcggcgcccccgtcacggacgagcgacaagaagccggtggcgtggtgcccccactcgaagccgccgccgacgatgaggccaagcggcgcggagtcgtcggcgccgccgctccccatccgtagccgcgctcgcctgttgctgctgcggccgctgcctctccgccaccgcgaacgcccgccgacactgccttttccctgccgctgccctcctcttccccgccgctcattccccgtcggccgcgccgaccctcttcgctgctccttctcctctccgcctctccttccccgtcggccgcgccgtccctcttccccgccgaatcggtgacgccaccgccaccacatctgccctcctctttgccgcgctccttcctcgccagccgccagccgcctcaccccaacgatgatgcacggtcacggcaatggcgccgcgcggcacgtgggggaggagggaaggcagacgaccaccacggtcctccccgcgtgacggcaaccatcggcggcgctccccttcccgtcccggtctcccgcgccgccctcgatttgctcccctccccttcccccgctgaccaccgttcccatccccaccctcgccgctgctgccgccgccgtcgccgccgcccacctcgctgtctccacgcccgacttcgacgccgcggcgggggccctcttcgcgcgccgcgcggtcgaggagggtggggccgccgcgctcacctccgacgaggccgatgcggtgccatcgcccgccgctgttcctctgcctcgtgggcctcgtgggcggcggtcggcggaggagtccgcgcgccgctccttcccccacgtcgcccatcgtcagctgccgccgccctcctcctcccgctggctgagttagagaagggagagagagatgaggaagggagagagaggagggaggagagagaaggttgatgtggcagcctgacatgtggggcccacgtgggtctcacgctgagtctgccgccacataggacaaaaccggggttaaaaccgtcgagggacctattatgactggttttggttagttgggtgacgccggatatccgattttgtggttgggggacgattttgtaattcgatgacaagttgagggaccttgggtgcactttttcctcacggagcacggcgcggaccggcgggctgagacactcgcgggccgtggcgatgcttacccaagctggacgctgtgaaatgggccgcgggttacaaaaacgaagtacgcgttcacgtttcccaggcccatctaaccgtagggttttagcgtctcgcccccgtcctctgccggcgtagcgccaccgcactgcgcacccgccccgacgcaatggccaccgccgccgccgcgagatcgttccttcgatcgggagtcgcctcctcctcgtccatccgcggcgccgccgcgagagccgcatcccgagccgggccggctccgctcccgaggaggctgcccgccgctgctccccgtctcatcttgaggtacgcgcgagatctcggagttgaggacttctggttcactaggaatttttgtttgctttccttgatctggatggggagtttagtgcttgtgtttttttttgtttccttttggattctgcaggtcgccggtggagatgagcagcgtctgcttggagacgctgatgcccatgcacagcgccacggcgtcggcgctcatgacgtcgctcctcgctgcccctgcgtgcaggagctttggctggctctccgaaggtaataatttctccctgatctcaatcccgttaactgcttttccaatggcggtacattggctttgagttatggagcgcatttgtttgttgctggactgtagagtggaatagattaggtgctggtttggacagatcagaaagacatcaagcactattaagtggtaataggatgagatgtttgttagttgtagctgtgctaccaagagatgtattattgttcatcaacacctaagtataataagttgaggaccaggctctaatttagagtcctacatgaaaacaatcggttcaactgtaattatgaattcgcattcctttgtctaccaaatggactgtcccacattatttatttcaattcatctttgctgcagtgggcattccgcttacagctttaatccatgtttattgcagacttgtagtccttgtttccaactcctttagagcatatttttcattgttccctggtcattttggacacttgtttgttagatgaacaattccaaacatgttggatttcttatgtttcaactcctttacattctatacggacaaagccttgctaatataacgtgacacattccttaggcttttggcattatgtttgttaagtgtcttcagtgcacaaaattaatagccccatcctataataacatcaaggaatgagtgtgatgacaaaccttatgcaaactatatagcactctcctagattaaagttaaaatgtaatagtcctgaagtttgtcatgttgaaaccaatcttatattttcgcatggcccttgttgtagggaatgagtgtgatgacaaaccttatgcaaactatatagcactctcctagattaaagttaaaatgtagtagtcctgaagtttgtcatgttgaaaccaatcttatattttcgcatggcccttgttgtaggtcaagacgaaactagatgaacaccaagcaccaaaggtgaataaaccttaaggattcacatactaataactgttgatggatagttcccatcactaatttatggctctgaaggatttacggagacaagatacctttatttaaaggaatgcattgtacgcttcatcattaataagtaaacatgtagctggagtgcaggaaatgaaaaccaaactatgtttcatcgtgctattccacagtccggataatttagagttatccttttgttgttttttctcgtgttatgtcacaagcatacatttagaccttttgtgttgccggatcaaaactctcccaagagcgacattttcaaatcatagaccattttagttcgatcgtttacccccttaggttttattgaaactgtttgtaatttgtaggtttaatattgaagtagagtttcaatttataataatgtgctaatcatcatgaattacaaatttgaggcaaaagggacactgattcttttgtattggcccagctggcaatgatgacgtgtgacaaactctaggtggaatgtagcagattatagtcccgtcaactcaaatctacaggtctggcaaggttttaaggagcatccatgttagcatatattcatagtcatgttctattaattttcctgccatggtttgcacaaaaaatgaaagatgaagacgcatataaatctctgccagggtacttgtttctccttttaattaactaggaactacatgattatgtttgttctttgtgatcattcgggaccatgctattcgatgtccttggaccttacctaatgatgtatgcagtttatttgtcctgctatcatgctattggaattataataagctacaatgaaaccatgattatgtttttagttcttgtatatacttgttttttgacacattatatatctctataggtctgtgattagtgacaatggagggtgtctgagatgaagacatgctagtatttactttgtcatttctgttgcttcatgttttatcactttgtaattcgtggaattaaaacaaaaaagaaaatttatttctttggctgtaactttttacgctgtcagttaaaaattggatcttagattgttgcgtttctatttgtagatggatgatttgttgttatcggagcctgatgtgacgatagctgctacgagatacctcctattcaatttaaagtactttccgtcggcgtcttctgagcgacatgttcagtattctgggattttggtctgtgtaagcgtctacaagattgttacctgatcgttgcgacgcttacctccggttgtccaactgattttactattgatggcctactactgattaagtcccgctgagaaaataatgctgagttggaaattttctaattctacattgttttgcttctatctgcactgttactgtattatgtacagcgacagtttcgtaccttattactacagcagtacagtattatcgtgttgtattaagctggagacgccgttactctctgttccgttgacgagcagtatcagaggcctctatctccatggtggccatcgcgtcccaactgttagagcattgtaattcaagctagcttctttctagaggggaaggtggtgccatatataacaaacaacgatgtagggaaacactcagcatccaagaaacaatttttgcccatatggaccagaggttcaaacataagattactacggttcgaatcagaagcactgcagacaatttatctcctagaaatcatatccttttagaggctcaaaatgcagcagcaaattgactgatcatctcacatcacatttgttcttacaaccacaactgctgcagcacctaataggctaatacccatccgtacatagaaatgctcgataggaggacatgaagcagttcagaccaactgctacaacctaacctcagaatctccttcatctttcactttcttgagccaactcaaaaggtagaatttgaccaaataggcttggaacacataacttctgaataacaacgaaaccaacacgatctcacccttcaacattgacaagttcatactccacaagtgagagattgttatcctcctttacgttgaaacttgccggttcagtcacttcaatgcggccccatttgtccacagcaagcctcattgatcctttgaacatatcaatttttgcattgcggataataacagtgctgtcagccttcatcaggtcaactgtaaatagaatacaattgttagacatcacccaagtaaaaacttgttcactacataagttaggaagatattcttgaattacgtttgtactataatacgcaaaaggtcagggactgggcatgttatgaatctaattgtccattcatgtgaataatcatgcataggacatgtacttatcattttggagtaatcatttatgaattacacttacgataataagcaaagtaaaattagatatgtgcatatacgagcaaggcatgttaaaatctatcaccgataaaaaaaaaagacaatcatccaaccagcttcagaaatgatgtgctcaaaagcatatactgtcatgcatatatgaactaatccaaaacactaattaggcagagggtgaacttgcgcaactcaagaataatctatcaaatgccattgcagtttcatgcacccagagttttcaagcaaatatttctacagagattaagaactaaacagaaggcaatcaactaaaacatgcaatgatgcacagttcacaagtacagacgtacaggtacttacataaccttacacagataaatatagaaagtgacacctgtaccatttgggttacacaaatagcctcaatcttaccaactggatacaccagccagcagccaagcatattttacatttaaatccaaattttcggaaccaaacgttaatcttagtttggttgtgctaaaaaccacatgctgcattacatggaacacagtagtatactcttgcctgatatcagataaacacctacaagtacatactatcgcacattattgtaccaatttaacactaagcatgcgacttcaaaaccagcctcgtcaaaggaagcaaacgtggtaacggaaactgaatactatgcacagaatggggacacagatcgtaccctgctcgttgcgggcggtgaacaggatgcagccggtctcgtcgccgatgaggcactcggcgatcctcgtgggacgcgccgccgggcccgctcccgcggcggcgcggcccttctggaccacggtcttggagctgagcaccttggcgacgagcgtgtggccgcccgtgccgggcttgagctggtccaccttgacgaacaccggcttccttttcgccgccgccgccgccgccgccatgggtacggaaaaaagaacactggagagtagtaatggatagagataggaataggattacacggagggccaaaccctagatgaggcggggagagaatttaataggcgatcgaggaggaggccaccactagcgacgcgcgcggcggtgacttgttaaaaccagacgctatcattaccgggtccagtaggatggatcaaaaggagtattatccgcttctcctttgccaaaaggtcaagaaaaaaaaaaggaagaggttcagttcggtgggaatttggccgccatgagtgataccctatgctatgctactatgcccctgagtagagtagtagttatttagggaataacctgagtatttgttattaaaaaaaataaaaaaaagacactcacatacgccaccgtgtacatgagcatcgttgaaatattagacctatcaataactcgatataaatactcctttatccatctcattttaagtgcagccataatttttcgtgccaaactttaatcgtccgttttatttaaaaaatattaaaaacataagtcacacataaagcactaacaaaaatactaattaaagaaaaatatgacgaataatcaaaattagatacagaaacttatggttaaaatgagatggaaagagcagttatgttccaccggataaaaacaaactgagctacgctcatctcgcgaataatgatgtgattatttgattcgagttggatatgataggacgacactttcgaatagagttttcgagcatcacttctaaaagcatccatcagataaacttatcttcatagccatcattaactcttattagcatctttgcgtgcaagggaagggcaatcaacctaaacccgtaccttacgtgttgttattatgctcgaccaaggcaccaagctgcaccgaaagtccaaggttgcccatcgaagcaccaattgtgcctctactaattttcatttaaagcaatacttcgaagcatttgtgcttacagttacagacgatagaatactcgctgcattctgccaatgaggcaaatctttcaggccaacgttggctaacaccaccaggcagcatcattccaacatcttcccaggaaatgagagaaatgacacccaaaggtgaaccttcagaaggagggcaattgcactttgattttccaggcgcaaaaaatggaacatccagccaggttaacaaacaagccattagagttcacgggtaatgctgcaacagaatcatctacatacaactagctctaagaaggtgcaaaactggagaggcctaaattactcagtacaaatctgaacatctagagtaagatgactgaagctaatcagccatctaaaaggttcaatatggatctaagctatatcagtaaacagaaagccttccacattgcataagaagctgtacagaggtgacggaggacggcctaactgcgataaccttgttagagcctggcaaaagaaaatcagcagtcagaatcatcggaagtaagactgaaaatgcacagtttgatctttacaattgcaagaaatatgaccaagttaagcccctgctatcgttatcttgtgttacagcagatggttagtgtactgccataaaacagaggtatacgttttacacaattttcataaaaatcacagttcagctttgattggtataggtatggtggtagtgctaagcaggtgtcatctgtgagtctgactataaccaataacagatggaaatacaagggcgagctgatttcttcattagaagcatcaaaaggtttcgtgcaagtacataaaaagcaggtagaggataaacatgagacttttatactccctccgtccctaaatatttgacgtcgttgacttttttaaatatgtttgaccgttcgtcttattaaaaacttttgtggaatatgtaaaactatatgtatacataaaagtatatttaacaataaatcaaatgatatgaaaagaattaataattacttaaattttttgaataagacgaacggtcaaacatgtttaaaaaagttaatggcgtcaaatatttagggacggagggagtacctatgtaacgacagtattttgttaattttaataagtaaaattttatcaaagtgaccacactttctttgatgcacacttaggtttctgtttgacagggaaggtaagagctatttactgaaagctcttattggacaataggctcttttctcggatcgataagtttttgtccccccgcccgtaatgaaaggagatacaaccagatccaaatagaaactaaattttgtctttttagttcttatgtaagcatcaaatttccatagcaaaatgcgaacagtttaaaatataaagatatatctgttaatccaatttaatgctaaagaaaatctaaataggcttctcacaaaaaaaaaattctaaacaggccaaataattcatcaaggcttattgtactgtacctcaaactgcaattgttttcttgccagcaagaatgcgggatatctggaggcctctgctgaaagcttcattgaaaagtaccctcgtctgcatttcctgaaatccaggcaaccaggaaaagaatgcaactggcgccataacaaacaccccaagcagtatctcatacaaacgtgccacagaaacaacactggcccagaccacagtagactcaatgaatggtctaatcacttgagcaatggaaatcaagccccaaccagtaggaatgaatgccaaaaggcttgtgaagatgtcaatgatttgaaatttagtaaatttcagaaatattatcagcactagcactgcaagaataatgacaccagattggatgacccggtagtaaaggtgttgttttgcagcatacttgtctcgagcatatgacattaggacaaaaatgccgaaaatcacagccacacaaatccaggaaagcagataaacagcaatacttctgctttcatttgcgatcttcaactggtatacaaccccatactgaaaaaagaagtatctgagatctaacaatatttctaaaatctttccccaaagaccagttgttcgtagatgatcctgctcctcaaaccaccaaacttcccagctgtgttcagccttagaaaagatactaccagggtaccagatccagttcatgaaatcatcaaagtcatacactgttttcaaccaatcaaagccagatggattaaaagcaaatggagccatgatccatgataccactagaaaccagctagatatcatcatgattatgtaaacaagtgtatcccttgcaatcacactgtgagctgcatacacagtcaatactattccaagttctattgcctttatgaagtggctcctagcatacagcctgtaattttcagcaaaactcttatgctgcacaacaaaaccacggccagtagcacgatacttagcaccgccatgaagaattgtccggccatagtaatggcttttcgtccccatggaaaatgtgtagaacacggacgaaaacatcatttgcatagtgaaaaaatcccagacagcaggcagaaaaccctgttcaagagagttctctataatcattggcaaggcagtgaagaggccaagctgtatgacaaattgctgattcagaacggcacccaaggctttattgttggtagcattagcgctaccctgaattccagcctcaagaccactcagagctagatagaggcgtccccaaacaaatgtataaactgtcaagaccaccatcattgtgttgaagtagaatcctactgttgtatagaacacagaaagactcctaaagaaatccagcctatgaccaagtctgtagatatccctacttagggtctgttcaccattgccactagaaacctttgcttcaaacatcgatatctgattgagcccaacatcacgtcccttaccaacctggatatactcatggtggctaacattgccaccgcgtagggtacagttgaaacctgcaaatatgtcctcgctgatattgattactctggatgccttgcttataccacctcgggttaaaaaccaaaggcgatcaaatacatcaggatgcccataatgcatccgaaccttcaacggattagctagaactcgctgtccaagggtaacaaagcttgtttcttgtgcagacatgaaccaagcaagtgaagacaccgatccagtaaaaacatgctcccggacgcccaaaagcgttggtttctggcttccatgataatagtcgtactgttctagtaggttacgcatcttgagggcctcctcaaaataattatcctggttcatatcaatcgtttgcacagcatcacctcgtgtgaatatgatggcatggttctgattttcaggttttccctccccaagtttcagttgacctggcaacctaatacggtatatctcaacctctctctgtaagacaggatcaaatttaacaaggacagaatagtattgcgtatcaccaatctcaggatggacctcatcgacataagcaacacggagggcatcatttttcttcataagagttaggatatcttcagcacgttgatctttcgcctttttctggtttccatatatttggcaagcgaccacataggtgtacttcatgatagcagcaccatcttcctggcctttaaacaattgacttacagtacttgttcctctctctaacctccttcgaggtcgttgtgataaacccccgttcatgggatatacatcattctcatactgaactgaaccaaaagaagccagctgttttgttccctctgtaatttctacttcagatgcattatcaagaaaagcaagcatcttgagagccctgtagtagtacatcattcccctcacagtccgtgctaaggtctgccccctgtacgaggcccaaagtcggagatcctggaattttccagcccaaatgccatcatcactagccattccttccctttgcatgcgctctaaaaagtttttccaatcatcttcataaatcttttgaagataaaacaagattgagatgccatcttcattctcacgacgaagctggtccttgttgtacagaacatcttcattgtaatatggggttaaaacactgaatgccatcatcctctgaacggtgggagcacgaggcatgttcatgaacagggagttgctgaagaaagttatgcgccgacgagcctcggggttctttggaacatcgtccatagaatccctggatgtgagaatcgtatggagtcttctcacctgcttatagaagctaacatcattgtcatctgggcattttatggcatcctgaaaaagcagctgagattcggttggtcttgatagtgctagcccctctcgcctcagctgttcaaagtccttcttgatttttggaaaatcatgcactgcaagatcatacagatcctgcaaggtacgaactatcttgatctgatccttgtccttcaatagaagctgctccactaaggagattacatacttatgaatttgaggtaataaggttagcctatattcttcagtgaactttccatattccattgcaccatcaaatgcaaggaatagctgattgacaataatgtgttcattagttctctccttgattatttccagcagcaagtgacgtatgctgtcataagcttcaattactgcacatcgcctgtactcgttgttacatatcttgttccaatgtgtcctgtcatcagccaccagctctgctgcctgactgagagcaagaagaagctcattttttagcagcaaacaaggccaccgtaccacacgaattctccacacaactgccggcagctcaagaagcccaagctctttatcactaatgatgtcctcttccctaaatgtttgaatgatctcattccaaaccagtgcaaacctcttagcttccacctcgtttgcttcaatcttcctatatggacggccaaacccatatctcagcttcagccgattgattgcatcatagaacttgctgcggatgccaccatgaacggtatccaggtgctcctctggcattaaattgaactgcattgcacttgcaaagaactggaacctcaagcgcagctgctcaacactgcgaatctcccccagatgcgagaaaaggccgataagcgcccctgttagtgatgagaagactgcataccatatctggatatccatgaggtaaatgataataactgggagccacaggatgattactgcaaggcgctctgtgtgaggcatgaactcaaaccagttacgcttgatgtcatggagtttgaagattacctttgttggccccaccatcggcttaatctggagaaagtagctgaagctaaacttagaaacaaggaggcacacccagaatatggagtacttgatgttatcaatgagaccttccctcagaccacggccaacaaatgtacgtgtttggaaccaccaggtcagcacatatagaattttccaattggttttctccagaaaatttcgaatccaagggatgatgaagagcacaatcgcaagcacttgcgggatgacaaacacagcagctgcctcaaggtaattcagcactctggtattggcagcaaaggaccacctgcgatctcgccaccgctgatcccacattcgcttatagagcacactgaatgtgattgtccaccctgcagcaacaagcaccttgagcaccatccgaacagccactgtttttgtctccctcgacacgagactgtactgagtacccgcatcaagcattgcctgaacaaagcgcagtccaccccaagtgatgaacacagacagcacccggacctggatgtcccggaatctgaggctaacccatggggttttaccatcccatgcaacaatcatcgcagcttgaaagaacagaatatgcatcacccataccctatcgaaacttcggtagacattccagaatgaccgctgctcaacaaagccagtcttgccaatgcgcccagtctttccaggctccacaaagaagctcctcgatggatccagcggccaccggagccgcttgaaaactcgtcggctccagaagtactcgttgacatcgtcgtaattcctccacgccgagtgcggcttggtcccgttccggctggcctccacctcgttcttgaggacgttgtagatcggagtcaccacgcggatgaggaaggcgtcctcgccgcacacggcgggcatcgcaggccgccctgtctcgatgtcgatggactgctcgacgacgtggtggaggtcgagggccatgtagtggaagatgtagcagaggcactccggcatgaacctcaggttggcggcctccccccagatgagcaggtacagcgccgtgtagaggaggtccatgcggacgtcgttgccggtggcggcgccggtgcggcggccgccgccgccgccgctgggcacgcggaagtggcgcttctggccgaggtaggcgcaccaggaggtgtagttcttgaggagcttcctgcggatgccgcgggcgacggtgaggtggaggacgtcgatggggtggtccttggggaatcccggcgcggcgcggagctgcgcgttggcgaggaggagcaccaggtgctcccgctggttccggacgttgtccgcctggaacccgaaggtggcgccgagccagtcgaagatgtcggcgcggtgcgggtcccagacgcgggccagcggcggcgccgggaagtccgacgcgtgcgacagcgcctccaccgccgcccgcacttccggcacctgcagcgacgggtggtccccgtgcatcaccacgtcctggatcgggatgatgttgtacgccgcctgcaccaccgtctgctcccccgaacccgccgccgccgcggcgcggcggttccgcagcaagctcatctccccgtctcacgcagccagctgcaaaaaaatcactcgacgagtgtgagccctttgaagcgaagaagtacacgggatgatgggaggaacctaggtgggaatcacatgctgcgcagctggtttattcgggctgccgcttttgttcgcttgtttgatttgcttgtctccttcggattaggcggaagcgaggcgtgcgtgatcgcttcaacagtttgcatcatagccgccgcctagtaggcgggtgtgggtttggggctcggtttggttgctttgcttgtggggtttctaaccatgccgctagtgtttctgtgcgctggattttccggtgggggcaaaatgaactaatgatgatggcgatgagaagatgtgactccttttttggaggagggatatgcaatggatttgtgatctactggtaggctacggattactgatgcactgtaagcaaaaaaaaggggaggtcagcaaagcaagtctacaagtgaatgggacagattggtgtaatggtctggagtaaatctcaccatccactcgcactcaggttttgttagcttgtgttgtatggcatctggtgtggtaggaatcgatgaaagaagataaaggtaagaccatactagtatatacaccctataaggctctgttcttttggttgagttgggaacccatccctccggtacggaaaacgaagcagtccattagcacgtgattaattaattatttgctaattttttttcaaaaatggatcaatataatttttttaagcaactttcgtatataaactttttgcaaaaaacacaccgtttaacagtttgaaaagcgtgcgcgcggaaaatgagatgggggagttgggaactccaggaaacgaacagagcctaagtaaagtgctcaagctacggaatttgggtgagagcaaaggtgttgatttgagaaaccaggagtgaattttgtgcagatgagtgtggtctagccttatattcactccattttcaggagatgaaacagaaagtggtcgatgcatgagaaacttttgaattagggagtgacaagagcataacttttaatgttggtggtcatatggcataagggtctctcactttttttaaacatcttttctacatttggaaaccttttcttttgagagagaaacaattggatactattgcttacatgctattcacgtgcgatgtccccctaaaaaactgaaagaactactaggcgtcagatatggataaaataacaggggaaaaaattacagcagttaagtaagtacaagtttcaaagatggtgaatggcgtatcagttcttgaacctcagacgggatcgataccttgaccacactgaataaatgttataaaacggtgattttattcttcttttgctaggagcatcaaatttttatgatgtcactgacagcaactatcatctttctttgaggacttgtcgttgtgacccaggaacacttgtcgtatggcatatttggtgctaaatccttctgtgttacgcctctaagacgcttttttggctaagcttttattgagcttgcactgccagctttcggtgcactagagtaggcactaatcacaaaagagcgacacctcacagcctatttctatcacaccgcaatctgaatctctctggatgtggatggagaattagaaatacggactatggagctcgtaaacggtaaggtctattcattcagaagcgaagataaaaaaaaaaactctatataaaatcggcggtagtaagaaaacaactaccactgggtgttcccggctatttctacccatgatttgaatttgatgaacccctaaacaaaccatatgttgctgccaaagtgccaattatttaagcgaccgcacacgctaaacgctattgctcgcgttttattatctgggttgagaggttgacgccagaagcaaaaaggctcaagcaaagcatgcaggaggagatccaccacactccactgcactgcactctgaataaagaacgggggacacttggtgtgcgggtagccgcacggctcgaggaaatccgccactggaaagtgggaccgggcagtttcgctactgagaccaaggggtttgacccgcgggactgtaacgtgggcccacctgtcaggcgcggcggaaaacggcagagagagagagagagagagagatggcgccggcatattcggggggagggggaggaggaggaacacgtcaatcgccgcagcggcggaggcagctgcgtgaaccgccactggcctcgtcgtcgtcggctcggaatcgaatcgaaatcgtcggttccggtggccgtgggagaggaaatcccctgagccggagaagctcgagctggcgaatctatggcagaggcagcggtgacgagctagcgaaacggagaggggaagggtctcaccggatgggttggccgccgccgccgccgccgccgcggcgtctcagcttggctcagctgctcctcgatctcttcctaaaacctggtcggaattgtaggagaatcgagatgctgagaaacaggaagaacagattcatacagtgagattgctatgcaatactaggtattagtagatatagtaggtagaaagagattaccctttattgagttttcgttcctccctgctcggcctcccaggtgtcagcgcatttgagatggtttcgccgtggaggtggagcacagataccacactcctcttttttctagccaggccgcgctcaggatcgtaggcccgtttattttactcgtgagctcaagttccaactcacacatgcgtcaatccgaattcaaaattctagcccgttcagtgcatatccgcacgcttgctgacgtgtggaaaatgctgtcacgacacccatactcgggtgttctcgtattttttttaagtaaatttcacaaaactacatgttttatggttcaagttgtagaaaaccacacacattttaacacttggcacttaagtatatatattttggtagtttagtttcacaaaaccacactatccatgaatggatttacccgcgagatgacgtggttgttccatctaggatggggacgtggcatcctgttaattttgtctgatggctggtaatatgatgccatgtcctcgtcctatgtgaaacaaccacatcatctcgcgagtgaatccattcatcgatagtgtggttttgtgaaactacacgaccaaaatatatgtaattaaatgccaaatatcaaagtgtatgttgttttcttcaacttagaccataaaacatgtagttttataaaatttacttttttttttattagtcacatagtcacgcaacttgattgagcaaagtgaaaactgtaaaagaggaaatacccatatactatcagaaaataccgtctctgcacttctgcaggtaaaagatgctcgatcaagttggaacaatttacatgcaactttaaaaacacaagtagcaactggcaacaatcacctgacatttcacaccgcaaaatgacaatatacctggcaataatttggattagcacagatctgctgaaatggtccaattgcaaagaagttggtggtacacgtgcaggaagtacatgaagattaagatcaatgtataatatgtacatcgtacaaatacgcaacagtcaacagatggcatcacttcaaatcttatttattcaactactacacgatagtaccactctttgcacacgtatgagcgccgtgccgggatggagagaggtccaaacccaacccaggacgaaatcaccacgcacgagggggtgctccggaccctgcttcgttcaaccggtccagcaatgtgttgaaatccatcggctggccactctcggtcatcctctgaataacattcatcacctgctccctgggatatcccatggtgattgccttctcaatcatttccccataaggatggccgcgcatcatctgatgcgaacctgggtgactcataccaacattacctggagctggaggcatctgaggtgcctgggctgctgaaggaccacttggggggtagccatatgcagtgttgtagccatgtgagctgccctgcggcgcatattgtggcgggccggcatagccccccttacttggaggtccgaaagagccctggcttggaggaggtagctgctgcctttgcatgttgtgctgcggtggtggcatgccaggtcctccgtatgaatatggcacttcagaacggctccccgctgccggagcaaccgtgttgtatggtccttgcatagccatgctgccaggtagagtttcagggggagggttcaaggactggtggggttgataatgagggtagtttggtggagtttgaggcctcatctgattttgtacaggaggatgctgttgtggttgcattgcctgaggaggaagctgagtgttagattgctgcggttgcactggtggcggaggaaactgttgagcattaggctgctgcactggttgaggagcaaactgctgagtgttagatagttggggctgctgcattggttgtggaggaaactgctgagtgttagataattggggctgctgcacaggtggaggaaatggctgcgagaaagtcggctgtggctgggccactggtgcaggagccggctgggaagattgctggggccactgctgctggtagggagggaaagactgaggctgggtttgatttgctgcctgagactgttgagatgaagcatggacaggaacatcttgcgttgctgaaggccttactggcaagtactgcacctctggttgtacttgctgcccctgtgtatcctgaatgcctggagcttgacgctgtgggtagtaaacaatggcttggctaagaacataacggtcctgctgtggtacagaagagctaggtggctgctgcactgtctgatctttgtactgttggactggttgagaagctctaggtgcaagggatgagttcacctgatgaggcaaaacaatcgccagctgctgaccaggtgcatctgccttttcttcaagcgtcttttgctcagggaaagatggtgttggcatatcttccttctttttagatgtgtcatgtgtaagttgaaatttggctaattccttctgagtttcagctaactcttgcttgtccctaaggatttgaatagatctgtgcacctgcatcatttgaaaatttgattagagttgaaacttgaaaacttctcaacagagaattaatgctcaaagatataaaatacagtacataaacagtaaagaaattaaacatttggagattgaattgttggttaataataaattgtcacatcttctgaacttggatacggtcatgtgcccatcaacagctctgtgatagccaaaatgttttgcaacgtgcatgtcattttagactgcaggacaatctcgatgaataccaagaatgaactatacttaaatattctgtttgctagaaatactcgaagtttgtggtcaggccttaatctccaaattctaaataagtgtcatcttgaagctcgtggtagcacctaagactccaaatggccattatggctcaacagatgcatgtctggcatggaacatatgagatgatgtatacccttagcatttgtgcactctgaacttataagatgttagaacagatccatcacagggatcacttatttatcaaccacagttgccaatttaaatacagaggagtgttgccaatcctggttgagtcacagggtatacattagacatactgagtatattcaagagtggattccaggcttcgagtgcacaacaggcaacaagactagtttatcagaagaaagtacaaaacaagaaggacatttatgtgcattaacctctgaacaggtcagtagggagcagcctttgagagaccaggaagacatctctccctttgtctgaaagggacggtggtatagcaccatcacatttcttagagattggaaatggtgtactttttgttcaaaggaaaaaaacaataatcacagcccaaaatactaaagaaccatagcccacaaaaaccacaacaacttaggagattagggcctctaggctaaacatacataagcctaatatttccctatgtattcactagatggtattttaaatacatataagaattggagcatgcatttaaagcgaaggagcaaaatcacatacacagtataaagaaaaggtaagttgtcacaacaaataaagaaaacatgtactgtacatgtcaatcaacacaaaaggctactccatccgttccaaaatataagcatttttgtctgcacgcggggatgtccaaataggcatataaattttgaaatacgtgcagaaatgctcatattttggaatggagggggtataatatatggatgagtatatgacatgatcataattacactggatgcaaaagaactgtcccccttcagtgcagaaactgaaagggtggaaaatgtgaaatactggatctagtctcaaaatatattttttcttaaaatagtgatttacttacttcatgaagatgtttctcaagagacttcaatctttgatcagtctcatcacggagcacatcacttcgaagttcacccatggatctctcaagcttatagcaatagatctccagttgtgaaagacgattagtaattccctcaagcgatcgcagcaaattatcagcatatttcttcatgcacttctcaacagcaaaaagtacatcctccttgccgtaactctcttgttcataagcttttccaaatggtctccccaatctactgtcgtgaaagtcctgctgcacaagtacaagaatgagggatgaatatagcacaaggatttctactattataatcattaaattaattttgcttgtaaaaatgcagatatctttgacaaatttcattttttaagaaacaaatacatcagatttttgtaatgctctctccaactatgtcagtaatagcttaatttgattatttatataattttggacgatgcaggagaactgcgcttcatttcattaagaagaaagaaatatttacataggagggatcaaggagtccctcctaccaagaacacatcccaaaacacaccaacccacaggtgattatttatatttcacctgttagaacatagaataccatcctccagcaacaccaagggtgtcatcagaagtttccagaatgctataatggactttcaacattcacccataaagacaataatctctaaacataaatggactgaacaaatagataagcaagacaataatccctaaacagactgaacatataggtaaacttatcaagtacaaaatcaacgtcaatccaccttttctctaaacattagattgtgttccttacctagaatagcaatgtcctggacacatggtcactaatttatatgtaacaaaaattttactgaacatgaaaactataggcggtattaatgttacgtgtgaatcaaatagtcatgacttgcataaatcttattcaacagaatgtcagaaaaaattatctgaaaactatatcctataggcatctttctctctcgtgcagtggccctcacagaaataacccactgaatatttcaattgatagcttattaaatgaatttctcattgactatctccagcctatattgaccattcaagacaaacctacactgcacatcaggaattcagtgtgggtttaatcaaaataagacctgaaaatcccaagtatagcaggtaccatataaaccttgatgcacacaataaaataaatccatgatattctctgaattacaacagataggcatagctggaataacacattcgtcaggaagaaaatgaaatagcaagcgatggctgcatagtaccaacgagcctataaccaaatcgatgtgaacgttacaattgggcaaaaaaaaaactgaaactattcagtgctgttcagccaattttcatcggaccgtttccacactattcagttgaacgaatagattcacgggaatacgacaccgctgaggcgaaatcgtgcggcaataagcctcggtcagagctctgcacgcgatcatcacgcaccacgattcacgagggatcaaaggtgggttgccgccgagagagggcgggggggggggggggggaggaagtaataccttgtcggccggatcggggcgcttgggctcggagggggcggcgaagtcgtcgtaggagcagagcacgtcgtcggcgccgaagtcgaagctgcgggagccgcggccggcggggacgccggagccggacatcgcggcgcgctagggtttaggcgagacggggatagcttccttggaggggaaggaaagggaggggagggggggagggaagcgggggttgggttgattggcactggaaggaagaggagggaggaggatgacgacttggtggtcggtttggtctgcggccgcctggggtgttaattaagcaaaggcgtcgccgtcccggttgcttgttagatggacgctcacattgacggaaacctgcagcgcctctgttggagaaattctatccttcggtactgtcttcttcagctcacgttaaaattaaaagtttagatagaattaaaataatgtgatagaaaagttgaaaatttatgtataaaaaagttttaatgtgatgaaaaagttgaaagtttattgaaaaaatttggaactaaactcggccttagttggaaaagaaaatttttgggtgtcacatcggacgtttaaccaaatgtcggaaggtttttcggatacgaatgaaaaaaataatttcataactcgcctggaaactgcttgacgaatttattcagcataattaatccgtcattagcacatgtgggttattgtagcacttatcgctaatcatggactaattaggcttaaaagatttgtctcgcgatttctcccctaactgtgcaattagtttttcatcttatctatttaatgttctatgtatgtgtctaaagattcgatgtgatgtttttaaaaaaaaatttgggaactaaacaagacataagggtataatcattgttttctctgcaaatttttacaatcgtccaatcagtctataaaaatcagttgtatattcatgctaagtacagatattcacttaccgttatttttaaagaaaatctatttatattatatatatatataacggtgaagccaatacctatattacagttgagcggttaccactctgttggttttatcaagtgataacaccaacatgataacaccaacagagttcaggtaactgctcaactcaactgtatttataacaccaacagagtttaggtaaccgctcaattgtaatataggtattggcttcactgttagatatacaaaatataaatatattttagagtttatcactattgttactattgttacataactttgggatatccagtattgtggttcaagaatacgaatccaatacgaccactagttaagggagtcaaggtgaacttattccttccatctctatctctactattataaaaaataaagatgtttttgccggtaccttggtatgtcatccatatatgagtcggtttttaagttcattcgtttttggaaatacatatccttatttgagtcggtttttaagtttgttcgctttggaaaatacaaaatgatttctttaaaaaaaactcgcatgctaatttgagacaaccagactcctaattgtagctcatgtttagattttctgaaaaaatatatatccaagcagattacttgagacgatcggactcctaactgcaattcatgattttctaaaaaaatatatatccaagtgaatacccatggtgaatttcaccttaactaaaccatataacaataataaaattaaaatagccttcaaccattgcaatgcacgaacattttttttctagttactataaaaattgacgatgcttccgctgattctttggtatgtcgttcgtatttgaattggtttttagttctttcgcttttgaaaatacagaaggagtcgtgtaagaaattcatgttaacttgggacgagagtcagactcctatatgcttcacaattctcgctatcccataagataacaacgtacacgatatatctatcatcccaataagagttcctaactagatatcaatactatcaaaataaaaaaaatcccatatacttttgctaacaataatacaaataaaataatattcatcgttacaacgcacggatatgttttttaagttagtgaaagacggaagactgtcagctcacaggctaacatccataaattgggccgaagcaaggccttccgtggcaaatcgaaagtccgaaacgacgttaactgatttaagcccgaagggcctcatcgcagaagaagcccacaaccattaggccgtaacaatggcccgcgtcatggccttctgcgagccgttttgctggtaggctacaacgacggcgacgaggcgggcctgtttggcacagctctagctctacttccattctttctggagctggagctcagccaaacagctccaccaaaactgggagtagagttaggtggagccctttcacaaaatgtactagagttgtggagctgggtttaggtagctctacaacttcacttcaaactcaactcctggagctaaatttagaagttggagttgtaccaaacagggccagaacgttttgaccgaaaaagctatacgctctccctttgatcttgacaagagccttttccaccgagctagccattatttctcatcccttttctcagtcagatgacgtgctggtcgtccatttgttaattatttgcaatgtggcacaatcatgattcatgacctatgtaaagttgcgcatatttttcttaatttttgatggaaaagtttctaaaaggaacctttatatggccacatgctcggtgtcgtgtatatatatgtgtcacccgtacggatgattatattcggattggcaaatcttcgatggtaaagtagcaatgcagggacatcgaaagcagcaattagcatttgacattcgttcgtaattcatatataaatatttgctgaagctagctttgtcacaacaatgttggtaataacaatacaattcaaactacagcgtatacaaaatatatatgctagatagctgcagcggctagcgtacgtatacatatgcatggctactactccccggatggccggatggatatgctacgatgatatatatagctagctgcagagaaaacattatttgctgccaaaagaataacccggccgctacacaagttgcttgctacctgctgccacccttagttacaagggtttagtagtacaactattgagcaccagtcgatcaacctaagcctctcagagagattatttctttgagatcataatagcctcagacgagattatttcacgaataatgctcgatatatatatcggatcgtcgtctagtaatggtgctgagggtccgggccgcccggcacttcccgcttgccgccctgtaggctcctcacgttccacctccccggccgacgacgtccacggataccaaatccgccgccgccgccgccgccagccacgtcgtcgtcgtagtcgccgcccggcggagcggcgtactctgccaaggcacgggccgcctcggcctgcgtggccgcgagccccacgacgaccaccaagaccaggcagagcacaatgcagacgcaactacgaatagccatatctcaattgatcgatgaaattattcaccgtacgtacgtgtgtgtgtgtgtgtgtcgatgagctatagctagctagcttaggttcgtttgtgttgtcatggccaggtgccggcgcgaggtgtgtttatatagggggtgtagaggagacggtggaactagtgcagcgacggttacaaaagaaacatataagtgtgggggccaaagggcgccggccggggggcgttttcttggataagttcggtactaatctcaactaccaccgcattggcgcattctacgtagcctttcttctggcctcgtccgagtggccactggccaccaccaccacaattgctggtgctgctactagctagtaatagatcagtaccatgatgcacaccattgccactttctgcgacgaggaggatatatatatccccttttggcttttgcattaggcattagagtgtgaggtatgctaattgcaatggctgtactacatgtaggttgctgttggatgaaactgtcagctagctaggcatcctagacaacgagtgcttggagttgtcgaattcacaaatgtcacaggtaagatggaagaaattaattaaacacacagtaaacattgagtagaatcaaagccaaggacaagactagtagtgtagctgaactggctatgcgccgaatgcagtaccgccagcacgtacggcgccaaattacctggataaattcctaagtacagcatgagatattgagctgaaaccaaaggcgaatcaatctggttcagaattgcaatcctgcattcagtattactgggtcccctggctatcaacatttgcaatctcgactttgatacgaagctactgatatccataccttttagtgccaccagacattacaataggtaatatggaaggcaattgtaaaatatgaaaattcaaaagaattctttgaccaaatcactttgtagcatcaaaacaaatatgctcgatcaccaaccattagtatacgagcccgctacgtagctatgtagacagtgcttagtggaaaggaaaacgagtagccaataaaatccaatgcttggatgtaatttatatgtcaatatgtcattttgctcatctatgtgcctgcttcgtcaaaaggctgtagtacctcgaaaggttagttaatgtttcggttgcagatttgctctttatatctttgcaaccgattagccacatcctctgcatgtaacggctgtctgacctcctcataatgcaagaaggcagcttgcagaattttataagataaatggtcgaaatcaaacccaagagattacaaataagaaccacttgattgttaacacagagtccacgtttcgggttctaagtgtctgtttagctgagaaatgatacggtcatttgactttaattcgatcctgtatgacttgcttggtttgagatacgaaatggagtgatccatccgtaacttcgtccctcaaaaagtcaaaacatatggttactgacaaaaattaggaattctctttattccgtcaaaaccatgaaataatctcacgatgaaatactcgcaccagagaagccatattaattaactgagtcggttgtacgtcacaatcagcagattccatggtaatatagaggaaaaagttactgaaatcattccagtcaacaatctttctacatactgtgttaagtgactagatgcaatctgtttcgaaagcgacaatgctgttccttttacaccacaccttttgccactctctggatgaaagcaacctttttcagataatagtaaaaatattgatccacctagaaccttaagcgatgacgttattctttttttttttaaccttacatctattacctgaatataagtgactgaacgatcgcttaggatatttccaactcagtacttctcattttcatttgcatagcagatgcagggaacagaagcagagtgatcaatgaagatgcctagtagttatgtaccatctattacaagatcatataaacaaagaatctgcaggacagacgaaactaactattttgtacaggatcaaccaaaactaatttgatatccaccatgatccaaatgttgaagtgatatacggtaaactggcgagtcaatgtaaaaaagaaaaggcgcacctccattgtttatcaaatgcaacttcacctgaaacattgctagctaaatatttgtgaatctgtttggcaaccttggagaaatgtgaccatatgacaggccttggttggaaatgcatgcctttacaaacaatttcagcttcctttaaataaccaaactttgtatgacagatttgctagctaagtacttgagtatctatcataccgtatgtctggcaaccttggaggaatgtgcgccatacgacagcacttggttggaatggcatgcctctaatcacaacctcagcttccttcaaatgaccacacttgcatagcatgtccaccacacaaatgtaatgctccatctcaggctcgattgaatattcagacttcatatgtctgaatatattcattccttcatgcaccagtccaccatgcctacaagctgaaaggactgctgtaattgctaccttgtcaggtttgaagccatcctcttccatggctttaaaccatgccagggccttacgagaaaaaccattaagtgcaaggccagaaattatagctgtccaggagataatgttcctatcttccatttccttaaaggctttcagacattcttcaattctaccgcacttagcatacatatctagcaacatattatgaacataagtatctaagcaaccagaattggtcttgatgataagcccatgaagcaacctaccaagaacaaggctattagactttgtacaaatgcttagcaggctcacagatacatagctatcaaaatgatgccccaaaattctcatcagttcgaaaaatttaagagcttcagcataatcaccattccttgcacaagcagtgataagtatgctccatgaaacagtgtcattacatccctgatgtaaaagtagcttcttcgcttcgtcatacatgcggactctgttatataccccagctaaaacattcatggagacagcacaggagtcaggatctaacatacccccataagccaaagcatcagaaaccatttcatgtgaagcatatgaagatataatggcacttgagacatagtcatagccgtcgtaacccaatcttgttaccaacgagtgaatctgcaacagatcgaatactgatgggtccttgagcaaagaagacaaactaacctcgtttggcataacaccagatcgcaacatctctctcagaataaaaaacgacgttggaacatcagtatctgagtgacaagaaatcagtccattccaacgtgtggtgctatcctcaggagcttcttcaagaactttgtgagcatccttcgtacaaccacattttgaatagaaatcaaacagtgaagtgttcacaaatggtctcgtattgagattgtgtttgataacttttgcatgaatggacttcccatgttcatgtccatttatactggtgcaggcataaattacactgctaaatgttatttcattgggcaaaacactccaaccttccatcatccagaaaaattcaagggctctctgaggcaagcttctcctagcgaaggcaatgatcattgtattccaagaaaccacgtctctgaacatgaactcactaaacagattctctgccaaagacgtggaactgtgagtacagtatgaattcagcaatgagtttgcaactgttgagaaggaatctatcgcaattttcttcacaagcccatgaacttgctctggtgtgccaaaagcaggaagtactgccacaagagagccatcagacacgctgttaccgcttcgaaccagcgccctgaaccagatcacagcatcgcaggcacgtccatgctgcgcaaacgaagagatgagacagttccaggtgacgacgctccgcacaggcatttcgccgaacaacctgagtgcatcatcaaaccggccattccgcccaaagaaccccaccagcgatgtcccggagtaggggtcgctgtggagcagcccgctcttgaggatgtgagggtgcagctgcgccgcgcagcgggcgccggccgaaggcgaggagaggatcggcgcgaaggtgaacgccgtcggggcgacgcccgcggcgagcatgcgcgcgaggagcgcaaagccctcggcggcgcggccggcgcgggcgcgggacgcgatgagggagttgaagagggaagcggagggcggcgcgctcggactcgggctcggcattccgtcgagcgggtgccgggtgcggcatgggggggacagcggcgtgtcactcctggcgcgccggcgaaggccaaaggcgtgccgtcacgggcacgagatgctcgcggtgcgcacagctaatcgcgcgccccggcgaccggcggcgccgcagcaggcggggcggcgtcgaggcggcgcgtggcagcagcggcagaagaggggaaggaagaatcgcaaacgagcgcgcggcgacgttgcgatgggctcctcaccggggggtatctgcccgagcgcgcttgcagttgggctggtttgggccggaaatacgcgtggcggtgcatcgggccgaaactgcaaggaaagcgcgcgacggcttccgctgagcaggctgtgcgtcatgatagaccgggccagttttcctgcaatttgcaacataaaaaacgtttttttttttgcattgcatatctgatgatatttgcatattttctctttatctgtcaccatattgcgcagagcattttaaatgatcttcagtatcttcgtcatatccgggttagcattttaatcgatcatcagtatctcgaattcttggacatatgtaccacatgcagacttagtgtactataaaatgccgccctggataatatagggccggttcactttgatgaaaaaaaaccttaccaaattttggcattaccaaaaattttagtatagttgccaaaattttggcaacgtgccaaattttggcaggatttcttatataattactaaaatttggcagcaaactaaatatagccatttttttggaaactttatcgaaatttggtaaggttaaaaatggtatcaaagtgaacgcctatagtatagctagctaggcggggtctagatcccctagagttggctacaactctatcaggtggagttgccatgatttgtgccattccgtgtacctcaacggctaagattaagccatgttaacattaatatatacttaaaacaagtaattaaccgtgcaacaaataaacttgcatcaacaacatgtcacaggattttttttttactatagaattgtagaattaatacaagaatttcatacttcatctattttattaaaaaattatacatattaatattgatatggttcgctgttgcatatatatgaaaacactgtgttggtatatactgttgcttagagttgatcgactgtacgtggttattaagaacaaaaagtttttcacttaattttttgttgagaacataatcaaaatagaggaagcgcgcgttgaaaaaactaatttttctctcaagctataaccattaatgttgaggagttaatttattaggtaaatttgatgaggcatgatctcagccgtaggaaacagtggatggtatagatttggccaactctacttggtagagttatacccaactccaagggatccagagcagggtgtggatccctcggagttgccttcaaatctatataagtgtaccaaacatccctgaactgaccgatccatgaactgaccgatatatagcccatccatgaactgaccgatcgatcgatctccttttgcttgatatatatatactaagtgttcttttggccgacatggaaggtacagggcggcggccggccgcggcaatgttggaatcgttagcggtaggtaccagttgataaggcattggcgtttctcctcatgcatatgcaatgcatctgctgcgttggaccatgatcatgtctgacttggatcattagcattagctaactatactagaatatcaataacatgctagccagagtattgattaattactagtatctttaatttctggtggccggcagaccgatcgaggcctactgcctgcatattgccggtgtggcggtgcatgccttgcttatcttctcttgacagtaagcattctggcctgtgcctgcaccgaccttttctcaaactaataccatggacgatttgagtttaaaggtttctctccaagaatctttgtgcaatgaaggatttaattgtctccctcattttaggaaaaaaaaagcgtgtcatcccatttaaattacaattgcaaaatttagctgaaagattattcaatcttgagctgaaagttaaatcaattgtgtgatcctttaattggaaatgacaaacttttaattgaaatcctgacatgagaatcgttagtggagcctccgggagcccggagtggtcgagtggagcgtggtttcatgaatatttccagtacaatgcactgaatctgaattgctcgatcactacaatggaaaaattctaattgcgcactcatcttgaattgctcgatccaaccaccatatctcagcgaaaaattaagagagaaacataaaaaggcaagaccaaattaaaccggattagtatacacacgcgcaccagccgctaatgagattaatggagattgaaaataagaaacaagaaagccaatcgcttcgacgatttgcagaatagctagctagtgaccgaagctctggctagcacacgtcatataatattcagtcgaccgtcaacctctagtctagtagtattacgctttctgaaccctgaagaggcaaaactaaacgtaccctacctgtattttaattacaccatcctaaccggccaacccaacaaccgctcgatgaacctgttcgtcgataggctgcgtctgataccaaggccccatcgaaaagcatatgaaactatgaacagagcagaaaattaaaaggtttagccgtgacgtacggcagctcgatccatcgagcacaatcgatttaatttggtttaagacctgaaaaaaatagttaaagcaatgcaacttgtgtagataccagcaattttctgacgatggcatatcatatccaaaaagttcttgggtcttttaatcgcaaagggttttttttaaggcatggactagcttttgatctctctgattaccctattcgttaagaacctatagaatgagaagatcgtgacaaggcacgtcgcaagcaatgacaaaaatgaaaagttgcatgcttacctcgatcggtagataggagaagagcagactaattaaagagttaatgctcttttccttgattgaaaacaagaaactaattaatgcttgagtgactgttgtcagagcagtgtgagtccagagctacctttttttttcctccgttattcttggcatcggtcgaggtctttctttttagacctactgcgataatcgtctgtcgagtcttgcaaggccacacgtacggagatgagcttttcatttcacgttttactggatgatacttataatacgacgttgctacaagaatttacatgaagcattaattgttagatatagatgataaactttgggtgtgtttgaggaggagaggattgagtgattgggaagatacgcaaaacgaagtgagccattagctcatgattaattaattattaactattttaaattttaaaaatggattaatgtgattttttaaaagaactttcctatagaaaatttttgcaaaaaacgcaccgtttagtagtttgggaagcgtgcacgcggaaaacgacgtgctttcttcctcaaactcactggaacgaacgctgcctttgtaatgatgacatcatgatgaataactttaatcactttgttgaattttgtaaatcgcagttctgttctcgagcccaaagagtgaactctttaatggggtggccttggtaatacgacgttgctactaaattttatactagaaaacgtgataccttccggtattttttgaatgatggtaaaattaccccctgaagaatacgtaacaaaaaaaaaaaactagaggacgtatgcacacgaacatggagactcgtcctaagctgtgcctgtgggcttgggtgaactgagcacttcccggtttttggcctggttagccaagatcaatcaacaatttattgtaggcttttagacattgtgtgtaaccatcctagttttattaaaaaaatatgtagtaagtattatttattttgttatgacttacttttgtcagtgaaggtatttcaagcattcatatcatatttctcacatttatacaaaacttcaaataaaatgaataatcaaacgcgacatcaagtttaaaagacaatagcaccatatatttaaaaacagatgtagtatttgttgtcagtagaaagtacatttagtgatttactcaagcgtatatattggactgctggtcactagctaaaacttgagaagttatctggagttactcaacgatttgatgagctgctggggtacgaagagccgggtcttccagctagcttcataaggtggtgagcgatatgtattcgaagcctcaccccttctaattatttgtataataggccatttcctaatattcacgtctttatttgatgaaccgctgtacgcctgtacctagtgctccattgactagtgccatgtcaatgtttccttctgaaaagttcatcactaagaaatacattcacgttatggtcaagcatgcagcaatattataggctcatcattgatgccgattttctatgcacatatggggccgcgatatatatgcgcagaacggtgcctttcggccttacagctatacagcacataactaaagttggcagcaggtgcatcccttcgtacacagccgaagtctgaagctgcgtgtataaattgcttcctatactttattaatttgcttattaatgtgtcgggttgtttagttcactacttcactttatcaagccacatcttaatcatattataattattagataggtatttatttcgcggccacaacttagatttaccatactttcttatactttaaactcctaaatcatttattttttttcgaaccataccacacttgtgacataataattcatggacataattttttctaccatgatcacactttagctaaggttagctgtcgcaaaattagtcaccaaccaaacaacccctcctttcacatgacacaggaatatagtgttgtacgttcattttcaatgtatacagtcaatgcatgttaattgtgtcattgttagctcggatatatatatcgttgacgaatgattatatttagctgcttcaatttgcagcccaatttaaactctagcactgtccttttaagttggtttcttgagaaaagcttgtacgagtacatactccactgaccgaccgctgatcttattgatctatatgatggtacgtacagagcggatccgatcaatgttactaaaactaagcttgtgcgctttgtcgagtagatttgtactagaaatagaaaatcaaagtgaaatcactatattaattattcccttccgatggtgtttcacaggtatgcatgcatatgcatcgaaatgaactcgtctatattgtccatctatctgacaacatacagtgcagaacgattaattagtcgagttctacagttctacactacacatggtctgatcatggacaagaacacatgccgtacaaagcgaaaaacagaaacaaatcaagacgaagaaacagaagtggtaaacaaaattaaccgcaagatcgaacactgaaacatgcagcactgggcgatcgacgaccatacaaaaaaaaacctccttaatttgtgttgatgcagacgaggcgacgactacctacgactgagagagatcaatggtgctggggatccggccctccggggctaagccgcttggactcgtgcgccgccgcgccgccgacgacgacgaccgcgccgccgccgctcctccgccctgcagcctcgccggccgccgcggcgggcaccttcatcatgccggccacgcctgcgcggccggcgacaacggccgcctcctccggcgcccgttctctcaaagccctggccgaggccgagcgcgccacggcagaaagcatcaagatggcgcagaaagcgaacacggccaggtacgtacgtgccgccatgtcgcctgctgagatggcctctttttgggaggaaattaaagctgatggattctagctagctggggctcgagacttgggtttgggacaaagctagttctacgtacaggtcgatcgttaggttgaaggtgatgatgggtttgtgtggagctacacatctaggcctgcatcgtcttatatagcctatagaaccttgtggcgtccacgtaagatagatatgatgcgtgtgtagctataagctagtaacggacatgatctctacagtcgagggcaagctgactaagaaaccatgcaaattaagacaaaagtatgttaactttgccacctcttctaaatgctcagccactaattagagagagagagagagagagaggctacaacgaattgtcttctcggtttattaggggcggcggccaaagtgtattccgactatgataatagctatacgcagggtatgcacgcataaagctaaatatatccgtgtgtttttaggtaagcacgtatttatgcatggatcaaaaaatactccctccatcctaaattgatcatcatatatacttatacaccaagaccaatgataatttaaatgacatcaatcaatacaccatgcacacacattctccaataatgcatgtatcaattaaaaaaccatgtcaattacacctcattactaccaaatctatatttcatggcagccattttgggtttttactggcggtatttggagccgccacaaagcaaaggccaatgaagatgaagcatctgcgctggcggcgaaaaaccgctagagaagttcatttttcactggcggtctatgtaaggcagccgccagcgaaaactgacttatgtggactgctagcgaaaacatatttttgctagcggttcctcatttttactggcagtggatggccaccaacaaaaatttggtttcactggcggcaggtaatgagacccgccagcgaaaataatttggaagaaaaataatcaaaacggaaccgcaaccctagccagccgtctgcaataaaaattacaccaaaaatatccccaaaatcagattttcgcagcgtgtacatattcaaatccacttccaaattttcgagcatcgattcaaatcctcatccagagttcacagcatacaagcattttgaacatggaagtgaacacagcatacaagcattttgaacatgaaaaaaagaaaaagaaaaacagcaacaacagaagagaggaaggaggccgtcgtcgccgtcaccgaccgagcagcaccggttgtgcgagccccgtcgccgagcatcaccgccgctgagctcttctgctgtaccaagccccgatctaggaagccgggctcaccagcgaaaccgtgggagggggaagggttgggggagggggaggaggaggagctcgccatgccctctgtcaccgttgtcgtcccgtcgccgtgcccccgcttcccatcgcagtcgtcaccgcgccccccgtcgtcgtcgcgccccaaaacagctcctcccgtcgccgtcactgcacccccacctcccgttgcagtcgccgtcgcgccccacgactcctcctcccgtcgccatcgccgcggcccccgacgaccgccttccgtcaccgccgcgcacggttgcctcccttcgccgtcaccgccaccacccgagaaccgtcggcagagccgccgccgatgccgcctggaggagaggacgccgacgcctaggaggagtggatctgtggaggtgaggaggagaggagaggatttgaatctggatctggatctggtgctgagaggagaggaagatatttttattgtgaagaggtgtgtgggattttagactatttgccattcccttagatgtagcattcccaaatgccatcttcccaaataacttagacaatttgcccaggtccccacaaatcagctctcctctgccattttacacccaatttcgggtcccatggctgccacatcaccaaccaaggtggcactgagagcgtgaaatgtctatcttgcccctgcctcttctcaactgttatgttttaacataaaaattacacaaattgccactgacactaaaattgaacaactgctctcataggagcactgttaagacatcccagtcactctaatccctcgttcataccatcccaacccaaattgcacaatctgacaaaatatatcagccacattgcaccataataacaagtatataacgcaattcaacggaacatttcttagaactaaaatagtataggcttcaaatattgttttctgcatttctacatagcacgtctagtagcaagcatggctggccttaacattggtctttgctgccattaaatacataaataaccccatctttcttgagtccagtttcatgtaacaaaagcaaaaaggcaacatcagttctgttttttctttggagtcaatttcttcttggttggtggtagtggctgtgatggtgttgcttcagtcatagccaagcgcctccttgtcactggtccaggtgaatcttgtgagcatccttctctagcaatagttggtgttccagttgtccttgtttgactaagaaaaaaagatgttagttatgcagtcatcacaataatgatcatgtaattaaaaagaagcaaggtctcttttatatcctaacctcctagtgactcgagcagggctatcaactaattgaactctagcaacctttgatcttgttggagtttcaacaatttccttagcagttttctttttcctagcttttgtagcaatattctttgccttcctcttcctaaaaaaacacaagtagaacacaagttgaagacagtgaataaagataggacaagttaacaagttaagaaaggaaaggaatgaataattgaagcaagttaagacaatatagaacaagttaacatgttagaattattacctctttttggtcccattaagaggacacttttggctgctctgtctatgccctagcccaccacatcttgggcatttcacctgccttctgatctttcctttccccttctcaagacaagaaggaatcatgtttttcctttgcctaggaacagttctaggcttgggcactggtggctgcaacttaaaatctttgttcgctgttggccattgggacttgtcagttatgcaggggatgacaccttcatatgcagccctaaagcaactaacagagaaaacgggatcaacaaaatcatccatgattggattcctttgtttggagatagctgcaagagcatgagagaatggcttccctgttaactgccactccctacatgtgcatttctgttggtcaagatacacaacatgcctatagacttcaacactattatggagctcagtcacttcagctgtatcatccgctcccttcatgactctcatgttggctaaacctctagttgctgcctttagttgtgtgacaattgcaggtaaaatgtttctgccttctagtttttctccaatcttccttctcttagcccacaaggctgctgtcttctctctgattgcatctgctagggcatcaacttgcagttccttgaattctttgatccatgcattccatgactcagccacattattagtgatgaagtcacatttgatctttggtgagaacttgctccttgcccacagaattttatgatgtttgtataaccaatcaccaacatcaggatcagctgataaaaccttatccatgtgatagtcatagatctcagacctaaaagctctagcagctggccacaagttaccataaactgtaccagttttcctctttgtcaagttttccatcaagtgcctaaagcactccctctcctcacagttaggaaaaaccctctcaactacattttctaggcccttgcaagcatctgtacatattgccaggtcttccacatgtccaatacacactgcaagttgctccatgaaccaagtccagttatcagtggtttctgcatcaaagaacccaaatgccattgggtacatccaattatgcccatctaaggcatttgatgctgccaagtggccattccacttcccattgagggccgtagaatcaatgctaaggtattttctgcatcctaacaagaaacctgtgatgcaaggctcaaagcaacaaaagaacctctcaaagtgaacttgaccatttacttccttggtaccaatttcaactcgactgccaggacacctcaactctatctcagccttaaagttatacaaggaatcaaagctatcatcccatgaactcccaaatcttttgtatggccctctctttacccttccaaacagtggagtaaggaatctgtaccttgtaccgctcctctaatatggtctttagctccttggccccacaatttggcttcttcctcataattgcagcagctctatctgctacc

SEQ ID NO: 80521 - DNA, 1701 bp, Oryza sativa
  unsure (1)..(1701): unsure at all n locations
agtggttgttcagattggagataagatatatcgatttgttagctatttgctggatcttggagaaaagtttgtaaggagtagtccttattctctccctccctggtgccaccatggctaggtccaggaaacctcaacaaggactaatgtccctcagcccaattatgcccgttacatacacacgacaaagataaacatgcatttaccctgaatttgtagtacgagaggaatgcctgtaacactgatattcacctgagcatatgcttattccagcttcacggacatgctcaagagtctgcagtctatcgtcatatgatcttgtggaaataatgttggggtaatattctcttgatgtatctaaattatgattatatgctgtaagcccagccttcttgagttcttcagcttgttgcttctctagcatgccaagagtgcaacagacctccatgcccatacctctgcagagatttatccacagaatggtaaatcgaagtcaagatagtgataaagcaagaaaactaccttcatgcaaatattctatcgtaatgtatgcagaggcttaagtcagtgtcctatatggctcaagattacgtctgtttgtaagtgaacaggcaaagaatagtttaatttttacattcaagattgacaatactaatatgtttggaaatacaaaaaaacagacgaataaactaatgatgacatagcaatggcatggaagagagcatgcgcatcagtgcatggttatgcaagactctgccaaatacttgcacacaataattctattgtgctatctttcaaaaataatacctaatgtccttgacatattcaaggatctgattaaaatttgttttcctcccaatggtttctctccatgctgctcccatgcaaaagcgggtgctcccagcctcctttgcctgagcggaaatagatcagaagaaataatgtgaaatgatattacaacccataattttctgaactaaagctgaagtcctcagtctgtaagaactcatgttaccacttcgcaagatttttaaaaacaacaacataaatgaacttggtcaccttgagataaagttacaaaaacagtaccttttttgctgcttctaagacagcatctttattcattaatttttgtgccttcaatcctgtactgtatcttgaggactgggggcagtatgaacaatcttcgctgcacccacctgtctttattgaaagaagagtgcactgttgcacttctctgaatttatggacacttctatggacttgagcctatagaaaatgcaagcattatctggttaaatgaaaatacattgcaattgagagctatttccctattgactaatgtgaaggctggacatagttttccttcccctttgaggctttgactaaaatgatcaacgaaaagcttgggaaatatgttcaacatatnnaaccaacagagatgcactttaagctaataatgcgaactaagatatgcatttgaatgaatgctgacaagctatcgtgcatcaagccagtcagatcgttgcagattgttgtgaccaaacatgtttgatatgggccattcattactcaagctaaatttgcaatatcaagtccgaattgtctgaagcccctatatgggaaatccttagcaccaatttccagattataaatgcccttgagggcattacttcctattaatactagagcttgaccaagcaa

SEQ ID NO: 80522 - DNA, 6797 bp, Oryza sativa
aatatacttagatgcaataagatcttgacataaagggcagatttaacatgtcaataaaacacataaagcaaatgtagttaaatcaggtaagattggctaaaaccccgatgctaccctaatcggcaaccagaaggcaggctagagttgatattctaagcacgacttaatagatcaaactcaattgatgcagcattaagtatgaaaagaagaacaatatctagacaatcaagccgctagaagtttcatagagtggtagatatcttatataatctaaatcaacgtcgatgtctaacctaatcggttgtcctctactgaaagatgttagccgattgtaggttagatagcgatattgccagagattatgtaagatatatgataactcgacgaattacataaacaagattagagtgtcataaaaatggaagcactaatcccgagaacgcaagccgtcataacaagttttacctcttgttgaagatcgaaaccgatgcagctcaacccgaaagcaagaactcgtcgaaataaaactaaagaaaaagggtggcgatgcgccgagattgtatcgaacgtgtgtgttaaataattacaaggggttcggggtcaatttatacccgagaattacaaactatctccatatcggacacgactcttatctctaacaaactctaagatatcataagtctttgcggcagacatttgcccaaacatatctctaaggaaattacataaaatatcctaattaatagatacaattgccttctcaagactctacccacgtgtggcaatcatcttgaagcatatcaactcaacccgatgacgtacaccgagttgtattgacggattcaactcaatcggctaacctcgtccgactcgaactctgccgatcttagccgtagccgactcggacttcagccgattcttactctgttcccgaattgatctttgcctttgactccgcttcgatctaatcctcttttctgatggtgatattaccaaattcggtcgttaacaccacaaaaataaattttccatgcttccatgtgctttcttctcagaaaaaaagctccttttgaaaaaaaaagaaaggggagggaaaggcatggttatgaaatgaaaaaaaaataaataaagttatactccatcaagcatgagcatgatgttaaaagaaatttttgtagccatgcccacttccaataaaagaaggatttttgggagaaagaaagtaaatcaaaaaggagaagcattaagaaagtaaatcaaaaaggagaagcattttctttattttcttcatgcaccatttacaccatatatcacacactttatgcacgatcttgatcttgagtatgtttagttatctgctttagtctaagtttttgacttagtaataaatgtgaatgcaagtataccatgattgatccctaccgagcgccacatatcaaaaccttagagtaggaatcaacaaggcaacatttggtgaggaattcattttgatacacttagagagactgagtgaatcacttgaggaacttggttttgtttttcaaaatcatttgaaaacttccggaacaagagttgaataaagatcgggtgattggtgctttaattgctgttctgtctttcaaccgctcaaggcaaggagaagcagtgtctcgtgggaatcaggggtaagggtaagccaccgtgccaaaaattatttaatctaagagagagtacatataccttgcacctgtatctttgagatatgcagcatagtagcaactcctgatcaacaaccaagtcattgtttcctttcgtccttcactcgggacgagcaaaggttcaagcttgggggttttgttgacggtcattaacgatcagtttcgaccatcaatattactaaaacatgagagaactagtgatgcttgcaatgcataaatatgttagaataataatattccactagtattaggtctactaaccttttgcagagaatgacaataaagtgaaggagaatcgacatcaagtcagacgataaatcaatcggacgatgtcgagaaccagacttgtgtatgaatgggccaagaacgcagacttgacacgatgaatcaggccaaaattcacaagtctacgaagtgaagcagcagaggaggccgccagccaaagttgggctggattgggccagccccatgttcggacgaaccttgtggttcggccgaacctgcctcgcctccgttggatctaggttttggttgtacggtgtagatgaagcccctatgacggttggagggtattaccgaccattccaatcgtcacaaccgtcatagttcagctagaaaaggacttcaccttctcacttcacccacacacttcaagcaagagctctctcattcctctcaagtttagtttagtagtatctagctggtggaatagaattagaataggaagcaggagtctggaagccttcggaagagttcgggtacggctctagtagcttttctttcctcttttgtaagctttgtacttttattaaatactcttctatatacatttatggtattgaaatactttccgagtatatgagtaccaactttacattatgttcatgttatactaactgtacggctagcttatctgggagatgctttggtgcgggtatagtgtttgcatatgcaattactctatgtcatgacgatgatattagagtagtatctggtaagttagacgtggtgtctagattatgggatatcattatttggggttatatattgcggatgagaggtgggccgctgatggtgacagctcagtacgggtattcctccgcgcctatatataatcctaagttaatttcatggggcgggtattcctccgtatttagccctggttggatggtcatgacaggctgtcgtaaggaactcggcaatcaggggtggcttctcgaagtactaggagggcatcggatagagggtaagccaccgtgccaaagattatttaatctgagagagagtacatataccttgcacctgtatctttgagatatgcagcaaaatagcaactcctaatcaacaaccaagtctttgtttcctttcgtccttcactcgggacgagcaaaggttctagcttggggggttttgttgacggtcgttatcaatcagtttcgaccgtcaatattaccaaaatagaggagaactagtgatgcttgcaatgcatatatctgttagaataataaacttccactagtattaggtatactaaccatttgcagagaatgacaataaagtggaggagaatcgacatcaactcagacgataaatcaatcggacgatatcgagaaccagacttgtgtatgaaaagggccaagaactcataattgacatgatgaattgggccaaaattcacatgtctgtggagaagagaagtccaggaggccacagccaaattgtgggctggttgggccggccccaggttcggccgaacccatttctcgaccgttggatgaggggtttggtagggacgcgccagatctactccagatggcggttgcggggtacatcggaaaattccccttccacaaccatcataactacctatatataaggagctcactctcttcacttcaacacacacctcaagcaatagctctctcatttctctcaagtttagtttagtagtatctagctagtggaatagtaatagagtagaaatcaggagtccggaagccttcggaagagttcgggtatggctctagttgcttttctcttctcttttgtaagctttgtacttttattagaatactcttctatatacatttatggtattgaaatactttccgagtatatgagtaccaattttacattatgttcatgttatactgaatataccgctagcttatctgggagatgctttggtacgggtataatgtttgcttatgcaattactttatgtcatgaaaatgatattagagtagtatttggtagtttagacgtggtgtctagattaggggatattatttgggattacatattgcggatgagaggtgggccactgatggtgatataatcctaagttaatttcctggggagggtattcctccgtatttagccctggttgtatggtcatcacgggctgtcgtaaggaactcggcagtcaggggtggcttctcgaagtaccaagagggcatcggatagagggtattagctagtatatcagttaactagaatgtatgtatacgtatcatggttcaagaaggcgctaggcgctagttgggcggatagggggcgcctagcgcctaattggcgcctaggccccgcctaggcggcgcctagcgggcgcctaggtcgggtcaaatagttaaattcaagaaattagtaggcatattgcatagaaattagactatataacactaaaatagcaataaaacacaacctaagtaatttaaccgcctaatgcaccattgaatgcctaatcgcggcggctacccggcgcctagcgcctaatgggcgcctaggcggcgcctagggccgatttttagaacactgatacgtatattaaaagtataggaatatattatctttctcttttctttctacttagctcacataatatattacgagaatgagtagtaatgcttgtgtcactctacccttggattatcttaacctttgcttagaatatgattatcacaagtaatatataaattattagttgagttctctctacatgatctttccacgggataaaataaatacgatacccttggaatattctcaggtaaaatgctacaatggtatatccgtgtgcttgcggatgaactctgtaaccataatataccaggagtatttctgcgccattgctgggaattatatttctagtaatatcgttaagaaataccaacaaccatcatcttgagggcagcctcctcgcaagcatgatcaactatgcctgcacaagctgtcaccaccatgttgggtaggtaggagggaataccatggacctcacaacggacctggtgtgggaacttgctactgagaggacaaatcctggtgcactccagctctgctgggaaaccaaccacaaatgccatgcagacgagctcagcaacgaaaccttccatgtcctgaccatggtgcgtgttggggcggctggccatctatagaagacaaaggagagagaatcaatgcatgctcaaatccaaatataagcgaaacgataaaggactcaagtaaaacaaacaaataagagcaaaattttgtacatatattattttgcatgaacgaataaatataactgacataactgagcaataaagtaatgcggaaattagatacataataataatcacaacataaataaactttgcaaccaatacacctcagctaggacctaatgcattcctcccattaaatctcgactgactgtcaaataagtcccaaataattttactaaaacccttgactgacctctttaataaatttcaattgaacgagcgatcaagatttttcccataaaccgaaggaacgaatcccaattttcctgaaacaaatccaattgcacagaacaaatgcaataaaaaggattcggagggctcttaggtttccatttggcttgtcctacgatcaaggtcggctctaagaccagcttgtcatgcccagaaattcccgaatagaactccaagcagaatgtgcattaaaacccattcccaggaccggccagggtacacaaacgacaatattgacatacagatccacgtcttacaaacattataaaagtcttacataaatgcagtggaaaagaaaaggtaaaataaaactaattcttgtcttggatagtgagcggcgctattccacaagcatcctcgacggcacggaccaagcctactcctctgagtagccaccatcaaaagcgtactcgaactctagggttgggagatagagcaagactgagtactacccactgtactcagcaagtcataccggaatagagggtatgatacaggatataaccaaggatagctaaaggggttcatttgcataaagctagcatttaagaataatagttgaaagcagtaaaacagttgtagttaattaatcaatattaaatcatcactgctcaacgctacaccacgttgagacaaacccaaaccaccacctgaactaaccagttcattaagccaatttattaagtgggattaatcacagtgaatctggtcaaccgcccataaccgtgggcacggctattcgaatagttctactctgatcagaggtgtacaatggtacacacaagatagccccacgacacgttttcgtgcgccgacatgccaccacggcatatcggaaagaggccgtgacaggaccattcgcataatcccctctaaccaatcgcaccgcaccctagcaggcaacgggcagcttcttcttgtgccacggtgaatccggaagctgcatagacgtcgcatggcccatccaaactccatcacgctcaccctagcctgggtacgtcagctagaggaaagctacactacaatctcagccgttgccaacgctggcttgtggtaagtacactaaattcttccagggtttcccgcgaaacggtccttaacctccatgggtgcgactagcaaaaccatgcacccacagcccaccatttagtgtattttagttgattaacaccatcatggtggtacatgtccaaagttatgctaaaccaatgtctaagcatttagcgagaatcccccattgtgtgctagttcgactaagcaaggctaagcaagtcctaatccaacatctaatcatattacaacccaagatagcggggtgcaggaa

SEQ ID NO: 80523 - DNA, 11912 bp, Oryza sativa
ccgtgtttatataggggcggggagctcggacgtggccgggaggagcacgaaatggccggcgaagtgggggaggtgtgagaggagagagaggcgggattcagatttcgaatcccgggcatctcgtgggcgcgggcgagtggggaagggggtagtggggcgcgggggaaggcggggcatgctcgttcgttggcgacgtggctcgggaggggcgaagaaggtgggagaggcggttgcagcatgggcgtcgacggcgtccggaggttgtgggaggacctgacaagtgggccctacctgttggtgaccccgggagagaaaggagggggcacgtgggctgcgggcttggcctcgggccagcccagcaaggcgcgcgggcggaggggaaatgggctgacggcccaacaaggggaaaaaagagagaaaaaggggaaaaagagagaaaggatttccaggggattatttaatgcttgtgcttaattttaattgattaaaattatctccaaggctctgaaaattccactaaaatttttgttagtatattttgacatgtagaactcaagaaaaatttcacatgccattttacggtttctctcttgacttaaaaattttcttgagatgatttattaattttaatttctgcttaggaagaacttcaggttgtggcatgctgtaactcccgtaatctgaaactccctcctctaactcctcctttcgtgatcgtgatcgctgtaactcctctaactcctcctttatgtcccgtactctgtaacgtaattgctgtaactctgactccccctcttggctactcccacgtaagcgctgtaactcctctaactcctcctctcggtgtcgcgcctgctttaactcctcctctagcttactcgctaacactggtggagaaaccatcttttatcggtcagccaaattccacaataatcctggttctaataaaaactgggactaaaaagcatctttagtcccggtttaaaagttgaggggtacttattaccaaccgggactaaagatcatttttagtcccggttcaagaagttgaggggttcaagacagaccccgattatttttactaccggttggtataaacaaccgggactaaaaacagatctttagtcccggttgtttatatcaaccgggagtaaagagtaccccgaaccgcgcgccagatattatccgtgcgccacaaaaataattgtttataccaattgtttttacttccggttggtataaacaaccgggactaaagatatctcccccttcatccccttcctctcccctttcccctcccgtacctccccttcctctccccttcccccttcatcccgggcgggctggcgcggcggccagctggccgggcgggcgcggcgggcgcggcgctcgggcaggctggcgtggcggccggccggccgagctcgcgcggaggccgcaaggacggtggccgggaggccggcggcgccctcctctctgctgctgattttttttgaatttttgattcattggatttgatctgtgatttatgtgatattagatctgatgtgggagttgtgatgtatttcttttaggatttgtgatgtattttttgtttgagattttgtgatgtgatgtattgtgatctgtgatgcatttctttccaatatgtgatgtatttctttccagatctgtgatgctactttgatttggggatgatttgggaatatgatcggggatatttagggagcagatcgatttgagaaaaaaaaataaccggaactgctcctgatggatttttagtcccggttattttacccgggagcgtaactcctctgactctttcaataggtgtgtctgcgcaattcccgttccagttgctcatccacttgctgcagtagaagcaagcgccctcgttcccgttccagttgctcatgctccacttgcagctcctctattgtctggcgttttccctgacgcccgcgttccagttgctgcacgatttcctgatcctgctgcggcacatccactccaagcttcaatcgtaacttccgaagactttctcgcccctccttgatctccttctgtaggcgcccacgttccacttcttccttctttttctcttcttctatttgacgcaggtccatgcgcagaggcgacgcccggtaaacgcggacgccctgcctgcgcatgctatcatagaacctctcgggattccagacggcgacgtaaacgccgatggcgtccgtgaagttgccactccggccgcagaagccgacgatggaccccgagtgctccatggagacctcgaaccgcgtccatccagctctgtcttctccaagattgccgtatggtccgaacgtcctgttccggttgctcctgaactgcaaccaccggatgaggtggttgtcatggtagccgcacatgtgcgtcaacacctccccatggaagtcgagctcctcctgtgtgcgtccatgcatcaggttatttgtcagtcagtgattaattagtacaaagcatctctctgcaagctgtttgttttaacggaaaggctatatggctgttgacagaaaaaggatggatggatcattcgttttttgggccatccattcatctttgagattagtgctgattatgttcgggctttgatagacatgcagtttttagtcctttgactgaccttcgtgggacccacattaactattgaattttgaaattcgcgcctgcattatctctgtttgagagagagaaacgtagagatttttctatccctgagacagaaatcgagaggggaggacacaagagaacagatttttgatatttgacttgttctttcggatattgcactacgattcgtcctagaacagtgcgagatgaggatgagggcccgtgtttcgacatgcctcgtggtatcgtggtagtcaacgtgactcgatctccgtgcgaaatttctgattttgcgcgacgtgactcgatctctgttcaaaattttcgatttttcacgctgtgtctatagagtggtttttttttctattgtatttaacgttttcttagccgtaggattatgcgctaagattagtgcagaaaattacagtgctatataactaaaattacattcgtaaattcagttgatacgatatgtaagtgcactgtaattttgataaaaatactgtgtaaataaatatgtatttattatttcctttaaaatataaaattacaattctatagacctaatattacatttgtaagttaagttgatatgacatgtaagtgtattgtaatttcactatagttatactgtaattacaatgtaactataatagaattacactgtaacttttagtgtaattgcagtgtaactatagtgaaatttatcttctatgcattagcatatacctaattgagtatatgtctatgggtaattcaatatggaagtttgctagttttatggatatgggcattttagtagatctgaaagtttgttcttggatatttgacatgtttttgtttagcttatttgagctttaaattgtgcttcctgttttttttctcgctatatttttgggccagtgattgctcctctaggtttatttgggcatgtgatttattagatattgaatttgggctttagaatcagtttgttgtactttctggtttgggctcaagaaatttgggccttcgtatgggcatgtgtttgggctcaggaaaaaaaattgggcctccaataaaatcatatatgaaatttgctcttttattttttcagtttgttttttatgtcaaatatttccagcggttagatctttatcctaaggctataaaatctgcatgatttgagcataaaaattctgtcaaataattttctcccaaattaaaccgttcaatcgacgactgagtatttgtctgtgtttttacataattaaaacagtggaaaaattaatacaactccacgattaaagaagagtccctactgattctataatacaactagttgataagttctattagatcatgattaaatgaactagtcaccggctcaccgctcatgaaaacctttatgagattgtcagaagcaagaagcagaggccttgggctttaataaattggtcatgatctgtgcccatcgtcgttaccaggagttgttttacgatacacggtacaagtgacaaggggcactggtgtgagtaaattctaaccattcatttgcgtgggcatttctttaaatggtatattaattgtaaaatttacccacctttccaccgaaggtaattaagtcaatagtttctttctctacagctacagtactgaacccttagcgcatcattactgcaaaagcctcataggtgtgagttcatttaaaaccggcacatataaacctttccctaaatccacaggatgaaaaaggatacaaaaacgtcacctttgggtaactatatatgctggttgtagaggaaaatcaacacaaatactataggtgtcggttttttttagaaaaacttgtacctataatttataggtactggttaagtaaaagccacccggagcgggcgacgaataggacgatgtcggatgttggtggcgacggtggctaggtttgcggttcgatgacggcagcgacgacaacaacctccagcatgctcgatgttgacacgagggtggcactggcagcggaggggtgaaggcggatcaggtgggagtggaggatgcgcagcgatgggcatctaatctggtggaggctggcctttagtgagcccgttccggttttggccagccttgagcttcttggatccggtggctgtgggttgcggctcagaaaggcaggaccacgatgtagtcagatggatctagcccgccgtactcttcatcttctgcgggagaccttgatcgtctgggagaccaccgagcggtgtcgagccttggggcatgccggatctggcggttgtgggttgggtggatgtagaaggtagagggagaggaaaaagagataagacgagaaacaaaagagcaaaagattattattttaagggtttgagagaaacgaggttacgagagctggggtgttttttaatctcattggagcatgatttgatcactaacgctaaacaaatttagccatattccattttagcaatgtgattttggaatttattttagtcatcttatactgcttctagattttgatataatcattagatttgagcttagttttttttttagattacgtagtgaactctagtttatacctatgatgcagttctatggttagtttttaatctatctagattttactgaactcctggttcagactaaaatttttttagatcccattcatctgttgtttttcgtatttattgattaaaattaaatatgtatataacttatgttgaaagttatacatcaagcggatttgaataggtgatgttctaatgattttcagttgtagtggtttgctgatttcactgttcacgcattgtagcatcgcgtgattgtcgacggtgttgtgaatttaagtattgtgtttggtcttcttttttttattagggtggttaatttagggctgtcatagcattataacagattaacagtactagaatgattatttgttttatttctgccgcttgtttgtttttgttgtatacattgaaattaaaattaagcgataaccattcacccccttctgatcaaggcaacctcgctacaagtgccatgcgtacatcaagccgctcctccaaagagtagtccaaagagtagagtatatatagaattttgaatccaggatgctataatcgatttttaattgtcaacaaaaagtatttagattttgggtagacatggcagtaataaatataagtttctaataagatagagtagatcctataaggagtggagaaattgttttcacttggaaaatcacttcctaagaacaaatctatcaagtattgcttgctacatacctcgggtattccattgcctccctctccttgcagggtacctttcacacgtttgccattgtcgtcgtattcaaacaacattgagctgacacaccaggaagaccctatactcattcggcgtacaccggtgtaaccgccagcactggcaccatggcctccctcatcccaagcatggcctccagttccaccccacggccctatcttcacacgctgaagtgtcaagaccattaatacacctatcactggtggagaaaccctttgtagtcccggttcgtaacccccctttagtcccggtttccaaaccgggagtaccaatccgggactaaagatcgctatctttagtcccgggtgaaataaccgggactaaagatagagctgacctttttttttttgcatgcccctgttgctgcatggtttatatatatatatatatatatatatatatatatataaaccatgcatatatatgtttcaatacatatatatgcatacatatatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgtaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatacagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcacgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcactgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagtttttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgcaacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcctccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaattcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcacaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattacattgcattacaaatataacaatcatttatattattacgtcacttgcctgctccaattccttctagggctagctcttccactcaggcttgacggacgactccgacaacacgtcttttctgcaagataaaaaaatgtattaggataaatgcgaagtaacatatatatatatatatatatatatatacatgtatatatatatacatgtatatatatatatatattgcatttcacgttaacgttcgtcctcgttcgttcgctcgttcacgttccctagctcgttcacgttcgttcgatcgttctcgttctcgttcacgttgtcgcggcaacgtacgttgacgtgttcgttctcgctctcgttcgttcgatcgttctcgttctcgttcgttaacggcggtgtggcggcatcggggcggcggttggcgcggcggcgtggcgacggcggcggcggcgtggcgttgtggggccgtggcggcggcggcgtggcgtggcggcggtggcgtggcgtggcgtggcggcggcggcgtggcgtggcggcggcggcgtggcgttgtggggccgtggcggcggcggcgtggcgtggcggcggtggcgtggcgtggcgtggcatggcgacggcggcgtggcgtggcggcggcggcattgcgcgcgcggcggcgaaggcggcggcggcgtggcgacggcggcggcggcgtggcgttggcatgcggcggcggcgttgcgcggcgtcaaaggcggcggcgtcgaaggcgacggagagagatcgagatcggagagatcgagatgcatgaagggagatgcggcggctctcaccccagagatgcggcggcagcggaggaggcggaggcggcggcgaggaccacgagctcgagacgacggcgagatacggcggcgtcggcgcgggcatttgccctaggcagtggcggcgaaggagagaggccgagagagatcgatcggccgagaacgtttaagtgttggttaagaag

SEQ ID NO: 80524 - DNA, 76846 bp, Oryza sativa
  unsure (1)..(76846): unsure at all n locations
gctatggcattgcagaagctgatgatgaagcaaaatcagaatcaaaggcagagctacttcctactattgttctatgtaaagataaaaagaagggaagattgaaaccaagaagagcaacatctcaaattctagagaagcctgaagattcaggttcagatgcactagtgcctgaagatatagatgacctgaaaataagatagttcagactctgattataggcagcctatagagcaagatagctctggagatgatgaagaagctgaacaacttaggaaatttgcaaagaaaatcaagagaaacattagggcaaggaagctaggagttcatagtagccaggctgtagagatacttgatgatgcactggtgcctgaaaatatcaacttagaagatgatggcagtgtgtattataactcaagtgatgactactcctatgaggagaatagtgaaggagaaacaattagatggaagagcactaataataggtttaacaaaaaaggcatcatttcctgtgttctctcttagcatggcatttagatcaagtaggcagttaaagaaggcactagtgaagtacgggctgacaacacacagacatattctattcccaaaggatgaaagggacaaggttagggcaacctgctattgaccaggatgtaaatggctaatatatgtgtcaaagacaagtaggtctaaatggttccaagtggccacttttaataatgagcattgttgtccacctaggagagataacaagctagtcacatccaggatcatcatgggagggctgggaattctcgaaatggaaaaattcacatctacgcttaggctacgatggttgtggctgtttgatacaagcagaccttgggagctgatggagatgccttgcaatatgcgagatgtacaactcttccaggcatgcacaaaaatcacagtaggagatggcaaaaaaaactcttttttggaaagacaattggttaccaggtttgtgcccgaaagatcttgctcccaacctcttcaaattggcaaaaataaagaataggaaggtggaaacataaatgatagacaacacctggctacattcttttagacagatcactaatatagaaaccatccatgaattagtgcaattgggatccctcctcaatcaaataactctttctgatcaacatcatgatgaaatatcttggacaagaaatgcctcatgaatcttctcggttaaaagcgcctgccgcttccaattcatgggttcggtgattgatcatattttcaacctaaattggaaggctcattcttcatcaaaaggctcttacagcagaaaacctgctaattagacactgggaatgcgactggatctgtactttatgcagagaagcttttgaagatacagaccatctgttttgccaatgcaacttcatcaagcaggtatgggcaagaattgccgctgaaaaagggattattcccaatcctaacatttccaccactaacagtggatgtgttctctagggtccactggccttaaaagccaaaccaggtcaaggatcggaatcctgttaaagacatggtggcatgtttggttgcaacaaaacggaaaaaaaaatcaattcccaagccccaagtctacaaagaacaatatcactcatcctcgacgacatacaggagcaggatatggttttcaaacctccatgaagggagaaagtcctgtactcattgctagagttggttgttttaagaatattttgtaatctcaactttgtaaacttggctttctaatctcctaaatatatctggctccttgctagagttggttgttttaagaatattttgtaatctcaactttgtaaacttggctttctaatctcctaaatatatccggcaaatcttttgccgctttcacttcaaaaaaaaacatccaggatcatagtaaataaatattttgatgttatcaaggataatccgacatggaaagtggaacatattaagaagtcagttctaaaggacatgcttgttgatgtgcccatttcaaagtgcaagcgggccaaagccttagtgctacaagaagcattggataaaactaggggagagtctcaagagtgtatgattatcaattggagttgttaaggagcaaccctgggagtattgtagttgtgacccttaatccagatatacttgacaagaaagtatttgagaggttttatgtatgctttgatgcttgcagaaaagggtttcttgctggttgtaggagagtaattgggctagatggttgtttcttcaagggtgcttgtaatggcgagctaatatgtgctattggaagagatgctaataattagatgtatcccattgcatgggcatcagtggagaaagaaatatatgattcatggtattggtttcttgggtagctaaaaaagatctcaatataaatgatggaggtgaaggatgggtgataatttctgaccagtaaaaggtatgctttttaactatttatcttttaacaaaatgtgcaatgggtcctaagttgtaataaatattttgaattacctgtcttgtagggactcataaaggcagtggctgagcttatcactagagtagaacataggatgtgtgcaaggcaaatatatgcaaactggagaaaaaaggacactgaccagaagcttcagaaaaaaatctaaaactgtgcaaagtcatcttgtagggagcttttcaactataatagagcaaagctagcacaagacacccctcaaggagccaaggacatgatgaccaccacacctgagcattggagcagggcattcttccagctagtgtcaaattgtgactccgctgataacaacatgtgtgagtctttcaacaactctattatggattcaaggttctttctagttatctctatgaatgaagccataagattcaaggttttttcaacattagctctctttgaccatgtcctgtacatattttttttctgaggctcagccctcaactctgctctatcaatatgtaaggcaaaacctcttcccttttgaaagttcaagtgctattaatttggttttggtgattaatgataaatccaattatatgagactaatttttttataagcattctttgcctagtgtcatgtggatatgaaagtgaagtttgtgataggtgattcccggacttcatatgagttgaaatagaaatgttaattgttcgtggacctaaatcacaaggatgaaatgcattgacctaaatcacatctttctctctatgcacatattgatatattcatatataatattttcatgtgattgacatatggatttgagactaatgttttgttgagccatatcttgtttagtctcttcacattgagaatatggagatgatgaaggtatgcttctaccttaatgtctacatatgataaataccttctattcttgtatagggtaagctcacgatgttttatctctagttatgcatactttttcttcacacacaaaaaaattgtatgcatacatttaggggggtaaatcctataccttagttatgcatgtattttgtcacatcctgattttcgtcttaggatttataaattatttaataaattattattagaatttatattaaatgttcattaatttacaagtgaagttaattgtggaaaataaaatttcctaaatataaagcatggatgtatttaatttttattaaattctccatggttaattatactctctggaattttctcggattttttggagctcaactcttaattttaatcatacaaagaacaattcagtaattatccacatattaaattaatcattaaatggtctgattataattttgttaagtactttgagtgtccaagtattttcaggatttttcttgaaattatttgagcattggaagtatttttaacaattcaaagatcatttcagtgattaatttaattggaaaagtaattaaaattcaccttttccttttcgggccgaattagggaaagtcctctcactctcggcctagtctcctctcagcttgcagtcctttccctctctttcccgaagtctgctttgtgtccctcctttaatcagtccttggaagtagaagcccagccgaaagtctagtttgcttccctgggcactgttcatcttcaagcttggacagaagcctgagccagccgtcctgtgcctggaatcgaattcgtttttgagtttatctctccaactaaccctcggtttttccggctcaaatcctctcggttggagtccgatctcttcaatccaagcctataaatagcatcccctagtcgccctctttcgtttgccccatctcccgagctctctcgtgcctcgtagtgccgccgccgcgccacccaaaccgccgccgtcgccggccggcgaacagccgcctcgcgccgtcgttttagccgtcgccgccgcctcctcacgccgccgtcgggtgcgcgtggaagaggggaagctccgccgcccttcgccgtcgccaccggtcgccggagagccgccgccgccgtccaccgaaccgccgccgccgcacaagctcgtcgccggtcgccatccgtggtcgttcgtcgcattggttagtaccggtgagatcgcgttgttctcctctacgcgtaggtgccctccaaaagtccggccgagtcccctagcgccggcgaggtcgtccccgatgacgagtcgacattgatgacgtcagcatgacgtcatagccttttctttttagtttttttaatagatgcaaatagtttaaaacttcggaaattcataactaattcatcgtagctccgattcgagtggttcaagttgctaagtttttctaaaatcaagatctacatgttaaaaatatccacatgtactgtttatgattgtttttgtactgttttgttgattttgttcatttgctttagtttccgtcgttccggaggagagcgttttcgttgaggaaggttctgaagtgtttgcggaagctcaaggcaagtcacccagatcccaaacaaccctttgaacatgttgaacccgtttaaagctaatgatttatttcaacttatgcattattttcgaatgtcatcgggtgatgagcctttcccaattaaataatggccgaacatgactttattttcctatgggttataatttgattagcttggaccttatatattggattggttcagctaaatgccatatgtatgtttgcttagtcatgcttaaacattagctaattaaaggggattaaatataaatcatattatattattattaattacggttatatttaatggtagctcacgatggttaatcgtgttatgttatgtaaattaattggtaattaaaactggattaaggtgggttgtgagcacatggttttgaaggtcgtgctcatgacaattaaggaccggttcgcgagctactgttgtgaaacatttaccgtgccaaccacaagccagtgtgagcaacggctttaccttttgtatagcatgattcattacggggcaccagactgtgaagcggcgagaagtccatgggggtcgctggggagtccattgcctttggttttgagggggagattatgatccaggaacggtgcactgtggtgagttgtgttgtgcgaggggtattgtcacagttcctttccgaggtaccgtggtggtgctaaggcgcatggtgacatgttgtgggattgcgtcttgtgggtacagtggtacacctctgatcaaagtaaaactattcgaatagccgtgtccgcggttatgggtgagttgagcaatgtttttcgtgattagtcccacattactcattaatgttaataatgtgataattaatttgactcctggtttggaatggataattcctggtttggaggtttgatctgtacgaccggggttggctgttcaggtttggttgggcctgtgcagcattggggtgctgttcagtgtcgattaaaattgatgattaattactctactgatttacttctaaatgtttgcttaatgctgctttcgcaaatgaacctatattatgccatcctttggtatccttgtgcatttgcatatttgctgtgtggcttgttgagtatgtcatatgctcattcttgcaataatcatcaaacctcagttgaagaaaaaggatccagaaggagaagatgtttggcttatactccagttgagctgcctgtgggagtggagctgaagccatcgctagaccgttaattccgctgctattttccttttcttttgtaagtatgtaacattattattatgatggatttgtatattaaattgtcagtttgtgtacctcggctgattcctggacgaggattttatgcacaaattagtttggaaattactagtgaatttctgggcgtgacatatttgatccaagtttttcacttgcatttaattgggatctttacatttgagtacatgacacttgtgatattggttaatactcatccacttccttttatatgcgcgattggttgatcaacatgtagaggttgacaaccagatcattgagaccaataatttcattgagttgaatgagaaacattggtcccaaggattgaaaaggtgttgatgctcaatcgatatcattacagctaaaatactaagaatgacagtggagatattgaagatgcggaatacgaagtggctattatggcaagacgatcttcaaatgattgatgctcggtcgcgatggaccatgtgacagtgaagggcaagcaaggggcttggcgccgaagagccaaatccggtggtgaatggcgagtgacagctttgtcatgatggaccgtgcgagaccatttgaagctacaagtaaccgcatcaattatttgaagaatatatggtgaaacggttttggcgttgctgttccttaagacaaaggaatgaagatgaaaagaaggcattccaattggtataattctcttcctatataaatttgagtatagtaatatcgtactatcaagagggatgcagcgtcgatgtgtttgtgtatgtttcggtgctcaaagtgaccaatcatagtgctaccttgagagacactcaagctttaacatatcctttgagtggttttaactttgtttttggttgagttaggtagtcctctaagtgagcttttcatagagttcaagatcatcaaaaacggactcccgagcgaaaacttatggtcgttttatcctgtgcttttcggaaattctgaaaatggctgcgaaactgagataggcttctgttgattttttgcacttgtccgaaaatgcattttggaaattccgaaaattacagtcttggcctccaacggctagttttgagaggcttgggtatgtaaactcttccgccctttaagtggctgctgttctggggcaatattagacacatgtaaagccaaatagctttttcccatttccctacctttgtggtgcctctttgtaagagggatttgagaaggggagagagttggattgagagagtgagaagttaagagctagcgagtttcactccatactttgagcacttgagttcatagcaaacaaatcttcagttgtgttagttactcttggggactaaggtctcctaaacggctaggtgttgccagtgagcgcccaagattgtggtgtgcctcgaaaagtttgcgaaggctttgatttcgcctctgtaagggaagaaatcaattgtgaaatcaaggagtgcatttgcacaacctcgtgaggaaagggttaaaataaacctagcctttgtggcccctcaacggagatgtaggatccgtggatctgaacttcgagaaacatatcaatgtgtctcctttcttgctttgcttattcttgtcatctctcatattgtgcttgagtttttttttatccaatcacttgtattcttaattaatatagttgatgaccttatatcttgcttcaatctcttgtttgtcaccttttgattcatatacattttatttgtttgagctacaagttcatagctagtgtgttgtttcgttatccgctgaattttcggttgaaactgaaactttcaatcccataccagaagttccgagttgaaccggaagttctcatcattctaatatattatgaagttgtgataatttttttaggaacgcctgttcacacctcccaggcgatatcaaggtccttttacctttccttaaaaaaagacgttgtattcatgcatattttgtgacagtgcattttcagaatcatgtgttccacgataactctgaatgctgaatataatgagttttatagctagacacggttattaacaaagtaggtagaattaaatagtggaagattgtgattggttgagaagtgaaggtagggaaattgaatggtggagggttgtgattggttgagaaggatatgttggtgaagatgttattatatttaggaacaaattatagaggctaaaagtttttatattttaggacggagggacgagggagtactgacttttgtaattctcttgtaggggtgaccaaaagagattcataatatgcagccacatcggacgtacacaaaatataactaaacttttttactgcagagcttataatatgcagtctctttggacagaggagtatgatttttttcttaaaaaaaatcatagctgccaaacaccaccttattacagagtcacttattaggtatacacgcatgcaccgctcagttattagtaatgaaacaaagcatatccagagaccaccttattacagagtcccaattcccttatggggagtcatccttaccaaaaaaaaaaaaagaaatatcgtggctgcatggaaaatagaaccttcatttcaggatttgcagcatcggcaggtttggcaatgttttttttctttttgaggtttggcaatgatttttagagtgaccatataagctgctactgacatcgtaacagttaaagcgaaatgtgccagcttcgaagccttgatagatttggctcggatggctgcagctatcctgcagaaacaaaaatacatgacaaaataaattagtctttccattacgctctagtaacatctacaccttcatagctctgcactaataaaaattatttagggaaattaaatgacacaattgaaagagcatcgatctcccaagataaattatcaaattaatagtaggcccatttcaactggagatagccaagaaacgagatatccccaaaaaaaaagtaaattttgtacatgagtctagacaactataatatccagattaatatacaaaaaatattttatttagatgcaaaagggtatgtaacctagttgttgcaatgaactgagttataccccaaggtactgagttccccatagtaacgaatttcaaattagattatttgaaagaccaaattctcatttttttaaaaaaaattaaaaaaaacatttagaacggatttacggatggagtactgaggaagcacaatacaataacatatatagaaaagcatggagagcgtgtccaaggttttacaattaactactttatacttactcggcattacgggattccacacaatgtgggcacttcgtggttgtactggacgagtaagtttgcttggcccctccaaacggatttgcaaatgcaaccttcccgtgattgcaatcaacagaggatgtcgcagtttttgcgcaggtcattttatcacttgaataagggcatattttgctgttaaagtaccttgcagcctgcatgagaaaggttcagagatcagaacatgaattcggtataatattatatatatatatatatatatatatatatatatatatatatatatatatatatatatatatatatatatattataccgaattcaaatgttcaatataaaacttgtagaagagaaaatattgttggtccctagtccaatgtaaaactctgataataaaagatatcctagtgtagaattcacaagaagaaatattattttcccataaatgtatacgaggtattgtttgacatgccactgttccatataaaacatactccctccatccgtgattgcagtggcgaaactaggatttgaatactgtcacgccctgaagttcttctccctagcaaaaatttaattaataaattgtcgcaagaaattatttgtttaaaggcaagagagaatttttcttggaatcggcatgtggaatttttcttggattctacatgtcaaaatatgctaacaggaattttagtggaattttcagagccttggaaataattttagtggaatcccaagaagttggaggatatacctatagtacaagagtatcctgaggtgttcccagaagacctcactacaatgccaccgaagagagaaatcgagttccagattgatctggcacccggaactgctccaatctacaagaggccgtacagaatggcagctaatgagctagcaaaagtcaaaaagcaggttgacgaacagctgcagaaagggtacatccgaccgagtacttcaccttggggtgctccggttatctttgtggaaaagaaagacaagaccaagaggatgtgcgttgattatcgcgcccttaatgaggtcacaatcaagaacaaatatccgttgccaagaattgatgatctgtttgatcagctaaaaggagctaaggtgttttccaatatagacctgcgatcaggctatcatcagttgagaattcgggaagaggatattcccaagacagccttcgccactcggtcttgctctcttttcccccacactagagttgaagtccttctcagttgaagatgtcacaaagaagttggtttcgtcgctaccgtcaaggatgcctgtggaatggagtcgcccactgtagaagtcaagtcttcaggcttagctcgtttttttcctcttttttccgctgcatttgtaatcttttatatttttgtaagacgtggatctgtatgtcaataattgtcgtttgtgtaccctggctggtcctggacaggggtttaatacacattcagcttagaaattcttagttggtatcagagccgaccttgaccgtaggacaagccaactggaaaccctaagagtcctcttaaaccttttcatttgcacatgccttttgcacttggatttgtttcggtataattttggggtttgctcttttgatttgtgggaaaaatcttgatcgctatttaatcgtatttctcggctagaggcagtctagggttctagcaaaactttatttggaatttatttggccttcagtcgggaatttgttaggtgatatgcactaagtcgtgtctagattcgatgggcatttttatgtgtatattatagctacgcatctattttgtgcattaatttatcgtttagtcagttgcattagtatctttgtctgggttcatgaaaaatgttccacgcataaaaatcatcatgctcggcgagttatttgagtcatttgttgctttatttaatttggttttgagcatgtgttggttcctatccctctgtcctctttagatgtcagacctgttctctgatcgcaagcgctgctccaagcttcagagtcgccgcctttatccttaacattttcttagttttggctgcttgctagtttctgtgtttaggtttgttgcttgtgggttagtcggcggtcgatatcatgtgttagtggtatgactgccttaattaggagttgtttgctttctttttagttttttaatcaagattaaattaattgcacttaaatctataagaaagattagtttccaagccatctgttttcttcctttctcttatttctacctatcctcgtccagatggtgaagacagggaatgatccccgtgcctccaatgacgctaggggcagcgaagagcagaccgatggagctcatatcagtggtgcatctgacagcagttcatctccaccgcccgagaacccaacggtcactcagatgatgacaatgatgatacaacagatgcagcaacattaccatcagatgttgcagcaggcgcagcagaaccagcagtctggtcctccatcatcacacctgtccaaactgttagactttcatcatatccagccacccactttctcaagcaccaccaacccaatgtaggccaacgactggctccgtgcgattgagaagaagctgaaccttctgcaatgcaatgaccaagagaaggttgcttttgctacacatcagttgcaaggtcccgcttctgcttggtgggataactacgtggtgacccgtccagattcaacggaggttacttgggcagagttttgtcaaagcttcaggaaggcacaaattcctgaggggattatggcacaaaagaaaagagagttccgcgcactgcatcaagaaaccaggatagttacagagtacttgcatgagttcaaccgccttgcgcgctacgctcctaaggatgtgcgcaccgatgccgagaagcaggagaagtttttgtttggtctcgatgataaattgaccaaccagctgatctccggagtctatgatgactttgagaagctcgtggacaaggctatccgtcaggaagagcaacgcaacaaaatggaccgaaatagaaaggtagctcagatcagctttcctcaggggaacaattagaagcctcgcttcatgacgggacagctaggtgagccttccaccctgatcatccgtcagcaccatccttaccacccgagtaacttcaacaacgactacaacggtggcagtcacaacaacagtaagcagcataaccacaactcgacttcacccccattaatggcaccagctcagtcagatccgccagctatgtcagctcagtcagaacagctcaagaaggagtctgcaggaaagccaagaccctgcttcaactgtggcaagcacggccactttgctggcaagtgtccgaagctaaagcgcgttggacctaggttcgtccaggcccgcgtcaatcatgcgtctgcagagaaagcacaggcatcaccagaggtcgtgctgggcacgtttccggtgaactcatatccagcaacagttctctttgattctggtgcctcgcattcttttatatccaagagatttgctggggcacatggattatcggtagtggaacttaaaatactgatgcaggttcatacccctggaaatgacatgaggacagcacactactgcccctcagtgactatagagatcaagaggtcacggtttctatccaacctcatccttctcgaatccaaagacctagatgtcattctcggaatggattggttgaccagacacaagggagtgatcgactgcgcaagtcgcactatcaccctaagcaacgacaaaggggagaagatcaccttccgttctccagtgtcacagaagtccgtagcgagtctgaatcaggctgttattgaggatcagacagaaatagcggaaaaaaatcccaagaagttggaggatatacctatagtacaagagtatcctgaggtgttcccagaaggcctcactacaatgccaccgaagagagaaatcgagttccagattgatctggcacccggaactgctccaatctacaagaggccgtacagaatggcagctaatgagctagcagaagtcaaaaagcaggttgacgaacagctgcagaaagggtacatccgaccgagtacttcaccttggggtgctccggttatctttgtggaaaagaaagacaagaccaagaggatgtgcgttgattatcgcgcccttaatgaggtcacaatcaagaacaaatatccgttgccaagaattgatgatctgtttgatcagctaaaaggagctaaggtgttttccaatatagacctgcgatcaggctatcatcagttgagaattcgggaagaggatattcccaagacagccttcgccactcggtcttgctctcttttcccccacaccagagttgaagtccttctcagttgaagatgtcacaaagaagttggtttcgtcgctaccgtcatggatgcctatcgaatggagtcgcccactgcagaagtcaagtcttcaggcttagctcgtttttttcttcttttttccgctgcatttgtaatcttttatatttttgtaaaacgtggatctgtatgtcaacaattgtcgtttgtgtaccctggctggtcctggacaggggtttaatacacattcagcttagaaattctggttcgtgaatatctgggcgtgacaattacgagggggaactaaattgacaagtgatcataattatattttttcttaaaactaggaaggtagcccgcgcacatgcgcgtgcaccttatttaatgtgcatgaaattttgttagggatgtccatgtgtgggtgtttctctatctaaataaaaattgaacttatttaatgtgatttgaatgctggttataattttcttatgattacccttgcagcacataaattctaaactaaaattacttgagactgtacacttcataatttataagaaaatattatgtcgaaacaatagatgtagttcctatgagaaaattttggtcattttgacttctcgcatagatatcttacccccaaacatttgctcaaaaagtcatttttttgctagatagtatttgaagttttacatattttcattccatctagctttgctagaagtttgaatgtttctgtttagaatgggttttcaaaccaattttttttttaaaaaagataatttttgttaaattttgattcttttcatgtacattttttaaagaaatttggagaattccactctatgaagcatatttgaaatgatttgatttctgcaatttgggttaaaaacataagtgggttgagcctacaacctgacatggggtaaagtcatctcttctgaattatctcacttcaattgagtaagaaatattaaaatagaggtcatgtaataaatacacattattatgttgtctataaaaaattaacgctagatggggtacaaattatgacgtaaaacacgatatcatttaaagttttcctctaatttattggtgacttcatagatcatatagataatttagactctatgatcatcttaagattatttatttatcttctaaattgatcattgattgataaaaaagcaccaaggtcatattatataggtaagtagcccccatatacatgttgagagaaattaataaatttgatagaaagtgttagggtctaacaggatataagtaatgggtcaaccagctttattaaaaattaaggtgggatattctgattttcaatgacgaattttagtatcttttttaatttattgttggcctcaagatggatgtgggtctagaatataatttttatgttagcatttaaatatagacaatatgaatattaatgtattgatttcactaaaaatataatagttcgaacagatcataagttgaatatatgatttgaaaagttataaatattttatttatattgttcctataagtgctagtaagagagagaaggacagggacagtgggatacatggctagacctaatatgtggaggttaatttgtggtttttcctccataaagattaatttaattttaattatcataatataaaaataagagaaaaggaacatcacaccgcacggggacgggaagggagggaggaggatgttttttcttaaaaaaatgattgatctaatgacctaaaataatgtgttggatgtttaagtcgaaaacaatggtcggatgttttgtttttaacttaagagagaccagtagtggtttagaaatatttataggatgtttaatgtatttaacattgcaggggccgagagtgaggaaataaggtttgtgagtttttttaaataaaaatctaataacaacctaaatgatatgtccatcgatttaagtcaaaatggtgttttgttcttaattttttatgattttctctaatttataatttaggagtgtcactgtgtggtttataagatggttaatgggctttaacgccgcataggagcgcggagggaggtttgggatatatttttttagaaaaagataaatctaataacctaaaataatgtatatagatggtcgaatgtttttttaaggttttctctaatttaagagtgctatatactcatcccgtcccataaaacctgaacttaaaataggatgtggcatatgcgagaacagcgaatttggacatgtgtttagaaatatttatatgatgttgattgaactatttatttattaggtgagaatataggaagttggctagatctagtaggttgatgggctttttaggcccataaaaaggtatttaatttaaattatatggggatttaaaaaaaggagaggaacggttggttggaggaatcgcacgtacgtgcgcgcggaggctcacgtccggacggagttatttttcttgtgaagatagatctaaatatgaaaattaatgggcccaccaatttaaataaaaatcaatggtcagattttactaattttttagagtgacacatggggacttaagagcatttataggataccacatggcagccttagagcgtttgtaggaagtttaatggacttttagtatataatagatagattatatgcaaatttcaatgttttctttaggtaatgatgcatcgtattaacatgaaaaacatattacaacaaaaaacataggcaggaagttatactgcatatacttatttatttatgaaatttagcatgataagaatgttgagcaaatatatcataagcggtgaaaatatcgaccgagataaaagtctagataaataggctttcatctatatcgattttgataaaatgattaacaaactatctatcttgcaagtattaaggaatatttagaaatttgagatggtagccatctaacgacatgattatgattatgagatattaataaaatgtagtattatacaaggaaaaggaaaaaaagaatggcatggcttgtgcttcttttggttagtgactaattaatcctacacgataaacataagaagctggaaattcagcatggcacacgatgtgatgctgttagctaagctgtgcatgcatcggcagaatcctatgacttgctctgactttgagtcactgacatgggccaactggatagagggcacacatatcagtgacacaagttagagaaaagtaagttagaggatctctatttggttgggttgtagtttaaggctgcgttcggtataggaagttcccaacccctcttcctcgttttctgcgcgcgcacttttcaaactattaaatggtgtgtttttttgcaaaaagtttctacacgaaagttgcttaaaaaaatcatatagatctattttttaaaaaaattagttaatacttaattaatcgcgcattaaatgctgctccgttttatatgccaggagtgaggttcccaaccctcactcccgaacacagcctaagagccttattggttgcctatattttctaataagccaaaacggcttattaagaaaactgtttaataaaaccaaaaagatgtggtggtttaggcttcagaatctataggctgtttaaccaagcccttcttgcccgtcaagcttggcgtcttatagaattccctgatatcctctatgcaagagttctgaaggcgaagtatttcccccaaggatccctaattgatactaccttcagttgcaacattttcccgacttggcgtgctattgttcgtgggctggagttattgaaaaaagggatcatatggagagttggtaatgggaagtctatctgcgtgtggagagatccctggattccacgtgatcactcaagaagacctatttctttgagaggtaattgttggctaaaatgggtgtctgatttgatagaccaagatggctcttggaatattacagagatcaatagatgcttccttggtatagacgctgagatcatcccaactatctgtctgtctcctcatttggaagaagattttttggcttggcacccagataagacaggccggttctcagtgcggagtgcctacagccttgcttgtaagctggcaaacactgaagattcgtcaagctcatctgtagtgggtacacacaaagcctgggactcaatctgaaagtgtaagatgccacagaagataaaggtctttgcctgaaaagctgcctcaaactgtttaccaaccattgtcaacaaaaaggtacgaaatttggagtcgacagatacctgaatcatttgtaatcaggagaagggggatactgctcacgccctctgcaggtgcccacacgcgaggaacttgctgtcagccatgttcaatgcaggcaacatctctcttgatgtggaaaaatctcgtttcggtaatgagtggctatttgacatgctggagcaactccctgcccatgagcacgagatgttcttaatgacgctatggcggaattggcatgttcgcaatgaaatcacccatgataaagcagcccctccgctggaagtttcgaaaagatttgttgaaagttacatagccacgcttttccagatcaaggaatcaccgctgaaagatgtggaaaaagggaagtctgtagcgagtttgtctgtcactggcagggtaagagacagagcttctgatgatcatcgagttccgaatcccgtattgcattaggtgaaacctcaggttggttggatgaaactcaatgttgatggatcctttgatgctgccctatgtaagggaggaattggtatggttttacgggatagcagtgggaatacaatcttcgcgtcctgtaaaccgctgaacagatgcacaggtgctctcgaatcagaactgcgtgcctgtgtagaaggtctgaatctagttctccattggaccctgctcccaattctagttgaaacagattgcatgtctgtagtgcaactgttaaatgatggggaaagggatcggtcggaattggctaacattgttcatgaggctaaacgcttgctagccgggactaggagaattctagtcagtaagatccatagaagccagaatagtgttagtcacctgttagctaacagggccaaagttgactctgtctctggggtttggttggaaggaagttgtaattttatcttacgtttagtgcgtgaggacattttaagagagtaatatatttcttctttccccgcaaaaaaaaaaagaaatacaagttaatttatatataaagcttttatatatttgttcgtagcaaggtaaaagccaatgctataaagaaatttacgttgaaaataagttgaaatcaactttaaattcaagttttaaaattcaaactttagcttttgctttgtgttattaggccaaccgatgaggctctaagcagttgtgttgggggaggctaggcctcctcccgccccctggcttcatcccttcgtgattgacaagtgcacaagcaaaacgaaagaaatatagtagtccctctaccccaatttgaccgtccactaagattttgaggttttttctaaatgaccatcatacaataagtgggagtaaatgggaatcgctgaatgcgctgcacgcatgcaaccgtatgcatgtaactagccaagattaatttctgatggtgtaactaggtatgaaaatggttcataaagtttcctatttcctgagaggtttttgaaacggaaagtgtcagtcagaattttatcggaaatttttagaaatggaaatgaattcagattttttttttcaaaatcggaaatgaatacggtgaggctactatcggtcgaaaaccggaatcggtcagaaactttccggagataaatttgaaaacttttcgaaaacagaaactttttatatatagcttattagcttcagccttctctactctatatatgtttagatttctacataatattgagatggttagttgaatgtagataattttttagtacggtgctttagatacgtgtccaccccctacagtagcaggctcaccatgagcttctcactaggctcccgcgccgctcccttcctgtctcccaagggtgtgacctgaggaattcccgcgctcacaccgtgatctccgccggagattcgccggcgacagggagcgccgccgcgtcgccctagaatcgtcagtccatcgcctgacatactcttcagtattcctattcctttttcatatgacttaaaaatcgatcttatgtttactacaccatctaataacaataaaaatactaattaaaaaagcgcaaggagtatcatttaagagcgggttgtttcatgtgtggttgccaccacttccacgtcgctaacagacttattaattgtaaaagtaaggtactctgttcatcgtactccgtacagagtagcatcaatgatagaaacttcaccttttttttaatgtttgataaaatgggatgcgtcacctacggatggaccaacggattgttggtcgttggtatagcaatatcaatattattatggctcttagttgactcaactgacaagtctacgcctgctcttactatttaagaagcttccaatgcgctaacgcagcccagcgatctgcgcgtcacaactcacaaagccggggtagcttgaggtagtggtgccctggattctaaggtataccttgctatacactgatccttatgtaagttcgtctgtaatatatacacgtaactggtaaaatttgtccgtgcaattgcactagctagtttctaatattatttcatttcaagcaaattagttacttgctccggcctaaatatagcggcctaatttgatatacaaaggcagcaatattttaaaacgaaaaaaagtgcgtgatacatatataatataatttcttgatattgtttgttttttcacgtgccctactgcacatttatacctgcgaatatgccccctttagcacattctcaaaagttggaagccaacaggaaatctttggtgtcgctaaaattcttaaattctaggtgtgtttagttcgcaaaaagaatttttttagttgtcacatcggatgtttgactggatgttggaaggagttttcggacacgaatgaaaaaactaatttcataactcgcctgaaaaccgcgagacaaatcttttgagcctaattaagccgacattagcacatgtgggtcactgtggtacttatggctaatcatggattaattaggctcaaaagattcgtctcgtgatttccatgcaaagtgtgtgattagtttttatttttatctatatttaatgctccatacatatatccaaagattcgaggtgacgtttttgggaaaaaaaaattgaaaactaaaccatgcctctttaaaaaagttgtgtcaaaacctgcgcaattttagatactagtatttaactgtgattggtggcgtccatgcctcctgcaatatacttgccatgaatgtccacgaggatattttatattactccctccgatttcatattaattgacgttttagataaggttgaagtcaaactttataactttgaccatcaataattttaaaaatatttagtttaaaggaactagaacaatatatataaatttgtctttcaaaacaccataataaaagtaaacatatatttatttattatatatattataatagaaaaataaaggtcaaagatatattttgtagaccgtgttcttgtccaaaacgttaattaaaatgaaaccggagggagtatataaaaaagaatagaatccattccagagttttagcactccagaaattttggaagttcgattgtgaaatgccaaaactgtcatcaatttaaagctgccagaaaaagggtaggtgatatcaatatattgtcgtgccaaaaatatataaaaatatatggttgccctgattcctgtgtgaagcaacattttcactgcactgctccaaacacgccgaaggaggaatcaattcaccatgatccactctagctaggacccgtaaaaaatggacagtttggtcagcaggctactccctccatcctagtttaatcatcccctaactaaaggcgctaagaacaataacagcaaaatattcatcattcttaaaattaatcctctcatggattaagtgttccatcgcttcgtgtcttatggattgctaatggtttaaatataatataaattaatcttgtttggttgcaagtaacacattccaatgatacacatttagtactcttaatttgcacaaataaacgaagatgatgattattttgaaaaggccttaaaaatattaggggatgattaaaatgggatgaaggcagtagtatttcagagcttgcttctccatgtgaacattttgtcaagaatgagaatcatcggtaattcaattcccgtaagggctaatacgtgaaacggattccaacatatattagagttagggctccagggtgagctaggtatggagagggccagaggggacgctagggagagaaaaaaagagagtcaggagggcttttgtgctcagatggttcgggcttctaaattactgttttatattatgataactagctgggtggtccacgcaattgcgcggctagccaaaaaaatcatttttttaagtatgattttacttaaaatttattaaatagctatctcattgttaagactttgaaagaccaaaccttatcatcctcgtgtttctaattatatagttttaaaaatcacaccaattgctaccccttatgtcatcttctttatttgcttgctcgatctatcactatttctattcattcatcttggaacatttaaaaattagattttatagtttttagagtttattgtcacgttgggtttcgtttttataatttctagatgtcccgtcaaacgttgccattatactcctatacagcctgtccactatctcttctcttttattgtcattgagattttaaaaatcgaactgtgacgccccacacttttatctttagtgataaaagtgtgagaacatagattattatttaacaaccattattttgccaaataataatccaccatcagagatcgcaacagagaaatagttagaactacctttaattcatccctaggagcattaaggtcatctctactccatctagagtacactcataacattgaatagagtttgtagcaactccccgtagactcccatccaggagatagtcgtgaatcacgatttaatttagcactgcgcaggcttgtatcactgtacccatagctactcttaacatgtttgactgtcgcacttcactagatgcggcaccatgctaagagtacagaacttttcccctacttcaacttactacactccacgtttgtgttgagcctatcagccctccacaccaccgcgctactatatgcgcctggaatgcacttcatcggcattcatggggtttatatcatctcccatcctactactacgtacccatgtggagtataataaacttgataaggtaccaggtccagcccgtcttaagacgaatctatggtcgacacggtatatacggttctttgatacgagtgagggggtgattagtccttatatttatacaccgtatgtagggagagccctgacctgccatcatcatcaatcatctcatccctgagctccccctacccaccatactagtatcctgatgatctccatcatcatcggcttgtcaatcatatcatcatcgttcatttcattatattctagaaaatactttttgatgcaatactaggagaaatatttttatgaaatagatttttaagttgaaatagaattatcatctaccaacatgatcaaaagagagacttgcctgagtttctgtagccggtactatcaaatgacccaatttctgactctagccttttccctgcattttattgtatacattgattttcaattaactttcaaacttgaagaatataattggcttatctatctatattacagtgcacctaaaattctagcctgatgtacaatttctagcattccattaatttgtattgagtatatatattagttacttgatttaaactagacttgatttacagatttattgacagagttttgctaagcttaatgttagtgtagacaactagtgtgcactaagcaatttaacccttattcctgctctcctcacttatgtctctctctctctctctctctctctctcgcacatacaacaagctgcatctagttactcatccccttcttccattttcttggctgttgctgctgctaatggctttcttcttccccaactctgctcctcccttccatctacagcaccacccatggcgctgccaccccggcgcccacggaggtcgacgccagccaccaccactacacaccccaagctagctcactgcaaatccccttttctccccctcccgatttctcctcttcctcccatggtccaagccctaccaacagcgtctgctttctctctctgtgtgtgtccctctctctctctcatgctaccaaatggatgtgatgccactaatagtgatgtgaaagtgcaggaaaatagtgcctcgtgccatggctgctctatgaggtggcaagaatggcaagatttgaggggctcacctttgtctaagggacaagttcctccatggttgtgctcccgtgttcgtcctcgccaatgtgttggtctcttctcctccttgatagatcatctccttgtctagccaatttttcttctccccttcctagccgacatagagatggtatgagtatttggctgagaactaatttggctactaactattgggattgagggattggttcttgaaatggattgggcagaatcttgcattccgctgatttgtggattttgggactttggctattccctcctcgctccctattgctctcctcctcccctgatctgctcactcctcaccaagtgcttggggctcatatgcatgcatcagtgagcaaatgggcatggctgtagccatgctttgactgcttgactgagaggtgatgaggttgtgctactacctttgtggccttgtgtgagtcctcctatgtgcagctatgtgattggtggaaaattagtactgctggtgaattgaggtccctttggtgaggttacttctttatatgagatgtgtgacttcttagtgttaattagccggagccggatgacgaacccaacttaagggaggggtgccagacggtattagccgatctaggtatctcggtgaatggttgaatatacaccacttcgtgtatgggtctgacggcaatatttatttacatattaccttttgtgcataaaagggtcaagctatgcatgtcctgtgcaaccgtatattcaaatatatgatgtattgtattattagtgtaagtgtatgtatatgctgactgtttacagtggcgtttgtttgtactatatttccaattatcactattatattgtggttgtatattggacattgtttgtttgtttaacttcgacgaatgtgaatttcataaattttgagtggcttattcttatttccaacaattttgctagttaactaattaattagtgatatatgccacttaatttttaatttttaaaatagcttaaatttccgggtaacataattatagtttgggtttatttttactttccaaaagtcccgccaaaccatcagcggttttgccattgtactcctctacggctcgctcgctgcctcccttctttattgccttctttattgtcattgagatttaaaatagaacatgattatcattggttttttttactttttagaatttctaaatctttaaaaattggacttgtagttttattttttataatttttagaagtctcatcaaacgatgccactatgcccctctgcagcccgtccgccgcctactctttattgtcattgtgattctaaaaatcgaacataactatcattacaattcattttttattttctagaagtcccgtcaaccgtcggaggctctgcaactatactcttatacaccccgctcgttgcttctcctttttattgtcattgagattttaaaaatcgaaaatgattatcaatgtggttttctttctttatactttctagaagtcccggcaaccgctttacttgtttacttcacggcatacctgatgtccctccttttaatcgtcattaggattctatttggtgttttattaataatttttatatgccgtattaaccaccaccaactctactactttatagccatgttacttaatttatttcgtcatgtgttttagatggtcttttctttcaatagtctttatttttatcacaaattttagttatttataaattttattcctaatataaatcttttttttctaatttcagaatttattttttctaaaaaattagttaatattgtattgtgttcttttaatgtttttattttttattttgaattttatttgtttcaaaattgtattcctacttgaactctgttttaaattttctaattttggatattattatatttttattcgaaattttaattaatcttgtattgggttcttatatggatttttctttcaatattgcttctttttaattacgaatttcagctaactacttgaactcttctttattttcttttgctaatttcatatttatttttatttttattccgaattttaattaatctcgtattgggttattagatggactcttcttttaatattccttatttttaattccgaatttcagctatttttaaattgtattcctacttggactctcgtttccttttctaatttggattttattttatttttatttcaaattttgattaatctcgtattgggttcttatatggaaacttcttccaatattgcttatttttaattccgaatttcagctatttttaaattgtatttctacttagactctcctttccttttctaatttgtgattttattttacttttatttataattttgattaatctcgtattgagtttttatatggaaacttctttcaatattgcttatttttaattccgaaattcagttatttttagattgtatttctacctggactctccttttcttttttttttctccgattaatgtgggaatttctaacccccacagcgaacgtggtgcctcctttcaaagctattttaataatataatagatagatagatagattaccgtatttctaaatacaccaatatttattatctatttctttatttgacccataatttagaagcccatcaactcctcaaccaaatatatgagtgcaaagttaaaagggagacaatttgtaatttgcatagtgtatccttgaattaattttcttatattatatggttatgcgaaataaaatgtgtgattttagatatttgttattgatttttgtcgataccaatgcattttcgttcatattgttctgtttttggtttccgatattattatactgtttttattttcgaatttaccgttttcgtttccaagaaaacaattgggatgttttcggacctttttcatcccaggtaagtggtcaaggcgcgcgattgtacgtccattacacgcactcggtaattccagatgcaaaattgatttaccgctagtttccaatttccaacgatgcaggtaagatccacagcaacgccatgaacacgcaggtcgacgtcgagaatgtggacgtggtcatcaagcctagaatggtacctgcccatcagggttggcagactagcctctgcgactgcttcggagacggctgcgaatcatgtatgcaaagctacgactgactggatttttctggtttggtggtacaatgcaatgttttttccgtttcatggcttaatttctcgacctgttggcagtttgtttgagtgcttggttcccttggttgtcgatttcctgcatcggtgaaatcgtcgatcaaggcttcacaggtaggggtcatctcctctcccatagccccatccaaagtgctttgctttggaccggttaccgataaaacagaagagcgtttggattcagatataaaattaaagaaaccatcaaactgaatttagatcgaattaatatccgctgatcaggtggttaattaattatcggtattcagtttcaaaattttgcattttcacgcttattattatatccggttacagatatgtatgtgaagattttttacatttgcttaccgatatgcatgttttctctcttgtcaatttccttttggtctcctcaccaattagagtggtgctgtatctgcttcatctacctcattgccgcttatttcggcgtgtggtgggcgtacgcggggtggtaccgcggaaagctcagggcgcagtatggcttgccggaatcgcccctgccggactgcctcacccatctcttctgccactggtgcgcgctggctcaggagcacagggagctcgccgcccgtggatacaacgtgctgaatggaacttactccctccgtttcaaaatatttgacaccgttaactttttagcacatgtttaaccgttcgtcttatttaaaaaagtttgtgaaatatgtaaaactatatgtgtacatgaaagtatatttaacaatgaatcaaatgatatgaaaagaataaataattacttaaattttttgaataagctaaatgatcaaacacatactaaaaagttaacggtgtcaaatatttaaaagggagtagtatactccctgctatatatgcatgtgccgctttagacgacactgccaaggcgatgcaaaccccaagatctaacggcgttttctttggcgattggcatatgcaggttgggacggccggccgcaggtggctgcagtaccgcctccgtcgcgtagtgcgcccgcagtccaggctccgatgaggcgatgaaccaggagcaaataaatagctcgctccgtccaccgaacgaagccataagataagtggcccagtgcgagctgtctatctaccaaaattataacaaaattataatagaaaaaatgatacctcgtgatatttttataaagactgtaaaattacttatctatatatctatatccaacagctgtgtaaagaagccaggcatctgaataatatttgacatcgccctagtttgataaactaggaagagaagaaaagcccgtccacataagcaggcatatgtttctcaaactttttattatatatcttaaatatgtgagatgtatatctatgtgtcttctttaagaataatattattctactttaaatttgttgtatttttttttctcactataagtttataagttttagattgctctaaacgttggttatggttttattgcaagtatccacgcagtggtggatcgaagaattttcttgaaactccgcaaagctaaaaatagataacaaatgtacacaatttcatactacttcaaaaaacatttactatgaacgtgattgtgattttttaagcatttgctttgctggtttgcttaagtacggtaattaagtacttcctactgttgtatgtggctggatggtaaataatcacataaatcaagtcctaatctactgctgtgtgcgttgaagcccgggcagctgcccatgtggctccgccattgtatccatggaacaaattctaaactaaaattgttaaaactacagaatcccaagactatggaatcttgaatttatgtaaaaatatcgtgttgcaataattctgttagttattgtgaaattatgaaactatagatgttcttttgaattttttagcatgcttctagaattcaagcttctaattccgcttcagagtgcctcgccagcatattctacgacagaaagtttgacgggtgtcaattggaaattccacattagctagggaccggattttccagccggcagcacggagaaggcactgatgatcctaggtcattggtgcaactataacctttgaggtgcacacgatgcaaaaaaaaaaaaaaaaattgaggcacacacgacgcaaaaaaaaaaaagagaagaggctcgattcggtcgaatccgatgctttgagtcactccccgttgccccagattacaaatcgaaaaaaaaaacaaacttctgtacatgctaaactttctgtacaagcttaatcacatttttttaaaaagaaaaataaactgttgcacatgctaaatcacaaattcaaccaaaaacagaacctctcgtcatcaaacggataggtgacgtgacatggaaagggaaggggagcatggcaaggtacccagatctagcggtcattgagctcgagacagcgccctcacgtcaccccaacgtaggggaagggggtgccctacatgttgtacatgctgtacatggcaaggtacccggatcttattgatggcccccgcagcagacccgtaccagtggcaatatccgcttccccttccccatccccttccccttctctacctcctccctacccctcaccgcctccggcgaacaccgcgccacggtgccagtggcctgcacggagggtaagtgcgcgtggggtggggggggggagcgtcaggagtcacgggagcatgcgcacgtgggacgcgcatgctgccgcctccactcatgagtttagggtcgagtcgggagagagagcacgcgcacaaggggaggagaagatagggagaggataaggacggagagactcggtctattggctcagcttaacggtctaggatgcttgtttatttaaaacaaactagtacagataaagtgataatattataggtgccaaattttattaataaacggtacctatatcgtcacataggtattagatcttctaaacggcccatgggcatgtgctcgagccaaaaataggtgttagttatagactttctgacacctataatactatcttcgttttcgtttatgttgtagtgatatgaccaagttatgggttgcagagagctttacatggtgggcaagtcgctcgtcactgaggcagagaaaagctctaggtcgcctcttatgctttgcataacaaatgttttattctcttggttcaaaccaaaatgttggctccattttaaaataatatttaaaataattgctggtggatgatgatgtggcatacttgcatgttgagttttaaaagttagtaggtattgactttatagtaagatagaatatcataaataacacaccgatacaaactttaatttctaatgttgcagatcttatttcgtcatacgtatttgcaaagctattgacggtaattaggtaccaaatctaaccatcaatccctacataaaagcaaatgaaagaaaacatcaaacttggtgttagtgattattactaatcattttcacaagagttggtggatatttttatgcaagtgaattatggaaacactgctactcccgtcccgagctgaaggctgaagcactgccgtgctgccccttcctcgagctcgagcaccagcaacttcagcgctaccatcatgtgcttgaactcgagcttgagaactagtatcgtagctgaccttgtgctgatctactactcctcacatcccctccctcctgatgatcggttatagcataccaagaacagagtgcggtagagcataatagcaacaaagagagggagcacgtgacatcggttatgggctgcctaaattggaaaaaaaattgggggtaaaatatttcttggcctcagtccttaaacggcagtgctaatgttattttcgtctaatcgtgttcatggcttcacttggtaaaatagtatagccatgcatggaactaaagagctagtacctgcaatggagcaagtgatgcatgcagcgcaagattcctagcatggaggcatggagatatcttatatgctaatctatgaaggtagaaacatgtacatcttccgaactttgttcgatcatgtgctttttttatcagatttttttaagatggtttatctcatcgagagaatccattatatgccactgactttgtcacatgtctacaatttaccactgactttgtcacgttctacaatatgtcatcaacttttgtttaacttctacgatttaccatcaccgtctagttagcctccgttagcactgtacaattttgtccaaatgaccaaaatacccctacgacaaaaacttctaaaatttagataaaattatcaaaatatcatattatgaacacaagattgcaaaacatccaaaatttggtaaaaaaaacttaaaatctaacatttcagaattcttatccagattttgaaggtttttatcctaggggtattttggtcattttgataaatttgtgcagtactaacggagactaaccggacaacgatggtaaatcgtagaagttaagcaaaagttgatagcatattgtagaacgtgataaagtcagtggcaaattaatcgtagacgtatgacaaagtcagtgacatataatggattctctctatctcatattgctaggcatgtaaatacaagtcctcttgagatagacgcctacgcctaaacatttcaccatgttctttctagccttagtcttacaagttatatgtttccttccagggattcactcttttctgttgtcgtatttatccatgtttgatatgatgtagctttttttttcttctcaactataaagtttaatgcttatggttctatgctcaatcatatgtaccatgacccagcatggctctttgtatgtgatatggttgccctaacgcaagtattactttgtatgagagttttcctccatagaatcaacttactacaagctttgttgcctaggcaaacattcttctaatgcaactaatttccacagcaacgtgcggagtatcttctagttaaacacatagggaagacaaattgatttgagatgattaaagggaagacaaaatgattaatcattagtacgtgcacacaaataattatacatagacgagaatagagtcttgtagcaacacacaaatacatataggatacatatccatgacactcatggatatgttacttatttttgaaggtgcagactcattgccacctatccattatacacttcatctgcaatggctttacggattgtattcatcacttcctcgctgttaggtgcgtcataccaaacacataggggtggagcctctgggatgttggggtacccattgtataacaggttttgtgtcatgaaatgcgggtctgaactgtcaagcttgaagttgtggagagcaaacgtacagtgtgtgatatttgtctgatcgttctgcccaggaaagtaaggtatttctctaagaattctccactaactcttgataactccaaagctctttccattgtgttacacaaaaaggagtgaatgtagttaaaagtctcttcctttccatgcggtagtgttgcttctgaaccctcaaaatcatccaagtggtatcgaacatgcgggtatggaggtaggaatccataccaactggcataacccgagcccacaaggagatatttgcttgcacaaataaaatattcagttaatacccctatatggcattaacttgtttcattaaaaaaataaaagtgttgcgaaccccatggaaaccttggaaatatgtagggatagcctcgtactacttctatgagcaccctttagtcgtgcatagatcctggttatcccgcatctataaatatgacacgattgtcccatccaataacaacaagaacattcctagatttgacatggtgacgattccgtgttgaatggaatcatcaaatgccacaataacaggaatgtgtcccatccactgaacctgccgcactagcaaatggctggaaggcctcatcttgcatgacacggttatccactctagcaaagttaggatctacatgcttatttatgtcaattgtaattgcatagacaacattaagcactctatggaaatactttgacacagtagatcgtgaatggaccatcctattatttgtcgaccgattagaatagccacctgccatgttgtataggaatattccaagtgcttccatagggtatatctcaattgttccgtgaaggttataccgattagtgagtagcccaaacaaagcatgaatctgatcagccctcattcgaaatatagcttggcactgagctgcattggacattgtttccatcattcattccatctcgaattgttgcgggacccgccttgcggccttaccacgcaattttgcctccaaactagcaaccaacatatcaagaatgcaatcttcctcttcactgaagtatccatcctttgaagcatttgttctttcagacgaagtgctcaagttcccatagcattatatgacaaaataaacatggttaaggtacaagtatgaatggtgctaataggttttaactttattatcgttcaactataaacttagtcacgatgaaaaaattataagacagtacagaaaatttcagaaaaagatggaatacggacaaagaacaaatgaggtacgaaatacttaaaatattagcacatgtcaagtaaaattcgtctcaacataatttattcaatcagtgcaactgatagctcaaattaatggtgccgaaattgttaaactaaacactcaaattaataaggcctagaacaatcacgtttctcgaaagaaatcgaacaagttatttaacggacatcacaaggaaaattagagatgcatgacaaagatcgcatggcaccagtacgataatcactgccttaagaaatgttaaaacattttaacattgctgcaccatctgctccaaccgtaccatcataacctctaggcccaaatccacctccaccatcaaaccagcctccaaatccattagcaccacctgagcatgttggtggtggagcaaacatagtttctacctggtagtgcgagtggatgaagtacacaccttcctttggtgtgatgcaatcatcaatgaagaactcatgcaaatacccatcacgaaacagcttcagtgccatgtggtacagaggaaccttcttggtgatgccatcagccttcagtagctccatgcaagctctagcacttttggcttgcctctgttcctcccttctttctttgctctcattggactgcacccttaggtcagccaacctattcagagcatctccagtggagtcaccgcaaatatgcttgccgctgccactagagacactgacaggggttacgatccttttttcctttaccgcgcctcctcattgaagaaggctctggagatgcataagtagtgccatctgcatgaggtcctcaacatcgaggatcttagcctcctaggacacctgtgactgtgccggcttggacctaggcacaccggagcggtttagcagcacagttcttcctctgtaaacaacatgatgctcagcgttgaatctgagcggtgcatttctgaatacacgcgctcctcttctaagctacacaaattacagcacatagttggtttaatcagaaaataaccacttgtatgcatgtacagatggcaggatatagaaatggcagcacatgtaaacatgtaagcatgttcaaaacagtagaatctggaatcaaatacacataggcacacatttgttataacaaagtatataacagtagcaagtgaaaatacatgtagtgcagttagtgtacacatggcagcaaccatgtgttgaagttaagaaaaaaaaaacggaagcatatcaccttctaccacaatacaactgagtagttaaaataagtgcacaaatatgcgttcataaattgtagatgcagcaagttggtacttaaaagataagttttatttattgttgtcattacatctaagataaattaaagttttgctgcaaatacaacacacaattcagttatgtggtttgatcacgttgttgctggaaatattgttttagatatgtaacacatgccaactttgcaaacaataacttcagctcctaaatctcttgcttaatacagaataattcaaacatgtgcaagttcaattatcagtaatcctcaacacatggcactaacaggtcagattttaattacaacatgtcatggctgatcgccttggattattttgcaacctatgcatgctgctcattgttatcatgataaatacagaaacattgcagacatgttcaaattaaatgtgctcttgtcatctacacatggcatgaaaagatcatagtagagagatcagaacatgtaaactttaattcagtaccctagacagatcagaaaacattcaacattcaatttaatttgcagaaaaaaatatcattttttgtaatccatacattgagctcatacttatcattctatgtacaaaaacattgcacacaatctgcagatgtaatatcagttgtgaactacacatggcatgaaaagttcatatttttctgtgtttttttgagtgaactacacacttacaagtttcattgtgtttttcagaaacaaatgtctaggtttgtgatgtatacattcagctcaaaattatcttggtatatacacaagcatttaaaagaacacacatatttaattatcaaatgtggtgtacacatggcatgaacagatcatattaggctgttttaaattaaggactacacttgtgacaaatatggtgtacacatggcatgaacataatatattgttaataacatggcataattaatcataaatgtagtttgacatatctaggcatagaacaagtggtctgtaatgtcatgtactttgggatcaacattccaaatatatgtatgatagttaatcatacatctatacacctatgtataaagttttgatacactggcatctagagtatatctataaacctatatatgcatgaaattctgctacaagtttcaatgtaattttcagatacaaatgtcaaattttgtaatctatactttgagctcataattatcttggtatatatagaagtattctaaagatattgaaatttaattatcaaatatggtgtacacatggcatgaacatatcatactaggttgttttaaattcagtaagactacacgcatgacaatgaacatatgaacatattgctgataacatggcataattaatcataaatatagtttgacatatcgctaggcatggaacaagtaatctgtcattcgaaatactttaggattaacattccaaatatatgtatgacagtaaatcatacatctatagacctatgtatgaatcatgcatgtagaggcctatgttttgaactatgctacatctggtctgtaatgtcattcatctggaggcctatgtttgttaaagctcctactctatatggctctattgatccactgatggtggtgtgtgaagcatctatgttttcaaatttgctacatgtaatctctagtgtcatgaactttaggaaaaattgcatggcatgcgcaaaatggaaaaattgcaaagttaaactatacataacccttccatctgctcccaccattcagagtttacttggatggagccagtgtagggatcttgccccagatcggtggccattcattccagctaggtccatgtttggaaacggtggcgacagtggtcccataagttcttcagctactgcttgttcatgacccttctcgtacatcttgttctgcagattcatgtatccttgagctttggggcagctggaggtgatgatgcagccctcaatttcttccatgcagctatccaggaatgctttcagctccgcctacgtccaatgggtgtgaccgccagccatctaacaacccaagtcaagcaagcaagtaggttgaaaataaaagctagaacttgtgctttacctttcttagggcctttacagtgcacctacgtggcgagttatcgttttccatctaggccaaactctgacgtggataaaaaaaaaggtggtggcctggtgggacccgtatctttgcaaaggtttgcatctcctaccaaggatccggtttcctcaggcccaaaaagaaactgtgagtggtcccctctcccatgtcgcgtgctactactctcaattttcccgattattcccctatacgtcatccctctgcttggctccaccgacctcgtcgtcgtcgattcgccggtgggtccaccaccgcctcggcttcctcaaccaccgccgcgtccccgtgcgagtgggcttgagcggcgtccgggagtggagaggccccgatagggataggagagaggcccgcggtggcggagtttgtcgccgaggtggggggagtggggagaggccgccagcggcagagttcgtcgccgaggtgaggagaggacggaggcagcggcatcgctggtaaactcgccaaggttggtgggtggagaaaatggagaggattgtgcagtggtggtgggtgcctgggtggggttgagatttgtattatttcctccactgtaaggtgttcattgtaaaatttgtacttctttctaaattgagaaaaatatgagggctaaaatcaaaagtggtaggagctaaaacgaaaaatcgaagtcacccatgaggccatttgcactgtggggaaccaaaatttggacacagtatctttagtctatgtggcagttttaggttcttcaaatgggtagtttgcattactactgcccttggtgctacgagtcgagcaagtcccaatcgagtgaagatgcaactctggccggagtgaggcggcggaccagctgcaagatagcttcatggaactttgcagcgatgatgatgagtgctcgcgctacggcctggatgtcgtcttcagctgtggcagtgtagctggcgtcggattgcagagacttggatgaaccctgagaggatttcagatctaaagccacctctcgccgttttgccgaagtaaatggcaactgtggagaggatatcaagggctcggtggtggagtgctagagatgaagcttccgtttcacgcctttggatgccatggccggatccacaagatggcttaatatagctatgagttcaagtccccctctccaccaattttggcaatggcgcctccttggatgccggatgggacgtgaatctccggccctattcggcacgagaactcaccagagcagcagacgcgcgctggagaggctgatgcactgtcggtggaatcgacgccgcgccgatgcttgctgcgactgtgcctctcgttttttctccacctccaatgcgctaatattcgatctaagtgcttctcccctactccctccgtctaaaaaaatttaacctagaaggggattgttcattattctaggaggggtcacattctgttataggttgagttttttttttttttttgatggagtgtatgtgcctggcaaccctcctgcccaatgagccatcgacgtcgagcgcatggtctaccgcttgcacgccgctcaggacaagcaggagccgatgcagatctcgattcgcctccgtgaccaacggttgctttagtgttcggaggagaaagatgagggactccgcaagaacaggtggagaaagcaatgcacgaacgagcgaccgaaagctatccacgccgtcaccctcacggttggcttgaacagtaactcaacaggccagtccatctcgcggtaccgagattattgcaccatcttaatttcagcccatccgaatcccagctttccaacgggcccaaaaaaatggtccaaaccaccgcattccagaatgtaattcaccaggtgtataccattgccaatgcgcaagctgagcagatcatgatcaaatgcatagcaatgatctaaccagtagtattatactatcatatagtactaatcattcaactgcattcaaaatgagctggccatgaaatcagtctcacaattttccatggttttaatcagagaaaccaactcggcagacaaaaaagggtatcggaactgacattaagttttgatcatccataatttagtaacagcccaaatctcctaaaaggtaaagcaactagcaacaccatctctactcagctgctgcaacctcccctgccaccgcctcgtcagtctcagcaggcctgtccagcttcataccgacatcttccttgtagtcaccgtgtacctgtaaaaccaataaagaccacattttctcagaatctatactccttttaaacaagggcaatggtgccaccaagtacagtattatttttatttcccacctactccatcatgttttgtaccaactatccaaactatccatgattttatcatatttcatctgtaacaacatctacaggaatgaaattgtcccaaaaacctcactattaattagatttaatccacagaaaagcacaggtgtttggctagtaaagttacgtacacacaggaactaggagtggaaaaaaaacatctggcactactgaggacatcaagaggcagcatactgaggccaatttgtgttggctgccttcaacgttatttgaggctgttaacaaacatgttttgtacttggacgccatatcatgtttaaatttacttgctacattctgtgacagtaaaaaaaagaactccggccaggtcatttagcccccctaatacttgagtaagtcttgcttccaaatcaacactacagtacagcactatttacagaaggcaagccctaatataagatttgagctaatattggctgcctaagagcacaaaattgcctaggaattttttatcaggaaaaattatctaaatgcataatgtcataaaccctaaaatatattgttaaaactcggtattgcaacatcttacactaaaagttagtattcaagtcaaagcaaaatcctgaactaagtattttagggcagccaggttatagcaggggagttagtaaacatagttgattccaacacatagcaaatatactagatagattttctaataagattccaaagccaataaccatgctaatacatttctcagaagaataaccaggagcactaaaggcatctagctaggcatgagaataaggttcctcacctccatcaacttcccaagatcaaacttcggtgccttcaagatcttcaccttgcggatgaacacattttggagagggaatatacttgaagttgacttctcgatctcctttccaatgacttcagggatgaattttgaaaccagttctttcaagtcacatgttgatgcctggttggccatgatctcaaccatcttccggcggatcttcaaacagtggacaaaaataaagtaaacaacaagaacatacctcatctcaaaaaacaagaacttacctagtacagaacatgcaaaaaagtatgacaaaacttttacctgccggatctggctagcctgagcgtaacaggtacgcttcacctgatttgggcggcgcttggtgaaaccaatgcaaaacaggcggagcatgtagttatctgtggtcttaacatccacatgggcttcaatcaatgtttgccatttcttgaccaaggacctaagtttgtccgtggtaaaactcatgccctagagaaaatatgtattggtttagactacataggacaaaagggatcacagatacaacacaaaaggattaatgaacaatcaatgctcattcttacccagaaattcgtgaggacattcctcccctgaacatcctcagcacgaagtctaaccttcctgtaagcctgatcctcgtcattctgaagatccgccaaggagacttcaaagacacgatgcttgagaccctcagatgcaatctagaaaataatttcatgaataataatcagcaacagacatagtgctgtaaaaaattcagataaccttaggaagattacacaaagaaatatcttgggtatttaaacatcagactaaaatatctaattagtgagaacacatgatagtgttactgaaatcaagcatttgatgtatgacgcattaaaggcagcaaacattaaaggcagcaaaaaggttactccaagtacatctcagcaagaatcaatcacctcaagaacttatatatatgattagtgttcatcaaatgaaatgaaacattccatgtatcagccataaaaatctaggagagtagaacaagtacagcacagaagaaatcttgccagaactcccacatttgcattaacgaaacaaacttctagccaaaacataaaaatgcatcaagacatcacaatcacaataactacatcaacgccaacattaatcccttagcctactcagatatagaatgacgcagccacgcagatccaaacagatagattccgcacatgtactcacagacagtgatacaaaatgaaagcatggatcagatcgcggattgaggttgacgggcgcgaatggggaacgaacgaacgaaccttggtcccctgggtcctggagacgagggtcttgccgatgttgcggacggagaacacggtcggcgccttgatgtcgtaccaatccttcttggaaaagggatcgacgctgcacccacacggagagagaaaaagagaagaagtcccaaatcagaatcccccaaaaaccccaagcaagaacaagcagctcagagaggacgagaggtgtggcgcccacaccgcccgcgcgcaagcagcttacgtcttcttcttgctgcccttcctgcccttggagatcctcttgttcttgcccacggccatggctgctcctccctctcctccggggttagggtttgggagtgagtggcggcggcgcaggtgggagaagaggtagaagaggcgaaacctagtggcctgggtggggttttgtaagggaggggtggctcgatcggacggctgggatgtgccaagccgcaacacgaacttagcccagcttggtcgagctcggctcggtgaagctcgcaagcgttacaagtaggaagaagagggatttcattcggctcgatttccagtcgagagcccagcagaaaacgagtttgcaacaagccgagctcaagtagctgagccttgaggcccatttggagttccttttaacgtgtgatggtttaagcccaagtatgggaatcagacttatatttagggtttaatatggatttgttaatgtgtagtctgattatagttgtataaataatttgattttttttattgatcttcctttagccctttgcttggactagagtgaaatcgaattcttaaattataattgaactatatttgttgtatttgaattatctccccttttataattcgtcaatatattgcttgtgtttgtgtataacgtatgaccttgtgattagcgaattaaattggtatttgattcccggacttttattacatcataattggattatatagaaaaaaattggtgtttgatttctctgtgctttatttgatatttgtaaattagttcatttacattcctcggtaggttttggtatttaattatttatagttccgttttaaggtgaagttccacataactcaagcaacaagatcctagaatgatgcaaaagttggaaattttactgatctttaactgaatatttagggtgttacactttctctttcgtaaaatctatttggagaggcctcttgattttgccttaactagtgacgtctaaatacggagaaacgtggagaagtccagctactacatggtactacatgcatgcattttttttaatatacatgtacgtccctttcctcttcaaataaagttttctctcaaattacttatccgatctacaatccgattacaccattgtgttcgttacaattaaatcttcacaacaaaatcttacgtgattatattacgatgaaaaaatatttatatttataaattacttttattatatatgtaagttactcttatctcatatatatatatatatatatatatatatatatatatatatatatatacatatatatataaaagttacttttagagttgactaaattacttcttagacatataaaagtaaatttaatagagtctaaaagtaatttacatatatttgtcagagttacggataaggtataccctctacccttggatgtacgctatacgacaatatggtacatctgcgcgtgtacggacgttctctgtatacactaaggaaatccatcacgaagtccaccaatggaaaggttcctacccgtataggactgggtcgtcactatatcgtgcagggtacgatgtctccgagtcctacttggagaccacatgacctgcgatataatagggacccccgggaagacctaaggcatcgaatctcatagccaacacaacgaccacagcctacgaagccggagcctacaggagccaagtcgtcgggtgatctagtcgaatcaactcgactacgatctcgtcggtatcatcgagttccattattccctttataatttgtggttctctccatataatcccatatcaactggattagggctattacctattaaggggcctgaaccagtataatcgttgtctcttgtttccttgatgtcgtactacgtagatgctcgtaccagcgtaccccaataccctctatatccggtctacgggtacccgccgtcgacagtggcgcgccaggtaggggaacttggtgctcaaggttgtactactatgacatcaagcttcgtcgacaacggcgtcaacaccggccccatccaaggagtccctacttcaacaatgctggtgtggactcaagtcggcaaaattgtcttcccggtttacaccacggtaccaatctcggctggtccatcaatgaccggaaacgagaacgccgtggctataaccccggacgatcccgtgtcgaaggatcctcccgccgtagcggagaacagaacatcgacgtcatacgagcccgagaaggttcctagtgcggccaaaccttgtccttccgacaagaactgtgagccgacaaggacaactcccgaggtaacaaagccctggtgtcctatccacaaatccaggaagcacaacttgcaagcttgctgggtttttctcaacgtacaagctgaaattcatgcttgcaaggagcgtggaatccagcgtacttctccaactcgtgatgtctattgtcctattcacaagacgaagaatcatgacttctcaagctgcaaggtctttctccgcgccatgaaaacatcgcttcctaaggtccagcagtcaggaatctctcttaaggatgcagacaaggaacaaggagcgacgttgacctcggatcgattcgttggagtaatcgacatcgatccccacgagccatcagtcctacacttgctcgaagactatggctcgtcatcttccagtaaacgacgcgacgtgtttaccatcggtgggactagcacgtctgcgcacgctaacgcagatgcggagaaccaagcggtcacgccggcccaacacctcggcaccgtcaacgcaatactgagagaagctccctatgaccccgtacttaacgatgatctcccatgatggacagaacgactacgggaatcagtagccaatctcagtaacgcgttcgaggaggtcgctaccagagcacaaccagaacatctgacggttggcggtgccgacggcgaaccaccggagcaacggacgtcgcctagacgagctacccctccacctcgcggcaccggcgatctccgcgaccatctgaatggccgccgagaagcacaacgcgcgcgagataacgagaatcgttcccaacattgtgtctcttcacgtcgtcataagaacgaagagcgaggaggccgctcgaacgaagaccaacaccaccataatcgtcacatccaccacgaccgcgacgatcgcgaacagtggacaccggacgatgctggtcgaggacgtcaacatgacggtgattataatggggatcggtgccaggacaacaatggtggacgacgatagaattctcgagaacctgaacgtcgccctcggaatcgcacaccggagccgagtgaaccatcgtcatcatcgtcatcatcttcatcctcgtcatccgatagacatccacggaggacacacgatcgccgacaacccaccgcccctagcgccgggtgtagagctttcaaccgttctctatgtgatgtccggtggcccgagaaattctgacccgaggcaatagagaagtacgatgggagtactgacccaaaagaattcctccaggtctactccacggtactatacgctgctggagcagacgacaacgcgttagcaaactatttgccaatggcgttgaaaggttttgcgcgttcgtggctgatgcacctcccgccctactcgatttcttcatgggcaaatttgtggcagcaattcgtcgctaacttccaaggaacttacaagcgccatgcgatcgaagacgatttacacgcgttaacacagaatccggggaaatctttgagggactacgttcggctctttaatgagtgcagaaatacgatccctgatattaccgacgcctttgtgattcgcgctttcaaaaccggtgtcagagatcgctacactacccaggagttggcaacaaggcgaatcacaactactcgaaggttgttcgaggtcgtcgattgatgcgctcatgtggacgacgcactgagacgcaagaacgacaagccaaaggcggggggagagaagaagccagccaaggacgcacctgagccaagcaagaagaaaagcggcaagagtaggaaaaggaaagctcaagcggaagtcctcgcgtctgaatacgagcaccctcccaaacacccagacccacaaggcagtgatacgaagagaatatgatgccccatacacaagtcagacagacattctccggaggagtgcctcatcttcaaaaagtcgctagaaaagcaactagctttggagaagggcaaacgagcacgtgtagtcgagaaggccgcagaggcaaccactcaggactcggactcggcgtacccagatttcgatcttcatgtctcgcacatcttcggaggttccacagcgtactcttcaaagcgagaatacaaaaaagtggagcgcgaggtttgttcgacatggcaaggggttacacccaagatgaagtggtctgaacagaagatcgagttctcagatgaggaccaccccaaggctgctgttatcccaggacgatatccgatcgtggtcgaacccactattcggaatatcaaggtagcgcgagtcctcatcgatggcggcagttccatcaactttctcttcgccagcaccttggacgcaatggggattcctcgaagcgagttgacaccaaccgatcaaccttttcatggaatcactccccagtcttcgtccaaaccattgggcaagatcacgcttcctgtgactttcagccaagcgagcaacttccgaacagagcagataacatttgatgttgctgagtttgacacagcatacaatgccatcatcggaagaaccgcactcgcgaagttcatggccgcatctcactacgcgtatcaggtactcaagatgcccgggccgaagggaacaatcactattcaagggaacacaaagctggcggtccaatgcgacaagcggaacctcgacatggtcgagcacacgcccagcccaccggccacagccgagccacccaagaaagtgagcaaaacaactaagacgccgaaaccagatggcgcaatcaaaattgttccactctccagtgccaaccccgacaagacagtcaagatcggggcatcactgaacgagaaataggaactcgcgctcatcaccttcctccgcgacaatgcggacgtattttcttggcaaccgtccgacatgccgggggtccccagggaggtgattgagcacaaaatcatggtgcgacccaacgccaagccagtaaaacaaaaactgcggagatttgcaccagatcggaaacaggccatacgagaagagctcgacaagcttctcaatgctggtttcatcagagagatactccatccagagtggctagccaacctagtcatggtgcggaaggccaacgggaagtggaggatgtgcgtcgacttcaccgacctcaacaaggcgtgccccaaggatcacttcctccctcgaatagaccaactagtggactcaacagctggttgtgagctattaagcttccttgacgcttactctagctaccaccaaatcagcatggtaaaagaggatgaggagaagacagcatttatcatgccgctcggtgtattctgctacgttaaaatgccgtttggactgataaccgcaggaaataccttccagcgtacgatcctaggcacgttcggttagcctaggatcttgatccatggttgctctcatatccgatccccagggtgtggtcagggtaacttctctacgtctacagtcaattactcctctatgctttgctaaccaatccattctcaaaatgacatcaagagtttgtggtatcaaaaccataaggttggagggaaacaccacatccctaaggcgaataggtacgtcaatgcaagctgtgtccacggctatttcacccccaggtgaatgtactaacattggttgccttagtttaactctggttaaattgtgttgttgacttgctttcagagatataaatgaatgcgatgctcctgaatcgaagagaactttaactggagtgaagttgagtgaaaacatacccatcagtacgccttggtcctcctgggcctcttcagctcgaacgtggttcacttgtccgcgtccaaatccggtagcggtcctgttagtctatggagtcctgaatagacctcgtccagcagcaggggtagtagttccgtgaatagtcgttgcattagctccggtgcaaataggtgtcttgtttggatgggggcatttgttggcgaaatgcccgtactctccacagttgaaacagcttcctggccttactgatccagtggcggcctgattcggtgcaggagcgcggttctgaatggtaaccggcctgtggtaaattcctcccagcttggttctccagcatcttcttctcaggctcctttgtatgtgtcccaccagtctccggctggtccttccaattggtttgccacaaagatcactttatcggcctcacgtactcgaacaagagttagcttcttctcaatgatccttaaccaatcttcagcatccataggttcttcagctgtggcaaatgtgggtggcttggtcctcacaaactctccaaagcttgatccaccgcggttgccttggttatttgcaatggcttgcagaagttgggtttgggtgaccataactccggccagggtggttaggtcaggtgtctcagtttcttcattgctggttgacgcccgacgtcggcttgccatctgtgtaggttgatggaataagtatcctaattttctaactagctcttatggttctatcccattaagggggttattttggtgtgaactttgttttgcaagcatggtggaataaactcatttataacacaacaacaatagatatcataaataacatcacagagtttcacaaatggtacataaatcatgatgcaatcgactgcatacatacgcagtccaaataaggttcatgcaaaagatacatcaaactaatcatcaatctactcgtcaatctaggtaagaggggggtgtgtctcgcatgctatccaaaaaccatctgatacgagatcgaagctgcaaggagtctgtcaatctagtcctccagccatccgcaggatcctggggcaggtagagggtggtcgctggcacgcgcaaacctgagtccccacggctcagaagtagtggcctctggatctggcttgggcctcttgcccggaggtcgtgtgctcttgcgagcagtgctgagggtgcgaggacctccaaggaaggtgatgcggggaacaggggtctcatcctctaaaggatcagtgatgtctggctcgatctctggctcggtgtcggtcccctctgtctcggagtcgacctggatcggagtctccaaactggaacccaactgcggagaaggtgtagggatcagtggagtgcgcacaatctccggggcaggtggctgtgtcactgtcgggtccactaggtaaggtgctgactcggtagctagcatactagcctcacccagaagagcgtggaacgttggtgggtacggcggggtgaggaagaagtagcggtcacgccctactgctgtggaagtagaagcccctgtggtgctgatcgtggctgctcgaagctgctcctccagctggctgacgtgctcctgactctctcttagctactcctcaagagtatccatcatcccgcggcgatcgttgtactggtcagataactgctggaactggtcgccgtggacctggagctgtgccttcagtgagtctatctcactgccccaggcctggtgctcctcctccaactgaagctgctgcgctgtgaggtcggtcacctcagtctctaactcccctacacgtctctactgatcgtcgatctccaatagggcctcctcgtagaagtcgtccgcagcctcagcccatcgtgacagtcgggtcactatcgggttgtagcagcaaggtgtgtcctgaactgtgcagacggagttgccctcctctcgaaatgggtggtgagcaaactcagtactcgccaactcagctcggtggatagagctaagtcggaggaaggcctcccgggctgcatcctgcatcgcggtctccggcaagtcgcgacggtggcgtgtcggaaagctgtagtctaactctgacgaaactcgtgtgtgaacctcgacccgagcctcctaaacagatccacactgtctcactcggtaaatcggaaatctggggtatcgcagacgcctcatcagccggtgtagctcaatgacgtatccctctgagcggggtacgcccatctcccaggtggcgggtgaatcctgatctgccttctaatctttaagaaaaacccaaagtcagctaagagtaaaacttgttttgtgaagaaaatagttaagagtaagatgaaaatcgttccgagttttgtaaacatagcgtttttatttttgaaagtattactaaatgggaatttctcccttggccaacttagaaaaggggtggagcgccttttggtcttttcctacagtcgtatggctctgataccagctctgtggacccccgtttttataacaggaatcattcgtgtaaacagtaccatttccctggatcaagtagtctggtacacacgagttcatagctgaaataccaaaagtacatacacgagagtctagtgctaattattacatcagaagcccgcaggcattgtcttaaatcatcggaccgagcggtccggaatacatccaaaagcagaaatagataaggcagcggaattcaggcagcggcatgccattgccacaggcaacgaccgtactaacacctactgagcgccatcgtcttcatctccctcctggtagtaggcatagggatcctccgaagcttcatctcccgcttctgattaattttatatttgcaagggtgagtaccaaccgtactcagcaagccaccacagcaacaatgcatatgaaaggggtattccaaaggatggctatggctcttttgcgctaagccagttttgtaattcttttcacaaacctaagacctagcatagactgatcaagttttaataccagtgttcacattaaacaacgacggttctgtccaccatccattgtgatttcaaggatagcttcccgccattgagtcgtcatggttttctgaggatgtccaccttccctcctctcaggaagtggctccagcagcataaaaatcatcatgcaatatcccatcccacacaggttaagaatttagagtctagccaagtgcaatacatgtcccggtgctcaataactgcgagcacggctattcgaatagatttggtttactcacactgcagtggatgtacactttacccgcactccacgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcagtcctaccaatggcgacaccgatgtagggcacgcctctcggccctacctcaatggctgtcccaccgtagcgcacctgcctcactcaggggtgaaccatctatgcagggatactgcttccgctcggctatctactccgctaggtctatacccatacgagaagtgcggttgtacgagggtcgtttcatgcttaacttcatggctcggtccttaattgaccggggacggtactagccttttccagataccacccaaatcctccgtccgccccagtcgaaaacagttgtgtaattttatttctcctttcacaaatcatgtcatcaacatcatggcaatgtggcgctcatgtctccacatgccgcatctccattaccttcccaaaggtaattgcccaaacatatagcatttgataaatatgagtatgcatgattctagaatagcatttctaagcaattgtcatagttgactagggactcatacgtaaacatggttacaaagatctaagggtaatcaataatcaaggcatggcataatcacaagtaggatgttcatcattgcatgcaattttatttgtaaacaaaacaatttcgcaattgggatcaacatgttcaaggaatagtgatgacttgccttgctcaaagtcttgcgggtcttggccttcgcttggatccgcaactccctcaggctctatagttacgtgcgaaaattgatttgaattcggttagaattcaaataagaatccaaataaatccaaatgacagtcgaatgcgaaagtcgattcctttttattaactttactatccgcgaactacggcaaacccaatttcgatttaaactattttgcgggtataaatattttgttgtcataagtttttaatttaatttacccgagcattatatccatataataggttaggaatttctatcgcgagctaaatatcggacgaaaccctagaaatattatacgatttaatttagtctaagactgaatgattaaatgtaacacacggctaaaatctctagtaattaaatccgaatttctaccgtgaatcgattacttatagggattacccaaaaataatctataataatctataagaattcatctatttgtttagtaattaactacatctaaattattaccgcgaattgatttcttatagaaattgccaagaataatccataatttatattaaattttgcaattctacgactataattaatccataattaaattctaattattttaaattttctaaacttccctaatcttcctctaatttctatttattttttttcttttctttttctctcctcttttctctcttttcttttctttttctctctttttctctcttttctctcctcccggctcctttctttcttttccttctcttcctctcttttcttttcttattcctccctaccggcctctcctttcctctctctctctcggctcttgtccacccgagcagcggcggtggtggacgcgagggggggggaaagacggctcaccagcggcggcggcggcgacgacggcggcagcgcggcggtggcgacgacggtggcgcaaggcgacggcgacacccggcgcggcacacggtgcggcgcggcggcatcgagggcggcggcgcggcggcacggggacggtggcgcgacggcacgaggacggcggcgtggtggagggagagaggggaggaagaggaaaatggagtgggggaaatggaggggggagtatttatagggaagagggggagaaggagaggggaggggcgacggggctcggggcggcgcgcggggctcggcgcgtggtcatgggacggcgacggcgacagcggtggctcgcggcgtgaggcgggacgcgacggcgacggcgacagcacggcagcggcggcacggggcgcaagacgacgcgacgggcggcagcggcgacgtgacagcgggcggcgcggcgcggggcgcaatgacgcgacaacaacggcgacggcgacgcggcagcgacggcgatggcgcgcggcggtacgaggcgcgaggcgcgacggcgacggccgagcggcgcggggcgcggcaggcgacagcggcacggcggcaggcggtgatggcgatggctcggggcgcgaggtgcgcatggcagggaaggggaaggggctagggaacctcgtcgaacacctagagtgcaatgaacagtgtctttttcctatttatcccgattttagtttatttcccatataaatttgattctataatttctaaatcttgcataaatgaagtttactcaatgtttctgttatctcaactaatgaattcaccctagattaatattactcatattttattggtataatttatttgaatttttaattagggttaattcttgttccattgcatttaaatctaattaatacaaatatggccgcgatgatattttatttattcctatccttacataatctttattttaaattataatttatttatttctttaaccaaatctaatttcagggttaattcctaattaattttcccctatttctgatcgatgaattctgaaatcaaaatccaataaaatcgtcgaataaaattggcatgatgcaatttatttaaaaagtttttgaaggcccatatttttagagtttagattttttttttgtcggtcgaattttcagggtgttacaaacctaccccccttaaataaatctcgtcccgagatttcttaccagttttcgaatagatgcgggtactccgtcctcaagaattcttcgctttcccaggtggcttcatcctcagtgtgattactccattgtaccttgtacatacgccacactttgctcctagtcctcttttctgctttacccaatatccggatcgggtgttctggatacgtgagatcattgctaatgtgaatctcttccagcggagcttgttcttctggcactcgtaagcatttctttaattgggacacatggaagactgggtgcacatcagcgatattctctggtagctgtaactgatatgcgacttctcctcttctagccgtgatttgaaagggtcccacatatcttggtgctagttttcccttaatcttaaacctttttgttcccctcatcggagaaacctttaaataaacgtaatctccttccttaaattctaggtttcttcttcgggtgtcggcataactcttttgtcgtgattgtgctacctttaaacggtcacggatcaagcgaaccttttcttcggcctcattgataatgtcaggtccaaataccgcccgttcacctgtcttagaccacatcagcggcgtccggcatcgtcgaccaaacaatgcttcattgggggacatcttcaggcttgcttgaaagctgttgttgtaggagaactcggcgtagggcaaacacctctcccagtctttgctaaaatccaacgcacaagctctcagcatgtcctccaggacctggttggttctctccgtctggccatctgtctgtggatgataagctgtgctaaaagcaagataacttcctagggcttcatgtacttttcccagaaatgcgaggtaaactgtgtgcctcgatcggatataatcctcttaggtataccatgaagacacactatcctggtcatgtacaactcggcgagtttagcactgctatagtttgtcttgacggggatgaatcttgccgtcnnnnnnnnnnnnnnnnnnnnnnnnnaaatggaatcatatcctgttgcggtcttgggcaatccaacaataaaatccatacttatctcatcccatttccactcgggaatcctaaggggttgcagcaagcctgccggtcgctgatgctcagccttcaccttttggcacacgtcacagagtgctacgtattccgccacatctctcttcatgttgggccaccagtatccttccttcagatcttggtacatcttcgtacttccgggcaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaagggttcaagataatgcaatggagtgccaaaaccttacccttgctgctggggagtgggtatatatacccccaaccaccaaaactagccgttggaaccgaaatccccaactttgtgctctgccagtcagactgccgttgtgaggctggtcagaccggactactttgtaacggctacggctagaaaactagccgttacagggcaatcattgagcccactcaacctggccggtctgaccgcagtgtagtggccggtcagaccgtccacggctcggtctgaccggttgcggctctggcggctctgtatcgccaccaaaaaccagaccagtgcaacagactagtggggccggtcagaccggccttaccacgccggtcagaccggctaacagacccggtcagaccggcctaaggcccacggtcagaccgcaggtcacttttcagctcaaccgaccgttagtaaaacgacgatatctcttgactcgggtctcggaatttggcgttcttggactctatggaaagcttattcaaagggccatccaacccatgaaaaatccatccaagaaacacaacttaagtcaaggataatgggctcacactccaaaggatatccaccggacatacccacaagatgtcactcactcctattggacatgtccacttctctcttggtttaggacttgagaaaactaatcacacttggttagacaagcccaaaaaatgcacctacatgcatatgaactaatatggcacaagatcatccacaagctcgcttcatagaaccctcttgatagtacggcgcctatctagcaaatccgatctacaccaaacaccaagaccgggaaaagactaagaaaacattcttagctacattatacctttgccttgcgccatccatcttagggtcaagcttgagccgagatcaacacttgtgaccatccggttgaaccatgtttatgccgaggtcttgtccatcctttgtcaagactttattctcatcacaagcttgacttcattcttgccaacataacaatgtacttggcttggtgaccactaacccatggtgtcattcattagcctcatcgtagtgggacctattccttttcacacctcaaaggagaacattagtctcaacaaatcggttgtcatccttcacttgatgaccaaccggttgcatatgaaagatatggatatgtttgttgagtattcattaacatcacaagtgtcatatactcgtatgcaagctcaagtgcaaagatccgatataaataataggtgaacaacatggatctagaacatgcacaataaatgtataggatttgctccccctaaatatatgcatacaaataaatatacaagagatacaagtgtatgcataattagagaatgaccaatgggggtttatcttatacatatagagaaggcatatgtagtaatgatgtagaccaacataaaacatataccttcatgatctccatgttctcaatgtaaatgagactaaataagataacattcgagtaaacattagtctcacacttatatatcaataacatggaaatcatatatatgaacctatcaaaaagtaggagataagaagtggtacatatcgttttatctccatgcatttcatccttgtcatgattaaggtccatcacaaaagaatgcatatcttccacatctcattatcaggaaataacctagtagacaacttatgcaaaagagaggttaatcccataaacatcggtttatcatctatcaccaaagtaacaattacacaaattgtttaatccaagatctttcaatcttttctctctttggtgatggataataacccgatataaacaatatagagagatgagatgaaaaatgatttcaaatcaagatagaaatcttataataaacaaaatatagaataagctccccctcaagatgtgcatacatatggatatgaaggaacgcatatgcacataatcaataaagatcaaataggaagctcatactatattttggatccacaagagagaccaagttagaatatgtgaagtttaatacatacctctcatcatttttactttcatatccaaatgagactagtcaaagaaaggctcataaaaatgattagtctcatatagttagatttgtcattaatcaccaaaaccaaattaaggcacttgaacttacatcatgacaccgcactccccggtgagctggtgcagaccagtgtaggtaacctgcagcgagccacggatctccgacaggttgttctcgagctctgacataaagtgctcaagcccctaccgttgccgctcgttgccggctaccagttccctcattttctagaggtcctcacaaacctccgccaagtcgcgcgccagtttgtcggcgcgctcgttcgccgacgacgccgccgctgccctcgcctccacgatctcgcgacttatgccgcgagcaccagcctcgaggatgcaccccatctcgacttggagctcctcccatgtgaggacggcagcaggcgggcctcgaccgggcacaagatcgctggcagggccgctgggcgtcacttcgcggctcctgggcgcgaccacgacatcggtcgaggccactgcaggagatgcgctggagtttcccccagacccatcttgcgccgccctcgcccgcgccgccctacgaaagacgatcatgttggtcatcataacaaaacgccagaatccgatcaagtcaagggcctcaaatttcgtccacttacttctcgccgagtgtcaccagcctatgccgtcgtggaggcgggggagacgcatccaaggcctaagtaaaccgagtacgatatgagggtgacattttccgactacgtaatcgataaccaaaaaggcttaccgatggggtgggcgtcttccggcggttgccgagcacggaggaaaacttcctccctttcctcggaactttgctgccgctggtcgtggcagcagcagcggcaatggccgcgtcggacgcctcctgggcaacgccctccttcaacgaagccgccgcctggtggtccgcgagcggcccaatgatgtcagtcagggagagtgcctgcacaacatgaagtcatgatgcgatctaagagttaaaaggtaaagggtcattgattacactcacgttgattgcggcttcgcgctcagccgcctctttctcgcaaagaggggtgggggcgttgctcgctgtcgtgggaccactgatcatcacctgggaaacacggtgctccacaattgcgctgttcaaacctgtagatcaagaaccaaatttcgataagtcaggaggaatgcgcatgaaaggagagaaacccagaatacaagaaaaatacctcgaggagaaacccgggtcgcgtcctctggcccagagtagtcaaaggctggatgggctcgagcctggagcggctggatccgtctaccaatgaagtccgcagcgacttcataccccgacaatcctcgtactcgtactcgtactcggagatccaaatactagagagatggggtcaaggcgggtttggcggtccaagacggaatcttgtctggttgctcctcaggaacaatgaagactggatccgaatcttctatctgaagatagaaccacctctgtggagattatggataccccatacctacacggcatgtatagtccgactgggtatggggtgtcatgtatagatagaatatttttaaaaggactcgggttaaattctaaacttgtatgtcaagaaaatacccgagatcctagtcggttacgattgtattttatctataactgcctattccgttaggaatatgggctgtgctttgtaatacggatcccttcccctatataaggagaggtccggatgcctttagggacacaattttcacccagatcatacgatcaataatacactcggtggatcaatccccggataggagtagggtattacttcttgattaagaaggcctgaacctgtataaaattccttgtctctaaacccatccacttttctagcttgatagccacccccttttagtattgccgaaatcttgtttcgacaacctcgcccgccatttgctacgagaagaggggcactggaaagggatgtatcgcgacttcaggccatcccgaagtcaaaaaccaacacacccggatacctttttagattccatccagcgcaactcgtagtaaaaacggaagaggtcaagaaacggctctaccccaatgtaggcctcacaaagatgataaaaaatgctaaggaaggctatggagttggggttcagatggagcagaaaaagaccgtagaagttcaagatgagaaggaaaactcagaaggcggaggaagaaaaccacagagaatataatcctcaaccgcaaccatgcggcccaggacgggttcaggttcagtacctcccggttccctctccatggtcccgcgaccgggaagagcgccctcctcctgcaacttcttcaaagacgcaccggtggaagtggacttgtcgaggtccatcgccgttggagatcgcgggagaagaaaccgaggcgagcgaattagggtttgcgtggaagcgtagaagacgaagagcgttcagaggctagaaagtttttgcaacaactggactccaaaatggattcccaaaactcctttaaataggcacactaccaacggtgcgaattgcaaggaaaggagagagatggccgccggaaatttctgggtccgttgcgcgaggcggtttttggacttcaatttaaattcactcataaccatttccatcaagtaattcaaatgcttgcatgcacatatttagggggagcatgtcctatgttttgtatttttgagactaacttcttgttaagtgtattttatgtttagtctcatgggaagtgaaacattctcaaaagtatgctattcacaagtggtaattcaattaccttttcatcgtatattttatctagctacctttcataatatagattaaattcccttgcttgatttaaatgtcaaataatgcacataaatttgccttccaccatatgtgtgcattacttttgggagaatttagtctatattatgaggtttcatgaataagtgatccaattttcctccacatcaaaaggatcattatatgtgaaactcgtgtgctttttatgctttctcttttctattgattcaaatagagaaaagaggtaatgatagatcaaggggagattgatttatgacaaccgaaggaatgggtgaagaaggatgagattggttaagcaccatcatcttgaaatgtgaggtttatgaaagtgtgctttacaattctagtccttaaatttatttcttttggtgatatttgcctcctgacccaaaatatagtgtaaactcctccccaattctcatttgagtaaagtgcatatgtatgcattaaatttatccttatatgcacaccttgagggggagtttattctataccttggaagactaatggtttaaattgagtttatacttttagtcttatgtcggaagtggacgactcccaaggtagacttcattattgcttctatggattttctttgcaaccttaatttcataatataggatggattcttttgttccttcatttcttttgtgaaagtgcataaagatttcttttcactcttttgtatgcacatatttagaaggagttcatcctatgttgtgatgctacataagtcttgatatgtctcttcatcgtcactatttattgggtcttggcttatgagacttttctttcgggcatacatgacttgtctatagcattatatgcctgacatactttttgccctccttttagtgagttttgggagaagtatgtgttaaagagaaaatattttttgaatcatgcttttgtaccttgctccaaattaagtgagtttatctaatcaatgtatttgctatatgtgcatatgggttcttaccaattgtgactacaaactaggcctatctcttttgattggtattattctatcaattggtgtggctcatatgcacaagaccaaaaagagcttgctttggattggtgtctctttggatcccaactctttctattggaattttgatgagttcaattgctttatttggtgttggtgcacatgattttcttgtatatcttcttgtgtgtacctcgaggctatttgtgctttgctattttgaaactaacgcttttgatagagtttcatcttgttgtagcctctttggaacaccaaaggtatgttaaacctttttcccttcaagtgtataggacttgtgtagttcttatatacttgatatgatttctttttctttatgctcccacccactcatttaatcttttggtgtttgatgccaaagggggagaagtataaagagaaagagatataaaggggaaagtgcatactcatttcatatgttgatgaaactaaccctctagtatatgtttcatgctcaagttaacatatactagagtattctctttaaattcctattcttgtgatagtgttgtcatcaatcaccaaaaagggggagattgaaagatctatgcactagagttgcccttgtaaggggaggttggaagatctatgatcctaagagtgtggtgattgttttgatgattaatgacaacccattgttggaactaactatttccatgagttggtgagattaggttaagttccggcatcaagttaaaagattgaagctagaagaagacgttataccttgatgaggagcaagtgaagacattgatgatgcggggtatgaagtggctatttatggcaaaacggtgaagggcaagtaaggctcggctacaatggaccatgcggagggtgaagggcaagcaagaggcttggcaccgatggaccgaatccggtggtgaagggcgagtgaaggctttgtcataatggtcatgatggaccgtgggaggccatttgaagctatgagtaattcgtatcaattattagaagaccgcaagatggaatgccgaagatcaagaggatgtggttctccaatgaacatcaagtcaaaagccaaagtgggtattgatcaaggcaaaggtataattgatttgggactaatatgcttaatgagtgtaggtgagaatagtccgaatagtgaaatggcgttgatgttgacaaccctcaaggtgaagcaagaagataacattcttagtggtgtattagtcccaggttgcttaggagtgggctaggatgcttggagaccccccaaaacaaagcggcgagaaaactcggagccgagttagactagtttactttttcgctttgagtttaggaaaaaccatactattaagaggggttccaagtgtggttctgagataacacaagtgctcttagtggtgtccaagtgttgaaatatttttaggagctgtttttgaaaatggctctactcgggacagagagtcccactcggaggttctgtctggaacttcctggcgccgaggtgaggttgaaaattttcctaagtgctggccggaagttcctggcacttttaccccgaacctcctggtaggtttccagttcaaacttgtgagtaatggctagatgacgtcacctagccgttatatatatggatttcgtccccaggtcaccctttggccattccactttagttcttgtgttccctagcttgttctatcctctcccaatgtgattttgcttcctccacctaaatcttgtgtatttcttgagtgagagagtgattttgagggtggtggtgaggattggagaaggttttgaaggctaggttgacttgagcacttggggtatctcgttgggctgtcatttggagcttgttactcttggagggtgacctcctagacggttaggtgtcgcccgcgagtttctaacaaggttgtggattgacccgggcaagtttgtgagggcgttattccacctccaaaaggaaacggaatactcggtgagtgtaatcctaggtgaggtttaggaggtcgtcttggtagagcaagccttacttgtggtgttcttttggtgttcaagttggggatcttagtggtcacttgaaaccaaagagaagtacctaggggtgttggcttgaagaccggagacctcttcctaggccttttcttggtgaggcaagggattaatcaagacccagctctttagagctcctcaacggagacgtaggattctcggtggagaatccgaacttcgggaaacaaatcgtttgtctcctctcactctctttatctttgtgattgtgatgcttatctccttatttgcctagttgtgctatcatgtctcccattgtatgatcacttgtgctatcttgtgtattttcatgtgtattactcttgtttgagacatgttgtacctctctatggtttaggcttccttgtgatttaatttacttgttgtgaggtgcttgaaatagcaattaacaactgcccggaagttcctaggaagaaccccggaagttccgggcagctttctctgcttgtgagaaaaagctgccaggaagttccggaccttttgccaggaagttccgggccctgattttaaccgttgtgttttgaagtaaattttaggaacgcctattcacaccccccccctctaggcgacatcaaggccctttcattgtcgaccactccttgtctctacggtcctcacaccaagatcgaccagtcgagaacgacagcaactccgacatcagaagtcgcgatcggttacatgagttcatttaagctgaagtcgggggctactgtcagggttacggataaggtataccctctacccttggatgtacgctatacggcaatatggtacatctgcgcgtgtacggacattctctctatacgctaaggaaatctatcacgaagtccaccaatggaaaggttcctacccatataggactgggtcgtcactatatcgtgcagggtccgatgtctccgagtcctacttggagaccacctgacctgcgatataaaagggaccccccaggaagacctaaggcatcgaatctcatagccaacacaacgaccacagcctacgaagccggagcctacaggagccaagtcgatgggtgatctagtcgaatcaactcgactacgatctcgtcggtatcatctagttccattattccctttgtaatttgtggttctctccatataatcccatatcaactggattagggctattacctattaaggggcctgaaccagtataatcgttgtctcttgtttccttgatgtcgtactacgtagatcctcgtaccagcgtaccccaataccctctatatccggtctacgggtacctaccgtcgacaatattataaaagtaacttaaaacaaaacagaagtaattttgtcacgacattataagtaaatcatttgtaggaataaaaatatgattttatctagaaattaaatttaatcagcagagatcaacacacataagtttaacaatttttaaaagtaacttcaatgttaattggaagtaacttttgcatggttcaaaagtaactgtctataaatctatttaatcatcgatagtttctttccttacatttttgtttttcatgtagaatgagaaaagaagatactattgtttttttcaagttgaaaggagatacaaaatagagtacaaactagttaccactagctatgtagtcacttccaattaaaaaagacattcattaaagttacttagtttttgttataagttacttctataatatatgtaaattagttttaggcttcattgaatttacttttacatatctaagaagtaatttagatatattataaaagtaatttataatttttcatcagaatatagtcatgtgagatcttgttataaagatataattgttacaaacacaacggtgcaatcggttcgtagatcggatgagtagtttaagagaaaattatatttgaagtataggtagataatgtctcttatagatggagtggaactagctaccactagctgtgtagtcacgtcctttctctttctatgtggcatattaccatattttatgggtccatattaagctaatatggtattttttggataatgccaaacgtcatggactaaattacgatccctttagtgtacagtagagcttatatgactgatgacaacaagaacatgtagactctcaaagcatgacttggcagagagaatgaagggatgagggactgggagcgggcaactatataatcgcccgactacacacgcactccaagaatgacacacccacgctaccaggcgcgagagtgataggtcatctgcagtacaacagagttcctgtggaatagtgatctaagtctgctacagtaactatcgcatggtactgtagcaagagtcctttagcaacagtggtcgaattttactctcgagtctcccagaggaacggcatattcgatgccacgtccatcacagacgaagccccatgagtaggggtgaaaacggtacgtaaactttccagattccagatctattttcaaaaacggaatctgtcggtcggaattttttcggaaacagaaacgaattcgaaaatattttctccgaaacggaatcgaaaattataagggcagtttctgtcggaactcggaatcggtcggaaactttccggaaattttctcggaatttccggaaattttgtgactgagatagcctggattcctttttttaaaccacttaatagtgaataccatggtgtcaggccgaaaatatcattgttgtgaaaatatcattgttgtgaacagtggtttccgtccgtttccgtaccgttttcacccctacaccacggtcagcaacgtctcctgcatttgccccgacgtccgtcagtccgacgccctcgtccatccaagcctccgaggctctgacagcgtccgccaggtcgccacctcgaccacccaggcctccaccctgggctgcatccccctatgaccaccatcatcggctcgtcgcccgttggatccgttgtggctgccgccgccgtcacccgctgcatctgccatggccaccgccaccgtccgtgttccccgcggctagcgctcctgccatcgttcgcgtcgctgcactcaccctcgccccgtcccgtgtggcagccactcttgcctgttgccggtagccgtaaggtcgcgccctctccccctccatccgctgcggccgccgccctcgccctcgctctcttcccgtgtggccactgctcttgcccgtcgcccgtagccgcaaggctgtgaccctctccccctttatccgtcgcggctgccgccgccctccatgcgtcccccgcgaccgtcgccctcaccctcgcaatcgccatggccaccgctgacaccacccccactctccccgctctggcgtgctcctaggtcccgtcttcactggccgcttgagagttgccttcatcgtcagagtaaaggaaaggaaaggaggaagaaaaagaagagatggaagaagagggtgtggctaatgggcgatcgatccccatgccccctgtacacacctctcctctcctccccttcttctcttcctactatactataaattttaaaaaaataaaaaaataaagttagaaaaaattatgtatagaaatactatatataaaaaatatttgaatttaaatttaaatttgaaacgggtatgtaaacttttgacttataaactttgggtttataaactaatatttgaattcaaattcaaatttgaatcgtgtatataaacttttgacttataaactttgggtctataaactttagatgtataaattttatatgtataaattttatatgtatagaaatactatatgtaaaaaatatttaaattcaaattcaaatttgaatcggatataattcaaattgaaatttgaatcgggtatgtaaacttttgacttataaactttgggtctataaatttaggtgtataaactttagatgtatagaaatactatatataaaaaatatttaaattcaaattcaaatttgaatcggatataattcaaattcaaatttgaatcggatatataaacttttgacttataaactttgggtgtataaactttagatgtatagaaatactatatataaaaaatatttgaattcaaattcaaatttgaatcggatatataaacttttgatttataaactttggatttgtaaactgtatatgtgtaaacttgaggtgtataaactttaggttcataaatttactaaaatagaaaagtaatgtggtgccaaaaaagaaaaccacgtggaggagaggggggaaaccgatcgctcctggcgatcaatcgccaactaggagtttcgggaagaagatgatgggccctacaaaaaataatagaatattggtattagagtaaacaagatatttctattgtatgcatgggctctattatttactataggtgacatggctacctattgcagccagtactgagttgtgttattgaacttgcttttagagcaagtttaatagtatagctatctactagctacaaatcatctatagccaatgtaatagccaaatcatataatagttgcttactatactattaatacctagtcccacctgtcaaacacacattacatcttggagtccgtgctgcaactagctacagatctgtagtccgttgctcttatctctcttcttttatctctttaaaatacgtttatagctggtttatagcttgttacgtacactagtaaccgtgcacgtgcaatgcacattccccacattatgtaacattaaacatataaacacacttaaactttgacgtgttttccccaatacatgacacaaaaaatgtagtttgagaattatatctattgtagtgtaatatagcacaacttaataactcccttttaaacacacggtaaaaaaatttggaaagcagccagtgaggataaaatcatccagcagccgtcaactggaagtatttaagccattaaaaaccctttggcagttatcagaaaatggggaacaattatccctaatcaagtaacctgtggcacctattagaaatgtttcagttatcaacccgataattcattttgttgaggcattaaactaaaggttgataaacggtgcatagctatatatcagtatattattcttcctctgtcctccctctgagtgttaagtctagccattcatcggtggagtacatatcaaacatgcagaaaatatacagaaggtaaaaagtatccaataattgattacatatttgtgctgctctatgataaaaagaagagatttaccttcccctaattctgattactaataattaccaagccattacatcgtacagtacacattcacttgacacttaaaactcacaaaatagtagactacctatcagttaactgaatggataaaacacttttaacagtacataacctacctcaaatggcattgtagatagttacaaatctctcttcctcttctgttgttccaaatctttcaattgcaattaaaagttgtagaggaatgggcaaggtacaggaggtgtttgtcagtgagccgaggccaagcagagagaggagaacaacaaaatttgcatcaataggacatgagctaactgacaacatatatgagtgaatgttaccaatctgcaaaacaaaacttttagaacaatatgtgaacttatattgaacattatttaagttttattgtgagcaaatgaaagcataatgtataacgttaggattatacctcaccattaagattcattctttctgatatggggaggaagactacagctgctgcactgaatcttgaatcatgtacaaaggtaaatcagattgaaaattgcatttataattcttttaaattcttcatttagagtgcaaatgaaataataccgtgagatattgaggatagttctcaaaaagatactggggatatatttgttgccaaaccgtcaggacatacaacattaaaaacatatgatttctacatcggcaaaaatatgcaacacaagcaatcaaatttgggaagcaaagagttgcccgggtggatgtgcagatcatagtaagacaatacattcactggaagctgcatagcaccttgagatcaggtctgtgttagcaaaccgattactcctgcagttcaagaactgtgaacaccaccaaacacggccgcatcaacaactgtcacctgctgcccttcttggaaaaacaaatatatgaagaacatgattaaatgacacatcaaaatatgatagcatgaatgcaaagcaattcaatgacctgaatcatctcatcttcatgctgatgtatgtgtgttctggacttctggtagaaagctggagcatccgaaacataaaactcaattaaatctctaatgtgcggcgtggttgcggcagagggctcagcgtgctcacagcgtcaacgacggcagatgtgggctcgacatggttgtggaggagagcacagcgtggccgtgggtgcgggtgtggggtgaatgagcgattcttgcggctgcggcggatggggaagaccacggttccggtggtggctggggacgactcggctccggcggcgactcgggacgacgtcaactccggccacggctggccgcggcggatgggaagaccacgtctccggcggtggctggggaagacctcggatccggcgagggcagcggtggagtgcgccgcggcggcggcggaaggggacgacctcggctccggcggcggctggagaagaagtcagctccggcgggggtagcggtggattgaggcggcggcggcagtacatgacgggaggagtgagccgcgcgtggagagggtgaggcatagacgcgtagtcttcgcgacgtcttcgcgcgaggtgaggctaaaatcgtgcggtcgagatgggtggacggtacagattagagatctgcggatggacggaccagattacaccggatttgcggatggacggtagagatcgatccgaatgattacaccaataggattggagggaggcgacttatctttttatattaatatagatatagatatagatatagatactcttacagtcttacgtaccatagtaatatttttcgaaccctttccataaagaaaaaaaatggaaaccggaaaagaaaacaaggaaccagtacactagcttacatgcttccattgattccccttctatgcattccgtccctcccgattctccaaacccactcacacacccaagaagatggaaggtcagggaacgcaccctgccatgcccgccgccgccgtctcggtggtgctcgacgacgacgacctcctccgcgagatcatcctgcgcctcgccttccccaccgacctcgtccgcgccgccgccgtctgcaggcgctggctccgcgtcgcctccgccccggccttcctccgccgctaccgcgccctccacccgccccgcgtcctcggcctcttcgccaagcacgccggggctcgctgttcgagcctctcccccatccccgcgggctcgccgccgccgcgcgccgcgccgcgaagggcgccatgctcggctccatcggcggcggcgagccgctgcccgtgtacgactgccgcaacggccgcgtcctgatggacctctccgacccgttcgaccgcggcgacggcacgctcgcggtggtcagcccgctgctgcacgcgtcgcggtcgctcgccgtcctcccgccggtcccgctcgccgcgcgcccgccgcccgtatccgccatgggcgacgacgacacgctgctcggccgggccaccgacgtctgcatcctcctccccgaggacggctgcgacggccagtcctacaccgtggtgacgctggtgcgcagcaagcgcgtggactggcgcgtgtggtgggagttcttcgccaaggtgtccgtcctgcgcgcgggcgcctgggacgacgacgtccgcgccacggcgccggtcgagctcccggcgcggtgccgcggcgacacgacctggaaccgtgccctgcttgtccaaggcaagctatacgtcctgggcatgcagtcccacgccattcttgtgctcgacctggcatccatggccacctccttcatcaacctccccgacggagtgcgccacgaggaggacggagacctcgacctgttccggtcaaacgacgccggcgtcaacctcatccatgtcaatgggtttcaagctcgtctctggcgtcgcggtggcgacgacgatgacggcgacggcatgacagcgggcaattgggtgttggtggacgacattggtgttcgtcgagggttcgatcacctcgcgaaggttggcggggagatggacattggtggtccggttggggttatcaaggtcggcgacgactgcgagttcatgttcttgtgcgttgatggcgatgtgctgtacatggatatcaggacgaggatggtgaagaagattttcaaggcgtcaccgaagagaggaggtgttctgccagtgatccatccactgaccatggtttggcctccaatcttcccagtgctggagtagatcaaggatggaggccatttcagtgatccttgaagaggaggtttggtttttggtgctttgtgtcttaagttcttgtctactgctggcttgctgctggattgatttatcatgtgtgtttgtttcttccattttgtggtaatggacttaaaaatggtatggtcgatgaattaatggattatgaatatatgggtatcctttactaaaatcaatatctgcttgtatatttgatttaactctgaaacaaacaagtaaattattatagcagattattataatctataagctagattattataatctaataagctgctctaggtgagcttttttcaaattattgagtggctaaagacccactactcctacataattgagaaaaattacccacctatgccatcaaccgaacagatagctgagggcattatagactttagcttttcaaacccaataatccatacctccaataatccaaacaaataaacaactcacagcttattctatgtcagcttattataatccagtttatagtaatctggcttaataatctagattataataatcataagctgaaacaaacaggaccttagttacttctatcgtaagcagagcctagttggcatgataactctggtgatgcattgatcttggagatttgttactgtaaccatgaactgcaagaaaggaagatatattttctttgaagcaaacaacccgttgatggaaattttaaccatgttgatggcttatgctccatatatccttccgatcgagcagaacgataaatatcttacgattagtgtacgatacaatgtttctatggcccaatcaagtatcatgcatgactggatcgtatcaaaatcgtaacaagtttgtcgtacgtacagcaatttcccgagcggaactacctcagcagccaggaactagagagccccaggcatcagtcgtttagtaattttgatgttcctattctcatgagttgccttgccgaatcaaaatgaaaaccgaaggattataggttctggatgttccatgctcaaaacaaaacaattgttgccatgttagaatctgaagcattatcaattcagcagtttcttttcgtagctgtgacttaccactttcaattatatgcatgagctgcttcaactatgacctgaaacccaaattcaactcaattttaagttggaacaaaactagataaaacatgctgggtaggcccacctggtgctagtgtctatcgagccatagctagacttatgcttggtgggtacaagtccaaattttccaacaacatcacaattgtttatatgatctgccatatccctgtttttcatttggatatgttgctaagccgagcaaatattccttttttttaaaaaagaaagtgttagaactcaagctatgacagagttgctctgaaatccgaaaattcctagttcagaacaagcagcacatggtacaacacacaaggatatgatttcttctttgttcctgtttcgtatgcacaaaatcagatattgagattcaatataaatgctacataatgttgtacctcctccatttcataatgtaagactttctagcattgtccacatacatatacatattaatgaacctaaacacatatatttgtatagattcattaacatctatatgaatgtagataatgctagaaagtcttacattatgaaatggagggagtattaagtacgaacagaataaagtctgatactacaaaaagctcacaacataattcaatcctaaattgtcaatgacagttattcacacattccaggtttccagtttttggactaaaaactcagaagcagtactttgcaaataatctccaaaacaggctatcaaaattaccagctcaaaattcctctgtagcatacctggaaaaaaggtgaaatttaaacctgaaatattgcttgaattcaatttgttaagcagaagaatatttttgaagtagatcaggttaactcatacttaaatcttattttaaagcataacaaaggaacatcacataagatgcctgactctcctaaaagaccagtaacaattagattgttacagcaagataactacatgctgaattgagaatcggttagacatcgcataaagcactagagaaaaatcctctgggatcattcatactgaattactgatcatcgtcatcgtcatagttcaaagccgggaaagtgggaggccatatcatcatgaagggaaagatttcaaaaccaatatcttcctttggagccatctcgaaaaccttgttcgctgtcctgctcgcaatatgtatgtggaagatcacgcggtctatcgtcaagaacagctcggcattatcctcgactctacgaagtgaaacaagagcatccccaagtgaaggatcccccgactcccaatcgggcctcgcaacttgaccaaacgattgatgcagagacatggtatcaaccatctcccaatcaccaccattcccaccgccgtctgtcgcacgatgccaaacatgaatctgaaaccccttcagatgagcaagatataatccggaatcgccgtcccgcaacaactcaaggttccccatatgctccagctgctccacaccatccgggagcttgatcaagaacaagctcatcgacgccagattcaacccaagaacatgctccctgcccagcatgtagaggctcccatggaagagcaatccacggttcatcttcttgtttggccagtagtgattcggcagctcgattgaatcggaggtgcggatctggtcgtctgattcacctctcaccaacactgctctcgcgaacaatccacggcctcttcgtatcagaaccaccagcgtgtaggagagatcgtcgccgccgtcgtcctcctcctcctccgggagcagcatccagcccgggcgcagcacacgggcatcgttgggtacctgatggagctgcgagtgcaggttcgggggcagatcgggcggcttccgcgcggggggcagcagcggggagacgacgccgaagcgtagctcgtcgggcgggggcgggaactccgccctgaggaggcggccgttgcggcagtcgaagaccacggcggagacgtcggcgccgccgagcgcgaacccgccgaggcggcggagcacgggggcgagctccgggggctggggaagcggcacgaacgccggctgctcgtcccggcgcgcggtgtggtagaagccgaggaggcggggcgggttgcgggcgcggaagcggcggaggaaggacgagtcggaggcgaggccgagccagcgggaggagacgagggcggcgcggacgagcgtggtggggaaggcgaggcggaggaggatctcgcggaggaggtcgtcgtcggcgagcaccgacgaggccgcagaagccgccggtggcggagaggagggacgcgtcgcctcgtcttccatttgcatgcgatcgaggaggtattggagtaaggagctcaggttgagctaagctaagctggtttaacaatatttttctacttaatgtcatttctacaacttcattactctatccatatcaaatataacaatttttaaccttcaaaatttatatattaatttttccacgaacatttttttccaaccaataatactccaacattcaagctcatcacttctaccatttaattctacatatattttttaataactatgtccaactctaaatatataaatctatttatccttaataaaggagtaactaaaaaaaccacatatattaatcagagaaaaggaaacatatcttatatacaaatactaactttaattcaggttttttttttcaatagttgggctgaattttggttaggaggcgcccacgctctcctgctgtaaaccacacacgcgtaggattatttggacaacacgccatgcattattcttttgtctcttttaatatcgagttaaacctttgctataaaaaggtttcaaacatctagctttaacatcggaacaaaaaaatctagatgtacatatactactcgtcctggagaaaaaaagaggcaagtgtcaagttgtcgaaacaaaatgtcatcttgttctgaacagggtatctaacattaagtcattaagtcattaggaacaccggtctaagggcctgtttagatccatgctaaaatttttcaccatgtcacatcgaatatttagacacatatatggagtattaaatataaaaaaaataactaattacacagattgcgtgtaaattgcgagacgaatcttttaagcctaattgctccatgatttgacaatgtggtgctatattaaacatttgctaataacagattaattaggcttaattaataaattcgtcttgcagtttacagacggaatatgtaatttgttttgttattagtctacgtttaatacttcaaatatgtgtccgtatatccgatgtggcacgccaaaactttacactcatggatctaagggggt

SEQ ID NO: 80525 - DNA, 82059 bp, Oryza sativa
  unsure (1)..(82059): unsure at all n locations
gggcccacggcgccggccagtgtgagcctgggtgcaaccggtccaccgtggaccgtgaggctgccgcgtgggccccactcccgtggacccggtccgcgcgccccctccccctcagctgacgcaataaaccccttttttaaattaaaatttaaatgaagaaattcgcaaatattcatttaaagagcatataaacttcaaatggccataacttggccatttgaactcggaattggaccgttcaagtctctaatttttccttaagaagtcaagaaccaatttttgtgctttattcctgcttgttatatggagtttattagagtaaaagccttctcttttccgctcttcgtggaggttgaagccgacatttgggaaagcgagcaaggcaagacacatcatccttgagcatattgaatcccagtttataaaattattttgatttaaattattgcattatcgctttacttaaattcccgcgttatcactgttttatctagccatgcctatttacttttgttatgaccttattattattattgttattattaccttgttcaccctagattaaacaaaaccccaactagtggacactctactcatggtaccactagtatgattttaggtagatgcttcgctggttaattagccaacattaggtggttttacaactctagactttgggatatttatatcacctggacactatggaatggttggattattgtggaattagattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactattgtctatggctaggataggttggaaactatgtcacgtcttccgtccatataccgtggtggtatgtggcatgtggttacacgtgaggaagatgtgtcttgtgggtaaagttgtacacctctgatcagagtataatctatccgaatagccgtgccctcggttatgggcaagccgagcaatgtagccaagttattgtttttaattcttaaaacctgcttaacaactaaaatgtggaatggttggcctgggttggattgggatgagctgggacccagggtcgggttgccagttcggtctgaatcatcgtaggccttgggttaaggcaggttcgtgtgggttcacggccttgattaataatattgtgtagctctaggaccgtggttacaaaatagctttgagcaactaagtgtcttttaatgctgtttactgcaaaccctaactctctatattatggctcccttgtactcccttgcatttattctgcacttgtgggtgtgtcttgttgagtacggtggttgtactcaatcttgctcaattttttcccaaacccagaagaggagttcctggaagatgaaggctttggtgtctagctcgtgcctgccgtcaagcgcctgtggtcgtcgccctagtcttccgctgtttttcgtttgtcttcttgtgtgctgggccttcgccgcccatgtaataaattaattaattacgcttccgcctgttaaactctgaattgtatcaacttttgtgtaccttgcctcctgggacaaggaataaggaataatgcacgcacgtaaggaacgcccgttgggttatttccggtcgtgacaagttggtatcagagcccccttgaccctaggacgagccttagatcccaagcctttgcaatattttcaaaataaaaatgatagcgaaaagaaacataaaaacacgcacaagctccatcgggcaaaagcacatatgtgttatacaaaggagcaaaaaattacatcatccgtttcagaacatttttgccccgcccctactaagtcccgcgaacacggttcgtcatctatactgtacacgactctaaggggggaaggaagtgaaatacacaccgacgtcaagcgataacaacttgacgattagtcatttcgaagtctaaccaaagtgtggcaatgtcatcgcggcgctggatgtggcaccggccgtaatcctctaaggttcgaccgggatgtcttcgcctccaattcgccattttgacaaccacagctacataaaaggcgaatgcttgatcgacgaaaacgccaggggggcaaaacgaatcggccgaagcatcgctcgccgaacattgaaaccgcaacagcttgtttcggaataaagataccgaacgccgttacattcaacttacgcaaaacacaagcgtttttcccaacgcaaaatgctacgagtcgaaaacggaagtcgaaagctaaaaagtcaacaaatcttttcgccaatccccaaaagggggccgaacgcatgactttgggcaaaatccccgctaaaacaatagggaaaaggggaaagaaaaaaatacaagtcaagaatcgcgcaaagcagacaaacttggcaaaatataatcacccagtgtcataatacagcttcgccattctcgaaaggcgaacgccagtgttcatatgttttctgaaggagtctaaaacgaggtttcggcaggaacatcgcccgaaaggggacgcctcatgccataccgcatagtttgcacggtctcggccgaagctccttactcacccttccccgtgaggggcttgttggaggtatgccatgaagcccttcggccggacctgtcgaaactatagtaccagcaaggattcaagccaaagacgtcaaggccattcaggcgaagccctatggcgaaagccataagcgaagatggcgaaggctnnnnnnnngaaagccacgtcgatattccgaaagtaaaggcatctcgggcgaaggcatctcgggcgaactacaaagacttcgccatgacgagttcggcatcaaggaggcccaacaggccgcccctagccttttaggcccatttgccatagaccaggcccagcctatcagcccattaaaggcccatatgtgcaaatgacactgcatacccatgtaaatgtccctttcataagggcaaccatgtaaaatcccctgtaaccctaaaccctagaaggtgcaagcttgtgctaaggctataaataaacctctagggccatgtaatgggggggatccccaaaaaatatttcacgaatcaatacaattgcttttacattccaactactgttgagagaaccacgcctttcgacatggcatagttgtccattcgacaacatttagcatatatgaaggtttgagaaaaaagactacaataccccttattaaatggtttataggtaagagtggagaatagttgagggtaaaatagggagaaatttggacgagaaatgattaaagggatcattagtactctattgtgagaattattttgggacaaattcaaatcctagagatacaattattatggggtagaggtattatattactaaccatttagtttgtaatatagcgtgactgacactaacacaacttaacatatgctaatcacttgtgttttttttttgaaacggtagacggctggagggctaccggttatattagaaggagaaacaagtgaaaacagagttattacaacgtaataagggagcattggggataatacaactcagggataggcagaaggggaagggaggctagttatgggggcttgaaaacaaaattccgtaaatctatgtcttccttgattagcgttgctacatccacaaaggaattggatgtttgtttgaaaattgttgtatttctttggttccaaatatgccatcaagttgagatcagggcattgaattttgctttgctttgtgttgcatttgccgaagatgtaagaggggcaatccactcaggaactgatccccgtggggtagtaggtagaccaagcattgttgagattgactcccaaacctgtcttgtgaaggtacaatccctaaaaaggtgaacagtgtcctctaatgcccgtcagcagagagagcaaatgcaattacaaggttagtgtcttatgagtagattgtggttgtaagtgctttttgatgtaagattagccatccgtgaaaatgttgtttaggctacgcatgagcagaccaaatgatcttgaaagaggggttcatcactgatcctagaaaatgtacttggtaagcacttcttgttgaaaaacatcttgaagaattcaaggatgatgatatgtcatcttcagtgttttcctccagagtgattagagagagcattgttcctagttggacaagttcatgaatggactccacatttgtgatctgcctgaaagaggttaaccaagagtttttagagagttatgttgcaacagttctgctcttccgttgcactagtgagaaaagatctggcaaaatatcttttggacattggtcttgaagccagttgtcatgccaaaagaggaacaaatgcctgtctttttcattgcaagggagtttcatttgggcccaaggcctctgatcatccttccatctgagctagagccatctcaatcttagcgctcttgaaaacttctcaaggtctaagattcctatgcctcccaaatctttatgttgacaagctgtttgcaaatttacgatgcatgttctagggtgggtgttttcaggctcagtccctttccaaaggaaagatcttctaagtttatcaattttcttgatgaccaatttggggattttcaaggtggtcatctgataggttgggattgctgatagaatatatttgaccaaagtttctcttccaacccagtagtctagaggagatcttttcaagaaggggtaggaaataaattttgtttagcttccttgtgtgcaggggaaggcccaagtatgttgttgggaaggaagacaatttgccatggaaattctaaaatatttgttgcatattgatgtttgcacaagctatagggaggatctctattttggcaatgttatttcgtaggccagaaacttccccaaagagctccaggagaacttttaggttttcaatctccgtggagtctggctttacaaagaatgctacatcatccgcaaatagggagattctgaatctcaaatttccaattccaaggggagagattacccttgattgttcagctagtttcatgatattattgagtggctccattgcaatgatgaagagaaaaggggagagagggtcaccccgtcttaggcctcttgcatgtttaatgggctgcccaggaatgccaattacgagcacttttgaactagacttttggaagagtgtcgaaatcccatttctccttctagtgccaaaacctaattgtgtcagaacttcaatgtgatattgctagcttacagaatcaaaagcctttgaaatatctaatttgagaatgagtgttttgaattttttcctatgaagccttttgaccaagttctggacatacatgaaattgtcatggattgatcttttccttatgaaggctctttgattgatgttaatcatctcatgcattgtcggagtgagtccattggccagaatcttagagacaatctttgcaaagctgtgtactaacttattggcctgtaatggttaggtgaagtagcatcttcttttttcgggataaagcaaatatgagcataattcagatcatccaattggtttaggttatgattgatgaaagattggactgcctttaggaggtcaagcttgatgcagtttcaaagaatttaccaataaaaccatcaggtccaggagctttctgtgcctggatagatttgaacgcctgctctaactctgctagagtgatatcttcttcctggtcattaaggtcaactattgcaagctgatttgggtccaatttaaagttgattgacttatgtgggtttgcccaactctttgatgaaagaaatgttcagctcttccactttctctagattggaagaagctattccagaagtggtttgcaacacctggatgggtttgcaacacctagatgaagttctttcttcttcttgcattttcttttaggtggaatagctttgtatttgtgtctccttctttaatccaagttagtctagatctctgtcgaattttgattttattgagcccaagaattttgtgcttcaagctactgtgcagaatttgttcttcgatagaaaaggttcatgatttctggacaacacctagttggaagataacctcgtttgtgatggccagttgaagtattatgtctcctacctgtttcgctacccatcttcttatatctcgtgccaaacgtttcagtttcatgttaggaattgctaaagggtttgtggagttgattggtctttcccaggagcttgtgaccatttcttgaaaggaatggtagcttaacctaaagctctcgaaacagaaatggcttggcctaggggatccatcactgccctacaaaaggaggggagcatggtctgaacaggagctggataggggcaatagtcaagcaaactcgtagggcaaatctcaatccatgaaatagaaagctctgtcaaattttatatctcaatccatgaaatagaaagctctgtcaaattttatttgagttgggttgcttgaggtccctgcccaagtgaacattcttccctggagagtaagcacttttatttgcaaatgaccaatggcccatataaacctttgcatcatcctcaaatcaattctcgagttgtttttgtcataggttttgtagattggattaaaatctccaattattaaccaagaaggtaaaacgatgctcatgttgtgctcaagctcttgtagaaaagcgagtttctctgcatcactttgtgggccataaacagctatgattggccaaaatgtttgttcttctctcattgtgatggtagcagtgagggagaaaactcccaatgtgacagccgttaaccgaaagaaatctcatcaactgcaaggattatgcctcctcttattccttgggctggaaggaaaacaaaagtattccgaaatctacttcccatagattgaacaatgcagggtgtgttcacctcctgaattttagtttcctacaaacagacaatcgaggcacaatgttggttgatcaggagtctcagagcttccttcttggtcggtgcatttaatcccctaacattctaattaaatattttgcagtgtcgttaagccattaggaaacaaaataaggccactaagagcatccaagcatagcacaagggagaacaaacagacaaggaaaggtttcaagagcaagagcagcttaggtttcttctagcagtattcacagttggagatagcgcgggagaagaaaactgtactcatgtgaagatacagaagtgaaacatgcttagaacaagaataacagctttaaggtctttgcaacaacatccatagatagtgcacttcttaacatagcggggaaggccttatagccttgttggtgcatcaaaactacataacacatcatacaccaaaaacattccaggttcctagaggtttgcatcacacctcctgacttgatcactgggggtttgccgtccattatttatctaggtgcctactaggttggttgcagagtagcttcatgctggcagatcaattgtctacgtcttggcaactttgaccttgatctgtttgcagccatccatctgcgcaacgtgagtgacttcttgaaacattgtaaataaagttttttttgacattctcatcaaaagagtcactctcattcatgataacaaatttcttagaaaggatttcttgagctatggtttcaattttacatccattctttcttttcttttcaaccctttcgctgtgcctttgagtagaattaagggtcacctttgggcgatgggctcggatgcgtccaagcgacagacttgggagtagtgggacctagactggcgtcaagagggatgccaccatatccccaactatatccttttcaatcgtgctggctctcaggatggattcctgccttggttcataggttggcgatgcctcgtcatcagcattcccatccacggagaagttcagttggggtaggtttgcctcaaccagcatcgaatcatcatgaaccaactagttcgctggaacttcctaatggagaaaaaagaactcagttgggggcaaggagactggaataagaagagctagtgacccgtcattgggactcttgctgcggcgtgaagaacgaggcttgtaggggggagccagcagatgggagagagaaggcagagctagtgttttagagctgcgtcatggtgaggtaggataaagagaaggtctcacctctccgtgctctttggatcggcgattgtgacccatggagatcgatggctcccttgctctctgcctgccatgatttttcctggttgtagtagctgtgctcatcacccctatgcactctgccgctcgagcagccagtgatatagccctagagagagcacgagcgtctcctgtggcatggtcttggtcgcccaccgccaccatctgggtcatcctccaggcccctcaccgcgctcagctccggcctgcatggaataggaagtggacacgagtgcgtgcgagaggcatcgtcctagaccacgtaggtccattcataggtcttgtagagcatgggttggaggtcttctagggtgtctaggtggaggatgaccgggtaggtccatcccccttcagtctcggcaatggtgggttgcatagcgggtcgatgtccaggaatggcatgtcaatggggatcagctcttcatctacattggagacgcccagccaagcttcttcttgcatccgcttcagtctcaatgaagttgatggagcacttgggctcgacaagcttcgccgtcaccccctcagtgtgaccatgcatcgggatcccctcaatgcataggcgcacacggtagtgacagctagaaggtctgatgaccctcatggtgtgagtcccaagctcggagatggtaggaacagctagaagagcggtcaagccgtagagtgcacggaataaagtccctatcagcaggcctagccaatgtgaggaaggtagcctcatcaacgcagtcactgtggttgtccaagcaccacgcaatgaaggagcagcacgagaacttttgccgaagcctctcgacctcgtcagttgcagccactgtcaccgtggctgccactagccttttttccaatagttcatccatcgcaaccggggttccacgaggggcggccactcgagaatccggcagggccttcttggtgaccgaaggttggtgggggagaggtgggaactgagagggatttgggagaagaggggggagcaagcaaggtggcaggtgaactttgtcccctactcttcgcttggagcaattaaggacttcatgtccaatccctctacaaaaccagcgtttgaagggctctctgcaatctttaattttgtgatctggagcaaggcatctgaaacactttccttccatatgtttaaagaaacgagctcttccttgcttgtgttggtcctgtggatctgcttgagcactaagggattgctgtcttctccactagtgttttgctttgacttctttccactagggatctgagataatttgggaggatcttttaatctactgagatggaggatgtgacgaggtagagattacacttccgctcttgagtactctaggcgtatcactagcgagaggcaatttgcttcgcctggtagataacctcttgctcacaagcaaactttggggggcagcagctaaaggaagagagtcactggctgcaattgaaacctaactgactggggtcagtggagcattgatgctttcagcaggagtaatcaagacttctttgaacgttttgtagaaccgctgctagggatggttctggatttgctcatcacgtggaggaggcgctaggctttccaggtgtgaaaccagatctagatctgaggggaagagtggcttaccttgtggtggaagacgacattcaagacctgagagaaggtttgagatgttacggggtggagagaagttgggcaggagagaggtctggaggtactggctggccggaggtgggggtggaggtggtggcgacagctagttgctggtgtcgagggtgggtgtctgggctaggggacgacatatttattgctactccctccgtctcagaatataacaacctagcaccggatgggatgtattctagtactatgaatctggacagccccctgtccagattcgtattactatgatgcgtcccatccgatcctagattgctatattctaggacggagggagtaatcacttatcatgtcattagtttggtgggctagggcctctagctatagctcaccacaaatggaatccattttttttcttaggccaagtgctcccttagaaactgttcaagccagtctcctactcaagtatagcaaaccaaacaagtctggatcaaccaaaatccaacaaaccaaactcatcccatatcgaagaagaaaacaaaaagaaaaaggtagcacaagatctgcaactaggaatcacgtgtacaccttgtcgtcatctgcctgctagcactagtagccacaagatagcacattgtatggaaaattaattcaaccgggtaggttaggaggccgatgttttggtgcgtacgtacaaggatgtcaagcttgccgccgaacatggcggcgaccctgccggcgatcgcctccgggtcagcgcgcacctacgcgtcggacggagacggtgacggcgagcttcttggctctccactcctccagacacctgttcagggtagcctcgttccgggcgcacgtgtgcaccgtggcgccgaagctcgccagttcctccacgatggcgcgcctggatgatgcatttatacatgcttaatcagttaatctgctgccatcgatttaactagcatctactaatacgccgaagcaacgattcgatgacttggtgaacttattcatagtataattagatgttaaaagttaattagaatcaataacaatttaacactggctgaagagctagataattaagagcacaatctgaagagatagatctgtttcactcttcaattctgaaaacagatcgatgggaaagcttggattcggcgaaggaagacgaattaattacccgattcctttgctgccaccggtgacgagagctgtggcgccggcaaggctccaccgcccgacctccggcctgctgcttgtggacatatcggcgtgcctccggtttgtgcgtcagacttgtgtgttagtgagacagcttgcagttgcagcacagggtcgagtacttctaaaggcgtaaagcattagccgtctgcactaggtgcttgtctagtccgctggccctgtccgcctccttgtgtccatctcatgaatatctttgacgtgtatttgttcagatttttctttaaaaaatactattttttatgggaaaagagagtatagcatatatcggcttgtcctgagttatccattgactttagacttgtttagttctctgagacaactccgcatccgctgtccactaaagaaacgggatcggttatctgtaatgggtttaaagcatcatctctttcggacagggcacccgtcactaagcaaagatcagtaatgtgagaaaatatcttaatcgggcatccggccatcacgaacgaatgactctcatctctaatgggcctaagctatagcctgtcacggatgactctcatctctaagcacccggaaagaatttttccggtcggtcacccattccgaaattgctctaggccaagcacgcttaatctcatagtttttttttaagattggattccgaaaaagaaattgtaacttgttggcatgagtattctattaatcctattaagccctgggcaaggatgtcacaccctagcattccctattcatatacatttattcatatacctaactatcaatatatttaatacaaccacattcatataacatccattttgatcatatatttcaccagcaaaaccgagttaattgcatcaaatatatatttagcaagtattatcacgagtagggtaaatcagacttctaggcaaaaatgaatttcaaattgaattttatggtactagatgaactcatctgaaaaagttgtaaaaaacaaagttgtagaactaattgagatctaccaattttatttagggcaattgcatatttgactctgttttgaaagccaactactaaattgaccctgttttttttaacttagcttattttaccctgcttttcaaaaacaaacatcaggcctgaccctattctgtcaatccaacgtaacagtgttaacttatggctaaaaagacatttatgcccttgcgtatttgaccgtgatttgttttctattcggtctaatttcatacacttagttgtttaaaaataacattttaacatatttgtgacacaaaaatttgacgaagaatcgataaaactacaactgaagtttaactaaattttggcagcatatattatccatcacaaattacatatactgaagaaaaaactaagagctagctagcctgcggccctggagtgcgtcgcaccaccgccggccgatgcccggagaggtggaagccactggccatagaggcgcaggggtgccgacaccgttcctgtcaccacctcctcaaatctcatcgtcactggctcgccgctgatgcaccgtcgccaatgcgaggaagagaggccaccgtcggcaccagcacagtcgccgcatggatggagagcaggtggaggagcttggcttgcatggtcgccggtgtcgggacattactccgtcgcctggaacagctaagccgccgtggccatcgactgcatgaagcagctgcttcgcgcgtgtgccgccgccgccgccacaaatccctccgcgccccggcactgccgccgctcagctggtgcggatcccctccctccccgccggcgcagatcccatcccgtcgccgctgctgctccctcccaccacgtcgtgctgccgccgctccctccctccagcgtcggcgctgctatttcctcatacgccgccattaccactcgcatttatgatacgagacatccagatagggtttattttggatagggttcctggagggtattttggataataattatattttttatttgttttttaatgaaagcttaacggagtagcgaaaaaagggtcagaccaagtgatcagttttaaaaaatagggtcaaataagaaaaccacaaaaaatagggtcaaattggtagttagcctttcaaacggggccaaataagcaattgtcccattttattttggtcatttttctatccgagtttgattaaactatataaaatttgaattctaaaatataagaaatttaaatatttttttgggtagtaaatgatttcaaatgaaaaaattatcaacaacaaagttgtatatctcctcaagatctataacttttactttggtctttctcccatataatattttttgaatagtttcaatttgaatttgaaaatatgacaacttcaaacaatattttcaaatactaaatgatttcaacagaaaaagtcatcaacaaaaaagttgtacaattcatcaagatctataacttttatttttgtcatttttctatataacatttttttgaacagtttgaatttgaatatgaaaatatgataacttcaaacaatattttcaaatactaaataatttcaactgaaaaagtcaacaacaacaaagttgtataacttatcaagatctataacttttgtttttgtcatttttctatataacatttttgaacagtttgaatttgaatttgaaaatatgacaacttcaaacaatattttcaaatactaaatgatttcaactgaaaaagtcatcaacaacaaagttttatatctcatcaagatctataacttttatttttatcatttttctatataatattttttgaacagtttgaatttgaatttgaaaatatgacagcctcaaacaatattttcaaatactaaatgatttcaactgaaaaagtcatcgacagcaaagttgtataactcatcaagatctataacttttatttttgtcatttttatatataacattttttgtgaacagattgaatttgaatttgaaaatatcacaacttcaaacaacattttcaaatactaaatgatttcaactgaaaaaattatcaacaaagttgtataactcatcaagttctgtaacttttattttggtcatttcttcatccgacaaagtgatagtaatatcgttaccaaaattcacatatctcttatctggttttataaactataacacggatatgtaaattttgtgaacaatgttactaacactttgtcggatgatgaaatgacaaacataaaagttatagatctttgtgagttatacaactttgttgttgttgacttcttttagttgaaatcatttactatttgaaaatgttgtttgaagttgtcatattttcaaattcaaactcaaactgttcataagaaatgttatatagaaaaatgatcaaaataaaagttgtaaatcttgataagttatacaactttgttgttgataatttttctatttgaaatcatttagtatttgaaaatattgattgaagttgtcatattttcaaattcaaattaaaactattcaaaaaaagttatatataaaaatgaccgaaataaaagttgtaaatcttgataagttatatagctttgttgttgacaatgtttccatttgaaatcacttactacaaaaaatttgttttgactaataaaatgaattattatactacagttaattattttgcacaggtcaactcacaaatataaacatttcatatgaaaaatggaaaaaaactaagtcatctcaattgggcataagtacagagcccgtcacgaatgagtcatctgtgacgggcctaattgttaccgattgagatataggcatacatatatgttagatgggtagtaaagtcaggcccgtcacggatgacacctatcagtgacgggccgtagtttaggcccgattgagataacattacatttctcaatcgggccctaagttggcgcccgtcatggatgacctaaactaaggcccatcagtgataggtgtcatccatgacggggttgacttttatgcccatctaacatgtctgtgcgacaatatctcaatcgggcgctttttcggcctcatctgtgacggcctgctaattctagtcatgttagctaattctaggcatgtcaggcgctaaggttctgtactagtgatctaatagatcatggaaaatcgggcgctctcctgtagctgccttatatgtgcatgttggctctctctcactctgatgcatgcatacatatgtaccgcctccccatatatgattgaccaccatacattcatacagttcttgctccacaagttctttctcctctctccgtacacaatttaaaccaaaatcatagtttcttttaaattaattattgatctttaatctaattacgtagttgtatttgatgaaattaaaacgttacaatcaaatctcacaacactatatttcaaataaaaatataattatattcttaattgaaacattgtttcatcatacatacaacatgatttatagcaggtgaaacatcacaacatttttttaaaacatccaaagaatacaacgtgcaacatttgtaaatgagctagtgaaacatcagataatatttattgcaatatctaaataacaccccgaaaaccacgtgcaacatttataaatgacatagtgcgacatccgaaattcttattgcaacatccaaataacaccatgtccaccaaacaaaaatacatttaaaaccttaaagtgtgtgttacacactgaaaattttgaatttcaaatatggaaaacaaaattttgaataattaaacacctttctcaaaatttcttcatgcaggttgttgtcaattgacaactgcatcacgtcgaaggacatggttcagttaacaatagttggaaagtaaaagcagccaggcccacctgtcaatggttgttggaggcgtatcacgaggacctttggccgggcctaccgaaaccagaggtgatcaaaagtgcgagtaggaagaaagcggcgaagatcggagaaactgcatgggcaaaggtgatatggcgaaagcagtaacatggagcctacaagctttgccaaagacagacctcgccatggggagacacggtcgaaggttcgaggcaaaagccttgccacggagagcacgagtttcgccaggcatcaggtctcaccacaaggaggcccaacaggccgacacaccctccgaagctttcgccaaaggccgggctgaaacactcaacccattaagggcccatataagcaaaagacacaggatacccatggagatgtccctatcataaggctaaccatgtaaattcccctgtaaacccaagaccttaaaacggagagtctgtaatagggctataagtagccccctaggacaatgtaacaggggatccaaaaaaattttactatgcaatataattgtctttacttccaactacagttgagagatccacgcctttcgacgtgatgcagttgtccattcgacaacagctggcgccgtgtcacaccctgaagttcttttcccaagcctaaattgaatttataaatgacctcaagaaaataccgatgtaaaagcaagagcgaaaccctaataaattaatgcaaataataatcggaattggcatgtggaatttatcttgagttctacatgtcgaaatgtgctaacaagatttttagtggaatttttagagctctagaaataattttaatcaattaaaaatgagcacaagcaatatttaatccctggaaattcatttcctcctttttctttttattttccctccttttccttttcgaataggccgctggcccattctcttcccctccccgctgggccggctgaaggccaaggcccagcagccgcccgcctcctccctcctccctttgggtcgccgacaggtggggcccacctgtcgggcccgtctcccagctccagctcccacaaccgccgccccgctcgctcccgcacctcccgggccacgtcggccacgtcgccgccttgccccgccttccccgcgcccactccctctctctcccgcccgcgcccgcgctcgagacggccgggattcgaaattcgaatcccgtctctctctcctccccacctctccccactccgccggcgaaatcgcggccatcccggccataatcgacccccgcgggtctatataaagcgcccccgtctccccctctctctttttcgttttgcaaccatccactcccgtgccctccacagccctagtgccgttgccctcctctccgccgccaccgccaccgctccggccaccgctagccgccgttagccgccgtgccgagccgtgccgtcgatgccgttgcgttcgccgtcgtgcaggccgtctcgtccacctctcctccgtcagaaaccgccgccgtaacccactccgcatcgtgcgccggtgagcaccgccatggccgccgccttcggctggcgtcctcgccctcttctatccacctctctctctctaaccccttttatcatgttcgctaggtggtttcggagctcgtgccactgccgtcatcgccctccgtcgctcgccgtcgtcaatcgccgtcggtgaggcacctcctccccttcctccctctctcccacgcagcttagccgccgtgccgccgcctagccgcttagccgccgctagcgccgtccgcgtcgccgcgacgtcgccgccctccgcccccagccggtcgccgccggtcgccgacttgcgccgccacggcatcgagccgtgccgccgtgcaccatggccgccgggccggcttgagccgcccgagcgcgccggccgcgtggttccgccgctgagggtagatcggggccgtcggttcagctgcccgcgtggctgccaggtggccgccacgtgtgcgccacgtcggcgccacatcagcgccacgtggtgcgctgccccttccccggtccatggacccagtccaccgcggaccgccacccgagtcactgacatgtgggcccgcatgtcggcgccgccccctctctctccctgggattttaattattgcgcaataaatcaattaaggattttaattattgctccgtttaagcccattcaagtcttagtaaatcaagaaaaatgcatagaatccattaaaaatggttttgttctctgtttcaatagtcttatggcctgtttgtattgtttgttttgtatgtcgcttagattccggttctcccgacgctccggtgtactttgaaatagtcgccgaggttcctccagcagcaaagcaaggcaagtcatgcattacgattgatcatattgtacccaatttacaaatgtcccgtatttctattaaatgttgcattgttttacaatgtcatgtgggatgggtcctactactcggccatatattgtttaccttttgccattgataacttaggtattaaaatgattagatgttggtttagggaatgcttagccatgcttagttcaaccagtacacaaagggggatcactttaatgcctagactttgattattggcatagctttggattagtaccaccgcaatggtgttgattaattaaaatatattaaatggttggctgtgggtgcatgattttgatggtcgcgcccatggcacttaaggaccggttcgcgggatgccctggaagaacttatcgtacttaccacaagccagcgtgggtaacggctgggcttgtagtgtagctttgctctagctgacacatccaggcaagggtgggcgtgatggagcgggacaggccctgcgacggcctctgtcgcttccggatttacgtaggcacgagaggggactgcccgttgcccgctggggacgggggtgaaacctgaggtgtggtgtgcttggctagagggggttatgcgaagggtcctgtcacggcctctttccggtatgttgtggtggcatgtcggcgcacagtaacgtgtcgtggggctctgtcttgtgggtacagttgtacacctctgatcagagtaaaactattcgaatagccgtgcccgcggttacgggtggtccaccagattcactgtgattagtctcaccctagattagcctaatggaattgattagttcaggaggatggttgggccagttgcaacgtggtgtagcgttggacagtggatgattaatattgattaattactacaactgttttactgctttcaactactgtttataaatgctcgctttatgcaaatgacccgctctagctatcctttggttatatcatgcatcatactcctattctggtatgacttgctgagtacggtggtggtacttagtcttgctctattcccctccctaaaccccagagtttgagtacgtgtcagatgatggcttctccgaggtgtaggcttcgtccgtgccatcgaggatgcctgtggagtggtgttcccgctgcagtccaagtcaaggcttagctccagttatcctttaattttccgttgcatttatgtaaaacttttatgatgtttgtaagacgtggatctgtatgtcaactttgtcgtttgtgtaccccggccggtcctggacgggggttttaatgcacattctgcttggaattctattcggaaatttctgggcgtgacacgccgtccgtggggacgtccgagcgaaaccactgagagtgagcgaaaccactgatgccaccaaaggaaatcgttaaggagagagttgccaagtgaaaggaaggcaacagcgaaggggagatggctggcgaagagggagtagagccttcgacttttgaagccgaagttggagctgcgccacccccagcagcggcgccatctcttccaccttcagcactgacgaccttgacagatgcggatacgttgaaagcggcggccacgctccagttcagggacgtgatcctttcgcctcaagtaccgggggcacctcaagctgccgccttcacctagctagccacgacgtcaacagcaatcatcaccttgcaagctgacgccaatctcaaagctcaagccaatgcagacatgggggctatacgtcagaacatggctaaactgcgagacacacttcgccagatgcaagagcagcagcaagcatacggagcagcaagacaagccaaggccaacacgcaggagtttccgacgctctacgctcagccccaagtttttcccccacatgctgcaccagccccggcgtactacgccaagcccgtcccggccgtcgctgtacgaccgccataacatgtgatttcggcgccggttcgtccagcggcacaccaagcccagtacccgaagcccactcacactccacaagcaatgatggaggcagcttcgaccttacaagcacagtttcaagccttcttgcaacaactcaatcaaccccacaacaatataccaagagcttcgcctctggcccaggacgagcggagcccaagtcaggggtgcgctagccgggcagccgttgggctagttcatcatgccaagttgttgacgtaaaaacacaaggcctgggagatctgcttaactccagtgcaggtccaaaacttgcctttgggtgtatgagcgtgccagttgatttgatcctgcaatcaacaggaaacaaagacaaagaaaccgcggttaaatccataaacgatagccaatcggctaggtgccgatgacatatcatttacctttgagccgatgtcatatgtgcatcgatcggcaattattaataagtaagaaagaacaaaatctactcgatcggctgtagatgttaacgatatataatccttaggtcgatatatacttaaatcaagtgattgggatagatcggtcgccatgtcgagacagtataaatcacttagatcgaaatatatattaacaacaagaccatatatgttcgtagcatagccgatcagatagatctagcatgtagcggctaatgctccgatacgactctatattaagatattaaagtaagtaaaatataccaaacgaaagcctaatatacttaaatgctacaagatcttagcataaaaggtagaattaacatgtcaatcaagcacataagataaaagtagttaaattaggtaagatcggctgaaactccgatgctaccctaatcggcaaccaaaagcaggctagagattgagattctaatcacgattcataagatcaaactcaactgatgcagctataagtatgaaaagaaggacaatatctagacaatcaagccgttggatgtttcatagagtggtagatatcctatataatctaagtcaacatcggtatttaacctagtcggctgccttctattaacagacgttagccgattgtaggttagatggcgatattgccggagattatataagatatatgataactcgacgaattatagcaacaagattagagtatcatgaagatggaagcactaatcccgagaacgcaagccaccataacaagttttacctcttgttgaagatcgaaatcgatgcagctcaacccaaaagcaagaactcatcgaaacaaaatgaaagtaaaagggtggcgatgccccgagattgtattgaacgtgtgttagtttgattacatggggctcgaggtctatttatacccgagatttacaaaatatgtccacattggacacgactcttatctctaacaaactctaatataccataagtctttacggcagacttttgcccaaacatatctctaaggaaattacataaaatatcctaattaatagatataattgccttctcaggactacccatgcgtggcagtcatcatgaagcttattaactcaacccgacaatgtattcttcgtcatattgtcggattcggctcaataggctaaccctgtccaactcggactttgctgatcctgatcacagctgattcggacttcagccgattcttactctatttccgaaacaatcttggatttagattccgcttcaatctgatctctatctttgatactcagattaccaaatttggtcgttaacacatgcccaccaagtccagaatattggataatgtttcgaatttgccatacgtcgactccgagagaaatccgcacttgccgttttccgaccgttacacagtgctttaaatactaaccgttgtccccgagatatctcacacagtttcctccattttcaccgccgaagccaattccgtcctctctctctccggcaatcccctcggtgcgcaaggcgatttcctctccggccaactttccgcccacggcgatgtcgacctctcccagcccgtccgccgcatcatcagccgagtacgcagaggtaagttctcatcggctagatcctcttctttcgtatcggattggttttccctttccatatcttgttttcttcttctctgttcttttggatccgtagcatctctccaacctgatcgcagttccgagcctatctgacgagaaccattactttctcggcccagtcggcaaccttgatcctactgagttcatcattggcgaaaccaatagaattcctttcagattagccaacctagatctaggtcactggaagaataccttcaaatcatggccatctctcgagaaaacttcacccgagaagagctggattacatggtacaagcgcatgtcgtctaacaagaaagttcactgggacgaaattggaatcggccaagcgcttacccttaccatagccaattcagctaaagatgaacctttaatggccgccgccacctatttctggtccaataccatcaacgcttttctgttcaaccaagggccgatgactccaactttgattgacatcaccatgattaccggattagacgtaacttcattgcctaaccctgtgagtatgaacaccaagaaccaatttgatttcaggaccaaaagcataggtggttggtctggctatgtagcggcatacatgggcaaagggcctgtcactcctcggaaacatgtggctttcttgttgatgtggctagaaaagttccttttctgtggatccagttgatgtcctacaaccaactggcaatttgtagccgaagccctagaatcaaagaaacaatttcccttagacaaaattcttcttggctacctgtaccaagtgttaaataatgcatgggccaaaatagctatcggcttagtggtaggagcaggtggcccatggtggctgctgcagacttggctgaatctgatggtcatgaaagttgtcaatcggccatctgtgatagaagctgaattcctaagattagagccgatcatagaagacgatggagaggaacgcacccatcgcaaatgcacatcctatcgagggtatgcttccacactagccgacacaggggcaaagctatcagctgaactgcttaaggattggttctgcagtttttatgaaggctttcagaaagatgctccaatttggttcccttatgaggactcagcacttctagagctcccatcggactttagatttgaagacatcaaccacgagagatacgaaaagtccagagaagtcttctcggctgcaataagcccatgcatccttcctgtcggcattcatcaagggaggaatattcaagtctcttatgaattttatcatccgatgagttctgctagacagcttgggatgggtcagctaccaatcggcttgttctttgccgataaaattcaatgtcgaggggaaatttcatcaaccttaatgatggatcggttactcaatctcgaaggacctcctttgggcagtattgaaaatatagagctggcaaggttcaggagtaagaactttgacagatggtgggggtgaatggaaacaacatatcttccatcaaccagcttctatgtaaatgacagatctgttccccgatgttgttcctcaggtatatctttgctcttgtcaattctgtttgaacaattattagccgacttgaaacttgactaatttctcttctcgtcttgcagacaacagaatcctctccccctcgcaagagcaatagtggcatagatatcgaatacgctccaggtctcattcccaatggaggtgggtcatctccccctgtcatcaattgtcatgcccccaaaacttcaagtatgctccaagggctcattagagaactagctgatgccggtaaaaagagaaaaaccagagcatcggctatagacccattggctccggctccaaataagaaagccaagtcaaataagaccaagccaaccgatgatctgtctgccgtagatccatccattgaacaagctctggatgaagaggatattggagaagatgttgatcaagctgaagctgggataagcggtactgaaaaaacaccatcggcttcacctaaacaaactcctccgactccttctgctccagttcatttttccagggtaaacaactctccttgatttctttttgcaaccatttcatttatagccgattgcttatagattttataattgcagaaaaagaaaactactatgagaaagaaatcggtagcaacaactctcaaactggctccaccagtaagatgttcttaaatctttcactagttgatcatcgccgatcttgtctaacaattgtctcttttcagcctcctcctccttctccccatgtacagctatcatcaagtgaccaaactccatcggctatcatcagctagaagcatcatctctagacagtttggtagtagactgtggatcaattaggactcggctacataaagttcaagctttgatcccggaagaacatgccgacgtcctcactccagctgcttatcttgaacaatatcaattcaaactggagaaggccaagctgagattagccgaacgtcgggagcgcagggatattgaagccacaatccaggccaatcggcaactcgtgcatgaagagaagtccaagcttgatcagctatctgagggcccgatcaagtctaatattgatcagcttgaagctcgtaagattgagctcttggcacaactccaagaatgcaatgctgatatgaccaagtccctaaaagtcatctctggaaccgatgctcaagatacccaagctattgaagaagtagaacacattaggcaaagagctatatcggcgatctagcgctacttgtctcagtgatattctataataggatgtagtaaatttttgtaatcggctaagatactctggcacttgtagttaacttgtcttgatttatgccgattaatataactccatgtttttgctcaagaatttgctcaaaaattttgcaacttttgcatatatatgtgcccccctaattttacaatgtcgaaggcattgatgaaattatatcttgaactaagggcaatataacaatatcggccatttgtacatcggcaaaccacaaccgattacaataggaaaataactaagggcgatataaccatatcggccatcccaaggcaatgcaaacacatcggctattatgtatcagtagtaccagccgatcatgcattaacccaaacacttgggtaatatttcttcaagtattttccattgagcgctcgtccataaacttctccatcgagtccttgcaacatataacctcctttagacacaactttatagatttgaaacggtccttcccaattcggcgactacttgccgaatttgctatcccgagtgccaatcggcaaaatcaatttccatacaagttctacctccgaaaaagacttggctaccactttcttgttgtaatgtcgagcaacccgttccttatccttagcaacttttgcaagggctctgaatctagattgaaccaagtcttccctctcatcggccataagattataatactcatcggctgtcaaatcattttgcaactccgttcttcttgagccgattctaacttctcatggcaaaacaacctcatgtccataaacaagtttataaggagggacttgaatcgatccatgacaagccatccaataggaccataatgcttcggccaatcgagtatgccactgccgaggataatcggaaatctctctcttaatcaatttgatcaaactcttgttagacgcctcggcttgcccattagcttgtgcataataaggtgagaattcaacaattttatccccatgctaccggcaaactgaacaaactcatcggacacgaagattgacccttgatcggttgtaatagtttgaggaataccaaatcgataaattatatactcttgaataaattgtatagcatatccagaatcaactttctttagaggaatcgcctctacccacttggtaaaataatcggttgccaccaatataaactatcaatgtatcatttttgcactcatactctcctgccaactgactgatcaccagtaaagaatcccccataatttcaatagtatcggcttcaacttccttgagtaattgtaaccctttgagaactgcctcatactcagcttgattattggttgcataaggcttaatagtataggcaaactcaaaacttgccccccgaggaaaaattataaccaagcctataccacaaccatgagtgcacactgatccatcaaagaacaaagaccatggcacaacctcaaccgagccgattgaatcatcacgatgatcaacgatcaaattctgttaaggaaaatatccactttccaacttttccttttaaaatcggagccgataacatgtacttaacgacatcggctttgcatatgacagtgcattcgttggacaatatataatgccttaacattgtacaggaaaaatacaagcacaaacacaacttctccacaggggaatatctcgtctctgcatccaagagccgacgacttaaataaaatacaactctttctttcccttcaagctcctgaatcaagactgagccgattgacttctcaccagctgatagatataatctaaaaggtaatcccttttgtggaggaatcaaaactggaggagagctaagatattccttaatactatccaaagccttctgttgcactgcctcccaagtaaacttttggtcggctttcaatcttaacaatggtgtaaaaggctctaaccttccagacaaattagaaataaaccttctaacaaaatttatcttgccgatcatctcctgcaattccgtctattttctggagactgaattttcttgatcgcattaacactcctttgagttatctcaatccccctctcatgaacaagaaatcccaaaaactggccagccgatacaccgaaagcacactttgttgggttcatcttcaagccatatttcctagtcctctcaaaaaccttccttaaatcggctatgtggtcctctatctctttagacttaacaaccacatcatcaatgtagacctcaaccaaccagccgatcggatcatggtatatgtaattcatggcccattgatatgtagctccagcacttttcaagccgaaagtcatcgtaacccattcaaacaagtcgattgcaccaggacacctaaaagctgtcttatgtatatcttcttcagccatgaagatctgattgtatcctgcatttccatccataaaactcaatatcttgtgccctgaagcagcatcaaccagctgatcggctactgcattggatactcgtcctttggggtagctttgtttaaatccctgaaatcaacacacaccctgactttgccgtttttcttgataactggaattatactagaaacccacttggcatatcgacaaggacgaatgaaaccagcatcatataaacgtttaatcttagccttgacaggttcgagcatgtcggctttgcatcttctcggaggttgttggtgcggcctaaaccccggtttgataggtagccgatgttcaacaatcgatcggctgagccctgacatctcataatactcccaatcaacacaatctctgaattccttcaagagctctatcaacttggttctaaattctagagataagttcttactgataaatgtcggcctcgatcgatcacctggacctatgtcaatttcttccaaataatcggctgacatgaaaccctgtccttgcttgtcatcgagatcatctactgtgtccttggtgtagacgtttgaaccctccacaacgccctcaaaataataacttgggctctccatcttcaattggttgtatatcacaatcggacacatttagaaaatctccttcccaaacctttccagacaagcaatctaggccatccatctcccaaagagctaaatcagcactggcaacgttaactgacctgtcggctggtacaatttctatcttgtcgacttgccattgaatcaagcattgattcatggttgaaggaatacaacaattggcatgaatccaatctcttccaagcaacaagctgtaggaacccttcccatcgatgacaaaaaacgttgtagggatagtcttgctgccgactgttagctctacattcaaaactcctttggtttcggatggattgccaccaaagtctttgagcaccatgtttgtcttgatgagatcctcagcattcctgcccagcttcctaaacgtggcataaggcatcaaattcaccacggccccaccatcgaccatcatcttagacatcggcttcccattgacataaccgtttacataaaatggcttgagataccaattctctgtcccttttggcttctcaaaaactgcttgttctggtgataaaaccaacttagccgatgcttcctcaacctcatcaacatcggcttgtttgactccaaattctgcaggcagtgtgaaaaccatgttaaccgatgcagttacaacactattccctttagccaatctttttgcttcatcggctgtggcttcatcggctgtaggaacttgattcttaacgcgccactcctgctgcggcttcgttttcttcagccgatggttgatttcttgctcaacctcttccctgttcctcaacctttgaacccttctcttctgattctttgtaaaaataccagaaggacaccattaagtcttcctaccttcattgtcctcttggtcacgatcttgatttactgggcccaacctttgatgaacaggaacccttgcttgccttagccaattgcctttattatatgatcggcttgaacttcctgcaatattgctgtacctaggacaatcctcattggatggcagcctcataccttcattccaacagaatctaaagaactcacaaccccaatgaggatcaagaccgctatcatcttcctcataatacttttcctgatgctaatcatatttcctctgatacttattgataatcatagccgagttcatttgaaaacctcgagcttttcctccatcggctgttcgaccagctgtatgtaccatattgacaggaaaaggattgccatcaaccttcatcggcttattggaatcatcaaacttgattttgcctccctcaatagccgcctggatctgctgtctaaagactttacaatcattggtagaatgagatccagaattatgccacttgcaatatctcctcttgcctagctcctcagccgatggaattgtatgaccagcaggaagttgaatatgtttttcccgaagtaacaaatcaaagatcttatcagccttggtgatgtcaaagtcatacctctcttcttttccagaactcttcacccattggcatggtataaccttcttgctcctaacccacttggctgctgctacctcggaatcatcatcatcatcatcagatccatatatgtaggtaaccttttgtgcaagatgtgacaaactatcaaagtcctgngatgagaatttctccctgattggagctatcataccctaaaaagccaaatctgctaacatcagtcaagcttaagttgtagcacttattcctcatctctctaaacctctgaatgtagtcttgcacaggctcatcatgcctttgcctaatcgctgttaaatcagacaatttcatctcatgaaccccactataaaaatagctatgaaattcttctccaaatcggtcaactgttgattgatccatatggcaaagaagaaaaccaagtaaaagccgatccagacaaagactagggagacaacctaaccctcaaggcgtcgacagtcgatgctttaccacactgagctaagaatcggctagcatgttcataggttgagacactgtcttgccctgagaattttgaaaaatccggaaccttgaaccggctaggcaatggaaccctctcaaaccactcaggatatcgatgccgatacaagtttccagtgtcttttggcttgatcccaaattgctctctcatcacatctgcaatcatatcggcccatggttcctattgaggcaccccctgcacttgctgtggcacaggctcgaacgagttgtactgataagcgaattgaggctgagtcgatcctccttgttgatactgaacttgcggcgatggaggctgatactggtaattcaaattgcccccgtgataattctgaaagtttggctgtatattgcgcaccaaatgttcgggaataacttgaggtatcaccgattgatctggttgcacattatgaaccaaatgctctgggacaacttgatttgcagcgtgctgcctcggctgattgtcgggcgtcctgaacccagccgatgcatttaggaaaccttgctgctgaatcggctgagcaacttgctgcctcggtggcgtctgctgaatcggctgctgttgaactgggtcagcagtaggctgagttggtaaaaacatagctgcaacttgctcttgagttagccgattcacattttgtccactatgctgagactgctctctcaccaacaaccgaggattgattagttgacctggtgccgatgatggtccagcaggtgcaggagccgatactggtgctgttggctgagctgatggcacattgggagcaatcggttgagcagtcggttgattattagtgatcaagggccgatagtttgggaaaatacctcctggcaaataaaccggtcctgtagcctgatactcagctattgagccatcaaccatcgacttcaccatgtttgacaaggtattgactagtaccccagactgattcttggaagttgttaaattgtatatgtgcagtgttaccatctgggctgagatcctcatctttcactccctgagaacaatcacccttatcacctgagccatctgcagcacttttatcacctaattgagctgtagcatctgaaacctgttctacctccccatccttggaagaacttgtcctaggaacatcagcaactaatttcatcttatacctctaaacaattgttccttggcgggtctccatgaatgagttcaagaattggttctgtgtttctgcatcatcgcctcgagattattcttttgttcaagtgtcaatttgtctatagtgacgggcacgatgttgctttcatgaacttcggacccaccaagcttcgggatcctagatttgggaggaccctcttttgccagccgaagatggcgatgctggtggtttcttagcgatgagagaatgctattgcggttctgacttctaatctctcccactgggcgtgccaaaagcgtgttgacataaaaacatgaggcctgggagatctgcttaactccagttataaggttatgtctaagggagcatatatgttgcaagggcttgatggtgaagtctatgggcaagcgctcaatggcaagtatttgaagaaatattacccaagtgtttgagttaacgcatgatcggctagtattgccgatgcatgacagccgatgtgtttgcatcgccttgagatggccgatatggttatatcgcccttagttgtttttcatggtgtaatcggttgtggtttgccgatgtacaatggccgatatggttatattgcccatagttgtttttcatggtgtaatcggttgtggtttgccgatgtacaatggccgatattgttatatcgcccttcgttgttttataattttatcaatgcttttgtcattgtaaaattaggggggcacatatatatcaaaagcgtgttgacagaaaacacgaggcctgggagatctgcttaactctagtgcaggtccaaatctcgccttcgaatgtatgagcgtgccagttgatttgatcctgtaatcaacaagaaatagaagcaaagaaaccgcagttaaatctataaatgtagccgattggctaggtgccgatgatatatcatttatctttgagccgatgtcatatatgcatcgatcggtagtcattaataaataagaagggactaaatctactcgattggctgtagatattaacaatatataatcattattttgatatatacttaaatcaagtgattgggatagatcgatcgccatgccgagacaatataaatcacttagatcgaaatatatattaataatgagtctatatacgttcatagcataaccgatcagatagatctagcatgtatcggctaatactccgataccactctatattaagatatgaaagcaagtagaatatactaaacaaaagcctaatatactaaaatgcagcaagatcttaacgtaaagggcagatttaacatgtcaatcaagcatataggataaaaagtagttaaatcaggtaagatcggctgaaactccgatactaccctaatcagcaaccaaggagcgggctagagattgagattctaatcacgactcataagatcaaacttaactgatgcagctataagtatgaaaagaagaacaatgtctagacaatcaagccgttggatgtgtcatagagtggtagatatcctatataatctaagtcaacatcagtatttaacctaatcggctgccttctattgacggatgttagccgattgtaggttagatatcgatattgccaaggattatgtaggatatatgataactcgacgaattacataaacaagattagagtgtcataaagatggaagcactaatcctgagaactcaagccgccataacaagttttacctcttgttgaagatcgaaaccgatgcagctcaaccagaaagcaagaactcgtcgaaataaaactaaagcaaaaaggtggcgatgcgccgagattgtattgaacgtgtatgttaaaagttacatagggttcgggtctatttatacccgaaaatcacaagatatgtccataacggatacaactactatctctaacaaactctaagataccataagtctttgcggcagacttttgcccaagcatatctccaaggagattacataaatcatcctaattaatagatacaattgccttctcaggctctatccatgtgcggcaatcaccttaaagcgccttaattcaacccgatatcatacatcagtatgcattgtcggaatcggctgcattggcttacctagctcgactcagacccagccgatctggactccagccgattcctgttctgtttctgaactcgatctccgcctccgactttgtttcgatctaatcttctttcccaatgccgatattaccaaatttggttgttaacacatgccccccaagtccggaatatttgataatttttcggatttgctgtaaatcgactctgagcaagtttcgcactttgccgttttccgaccattactgccgtgctttaaatactaaccattaccttcgagaaatctcacaccgtcctcctccgttttcaccgctgaaaccaactttgccctctttcgctccggcgatctccccaatgcacaaggcgatccctaggcgatttcgttcccgactagatctccgctcggggcgatgtcgtcttccaccagcccttctaatgcaccatcgggcaagtacgctgaggtaagtcctcaccagctagatcccttttcctctcatgaaattgatttctccttttcttctcatgttttccgcatcccgattcctttggatttgcagcacctttccaacctagtcgcgattcctagcctttcacacaaaaaccactattttcttggcccattcggcaatctcgaccccactgatttcatcatcggtgaaaccaatcggatcccctttcgactagccaaccctaacctgggtcactggaagaatacattcaagtcttggccatctctcgaaaaacctactcctgataagagctggaccacctagtaccgacgcgtatcggctagtaagaaagttcactgggataaaattggaatcggccaagcagtcgctctcaccatagcaaattctgctaaggatgaacctctgatggctgccgccacctacttctggtccaacaccatcaatgctttcttattcaaccaaaggccattgactccaactttaatcgacatcaccatgattactggattagatgtaacttcatcggctaaccctatgagtatgaacaccaagaaccaattggacttcaagaccaaaagcataggtggctggtctggctatgtggcggcatatatgggccaagggtctgttacccctcgagagcatgtagctttcttgttcatgtggctggaaaagttcctcttctgtggatccagttgtggccctacaaccaactagcaatctgtagccgtagccttagaatcaaagaaagaatttcctttgggcaaaaatccttctgggctatgtgtaccagatgatgaacaatgcatcggctaaaatagccgttggctcaatagttggagcaggtggaccatggtggctgctgcaaacttggttaaacctgatagtcatgaacattgtcaatcgaccctctgtgacagaagctgaattcccattgccagagccgattgtggaagatgacggagaagagcgcacccatcgcagatgcatgtcatatggagaatatgcatccacatcaaccgatgctggagcgaagctatcggctgagctacaaaaggactggttctgcagcttctacgaaggttttaagaaagatgcacgaatctggtttccttatgaagactcagcagaccttgaacttccatcagactttagatttgaagacattaatcatcgaaaattccaaaaatccagagaaattcctatagctgcaatcagcccatgcatcctcccagtcggcattcaccaagggagaaacatccaagtctcctacgagttttatcacccaatgagcttggccagacgacttggattgggtcaactcccaatcggcttattctttgccgacaatattcagtgccgaggacaaatcgcatccactctaatgatggatcggctacttaacctaccaggaccccctctgggcagtattgataatattgagttggcaggatttagaagcaaaaattttgacagatggtggggtgaatggaagctgcatctatttcatcaatcggctgcaatgtatatgatagatctattcaataacgtcataccccaggtaaactttgtcattactaaattgcataaccagttagccgattcattacttgactaatctcttgctcctgttttgcaaacaacagagtcctcccctccacatcaaagtaatagtagcaagaacattgaatatgcttcaggtttaattctgaatggaggtggactatctcccactctccttcacggcctaactagggaaccagccgatgcaggcaagaaaaggaaaactagatcatcagccatgagtaacttagccttggctccaaagaaaaagaccaaattcaagaaaactcaaccacaaccaactgatatgtcgactgatgatctgcccgccttggatccatctattaaacaagctttagatgaagaagaaattggtgaagatgttgaccaagctgtagccaaaatgagtgacacagaaagaacaccatcggcttcacccaagcaaacgcctccaactccttctgcccccgttcattttacatgagtaagtacctctctttgacttcttctgaaattacctccctctttggctaattacccatagactttgtggttgcagaagaagaaaactgctgtgaagaaaaaaccagcagcaacaattgttaaatcggctccaccagtaagatgtccttaattcttttacttaaacaatctcaaccgattctatataacacttgtctatttcgcagcttcctcctccttctcctcctgtacagcaatcgtcaagtaatcagactccatcggctgtggggagtcatcacgtcgaagaggaagaacaaccagctgcttctgctatcccagtaagtttccctttgtctcaacaattagatcagctataatttacccagctcttattctttccgaaattgcctctgcaggctctagccgatctcttctcttttgacatcagagattaccttgatgaggcagaagaagacacttcaagcaaagcccaagctcccctatccgatgatgtgagaaaaacacttgaagacatcgctcatcggctagaagcctcttctttagacagtttggtagttgactgtgggtcaattaggacgcggctgcatgaagttcaagctctgattcccgaagatctggccgatgtcctaactccagccgcttatctcgagcaacatcagttcaagctggaaaaagccaagctaagactagccgaacgccatgagcgcaaagagattaaggccataatccaagcgaattggcagcttgtgcatgaagaaaaaaccaaacttgatcagctatctggaggtccaatcaaatccaatattgatcggctcgaagctcgcaagattgagctcttggcgcaacttgaagaatgcaatgccgagctagatatggaacacagaaatctagccgatctcccaaaatcaattgaagaacaaaaagcaaggctcaaatcggctatcaaaaatgttgctgacctaaccaagtccctgaaagtcatctctggaactgatgctcaagatgcccaagctattgtagaagtagaacaaattaggcaaaggcctattttggctatccagcgatacttgtctcaataacttttgtgtaataggactcagaaattttttgtaatcagctaagatgctctagtactttactgtcctgaaattcctttgtgccgattaatatgactttgaaattcgctaaaaaattttgcctcaaaaaatttgcattgcattttgatatatatgtgcccccctaattttacaatgacaaaagcatggataaaattataaaacaactaagggcgatataacaatatcggaaattatacatcggcaaaccacaaccgattacactatgaaaaacaactaagggcgatataaccatatcggccatctcaaggtgatgcaaacacatcggctgtcatgcatcggcaatactagccgatcatgcgttaacccaaacacttgggtaatatttcttcaaatacttgccattgagcgctcgcccataaacttcaccatcaaacccatgcaacatatatgctcccttagacacaaccttataaatttggaacagtccttcccaattcggcgaccacttgccgaatttactatcacgagtaccaatcggcaaaatcaatttccatataagttctccttccgaaaaatctttaggtaccactttcttattaaaatgccgagcaatacgttccttatccttggtaacctttgcaagggctcgcaatcgtcactgaaccagatcctccctctcatcggccataaggttgtaatactcataagctgttaaatcattttgtaattccgttcttcgagagccgattctaacctcccatggcaaaacagcctcatgcgcataaagaagtttgtaaggagggacttggatcgatccatgacaagccatcctataagaccacaacgcttcggccaaccgagtatgccattgccgaggataattagaaattgtccgcttaatcaatttgatcaaacttttattagacacctcggcttgcccattagcttgtgcataatatggtgaaaaattcaataatttgatacccatgctatcggtaaactgaacaaactcgtcagacacgaagattgacccctgatcagttgtaatagtttgtagaataccaaatcagtagattatatgttcatgaacgaattgaattgcatccacagaatcaactttcttcaaaggaatcgcctccacccacttggtgaaacaatcagtcgccaccaatataaacttatgtcctttactcgatggtgggtttatcataccgatcatatcaattccccaacctctgaatggccatggcttaagaataggattcatagtcgatgccggagctcgctgaattgccccaaacttctgacaatcttgacaccccctataatatctgtaacaatcctccagcattcttggccaaaaataccctgcacgccgaagtaaccacttcatcttatgagccgattgatgagtaccaaaatttcttcatgaacttcgctgactgcaactttagcctgatcggcagtcaaacacttaagtaacactccatcaatcgtccgataataaagctcatcatccaacagagtatactttaatgccttatatctcaatttcctagaagccgattgagacggattatgcaaatactgatgcacatcatacctccaatcatcggctgtcattgctgcaatttcaaccttaacatctttgatcatgagcttataccctgatgccccttgggccaaatcattagcttcaatattttgttctcgagagacatgctttaaagtaaccagccgaaactccttcattagttgttggcacttctcattataaaccatcaatgtatcattcttgcattcatactctcctgccaattgactgattactagcaaagaatcccccatgatttcaatggtatcggcttcaacttccttgagtaattgcaaccctttgagcactgcctcatactcagcttgattattagtcgcatacggtttaatggtataagcaaactcgaaacatgccccctaggggaatttctgagccgatattatcaaaatgcaatgcaaattttttgaggcaaattttttgagcgaatttcaaagtcatattaatcggcacaaaggattgtcaagacagtaaagtactagagcatcttagctgattacaaaaaatttctaagtcctattacacaaaagttattgagacaagtatcataggatagccaaaatagccctttgcctaatttgttctacttctacaatagcatgggcatcttgagcatcagttccagagatgactttcagggacttggttaggtcagcaacatttttgatagccgatttgagccttgctttttgttcttcaattgattttggaagatcggctagctttttgtgttccatatctagctcggcattgcattcttcaagttgcgccaagagctcaatcttgcgagcttcgagccgatcaatattggatttgattggaccttcagatagctaatcaagtttggtttttttttcatgcacaagctgccgattagcttggattgtggcctcaatctctttgtgctcacggcgttcggctagtcttagcttggctttttccagcttgaactgatgttgctcgagataagcggctggagttaggacatcagccagatcttcgggaatcagagcttgaacttcatgcagccgcgtcctaattgacccacagtcaactaccaaactgtctaaagaagaggcttctagccgatgagcgatgtcttcaagtgtttttctcacatcatcggataggggagcttgggctttgcttgaagtgtcttcttctgcctcatcaaggtaatctctgatgtcaaaagagaagagatcggctagagcctgcagaggcaatttcggaaagaataagagctgggtaaattatagctgatctaattgttgagacaaagggaaacttactgggatagcagaagcagctggttgttcttcctcttcgacgtgatgactccccacagccgatggagtctgattacttgacgattgctgtacaggaggagaaggaggaggaggctgcgaaatagacaagtgttatatagaatcggttgagattgattaagtaaaggaattaaggacatcttactggtggagccgatttaacaattgttgctgctggttttttcttcacagtagttttcttcttctgcaaccacaaagtctatgggtaattagccaaagagagaggtacttacttatgtaaaataaacgggggcagaaggagttggaggcgtttgcttgggtaaagccgatagtgttctttctgtgtcactcattttggctacagcttggtcaacatcttcaccaatttcttcttcatctaaagcttgtttaatagatggatccaaggcgggcagatcatcagtcgacatatcagttggttgtggttgagttttcttgaatttggtctttttctttggagccaaggctaaggtactcatggctgatgatctggttttccttttcttgcctgcatcggctggttccctagttaggccgtgaaggaaagttgaagtcttgggggcatggtagccgataaaagggggagatagtccacctccattcagaattaaacctgaagcatattcaatgttcctgcaactattactttgatgaggaggggaggactctgttgtctgcaaaacaggagcaagagattagtcaagtaatgaatcggctaactagttatgcaatttggtaatgacaaagtttacctggggtatgacgtcagggaatagatctgtcatatacattgaagccgattgataaaatagatgcatcttccatttaccccaccatctgtcaaagtttttgcttctaaatcctgccaactcaatattatcaatactgcccagagggggtcctggtaggttaagtagccgatccatcattagagtggatgtgatttgtcctcggcactgaatcttgtcggcaaagaataagccgattgggagttggcccaatccaagtgggtgataaaactcgtaggagacttggatgtttctcccatggtgaatgccgacagagaagatgcatgggctgattgcagctataagaatttctctggatttttggaatttttcatgattaatgtcttcaaatctaaagtctgatggaagttcaaggtctgctgagtcttcataaggaaaccagattcgtgcatctttcttaaaaccttcgtagaagctgcagaaccagtccttgagtagctcagccgatagcttcgctccagcatcggttggtgtggatgcatattctccatatgacatgcatctgcgatgggtgcgctcttctccgtcatcttccacaatcggctctggcaatgggaattcagcttttgtcacagagggccgattgacaaccttcatgactatcaggtttaaccaagtttgcagtagccaccatggtccacctgctccaactattgagccgacggctattttagcagatgcattgttcaatatctggtacagatagccgagaaggattttgcccaaaggaaattctttctttgattctaaggcttcagctacagagtgccagttggttgtagggccacaactggatccacaaaagaggaacttttccagccacatcagcaagaaagctacatgctctcgaggggtaacagacccttggcccatatatgccgccacatagccagaccagccacctatgcttttggtcttcaagtcaaattggttcttggtgttcatactcataggtttagccgatgaagttacatctaatccagtaatcatggtgatgtcgattaaagttggagtcatcggcccttggttgaataagaaagcattgatggcgttggaccagaagtaggtggcggcagccatcagaggttcatccttagcagaattggctatggtgaaagcgagtgcttggccgattccaatttcatcccagtgaactttcttactagccgatacgcgttggtaccaggtggtctagctcttatcaggagtaggtttttcgagagatggccaagacttgaatgtattcttccagtaacccaggttagggttggctagtctaaaggggatccgattggtttcaccgatgatgaaatcagtggggttgagattgccgattgggccaagaaaatagtggtttttgtgtgaaaggctaggaatcgcgactaggttggaaaggtgctgcaaatccaaaggaatcgggatgcggaaaacatgaggagaaaaggagaaatcgatttcatgcgaggaaaagggatctagctggtgaggacttacctcagcgtaccggccgatggtgcagtagaagggctggtggaagacgacatcgccgcgggcggagatctggtcgggaacgaaattgcctagggatcgccttgtgcgtcggtgagatcgctggagagaaagagggcaaagttggtttcagcggtgaaaatggaggaggacggtgtgagatttctcgagggtaatggttagtatttaaagcacggcagtaacggtcggaaaacatcaaagtgcgaaacttgctcagagtcgatttacagcaaatccgaaacattatcaaatattccggacttggggggcatgtgttaacaacgaaattttgtaatatcggcattgggaaagaagattagatcgaagcatagttggaggcggagatcgagttcagaaatagagcaggaatcggctggagtccagatcggctacgattaggatcggctgggtctgagtcgggctaggtaagccgatgcagccgattttgacaatgcaacctgatgtatgatatcgggttgaattaaggcgcttcgaggtgattgccgcacatggatagagtcctgagaaggcaattgtatctattaattaggatgttttatgtaatctccttggagatatgcttgggcaaaagtctgccgtacagacttatggtatcttagagtttcttagagatagtagtcgtgtccgttatggacatatcttgtgatttttgggtataaatagacccgagtcctatgttacttttaacacacacgttcaatacaatcccggcgcaacgctacctttttgctttagttttatttcgacgagttcttgctttcgggttgagctgcatcggtttcgatcttcaacaagaggtaaaacttgttatggcggcttgcgttcttgggattagtgcttccatctttatgacactctaatcttgtttatgtatttcgtcgagttatcatatatcctacataatccttggcaatatcgatatctaacctacaatcggccaacatccgtcaatagaaggcagccgattaggttaaataccaatgttgacttagattatataggatatctaccactctatgacacatccaatggcttgattgtctagatattgtccttcttttcatacttatagctgcatcagttaagtttgatcttatgagtcgtgattataatctcaatctctagcccgcttcttggttgctgattagggtagtatcggagtttcagccgatcttacctgatttaactactttttatcctatatgcttgattgacatgttaaatctgccctttacgttaagatcttgctgcatttaagtatattaggcttttgtttagtatattctacttgctttaatatcttaatatagagtggtatcggagtattagccgatacatgctagatctatctgatcggttatgctatgaacgtatatagtctcattattaatatatatttcgatctaagtgatttattctgtctcggcatggcgaccgatctatcccaatcacttgatttaagtatatatcgatataatgattatatattgttaatatctacagccaatcgagtagatttagtcccttcttatttattaatgactgccgatcgatgcatatatgacatcggctcaaagataaatgatatgtcatcggcacctagccgatcggctatcatttatagatttaactgcggtttctttgcttctatttcttgttgattacaggatcaaatcaactggcacgctcatacattcgaaggcgagctttggaccagcactggatttaagcagatctcccaggcctcgtgttttctgtcaacatgcttttgatatatatgtgcccccctaattttacaatgacaaaaacattgataaaattataaaacaactaagggtgatataacaatatcggctattgtacatcggcaaatgtcacgaccggaaataacccaacgggcgttccttatgtgtgtgcattattccttgtcccaggaggcaaggtacaccaaaagttgatacaattcagagtttgacaagcggaagcgtacatagttaatttattacatgggcagcgaaggcccagcacacaagaagacaaacgaaaaacagcggaagactagggcgacgaccacaggcgcttgacggcaggcacgagctagacacaaaagcctttatcttccaggggctcctcttctgggtttgggaaaaattgagcaagactgagtacaaccaccgtactcaacaagacaaaaccacaagtgcagaataaatgcaagggagtacaagggagccataatatagggggttagggtttgcagtaaactacactaaaagacacttagttgctcaaagctattttgtaaacacggtcctagagctatacaatattattaatcaaggccgtgaacccacacgaacctgccttaacccaaggcctacgatgattcagaccgaactggcaacccgaccctgggtcccagctcatcccaagccaacccaggccaaccattccacattttagttgttaagcaggttttaagaattaaaaacactaacttgggtacattgctcggcttgcccataaccgagggcgcggctattcgaataggttatactctaatcagaggtgtacatctttacccacaagacacatcttcctcacgtgtaaccacgtgccacataccaccatggtatacggacggaagacgtgacatagtttccaacccatcctagccatagacaagagtaccgacccaaccccacctacggccggaacccccgggacaggtaggcaggactaagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaagagaggcccgaagaccggtccttatatggccgaggtgctactatcaaaaccatgcaccccgagcccagcctaaaaccattttgagggttttgaatagaggggaggtgtgaatccaattccacaatgatccaacaattccatagtgtccaggtgatgagaatactcccaaagtctagagttgtaaaaccacctaatgttgcctaattaaccagcgaagcatctacctaaaagcatactagtggtaccatgagtagagtgtccactagttggggtttggtttaatctagggtgaacaaggtaataataacaataacaataataaggtcataacaaaggtaaataggcatggctagataaaacagtgataacgcgtgaatttaagtaaagcgataatgcaataatttaaatcaaaataattttataaactaggattcaatatgctcaaggatgatgtgacttgccttgctcgctttcccaaacgtcggcttcaacctccacgaagagcggatcttccgaagctgcagcatctacacgaccaacgaaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaaggggtttattgcgtcagccaagggggaggggacgcgcggaccgggtccacgggagtggggcccacgcggcagcctcacggcccacagtggaccgggcgcacctgggctcgcaccagccggcgccgtgggtcccacgtgtcagccgcacccaagggcgcgggcggctgacggccgggccccacgcggcagccactcggcgcgcacgagggcggccacgctggcgcggtcggcgggaggcggcgcgcccgcgccccgatggtcgccgccggcgaccaccggcacggcggagcggcggccgagagaggggagggaagggggaaaggaggcgacggtccacggctcaccctaggtcgacggcggcgacggaggaggcggccggagtggagggaggcggcggcgcggctcgggtcgatggcgtcggcggcgctccggtggttggcgaccgaaacggagaggtgaacgaggttggcgaggatgcggtgaacccgaaggaggcggcgccgaggtgggaggcggtccggggagacgacggcggcggaccgaagctcggcggcgacggcggagagagagagtgacgtcgcgagctcaaatccggcgaggaggaagggcggcgagaggcagaaacggacgaaggaggtgcggggagggtttaaatagggttggaagagggagagagtggccggaggggaaggaaaccggcgtggcgctctcgggctccatcaatggcgccggcgggattaggggagggtttccaaacgaatccaagggagagagggatgcaaaattgggtggaatgggagaggggatcacggggagtgattccccccactttattgcacgcggggacggcgggaggcggcgggattcgcggcggcggcggcgctagggtgcgggggaggcggcgggagcggtgggagaaaggggatgacgggtgggccccacccgtcagcgagggtggcgggcgggcctgcccgtcagcggcgcgcgcgcagggagaggccgagtgggccgcggggagaggagagagagggggagggagatgggccgaattcggcccattagggtttttctttttataaaatcattttaactttgtttatttcttaataattattatttgtgctctgagaattccactaaaatttatttacacattttaggcttttaggaaatatacaaaaatcctctaagccttaattgacttttaggaaatttatttacacgttttgggacgtgacaaacctacccccgttaaacggaatctcgaccccgagattcggaagaactggcgaagagatcgggatgggctgactttagctcgtcttcacgttcccaagtagcttcttccttggcgtggttgctccattggaccttgcaaaaacggattacccggttcttggtcctgcgctccatggtgtccaagattttcactggtctctccacgtaggtcaagtcttcgcgaacttcaatttgctctgagtcggcctgctcggatggcactcgaagacatttcttgagttgcgacacatggaacacatcatgcacgttgcccaatgatgcgggcagctccaactggtaagcgacttctccgcgtcgagcaatgatacggaaaggacccacgaaccgaggtgcgagcttccctttcgtctgaaaccgacgtacgcctcgcaacggcgtgacccgaagatagacaaagtcatccactgcgaattccaggtcacggcgtcggttgtctgcataactcttctaccgagactgggccaactttagattctcccgaatggttctgactttcgcttcagcttctctcaagttatcagtcccgaacacttggctttccccaacttggtcccacaatagcggtgtccagcatttgcgtccatacaacgcttcatagggtgccatttgtatgctggcttggtagctgttattgtaggagaactcggcataggggagactcttatcccaggtcttcccgaaatctagaacacaagcacggagcatatcttctaggatcttatttagacgctcggtctgtccatctgtctgcgggtgatacgcggtgctgaaatttaatcgggtacccaactcttcttggagtttcttccaaaagtgagaggtgaactggtttccccgatcagatacaattttcttaggaacgccatggagactcacgatcctagcgaagtagagttcggctagtttgttccctccataggtggtcttcacaggaataaaccgagctaccttggttagtcggtccacaacaacccatatagaatcatatcctccttgggtttttggaagtccggtgatgaaatccatcccaatttcatcccatttccattctggtacttggagaggttggagaagtccggccggtcgctggtgctctgccttgacacactggcacacatcacaaagggccatgaactctgcaatttcccgcttcatactaacccaccagtatttccctttcaagtctaagtacatcttcgtactgctagggtggatggaataaggactttcgtgagcttcctgaagtatcaggtgtttaagttccttgtcgtccggaacgcatacacgatttccgttccatagggttccatgttcatcttctatgaaaccagcggctttacattgtttcatatttttgaggatcccatgcatatctggatcattcttctgagcctcacggattcgatcgagcaaggtaggcttggcttccagcgtagccaagaatccacgaccaactatgcttaggttcagggcatccatctgttgattaagttccggtggaatgccacggacgccaagagtgttgcaatggctttttcgacttagagcgtcggcgaccacgttggccttaccaggatgatagtggattcccacatcataatccttgatgagttctaaccatcttctctgccgaagattcagatccgactgagtgaagatgtatttcaaactcttatgatcagtacatatttcacagcaattcccaatgagatagtgccgccagatctttagagcatgaaccacagcggctaactccaaatcatgggtagggtagttgccttcatgaggccgaagctggcgtgtggcataggctaccacatgaccttcctgcattaatacgcaccccaatccttggcgcgaagcgtcacagtacaccaggaagtccttacgagtatccggtaagatcaacactggcgaggaaaccagcttttctttgagagtttggaacgctttctcgcattgtgggctccacacaaatttttcttctttcttcagcaactatgtcatgggtcgagcgattttggagaagttctcgatgaatcttcggtagtacccggccaaacccaaaaagctgcggacttgagtgactgtcttgggtcgcttccaatcagtgacggcggtcactgttttggggtccacagcaactcctttagcagatatcacgtgccctaagaatttgacttcggacaaccagaactcacacttgctaagcttggcatacaattgatgttcccgcaactttcccaacaccaaacggagatctctgattgcgagtacaccaggatgtcgtcgatgaagaccacaacaaacttatccaagtattccatgaacactttgttcactaaattcatgaagaaggcaggagcattagtcagaccgaacgacatcaccgtgaattcatacagcccatatcgcgtggtgaacgcggccttcgggatatcttcttcacgaataagcaattggtgatatccggagcgaagatcgatttttgaaaagacagtggcacctttaagctgatcgaacagatcatcgatccggggaagagggtacttgtttttgatagtaacttcattgagagctctgtagtcaacacacatcctctttgtcttgtccttcttttccacaaaaatcacgggagcaccctagggggaagtgctcggccgtatgtaccccttttcttttaactcttccaacagtttcttgacttcggccagttcatttgctgccatacggtagggtcgcttgtacagaggagtggttcctggagcaagatctatccggaacttaatctctcgcttgggcggcataccgggtagttcttccggaaacacatctccgaactcactgacgatcgggatttttgacagtcctatctgatgaagttcggaactgccgacagaggttgggggtgcaaagaaaacaaccggttgttccggccctcggtacagagtgacagtgcgtcttgcacaatccattactccttggaattgagccaatcaattcatcccaaggatcacatccaagttcttggtgtctagaagaatcagatccgagggaaaaggaattccctggatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacatcctcggcagtcacgtggttcacccgaccccgaatgacatccttaccaccgttgttggggcggggaggcgcttggccttgctggcgcctcggctttgggtatttatccgcaaagtgcccgggctcgaagcagttgaagcacagacgctgctgaccttgaacgtttctgcggccttgtccaggctgcacggctgacgtaggagaacggggtgcatgggtcccttgctgactctgctgctgctgcggctgtgggacgcgcaccacgaattgaggttggggcgcggagcgaggttgctgctgctgttgctgctgctgcgaggaggatccccctggatagggattggtgtagcggatcctttggttagccccctgttggttgcggaaattcgccaggcgacgcttctgcgactccagttccttgtgtttggcttccaagcggatgctcttgtccaccaaacgctggaaattcggatagtccccggagactagacgcacggacagctcagggtccattcctgctaagaacttctcctgcttttcctcatcttcacgaacatcctccggggcgtaccgggccaggttgttaaactcatgcaaatactctatcacagagcagttgccttgcttcaactctcggaattcccttttctgaagggccatgacttcggcgggcacatgggtcctctggaaagcggcggtgaagcgggcccaagtaataggctgcccctctagctgcgtagcctgaaagtggtcccaccatagagatgcgggcccctgcagttggtgagcggcaaagatgactttctcctcatcgttgcactgcacggtgtctaactttttccccacggcatgcaaccaatccaaagcatccacggggttattggagctagagaaggtaggtggacggatgcggaggaactctgcgagtttagaatgttgcgggggtggtggtggaggtggagcattatgttgtgacggattttggatgtgatggaggaaggcagccatcatgttggcctgctgggcgaagatttgggtgagaatggagttggtgtctggtggtggtggtggaggcgggggaggaggtggaggtgggctgccatggttgttgtggttgctaccttcgggttggttgccatcaccggtagtagcacttctcctggttgtcaccatctgaaaatcccacacagacccggcaaacagagagagctgactattaaaactaatcacccacgactaccataattcttgaatttattactgctattaagttggttcactaaggttcaggttgcttaagcaaataaaataaagacaggctccgacacagttataccacacaccggtataaccatgccccacacgactcaagcagaaaaaccaacgagaagaacatacgcgcaagcctactaactgctcgtctacttctgtgacgggccagggcggaaggtgagcaacaacacatcctccgtgctaccaacgctagaggctccctcctcctgaggaaccaagggcgcgggcccggcacgaggggtctcgacgaagcaggtccacgccagggactgacgaaccagctcgggcctagaggtactcttgcgggcagtgatcttcaggctgcggcagacgcgacggcgcttggggcgacagacctctccctgggcgatcttgagctgacacagctgcgcctccactgcgtctaggtccttcttcagctgcagattctcctgtcgtagctccaggatcttcatgttgttctcgaccaacccacgacgcaccatctgatggaagtcgatacgagccgcgtcgtacgcctccaccatgcgcgccaggtgcatgatggtagcgtcatcctccgagctagcatccctgaaggtggcgtagtcacgggctcctccgcgacgagggcggtagtggtagggcgagtgctgcaactcgtccgggtagcgctggtgaagagtgccgatggtgaggagagcggcgttctggcaagcggcggagaaagaatctccacccgcggtgactgccaacgaagtcctctcgggtgagccagtgagaatcactgcagtgacctcccaagcagcgtggggctctgcatcgtcaccctcctattccgggagctgcttgccctggtagtccactccatgcagataccccaagacaacgcacatgccccgcagctccaaaacgaagccagtcaggtccagaccacgacggttgatgctgccggccatctacaaacaaaaaacaaaagagaaaagcaacattttaaagattagattatggtgataaatgaagtagcaggacagagagagactagaggattttcacaaataaaaaaggatttttatttcgaaaatattgctaaggcttgggatctaaggctcgttctagggtcaagggggctctgataccaacttgtcacgaccagaaataacccaacgggcgttccttacgtgcgtgcattattccttgtcccaggaggcaaggtacaccaaaagttgatacaattcagagtttaacaagcggaagcgtaaatagttaatttattacatgggcggcgaaggcccagcacacaagaagacgaacgaaaaacagcggaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagtgcagaataaatgcaagagagtacaagggagccataatatagggggttagggtttgcagtaaatagcactaaaagacacttagttgctcaaagctattttgtaaacacggtcctagagctatacaatattattaatcaagaccgtaaacccacacgaacctgccttaacccaaggcctatgaggattcagaccgaactggcaacccgaccctgggtcccagctcatcccaatccaacccaggctaaccattccacattttagttgttaagcaggttttaagaattaaaaacaataacttgggtacattgctcagcttgcccataaccgagggcacggctattcggatagattatactctgatcagaggtgtacaactttacccacaagacacatcttcctcacgtgtaaccacatgccacataccaccacggtatatggacggaagacgtgacatagtttccaacctatcctagccatagacaatagtaccgacccaaccccacctacggccggaacccccgggacaggtaggcaggactgagcccctagcagcaggacaccggtcctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgagggttttgaatagagagaaggtgtgaatccaattccacaatgatccaacaattccatagtgtccaggtgatgagaatattcccaaagtctagagttgtaaaaccacctaatgttgcctaattaaccagcgaagcatctacctaaaatcatactagtggtaccatgagtagagtgtccactagttggggtttggtttaatctagggtgaacaaggtaataataacaataacaataataaggtcataacaaaggtaaataggcatggctagataaaacagtgataacgcgggaatttaagtaaagcgataatgcaataatttaaatcaaaataattttataaactgggattcaatatgctcaaggatgatgtgacttgccttgctcagagacaacggccttccgaaccttcggcgacgaccgcgaaccacgcttcgggaacctcaggaacgacagaagctacgcgaagcacacaagcaaagctacaaacctataaagaagcaataacaatacataaaaagaaagcacagggttctttaggttataacaaacgttaagagacttgaacgggtcgattcggagcttgtatgaccaagacatggttatccgaaatttaatgctgttatatggtgatttgcggattattgtaattatgttttacaactataaaacatgagcaagcgctagcctggaaaagacaggaaggctgcgccgttgacatgcggaccccacatgtcaacctaaaggaccacggtagaccgagtacacagagacggtccacgggtcgacggaagcggaccccgtgtgtcaactgaggcgagtggccgacaaacggactccactagacaccacgagggctgcacacgagcaaaccacgcggctaccgagcgcgcacacaaacacggtcaccacacgcacaagcgaacgactaccgacaccggtacacgggtaccggggtcgacaaccacacaacgggtacggggcgacaccgaaaggacgaggacggggcagcgagagaagagattcttaccaccacccgacgaggcgagggaacgacaacaacgaacgggcgcggcggagacggccgggaacgacggagacgaaaggcgaggggacgacttcggcggcgatccttggacgaaggcgagacgcggccggcccaacgcttgacgacgcggagccgaggacgaagacgacgacggggctgcagcggctcacttgacagaatgcggacgatgaacgcgaacggcttgacggagggacgaacgccacgacgatgaggatgacgaccgggaccggcgaggaggcaacgagggcagccggcggcagcttcatggagacgaggatggcgcggaacacgccgctgcgatgacgacgatggtggcggcgcagcgagacgacgagccggcgaggacgaacgaccgaccggaggagtcgtcgacgaggacgaacggagacgacgataacgaacaccggcggggttcggatggaggggaggcgaggccgagggcaaccttgacgctgtgatgccggaggtggagatggcgacgtcggccggcgcacgggcacagcggaagaggctgccgaaggcgacgtcgacaaggaggaaggagaggccggcgcgggcgacggcggtctccggacgaatcagagggtaggccggggtggaggtcgacgcggcgacgctgagggaggagacggcgcggccgacccacacctgagcggcacggcaggggcggctagaggcagtgggtggcggcaatgccaccggttgccggcggggacacgcctccggtggtttccccgtgaaacggaggtctgaccgggggagaggaggcggctgcgaggccgaacgcggcgacggcgcgaccggacggtgctcgggcgaggagggagaggcggctggaggccggttggcgccggagcgagagaaggagaaggcggggaaaggtggagaggccacgggagagcgcgggagggggctaagacgatagaacggagcgaggagattccgttttataggggaggagagggagccggccacgggagaggcggggaacggcggcggaattcatggccggcggccatggaaggtggccggggttggcgcgggcgttcccgacgattgggggctcgaatcaagggggaaattggggggaattgaagaggaaggaaaggggattaattccccctaattaatttggaatgagccggcttgaatggggcggatttggaggaggaacgtctctaggtttgcacgggagagagaagaggccgtgcgggaggaaggagacgaccgaggtgggacccacgcggcaaggcgcgcggtcagcgcgcgtgcggcgctcgtgcgcacgcggctagggcaggagggcgctgcggctcgggcaggggcattgcttgggccaggcggccggcccaggaggagaggagggagtggcggcctgggagagagagggaggaggagggagctgggccgagggggggaggggaagggcggcccaagagagagggagggaggctttgggccagacttggcccaaagggaggagggggatttatttttagtttttctttttagtaaactttgttaattgttgttgttgcttaagaaatattttcggtgctctgaaaattcaagtaaaatttgagggctcattttagaccaaggagaatttaacgaaaattctctaggccacattcgaatttttcttgtacgtattttagtgtttgccaatttcttttcgaattttaattaattatattattccttttagaaaatgatttttatttggggatgaatttattaggacgtgacataccacaaccatgagtacacaccgatccatcaaacaataaagtccatggcactatttcaaccgagccgactaagtcatcacgatgttccacaataaaatcagctattgcttgtccttaatcgccttcggcgactcatacagaagatcaaactcggttaaggaaaatatccactttccaacccttccttttaatttttgagccgatagcatgtacttgacaacgtcggccttgcatataacactacactcgttggacagtagataatgcctcaaccttggacacgaaaaatacaaacacacgcataacttctccacaggggaatatctagtttcagcatctaagagccgacgactgagatagaatacaacgcgttccttcccttccaacgcctgaatcaaagactgagccgattgacttctcaccggccgataaattcaacctaaacggtattcctttctgtggaggaatcaaaacaggaggagagctaagatattccttaatattatccaaagccttttgctgctctgccccccaagtaaactgctgatcggctttcaatctcaacaatggtgtaaaaggttctaaccttctagacaaattagaaataaaccttctaacaaaatttatcttgccgatcatctcttgtaattctgtcttattctctggaggctgaatcttcttaatcgcattaacactcctttgagttacctcgatccccctctcatgaacaagaaatcccagaaactggccagtcgatacaccaaaagcacattttgtcaaattcatcttcaggccatattttctggttctctcgaaaaccttcctcaaattagctatatggtcctctatttctttagacttaacaaccacatcattaatgtagacttcaaccaaccagccgattagatcatgatatatgtaattcatggctctttgatatgtagctccagcactcttcaagccgtaagtcatgacaacccattcaaataagccgattgcaccaggacacctaaaagctgtcttatgaatgtcttcttcggctataaaaatttgattgtatcctgcgtttccgtacataaaactcaaaatcttatgtcccgaagcagcatccactagttgatcggctattggcattgggtattcatctttcggggtggccttattcaaatttcggaaatcaatgcataccctgaccttgccgtttttcttgataacaggaactatactagaaacccactcagcatatcggcaaggacgaataaaaccagcatcatataatcttttaatcttagccttgaccggttcaagcatgtcggccttgcatctcctcggaggttgttgatgtggcctgacccttggtttgataggtagccgatgttcaacaatcgatcggctgaatccaggcatctcataatattcccaagcgaagcaatctctaaactcttttaagagctctatcagcttggttctaaacactggagataagttcttactaataaatgtcggccttagccgatcgcctggacctatgtctacttcttccaaatcatcggccgacatgaaaccttgatcttgcttgttatcgagatcatctaccgtgttcttagtgtagagatttgaaccctccacgatgccctcaaaataatagcttgggttctccatcttcaattggctgtatatcagaatcggacacttttagaaaatccccatcccagacttttccagatatacaatcaaggccatccatctcccaaagagctaaatcggcactggcaacattaactgacctgtcggctggcacgatctctattttgtcgccttgccactgaatcaaacattgatgcatagttgaaggaatgcaacaattggcgtgaatccaatcccttccaagcaacaagctgtaagaacctttcccatcgatgacaaaaaatatggcaggaatagtcttactgccgactgtcagctccacatttagaacacctttggttttggatagattgccaccaaaatctttgagcaccatgtttgtcttgatgagatcctcggcatttctacccaacttcctgaatgtagcatagggcatcaaatttaccgtggccccaccattaaccatcattttagacatcggcttcccattgacgtagccatttatatacaatggtttaagatgccgattctctgtcccctcgggtttctcgaacactgcctgttctggtgacagaaccaacttagccgattcctcttccacctcatcgacatcagcttgatcgatcccgaatttggctggcagggtaaagaccatgttaaccggtgccgtcacaacactcttcccttttgccaacctctttgcctcatcggctgcaacatcatcagctacaggaacttgattcttaacacgccactcctgccttggctttgctttctttagccgatgattaatttcttgttcaaccccctaaaggcgctccctgttcctcaatctttgaacccttctcttctgattcttcgtgaaaataccagaaggacaccattgattcttcctaatcacattgtccttgtcgatatgcttagtggccatgatcttgattaattggacccaatctttgatgaacagaaactctcatctgccttagccgattgctcctattatatgatcggccggagttctcgatgatatcactgcacccagggcagttttcaatagatgacaacctcataccttcattccagcagaatctaaagaactcacaaccccaatgaggatcaaaaccatcatcgtatttctcatgatgcttctcctgctgcttgtcatacttcttccgatatttcttgaaaatcttagccgaattcacctgaaaaccccttgcatgggccctatcggctgcttggccagctgtatgcaccatattaacaggaaaagggttaccatcgaccttcatcggctttttggaatcatcaaacctaatcttgcctccctcaatgaccacctgaatctgctgtctaaaaaccttgcaatcgttagtagaatgggacctagaattatgccatttgcaatacctctgtttgcctaattcctcagccgatggggttgtatgaccagcagtgtcacgaccggaaataacccaacgggcgttccttatgtgcgtgcattattccttgtcccaggaggcaaggtacaccaaaagttgatacaattcagagtttaacaagctgaagcgtaattaattaatttattacatgggcggcgaagacccagcacacaagaagacaaacgaaaaacagcagaagactagggcgacgaccacaggcgcttgacggcaggcacgagctagacaccaaagccttcatcatccaggggctcctcttctgggtttgggaaaaattgagcaagactgagtacaaccaccgtacttaacaagatacacccacaagtgcagaataaatgcaagggagtacaagggagccataatatagggggttagggtttgcagtaaacagcattaaaagtcactttgtaaacacggtcctagagctatacaatattattaaccaaggccgtaaacccacacgaacctgccttaacccaaggcctacgatgattcagaccgaactggcaacccgaccctgggtcctagctcgtcccaagccaacccaggctaaccattccacattttagctgttaggcaggttttaagaattaaaacactaacttgggtacattgctcagcttgcccataaccgagggcgcggctattcaaataggttatactctgataagaggtgtacatctttacccacaagacacatcttcctcacgtgtaaccacgtgccacataccaccacggtatacagacggaagacaggacatagtttccaacccatcctagccataaacaagagtaccgacccaaccccacctacggccggaacccccgggacaggtaggcaggactgagcccctagcagcaggacaccggccctgtgccatgacatctcgactaccgggccgcagctcgtgtagccttcatttgccctagagatgtccattgacccccgacttcgtccatctccatccgtgtacttttgtttataaccagactgagccacaaactaagccttacccactagacatgtggaactacgatagtgctttgcaacagaggcctgaagaccggtccttatatggccgaggtgctactatcaaaaccatgcaccccaagcccagcctaaaaccattttgagggttttgaatagagagggaggtgtaaatccaattccacaataatccaaccattccatagtgtccaggtgataagagtattcccaaagtctagagttgtaaaaccacctaatgttgccgaattaaccagtgaagcatctacctaaaatcatactagtgttaccataagtagagtgtccactagttggggttttgtttattctagggtgaacaaggaaataataacaataacaataataaggtcataacaaaagtgaataggcatggctagataaaacagtgataacgcgggaatttaaataaagcgataatgcaataatttaaatcaaaataattttataaactgggattcaatatgttcaaggatgatgtgacttgccttgctcactttcccaaacgtcggcttcaacctccacgaagagcggatcttccaaagctgcaacgtctacacgaccaacggaaaataaaagggcttttactctaataaactccatataacaagcaggaaaaaagcacaaaaatgggttcttgacttcttaaggaaaaaaaagagacttgaacggtccaattccgagttcaaatggccaagttatggccatttgaagtttatatgctctttaaatgaatatttgcgaatttcttcatttaaattttaatttaaaaagggtttatttcgtcagccgaggggaggggacgcgcggaccgggtccacgggcgtggggcccacgcggcagcctcacggtccacggtggatcgggcgcacccgggctcgcaccggccggcgccatgggccccacgcgtcagccgcacccgagggcacgggcggctgacggccgggccccacgcggcggccactcggcgcgcccgaaggcggccactcggcgcggccggcgggaggcggcgcccgcgcccctatggtcgccggcggcggccgagagaggggaagggaagggggaaaagaggcggcggtccacggctcactctaggtcgacggcaacgacaaaaaaggtggccggagcggaggaaggcggcggcgcggctcgggtcgacggggtcgacggcgttccggcggtcggcggactcggcgagggggtggacggggttgacggcggtgcggcgaagccggttgaggcgacgccggggcgggagacggtcccggcgagcggagaaggccagccggaggtcgtcggcgacggaggtcccggcgagagggcgacggcacgagctcgattccggcggggagtgggtgcggcaaggggcggaaacgggcgagggaggcacggggagggtttaaatagggttggaagggggagagagcggccggaggggaaggaaaccggcgcgggaggtccggccgccatcaatggcgccggcgagatttgcgggggcaaatctgcccgtttgaacacgagagagagagggaaaaatggggcgaaagggagaggggatcacagggagtatttccccccactttattgcacgcagggacggcgcgatgcggcggatttggcggcagcggcggcgcttggcgcgggcggagcggcgggagcggcgggagtggcgggaggacggggatgacgggtgggccccacccgtcagcgagggtggcgggcgggcccgcccgtcagcggcgcgcgcgcggggagggaggctgaataggccgcggggaagaggagacagagagggggggtggatagggagatgggccgagccagcccaagggagggaagggggacttttagggtttttctttttataaaacctttttaactttgtttattttttaataattattatttgtgctctgaaaattccactaaaatttatttacgcattttaggcttttaggaaatttacaaaaatcctctaagccttatttggcttttaactttgcacattttaattcttggaggctttcacacggattttaattattctaggcaacatttaagggatatattttagagtcgttttgggacgtgacaaacctaccccccttaaacggaacctcgaccccgagattcggaagaactggcgaagagatcgggatgggctgccttcagctcgtcttcacgctcccaagtagcttcttcctcggcgtggttgctccattggaccttgcaaaaacgaattacccggttcctggtcctgcgctccatggcgtccaggattttcaccggtctctccacgtaggtcaagtcttcgcgaacttcaatctgctctgagtcggcctgctcggacggcactcgaaggcatttcttgagttgcgacacaaggaacacatcatgcacgttgcccaaggaggcgggcaactccaactggtaagcgacttctccgcgtcgagcaatgatacggaaaggacccacaaaccgaggtgcgagcttccctttcgtctgaaaccggtgtatgcctcgcaacggtgcgacccggagatacacaaagtcatccactgcgaattccaggtcacggcgtcggttgtctgcataactcttctgccgagactgggccacctttagattctcccgaatggtcctgaccttcgcttcagcttctctcaagatatcggtcccgaacacttggctttccccaacttggtcccacaatagtggtgtccggcatttgcggccatacaatgcttcgtacggtgccatctgtatgttggcttggtagctgttattgtaggagaactcggcgtaagggagactcttatcccatgtcttcccaaaatctaggacacatgtgtgaagcatatcttctaggatctaatttagacgctcggtctgtccatttgtctgcgggtgatacgcggtgctgaaatttaagcgggtacccaactcttcttggagcttcttccagaaatgagaggtgaactggcgtccccgatcagatatacttttcttaggaacgccatggagacttacgatcctagcgaagtagagttcagctagtttgttccctccataggtggtcttcacgggaatgaaccgagctaccttggttagtcggtccacgactacccatatagagtcataaccgccttgggtttttggaagtccgatgatgaaatccatcccaatttcatcccatttccattctggtacttgtagaggttggagaagtccggccggccgttgatgctctgccttgacacgctggcacacatcacaaagggccacgaactctgcaatttcccgcttcatactaacccaccagtatttcccttttaagtctaagtacatcttcgtactgccagggtggatggaataaggactttcgtgagcttcctgaagtatcagctgtttaagttccttgtcgtccggaacgcatacaccatttccgttccatagggttccatgttcatcttctgtgaaaccagcggctttaccttgtttcatattcttgaggatcccatgcatatctggatcattcttttgagcctcgcagatttgatcgagcaaggtgggcttggcttccagcgtagccaagaatccacgaccaactatgcttaggttcagggcttccatctgttgatgaagttccggtggaatgccacggacgctaagagtgttgcaacggctttttcgactcagcgcgtctgcgaccacgttggccttaccagggtgatagtggatccccacatcataatccttgatgagctctaaccatcttctctgccaaagattcagatccgactgggtgaagatgtatttcaaactcttatgatcggtatatatttcgtagcgattcccaatgagataatgccgccagatttttagagcatgaaccacagcggccaactccaaatcatgggtagggtagttgccttcatgaggccgtagctggcgtgaggcataggctaccacatgaccttcctgcatgagcacgcaccccaatccttggcgcgaagcgtcacagtacaccatgaagtccttgcgagtatccggtaagattaaaactggcgaggaaaccagattttccttgagagtttggaacgccttctcgcattgcgggctccacacaaatttttcttctttcttgaacaactgtgtcatgggtcgagcgattttggagaagttctcgatgaacctccggtagtatcctgccaaacccaaaaagctgcgaacctgagtaactgtcttgggttgcttccaatcagtgacggcggtcactgtttcggggtccacagcaactcctttagcagatatcacgtgccctaagaatttgacttcggataaccagaactcacacttgctgagcttggcatacaattgatgttcccgcaactttcccaacaccagacagagatgctgttgatggtcttcctctgattgtgagtataccaggatgtcgtcgatgaagacaacaacaaacttatccaagtattccacgaacactttgttcattaagttcatgaagaaggcaggagcattggtcagcccgaacgacatcaccgtgaattcatacagtccataacacgtggtgaatgcggtcttcgggatatcttcttcacggatacgcaattggtgatatccggagagaagatcaatcttggagaataccgtggcacctttaagctgatcgaacagatcatcaatccggggaagagggtacttgtttttgatagtaacttcattgagagctctgtaatcaacgcacatcctctttgtcttgtctttcttctccacaaaaatcacaggagcaccccagggggaagtgctcggccgtatgtaccccttttcttttaactcttccaacagtttcttgacttcggccagttcatttgctaccatacggtagggtcggttgtacagaggagtggttcctacagcaagatctatccggaactcaatctctcgcttgggcagcataccgggtagttcttccggaaacacatctccgaactcactgactatggggatttctgacagtcctatctgatgaagttctaaactaccgacagaggttgggggtgcaaagaaaacaaccggttgttccggccctcggtacagagtgacagtgcgtcttgcgcaatccactactccttggaattgagccaaccaattcatcccaaggatcacatgcaagttcttggtgtctagaagaatcagatccgaaggaaaaggaattccctggatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtaccagggatggaatgaatgaggaacgtacccacgatgacgtctggagttgtcagcacatcctcggcagtcacgtggttcacatgaccccgaatgacatccttaccactgttgttggggcggggaggcgcttggccttgctggcgcctcggctttgggcatttatccgcaaagtgcaataatttaaaacagtgataacgcgggaatttaaataaagcgataatgcaataatttaaatcaaaataattttataaactgggattcaatatgttcaaggatgatgtgacttgccttgctcactttcccaaatgtcggcttcaacctccacgaagagcggatcttccgaagctgcaacgtctacacgaccaacagaaaataaaagggcttttactctaataaactccatataacaagcaggaacaaagcaccaaaatgggttcttgacttcttaacgaaaaaaaagagacttgaacggtccaattccgagttcaaatggccaagttatggccatttgaagtttatatgctctttaaatgaatatttgcgaatttcttcatttaaattttaatttaaaaaaggggtttattgcgtcagccgagggggagggggcgcgcggaccgggtccacgggggtggggcccacgcggcagcctcacggtccacggtggaccggttgcacccgggctcacaccggccggcgccgtgggccccacacgtcagccacacctgagggcacgggcggctgacggccgggccccacgcggcagccactcggcgcgcccgagggcggccacgccggcgtggtcagcaggaggcggcgtgcccgctccccgatggtcgccggcggcgaccaccggcgcggcggagcgacggccgagagaggggagggaagggggaaaggaggcgatggtccacggctcaccccggggcgacggcggcgacggaggaggcggccggagcggagggaggcagtggcgcggctcgggtcgactggtacggcggtgctccggcggtcggcgaccaaaacggaaaggtggacgagatcggcgaggatgcggcgaagccgaaggagacggcgccgagctgggaggcggtccggggcgatgacagcggcggaccggagctcggcggcgacggcggagagagagagcgacgtcgcgagctcaaatccggcgaggaggaagggcggcgagaggcggaaacggacggaggaggtgcggggagggtttaaatagggttggaagggggagagagcggccggaggggaaggaaaccggcgcggcgctctcgggctccatcaatggtgccggcgggattaggggagggtttccaaacgaatccaagggagagagggagggaaaattggggggaaagggagaggggatcacggggagtgattccccccactttattgcacgcgaggacggcgggaggtggcgggattcgcggcggcggcggcgctagggcgcgtgggaggcggcgggagcggcgggaggaaggggatgacgggtgggccctacccgtcagggagggtggcgggcgggcccgcccgtcagcggcgcgcactgggagggaggccgaatgggccgcgggggagaggagagagagagggggagggagatgggccgaattcggcccattagagagaaggagggattttagggtttttctttttataaaatcattttaactttgtttatttcttaataattattatttgtgctctgaaaattccactaaaatttatttacacattttaggcttttaggaaatatacaaaaatcctctaagccttatttgacttttaactttgcacattttaattgttggaggctttcacacggattttaattattctaggcataatttagaggatatattttagggtcgttttgggacgtgacacatattcctaatgcttataatgatgtttctaggggatatcctcccgatacaagacaaggccaatataatcatattgcgccacaaacacaacctattaggccaccaaacccaccgccaaatcaacaagggcctaataacatggaggatatgattagtgatattatgaggaatagattcgggattgaaactagaaatcgtgctagaacttacaaaaagtcatatcctgattattatgataatgtgctgtttcctcgaaattatagagttcccaaatttgccaagtatagtggtgaggatggtaagaccacatgggagcatgtaggtcaatttttggcgcaatgtggtgaggctaatagtgatacttttaaattgcgcttgttttctttatctttatccggtaatgctttcacatggtttacttctttaccagcaaattctattcatacttgggctcaattagaagaacaatttcatgattatttctatactagagaaactgagcttaggttatgtgatttgacatcggttatgcaaaagtataatgaatctgtcattgattatattaagagatttagagatgttagaaaccgatgttatactttgaatataactgatagagatttggctggtcttgcttttaatggtttagttgctcctcttagagaaagactagatggccaacaatttcttgatgttagtcaactcatgcaaagggctctggctcaagaaagccgggttaaggataatagaaaacttgctagaccatttgataaaaagcctaatgttaatgtggttgattacccttaagctaatgatagtgaggaagagggtgatcatgatatttatgttgccgaatggtcatggactaacaaaaataaaacttttgtttgttctaacctaatcccgactcctcgcaaagatcggcaaagtgaggttaaatatagttttgatgtggccaagtgtgataagattttttattatcttttgcaagagaaacaaattagattacctaaaggccatgtcataccttctcaagaagagttgaaatgtcgagcatattgtaagtggcatgattctcattctcactctactaatgattgcaatgtgtttcgacgacaggttcaatcggccatagatgaaggacgattgaagttcaccgatggctccaagatgaagcttgatcatgatcattttccggtgaatacaattaatttcaatgataagaaggtgttgattcggccggagcaagccgaatctactaaggggaaggaagtggtcattggtgaaccaaggtccaagatgatagtgctaaagaagccggaggttggcgtttggaaagagaataggagtggagcttcaacttctaaagcccctaggaagaccaaggtgacttttaatatgcttttggagaaatatgaaaagcaaggtggtgagaaaattcgcaacaaagggaaaagaccaagatcacctcctaaggagcgatttggtcattcaccaagacggtcgcgttcaccttcgtatcattatccacaagatatgtcatggggttcctatccaatgccgccgtcgggttatccttatccttgcttcatgccatgggggccgacgccgccaatgttcaatcatatgcctcctatgcaattcaaccaagggaggggaggaccacggaggccaattcatgagcgtttgtcttcaccaaacaatagccgattttatggtaagaatcgggctaatgaagaaaagtgggaaggaaagcgcgtcaaggtggaggagaggacttcggaggtgattactatcaaagtggggtctcatgatgtgccaataccttctggagatggagttggagtgtccccaaacaagaaatccgaagccggtaccagttcttcgcagtcggccggtctgaccgcagccatacggctggtctgaccgggccatcaggccggtctgaccgccgacccgacagcggttcggccgatgcctcaggccggtttgaccgctcgccacatgttggtctgaccagcgcgtctggccggtctgaccggtggtctacggccggtctagccgggctccagcttcggtttgatgagagggctgcaaagggcgatgtgagggcttcatcgtcttcaagcaaagttaataaagggcattatttacctcctggaatagagccgaatcctaggtggatgcctaaggatttgacggctacacaaaagagaaggttgcaacgtcttcgggcccaagaaataagagagaaaaaggccgaagagcaaagagataaaaggtttaacgagttgcgaccaccaccggtatggaggcctaagtccatagagaaggaaaaaccggttgatataaatgagaaggaagaacaatcggttgacaaaggtgaatcatctccaaaagaagacatggatatcaacatggtgtgtatgttgcctatggagttttgtgctatggatgaagctgaggttgctcaattctcattcggtcctaaagatgcggtttttgagaagcccgatgagtcaaaccgtcacatgaagcctctttatctcaaaggccatgttgatgggaagccggtctctaggatgctagtagatggaggtgctgccgtgaatttgatgccatactcattattcaagaagttgaggcgtgaggatgatgagttgaagaagaccaacatgattctcaatggcttgaatggtgaaccaacggaggcaaggggtatcttttcggcggagctcaccgtgggaaataagacgctaccaaccgctttcttcatcgtcgatgtgcaaggtaactacaatgttattttgggtcgttgttggatccatgccaattgttgtgtaccttctaccttgcatcaatgtttaattcaatgggacggcgatgatgttgagattgttcaagcggatacatcggccgaggttgcaatggctgatgctacttttgagtggcatcataggaatatccaatgcttatcggggagggatctttctagttaggattttattagtatctccgatggcaaatttgtacctatctctataaagccggctagtgtagcacggctaagccatataaatttgtataatgagtaaagaggctaatttagagtggttacaaaggagggtgtaagaatatcggtctacaaagaacgatattggcgaaaccgttgaggattttgatgaagtagagaagcttagaaaagggtttacatcggccgatcctttggaagaagtagacataggtgatggaactaagccaaggccgacttttgtaaacaaaaatatgagagctgattataaggttaagataatcgagctacttaaagaatatgttgattgctttgcatgggagtaccatgagatgccgggtcttagccgtgagcttgttgagcatcggcttccaattaaaccaggttttaggccttataagcaaccacctcgtcattttaatcctttgctatatgactgagtcaaagaggagattgatcggttgttgaaggcgaggtttattaggccatgtcgttatgcagagtgggtatctagcatagtcccggtggaaaagaaggggagtgataagattagagtttgcatagattttagagatttaaataaagctactcccaaagatgaatatcctatgcctatagccgacatgatgattaatgatgcctcgggtcataaggtgattagttttttagatggcaataccggctacaatcaaatctttatggcggaagaggatatgtacaagacggcttttaggtgcccgggatttgttggtttgtttgagtgggttgtcatgactttcgggttaaagaatgccggtgcaacatatcaaagggcaatgaatttgatctttcatgatttgttaggtattgtcctggagatctacattgatgatattgttgttaaatcggatggtatggaaggacatgtagccaatttgaggttagctattgagaggatgcgccggtatggtttgaagatgaacccacttaaatgtgcttttggtgtgtcggcggggaagttcttaggattcatggtgcatgagagaggagttgagattgatcctaagaagatagaaaagattcatgatttcaaagcgccgacatgcaagaaggaggtccaaaagttgctaggtaaagtgaattatttgagaaggtttatttctaacctagcgggtaaaatcgatgcttttgttcctatacttcgcttgaaaaaagaagccgattttacttggggggcaaaacaacaagaggcgtttgaagagttgaagagatatttgtctactccacccgttgtgcgagcgcctaaagccggaaagccttttcggttatatattgcttccgaagacaaagtcattggtgccattttgacgcaagaggaggatggcaaggagtatatcattacatatttgagccgccgccttttagatgccgaaacaaggtatgtctttatagagagactttgtctatgcttatactatgcttgtaccaaattgaggcattatttgttatctagcacatgcatagttacttgtcaagccgatgttattaaacacatattgcaaaggccaattctaagtgggagaattggtaagtgggcatatgctttgatagaatatgatttggcttatgaaccattgaaatctatgaaaggccaaattgtatgtgattttatagtagaccatcatatagatattgcttatgagggagaggtttgcttaattgaagttataccttggaagatttattttgatggttcttcttgcaaagaaggtcaaggcataggggtagttttgttttcacctaatggcatgtgttatgaagcatcggttcgtttgaagtattattgtacaaacaatcaggccgaatacaatgctttattgttcggcttacaagttatggagatggttggagctaaatacgtggaggcttttggtgattcggaattggtggtgcaacaactcgccggagtctacaaatgcttggacggatcactaaataggtacctcgattcatgtttggatattattgtcaattttgataattttgctattacacatattgcttggcgtgataattctagagcaaatggcttggcacaacaagcatctggctataatgtgaagaagggattattttttatattagaagagtcggtgcttgattttaaatctttatgcgaaattggcaaaactggagaccaggggcggtctgaccggccgcatgccgccggtctgaccggcgaccccgagcggtctgactggccctgtgtggtcggtctgaccgggtttggacagagcgccggggggcacgtttcaatcaatttggaagccgaattaattgtgaattcggacatttgtgcccaggtgacagaagaagattggagaattcctttgattcaatatttgaaggatcccacacttaaggttgatcggaaaattcggcggcaatcgttcaaatacacattgcttgatggtgtcttgttgaagtgcttagatgaagatcaatctaaagtggctatgggggaggtacatgaaggaatttgtggaactcatcaatcggcccacaagatgaattggttgcttagaagagcgggattctattggccgaggatgattgatgattgcttcaaatattatagaggatgtgaggcttgtcaacggttcggcaatgttcaattggcgcccgccgccgtgttgaatcccataatcaaaccatggccattccgagggtgggctttagatttcgttggtcaaatttatccttcattatcaaaggggcataagttcgtgctagttgctacggattacttcactaagtgggccgaagccgtgcctttgaagaatatgactcatacggaggtaattgactttattttgaagcatattattcatagattcggtattccgcaaacattaactacggaccaaggtgcttcttttatgtcttaggaagtgaagagttttaccgaatcttatagtattaaattgttgagttcttctccttactacgcttaggctaatggacaagccgagtcgagtaataagacattgttgaagctagtaaaaaagaagattgaggaacacccaaagaggtggcatgaggtgctttccgaagcattgtgggcgcataggatatctaaacatggtgccactaaagtcactccttttgagttagtttatggtaaagaagccgttttatcggttgaggtaaatcttggttctcttcgttatatcaagcaagatgatttgtcaagtgaagattacaagacgttgatgggagataatcttgatgaagtcatcgacaagcgcttgagggcattggaggagatagagaaagagaagaagagggtggccaaggcatacaacaaaagggtgaaaggaaagttgtttcaagttggagacttggtttggaagacaatttttcctttgggtactcgatccaaggagttcggtaagtggtctcctagttgggagggtccttatcgagtatgcggcattgttcgagggaacgcgtattttttggagacacttcaaggggagcgttttcagcgagcaatcaacgggaaatacttgaagcaatacttcccgagcgtttggcaagacgcttaggaggtactatggccggtaattagattatcgtcctaagaccaaaaacatgttctatgcttttagattcacgttgttcatcaaaaaggcaggggggcatgtgtttatacccaaatttggcacctaggattaaaataggaaagattgccaaaatttggaagtctgccggtttcctccgagtgggccggtctgaccgccgtgtgttgggcggtcagaccgccggttgagggctggtcagaccggcggtgtgtggccagtctgaccggcagggccgagtccgattctgtttcatcgggtctcgaggtttctttgctcgggaaggcatgtttcgggtttcctttggcttctatcccgagttggacgtggaggagggcctgtagagggcaagaccaacccctatataagggacatggccggttcattgtaaaaaagccaatctactatcaatcgatcgaattgtttttttatattgcttttagttttctcttagtttgtccatctttgtcgggttgcgccataaaccgtccgccgtcgctgtgagagtgcgacagctctttgtaggtttgtcctgaaaaccttccgttttgcccacgagacgggtagttatctagaaatcggctccgctagccggtttagttatcaaaacccatctaggtttagctctttgctagatcgaggtggttggcgactctaggatcaccgcaaggcttaaggtgctgcgatcgtgcttgtcaacttgtcacaaaaagttgccaacaccgtcggctgagatgttggtgcagcggaggaaaccgcctgagttgatggctgaacatcggtaatcaaagaccgataatttggaaagacacctccttgcaaataaaccgggcctgcagcctgatgctcagctattgaaccatcggctatggacttcatcatgtttgataaggtattgactaacaccccagattgattgatcaaagcatgatgcacagcgtagtcaacccgatcttggaaattactgaaaaaatcttgtgccgcatcactattctgattatgatttcctccttgcaacccctgagcaccatcaccttgcactccatgcaccccgtcaccttgcactccatggactccttgagaattgtcaccttgatttcctagagagctgtcgatagcacttttgttactcagctgagccgagccgtctggagcttgttttccatctccatccttagaagaactggtccctggatcatcagcaaccacttctattttgtacttctaaacaagtgtccccttgcgggtctgcatgaatgagttcaagaactgatcccgtgcttgctgcaacattgcttcaaactctatcttctgctcaggtgtgaatttttctggatcgatcggcacgacgtttccttcattgacgtcagtcaaccctaatttcagcaccttttccttaacagagcctgggctagctggggatggtggtggtggttgtttctcggccatgaggacgaattgttggctgacttcttaaatgtcccaccgggcgtgccaaaagcgtgttgacagaaaacacgaggcctgggagatttacttaactctagtacaggtccaaatctcaccttcgaatgtatgagcatgccagttgatttgatcctgtaatcaacaagaaatagaagcaaagaaaccgcagttaaatctataaataatagccgatcggctaggtgccgatgtcatatatacattgatcggcagtcattaagaaataagaagggactaaatctactcgattggctgtagatattaacaatatataatcattatatcgatatatacttaaatcaagtgattgggatagatcggtcgctatgccgagacagtataaatcacatagatcgaaatatatattaataatgagactatatacgtttatagcatagccgatcagatagatctagcatgtatcggctaatactccgatatcactctatattaagatattaaagcgagtagaatatactaaacaaaagcctaatatacttaaatgcagcaagatcttaacgtaaagggcagatttaacatgtcaatcaaacatataggataaaaagtagttaaatcaggtaagatcagctgaaactccgatactaccctaatcagcaaccaagaagcgggctagagattgagattctaatcacgactcataagatcatacttaactgatgcagctataagtatgaaaagaagaacaatgtctagacaatcaagccgttggatgtgtcatagagtggtagatatcctatataatctaagtcaacatcggtgtttaacctagtcggctgccttctattgacggatgttagccgattgtaggttagatatcgatattgccaaggattatgtaggatatatgataactcgacgaattacataaacaagattagagtgtcataaagatggaaacactaatcccgagaacgcaagccaccataacaagtttgacctcttggtgaagatcgaaaccgatgcagctcaacccgaaagcaagaactcgtcaaaataaaactaaagcaaaaaggtggcgatgcgccgagattgtattgaacgtgtgtgttaaaagttacatagggctcgggtatatttatacccgaaaatcacaagatatgtcctaacggacacaactactatctctaagaaactctaagataccataagtctttgcggcagacttttgcccaagcatatctccaaggagattacataaaacatcctaattaatagatacaattgccttctcaggactctatccatgtgcggcaatcaccttgaagcgccttaattcaacccgatatcatacatcaggttgcattgtcggaatcggctgcatcggcttacctagcccgactcagacccagccgatccaatttgtagccgatctggactccagccgattcctgctctgtttccgaactcgatctccgcctccgactttgcatcgatctaatcttctttcccaatgccgatattaccaaatttggttgttaacagataccactctatattaacatattaaagcaagtaaaatataccaaacgaaagcctaatatacttaaatgctacaagatcttaacataaagggcagatttaacatgtcaatcaagcacataagataaaagtagttaaatcaggtaagatcggctgaaaccccgatgctaccctaatcggcaaccaaaagcaggctagagattgagattctaatcacgactcataagatcagactcaactgatgcagctataagtataaaaagaaggacaatatctagacaatcaagccgttggatgtttcatagagtggtagatatcctatataatctaagtcaacattggtatttaacctagtcggctgccttctattaacagacgttagccgattgtaggttagatggcgatattgccggagattatataagatatatgataactcgacgaattacataaacaagattagagtatcatgaagatggaagcactaatcccgagaacgcaaggcgccataacaagttttacctcttgttgaagatcgaaatcgatgcaactcaacctgaaagcaagaactcgtcgaaacaaaacgaaagtaaaagggtggcgatgcgccgagattgtattgaatgtgtattagtttgattacatggggctcggggtctatttatacccgagatttacaaaatatgtacacatcggacacgactcttatctctaacaaactctatgataccataagtctttgcggcagacttttgcccaaacatatctgtaaggaaattacgtaaaatatcctaattaatagatacaattgtcttctcaggattctatccatgcgtggcaatcatcatgaagcttattaactcaacccgacaatgtattctttgtcatattgtaggattcggctcaatcggctaaccctgtccaactcggactctactaatcctgatcaaagccgattcggactcttgccgattcttgctctgtttcctaaaagatcttggatttagattctgcttcgatctgatctctatctttgatactcagattatgaaatttggtcgttaacacaagtcaagcccaaggggcatcgcctcaaagccaactgccgcaattcgacccaagcaccgcggtccaagcacccatgaccttcgcacaagccgtgccctctggctacggagcggtcccactaccaaatcaagtttggaaccaagtcgtgttcgacccagctatggtgatgcaagctgctccgactgaccaacaaaaccagccaatggtgtttggcacggggcatcaatcaacagctgctgctcaacctcatttgcgcccccgtacccgcagctaagctggccttctcagcaaggcgtcatgatcaagtcggatggcgaaaagggtttgccgttgagttgggggatcaagaatcatcccatcccaccccagttcaagttccctcatgtcccaaggtattcgggagaaacggatccgaaggagttcctctccatctatgagtccacaatcgaagctgcccatggtgacgagaatacaaaggcgaaggtaattcacctcgctcttgatggcattgctcgatcttggtatattaatttgcctactagtagcatttactcatgggagcaattgcgcaatgtctttgttcttaactttcgaggcacttatgaggagccgaaaacacaataaggtcttctcggcattagccagaggccaggagaatcgacaagggaatacgtgcgccgcttctcgcaagcacggtgccaagtgcaagacataacagaagcctctgtcatcaacgctacttcgaccggcctacttaagggcgaactcactaggaagatcgcccgcaaggaaccaaggatgctcgaacacctctttcgcataatcgatggttatgcatgaggcgaaaaagataccaagcggcggcaagagatacaagccgaatatgacaaaacagccgcagccgagacggccaccgcgcaagctcacgcacaagctcaaattcaagcccaagttactagttcggcacccgttctgattcactcaacccctccggtgaatcaagggcagcctttaaggccgaaccatgccccgatgacatggaaaaatttagaactgatcgagctggcaaagcagtgatggcaggagaagaagtgcaagcccttcgcaaggagttcgacgctcagcaagcgggcggccagcaacaaccttttcgcaaaaagatcaggaaagacctatactacgccgttcatggacactcttcgcacacaaccgagcaatgccggaacattcggcagcaaggcaacactcaagagctcaggcagcagcaagccagggctgaagaggcaacgcgcgaagcggtcctcaaccaagcacctcaggctgaacagcgccaagatgcacagtgaagagtgatctaggtcatcacaagatcttatccccccctcgcaagtgtcgaaacgacaaaaaaagatgcaacttcgagcagtgcatagtattgtttcggcaggcgaaggggtcccaagatacttgacgcaacagatatccttcagaccgaaggatgctgaaggagtccttttcccacaccaggatcggttggtgcagagatggttggtattgaagttcggcatatcttgatttatggaggcagttcggctgatgtcatcttcgccggaacatatgccaagatgggtttgccgacactggcattgtcccaagcaccaacctcgctcagggggtttggaggcgaagtagtgcaagttttgggtcaagcccacctcaaagtcaccttcggcacacaagaaaacaagagagaagaagagatactcttcgacattgttgacatcccatacaattacaacgccatcttcggctgaggcactttgaccaagtttgaagcagtctcttatcacaactacctcaagctcaagatgcctagcccagccggtgtggtagttgtcaagggttcccatccttcggctaccatggtggccttatagatcgccatgtgggccacccggcacggcacggcccaggcccggtcgtgcctgggccaaggcttgtcgagccgacacggcccgaccgacgcaccgggccatgccgtgccagcccacgtgccgcactcacggcctaggcacggcccaacacgcctggggccgtgccgggccggcccgaaggcacgatggcccatagtgcttttcctcagaataagtctaattttcctccctcctattgggctgtgacatatatatagctaaaaaaagtctattttacctcccttttctttgggttgtgatatcaatagctaaaataagtctatttaaggtccctattctttggacagtgacatttatatgtttatttttagtccctatactttgtgtggcatgcctggcctgccggcccatcatgccaggccggcctgaccgtgccgggccagcccagcgtgccggaggggaggcccagacacggcccggcggtcgggccaggctggcacgggcccgacccaagtcaagccgtgcggtgcttgggccgggccaaaaagccgtgccatgggccgggccttcgggcctcgggccttatggccatctataggtggcctccttcgacaggggagttcataccttagaagtcgaacggcaagaaagaaccaggccgacgctgaaacccgtccccacggcaaggttgtctggttgcagatagatgactctgaccccgccaaaatcatatcactcggcggagacctgagtgaacaagaagtgaatagcatcctgatcgtgctcaaaaaaacattgatatc

SEQ ID NO: 80526 - DNA, 536 bp, Oryza sativa
acccaaccccacctacagccggaaccttcgggacaggtaggtaggactgagcccctagcagcaggacaccagccttgtgccatgacatctcgactaccgggccgcagctcgtgtagccttcatttgtcctagagatgtccatcgacccccgacttcgtccatctccatccgtgtacttttgtttataaccagactgagccacaaactaagccttacccactatacatgtggaagtacggtagtgctttgcaacagaggcccgaagaccggtccttatgtggccgaggtgctactatcaaaaccatgcaccccaagcccagcctataaccattttgagagttttgaatagagggagaggtgtgcatccaattccacaatagtccaaccatttcataaagtccaagagatatgaatatttccaaagtctaaagttataaaaaccacctaatgttgtcttattaatcagcgaagcatctatctaaattcatactaggggaaccatgagtagagcgcccactagttggggttttgtttat

SEQ ID NO: 80527 - DNA, 4881 bp, Oryza sativa
tgtcaaacattttgaaacggagggagtataaagttttgagatatcattgaacacctccaaaaaaattcttacagtgatgcatgctgcgccgatgaagaaacaaatcacaatggtagctgtagatgttactttctccgtttcacaatgtaagtcattctagcatttcccacattcatattgatgttaatgaatcttacatcaatatgaaggtgggaaatactagaatgacttacattgtgaaatggatggagtaattattctctctatctttattctcttttcgctttaccaaaagagaattggcaacatgatgacagaggctcgagagaatgaagacagagttagggtgaattcttttgtgtttgtgtgtgcgcgcgtttttgaaatcgaatgcttttccctgttcattgatctaaaatttgcaatatgctgatgataatcgttcgggatcggatgcctcttccgaatgtacttttttccatccaacatcgaatgtactaattcttataataaacgactacaatcatgttagttgcagtgacctaagtagcactctaaagtcctgagtttaaatcttcatatgagcgaatttcatattggattgtttgaggggctaaattctcaatttaaaaggttgcatattttatttgggcatcatttgattttggcatacagatggctttgcccagtagtttaaattttataaataacaaaaagggtctagaaatacaaatacaaattacatgggaaaaaaagaaaaactcaaagctttatgaagattataacctatctaaaactctctcttttagatcattatattcatcctccaagatacaagagaatctcattcttgaaactagctaaccatctgtcgacattaggtgctaggtgctcaaaaaaaattaagcattccgctgcttccatatatgtcagcatgaagattattactatcttcaagaaatctttcattcaaaagcacaatcttgcaaaaactttcatcttggtagaaagacaatgacgtcttccaggaaattctaaacttcctccagtagggcttactaaaagtgcaatcaaatacattcttgtttcccctatcaccactcactcactcaggcaaaatatgcacatgataaatccgtgtcctgtggagcacaatgttgatcatgtcattgaacaacagccaaagaaacacttttatctttatgacacattttgatttccatttgcatgataacggccttgcatggctgcttaaaaaaaacaggctatacattcccgaatttttttaaaatagtaattaataacctgaaaattaaattaatagtaaatgaaaggtttaatttataaaaataagaaggacgctatgtgcaacagcgtccaggcatggacgttattcccgagaacgtccagatcaggacgctgtttgtaacggcgtccaccgttggagccgaaccaacctacggtagggaagcctccactcgcgattctttgtcgggtcgtcgtcctcaacgctgctcgccaaggaaggcctccgctgcgtctcgctcggttagcataagcgccctagccctagccgtcaggttaatagatcatatccgatcctgctgtccgatatgattcgacctatgcatcctaattttttagcgcacttcttcaaattaaatggccagctcgatcctgcaaatggcttctctttttttttccctaacgaatcgcagatggctactcttgattcgatacatgcgtgcctgcaactagctgcttcgtttatttatccagaacgtcctactgattgctccgtaaaagctagtagacctggttaataatgtactcaatgttagagcaaacagatcgatcaaggatgcaagtaacgctaatgcatgctgcagtgctgcacataaatggagaattggtaacccaaaagtgatggaatacagagattaataactgattatatatgtatgcccacatgcaaaacctaaacgaaaatcaactaatatccagtccagagcatatatacatcgttttcgaagatcagataagcagccggcgctgggttcatgtggcggcaaatcgatcctcagcagacgtcgcgagcaaattaacgggggcttctggatcagggcagagtttaacgaatggcaacgtgcgacaggaagttttgggcgctgatatatgctgacggtgctaggagtgactagtgagcgcaggctccctggcgagacgcgttgggggataacgaggctggtttggctgcaccaggagacggacgcagttgcgaacagcgtccccttccggacgttctcaggaacagcatccacgtctggacgctctggtagatagcatccttcttatttttataaatccagccagcaatttactataattatttaatttataggatattaattactatatataaaaaaaatcggatacattctctgtgatgaatatgatggcctattccataaaaatcttcaagttgtgtggatggactgtatatgtgcttctagttgaatgtatcatcatatgcttactatgactatgacagtggtaagtgacatgtctgcttttatctatcaaacattatggctacagaatcatccttgtatgtaaaaaagagtagagctagccttgcatgcttaaccattttaacggaaccattccacatgtctttctataacaaaagggtttgcccattcccttcgaattatgaagcatagtgagatttctgtaaataaatttgatagaccccttattatatacttatcattaccctcgattattgtttggcaaaatttgctatatgatatctaaaatttgtgtaattggttggagaacactgaaggcactattttataatttttggagaaaaagtggacaaacattttgagtttaaagttttcaatttccaaatgaaggttttgaaatttgagttgaatgtttttggagttcaaattaaaagtgttgaaatttggttgttttttcaattttgagtttaaagtttgaaatttttcactaaaaaattcccaatttccttttcagatttgagtttgatacactccgtaaaaaataatgtgcgtcattgaaaaaagaaaatcatgtcgcaattcacattgcctatactgtcctcaccaagatcgagtcggtgtttgtaccgcgttcctgttcctcgtagttctatgcataacagtgcaagccattttctcctgtaaaatcaaagtgtaaaatcaaagtgtgtttgattgttattctgtgatgaacaattggcatatgagattattgattttgatatttggagatcattgacgaagtggttttggagatgattgatttgcaggtgatgaacagagactgttgctgacaggtagtgaccggtcaggccgggttgttgtagtcagtcagaccagaggtatgtgtgcggttagaccagctagctcgtggcttgaccggccggctctgtaccggtttcggtttagggttgattctttggatatccatggacaatcaatgtttattctagatggatactatgcatatgtaatactgttgttcgctaacaatgagtcaaattggtgagaacttgtgctcggatattgtttcttggttgatgcgtttgtaggtggtcttgatgcctcgggagagtgttgccggtgatggatcgggagtcaacttgggataagatgacgtccggacgatcagaatatcacgtgggatatttaagctaaagatcaatacacgtggttgtgtgtatgggatacatagccgaatttagagggagtccaaatttggttcaattggagtttgtaaagtttgtttcttgtacggaaaggtttcttaggggattatgacttcttgtacaaggttggtctgtggctttaggctgcttacgttgggtataaatggagaaggagggtgtgtcattctggtatcatttttgatagagttgcgttgagataagataggcatatttgtaatctctatacatccaaaacttaaatgaagagcttgtcttttcgtttggcaatatttgattcaactcctgttcgagagagtttatagtagctatagcttctcttagaaactccagctgtcagacattccccaaagagttatttttaaccagattctgataatttgttgatgtagaatccatataatgaactagaagccaaaagatgagaaacccaactttctagatcttaccaacagcttatcagaatcttaagttcccaaaaacatgatttaaattgttgactctatccaaacattcatcttaatacttctgggttatgcagacttttggataaaacgagtaacatagttaatggacgaaaattaaaccatggcaatagttaagggacagaaatagactttgtttaaaataaagaaaagagaagagctcataattggtcggtgctgagtcttttgacgcagctttagaatctatcgagctttgttctacttttctttttctagcaagacaaatcattaaataaaatgaaaacgtactactgtacaaaatcacagtaaaaacacaacaaacacaaaagaaaacgaaataagaaaatactttccctattattatatacatcctgagtttaactcggtaagacggtaaagtctcaggtgagtacgccaagactgtaaagagcctttccttcccacgcatagtagtagccatagtcgatacagcaaaagattagcatgagcctcacttcaggagacatatacagattaaaaattgggcaaggaagcaaataattcagaagttaataagaacaaataaatgtaaagcgagaggtattcaggtttttttgccaaaatgaatacggcgaatagcttcctgagaacgtcgaaacttctgattcacatctatca

SEQ ID NO: 80528 - DNA, 10445 bp, Oryza sativa
agctgatacccatcagtaaacttgtacatggccaaaaaacagatttacagcggcgatacctaacactcatctaattaccttttaagtacccggagagatctatacaggccacagtaaaaaagaagagaacacatccagtctccaccaggacacccctattggctattacagtgtatctcaaaacaaaaatctccacatttgtcaattcaccagatttgcttattgatgccaatgcttaaaaaggattagcgtcaacatctgtacagcttagtgactgctgacattggctagtcttggaccccatccgcactcggttttctgaaaatcaaggagaaacgttagaagttggaaagatttcggtcccgattgcatgtcacgataaacaaacttatccgctcacctcctgtaatgattaacttctccacacgcgcaactatatgcttcccgaaagtgtagttcttcagttcgttcaaatgcatcttgatgcttgagaggatcacaactaggaatttgtcatcacatgtctgaaggattctctgtacaacataattgccaaactgatccttcatcagtccctgcatagattggtcaaaatgtgttattacaatcactgaaaaatcattgtgcatcaagacattgtcatacagtactagtacaaatacagtgaacattatattaaaacccagtgccatactgccatgtgttctgtatgaacaataaatcctaaaggctcttgtgcacttacttgacatacaaaatgaaactaaacacaataaatacagcattgatgtccgtgtggaaaacatagggttgtggaatcatttgatagaaaatatgctttcagttaacagctcaaggaagttgcttgttggacaaacctggaatgtttggccagaggatacaatctctcttataaggccttcacgttcatcaggagttccaaaagatagacacttttccacaacattagaagcatacttctgctggctcaagttcaccacttgcccagaaagcttttgaataatggatgaccgctcctctggcctaccatgttctaagacgtgctgaaaattgtttgaaaaggttcatcagtaaccatcaattagaaccgttaaatgctcattgaaggaaatgaaaaaaaataatactacattccaaactgggcctaaaagatataacattctttttaccatgctgcaatgtatcaacttatttaaaataataacaagaaacatttacaagttaattgagcccaggaacatcataagctggtgctgttttatatattttaattcccagtaggtaaaatgataatccgctggtgtcaaagtactcagttaatcagttaatgattgtttccagagtatgaagaatatatcgtatttcaggaggttactgttgtatttatatgtaaccatttcaaatggagataaaaatagccctaatacatagaagaaatgtggtaatcctagtaaccgctggcaaccagccacatccaacaaaagtttgaaccctggctccacacacataatttattttactaattttatccacaatatctgtaaactactaggttttttaatgatcaaggcagtgtaactatttttatacagggttaagtcaaaagtttgacaattgcagcaagtgaataaataaatggaatatgttaacctacttgaacaacatagtttccaaatttatcttctgtcaaatcaaaagcacgttcgacaatttcatccatcacagcactttgagttgctggattatggcaatgctccaaaactctctgcaaagataaggttagaaactaccatttaaagttacagaatttaatgcttaggaaacagaaggttgcaatttgtacctgaataactctgcagccatattggtgagtgcaaagcggataaattttctgaagtatatcctcaattacaaatggaatgtgatcttctggaacacactctatgcacttctggattacgtggttaccattctgatcagaaatacatctgagaacagaattcttaagctcaccaacaatagatatctttctctccaagtcaaccacatcaatgacctgtggcaaatgcatggataaaattccaatcaagcacctctaaagtgaaatgactcgtgcctcatcaatgtctcactcataatgctgacagagtgacaccaattttagttaaggtggcattccatgcatggacttttggtgaagacataacgctcataacgcaaacaaagaacaaagcatgttcattttttttaataaacagagattcattatctcttgtcagccaccatgaaaaaatgatttgccacataacaattagaaaaatcataaatggtaaatcatttgtcatcaattgtagcttttacacattagctcaatgctagtagtgagataagattgagtgttaaaagcagcggatgatttaatcttggttcaggcttccactcaaattatttttgtgtacattaaaattcttttttgtacattactaacagatttactttaggagactacactgctgtccacaataaacttgtaggaaattgattataaacttgtagagtttgcatgggttacagatttacatgaaccccaagaaaaaaaaagataacttaccttctgaacaactctgcaaccatacatctgaaagctgagttgcaaaaagtgacctctgagctgatctgctaactggcttaactggctttctgtagcaaactcaaaaaactgcaaatgtacaattctgaatgttaggtttcaaaatataaatatgagtaatcaaattagcaggacagataggcgtaccttctgaatcacataattgccaaatacatcagttgtcagagcaatagcattggtcagtatctctggaaagattttttccctgtcatcagctgaggcaacctctagtttttgttgaataaaacgacttccaaattgatccatactgcattaagataagaagtagataatgtgacaaagcattaaagttgaaaatctacaacaggagaatggaagagaaatgtacctaacttccataacatggcccactacattaacaagctccaagggacaagcaccacttctatttgcaagatccaaagaagacagatccaggcagtttgctacaggattatcttggtagatttgtgatcccatatttctaccaggtgtcctcctactagaggataacatccgcgattgctgatcaccaagatatggaatgcccctcaaatgtgaataagcatgggaccctgatctttgcattcttgaatatggaaaacgaggtccatcatgatatagtatgttgtcattatatgagggaccagattttgactgaaagacattatcttcctgcaaacaacgctgtgcaataagttcttcaaggaaatggttcctactcctgattaagtccaagtctgtgatgttgcgtctgtttctcaaggggttgattatatttaccatatctgcattgctatggtaattattctcgtcaagattgcttagctgcatcaaagctagttgatcagcaagagataggcgatccacattcttcatgtgatggttattattccttgaaacatagggactatccataatactgttctgcctgcgtagaagaccatctccatatgaaggtagtgaatgaacatccaagtgctcacaaccaagcgtacacaaagcattgccagataaaggagaacggcagtcattggcaatcttagaggaaaaatgcctgtcgtgattacgcatttccatttcatcaagcaggtctttggcaaggcccctttcatcatattctaaatgattagacaagttcaccctagataaagcatttgaaagatcagagtcagagagataggtggactgaaggtcccttctagcaaaagcattcatctttcccatgtttggcatgaagcgattctcggcatgcctatgaaagtcagcatcatctgttttggtctgtatccatggggaaccaacattaactgcagagtgatccagcatagcgccaacactatgaacccgggttggtccaaattgctgtccattaaactctctcgtaccattaaggtggaggcctggtgctccattagataatgactcagaatttccaaaatgatcctacaacaaacgaaataaattcaaattcaaataaccaatgcataaacatcaaacaaaacgtaagtctggaattggtgttgttgtattggactaaatagctcatcagccaatcctttagctcctctgagccatgcacattaattaatatccaaccgaaatgagagtcaatctcatacatgcacagggcagcagttaattctttgacagcgaagaatttatggcggtatacgcggagtcaaaatggaacccaaaactaaaatacctgggcagaagggctgcgatctatgtatctggaaaacacaggagcaaacacccaagaacatggatggatgtttttataaaaaaaaaaactgaaaacaaatgcacatcaacaataaattgcaaatcaaatatacaaaaacaaacaagcagattattttacaaactttagttcgctcactatgggccaaacggcaatcctcaaactctcctccccatccctgtgaaattccccaatccagcaaccaccaccatctccttttgatctcattgaaacagagaagagaccagatggacggtgactctgtgaatcactggatcttaagcagtggaagcaacatgagtgggagatacatattgtgtgagatcgcatgggtcctgcaaatcacacacaggttcacacttcacacacgaagtaacccacatgaagtcagatagaacatttcttatcttccgttagaaatttaggaaccgcaaaaaaatatccagaggaactgttgacagaactttctacaggaaataatggacagaaactatcactagaaacttaagaaattgttcagagaatctttccataacaaaacattgcatagcaaactttccatcaaaagatcattctacagcagatcttaaaactttcttaacaaaacttagaaactatcttcaagacaactttctacggaatactactttctgttgaaaaagcttgttagtaccaagtacaaacttttattcaaaatctaaatctattcgaattaactatcatgaagtgatgatttttttaaaaaaaaaaagtattggccaatgtggcacgctgcccctcaaactccaacagtcaacagagcggccacccaggaacaaaaattgaaaacatgtgtgcaggaaaaacacattaaacattcaatggacacaagtgttccacgattaggaattatgcatgactggattgaggagattacatagcaaggagcaactaggttcatattctctcttgattttgggcatttcatctaaacaagtataagtatctatggggaaaaataaacacccaaacaaataggtccaaaatatacttaggcatatacgagaatgggaactgaaaaggctcaaaagcaatttatgtacaagctatataataaatgtttacagcacatacagcctggtaagataattacatgatatttacgacatataagaacagaaatagcaaattctaatggcaggaaaataaagcctatatataattaacagaggaactaaagagcccaatggttcaactaagttgaagttgtctccatgagttaatcgaagcaatccactgaacatcaacatgatgaaagcacaaagataacacaattttcatgtgagttctagaaagatagctaacaagcataataagcatttagtagttctttaaggacgccatatgcactagtatggcatgggaacccatattttgcggaggaaaaaagtgaatcttttggccgaaagacattggttttacaacttttaacaattagtagcaaacttgaacgtacataggcagcacaaccgagagaaccaacatagataaatcaatagactaaagccacacaggataaattgaaataaaaacgatatgacaagaacaccaccaaacacttcatccaagcatccaaggtacagaacttaaaatccaaaagaactaacaaagaaaaatttacctacatagctacacctgaaaaattgcaacatgaacccacgcgagcaaaagaaaaaaacttcttttcataatttcgctgcgcatgattattactggaacgattcagcccatcagactgatgaaacccctaacaaacccaaaccaaataagccatgccaacaaagctcatccaagaatcgaagaaaagagagatcgataaaaatcggaacaacccaaccccacaacttgcatctgtcaggacacacaatcagtaaaacaaattcaagaaaaagaaatcacgcttcgtgcacataccacgcaccgccatccaatctacaccacgcgcacaactcaaaaaaaaagaaaagaaaggcaggaagccaagaaccgctcacctgcgcggcggcgccgcgccgccggccgacctcgtcgagcctcgcgccgaacccatccatcccggagaagaacgacccgccgccgccgcctccgccgcccccgtaaaccccctccacctcctgctgcgccaccgccgaagccgccgccgccgcggcgccctccatggtcggcggcgcgctgccgctcctcatcgggtcccacccccaccccgcatccccctccctcttctcctcctcccctccgccgccgccgccatcgccgaagggagccatcccctctctctcccccacaacgcgcgcgcaagcgaaacgaaaactcgcgtgtggttttgaacccaaaaccccacccccgcggtcgcgccgaaatgggtgggtgcggtttttggggtggtggcggcgccgagttagggttagggttttggttgggttttagggcggagagggtgggggcgcgcgggcgggagaggagaggaggggagggaatggaaattggggcccaaaatctggtttttttggggtggtttatatagagagaggatttcaggttgtgggtttgtttccttcagcttaaacctggagataaataaagaaagaaaacccttttctttctgataattccgtgcagtttttttttttggtataggagttacatgatgggactgggtagattcatagacactggatgtggggccagggtggtcgtgttttttttcccggtcagtgcttgggcccaactgtcagtgatgttgtttaaggtgggtttgttcgagtggatttaaattaataaaaaaatatgatttctctttttctaatataatataatacaaagaaggacgctgatatacatacactccctccggttctattactctttacgttttagacaatgtaacagtctcaaaatatatctttgactatattttttattataatacatataataaataaatatgaatacattgttatagttacttataagataaatctatatatattgttcttgagtctttaaactaattatttttaaattcattgctagtcaaagttataaaagtttgacctaacgttatccaaaacataaaaaattatgtaaccggaggaagcaaatgctattgtcgaaaaataaacacttatatgtagaatagattaaaacaccaaagtagtgtattgatttcttgatctcttccctgcatcatactactaggttatatttatatttataggtttatatagctctaactacaaatccaagtatataggtttttacatgcttatcttgtagatatggacatgtatagggctggttgtgtctttccacttcatattcagcttccaaggttatcctaggccgaacccaggtcgttagggagctggcttttttggaaggtcacttttcagggcaggccttcggcatcatggccccgacggcctcttcctgtcccagcgacagtacgccatcgatcttctgcagcgagccggcatgtttgaatgccacccaactgccaacccggttgatgctcgcgccaagctctccgcctaggagggtgcccccgtcgccgatcctactgagtacaggagcctcgccggtgcgctccagtatctcactctcacccgtcctgagatcgcctatgtcgttcaacaggtctcttcatgcatgaccctcgcgagcctcacctcgccttggttaaacgcatcctgcgctacatcaagggctcactctctgccggcctccacatcggcaccgtccggtcggttctctgactgactactccgacgccgactgggccagctgccccgactctcgtcgctccacctccggctactacatcttcctcggcgataacctggtgtcttagtcctccaagcgacagacgacggtctcatgctccagtgccgaagcgaagtatcgtgccgttgctcacgcggttgccgagtaatgttggctccaccagctactccaggagttgcatgctcccatctccactgcgactgttgtcttctgcgacaatgtcagtgctgtctacatgaccaccaacccggttcaccattgccgcaccaagcacattgagatcgacatcctttttgttcgggaaaaggtggctctgggataggtccgtgtgctccatgttccgtctacacaccagttcgccgatatcatgaccaaaggcttgccagtgcagttatttacagattttcggtccagcctttgcatccgtgagcctctcgctgcgactgcgggtgggtattaggaatactttgccatatatgtacagattgtattgtattgtttctttccttgtattctcctctaattgaggatcttgtacatgtgcttcctatatcaatacatggtcacccctcccattgggtgtgaggtgttctccccattccattctacacatacaaggacacgaagcaaatgtaggcaaaagggtaaagatgatttccaaatgagaaacagtgtctacggaaagcaaagtttaatcccaacgcgagactttaggcactagccagcccgctgctcctagatgtcgctctactgtgtactcctagatgtcactctgctcctagatgtcgctagagtagtaattaattgcatagacacggtctctaggttgttaattaccagtgattgctgcgtatcccacagttcgttagaggctggtgtagaggtggtgatagcccccaagatcaccgtagtcctccctgtccgggtacgaagtagagcgtgttctggtagcagcaagcaagccagtgcctgaagtattgagataggattaaatttaagctttctgtagacactgtcctcacttaggaaattctctctaccctttgcccatctttgccttgtgtcattggatgaacttgaaaaggaactagacacacatgtttcctgtggaaaatcgatgccttggaatagtcccgggtgaagtgctacatcgtagcaccctgcgcctgtggattttatttatgaccataagaaataccaacacttaccagtattgactcttgcttattgattattttgctgcttaggttgagtgatgcgggaatcatggatctttaggatagttcttactaggtgtctatccctagtcggtttgcctgtgtggtaagggcaggcaggttttccgctgaacttctattgaccggtcaactgcatatagatgatttagaccaatgtttctagctattcttaagttactttaattcgtgccttcatgtttctgatatcttggctaagataacagtgtgaagctagcaacctcctgagactagccgatcacaagttagagttttgagcaattgagatggtcgtgaaatttagcgatatgagtcaagtcccctgatgtaatacatttggtcgtcaccttcgagtagtttgatgggcatattttaagttgaagttgactgtcgggctattccatcgaagatctcctgtgctcactactcggtgctttgggttttatgttgtgtttggtgtttcgcatgctagatcaacgatgaggttggatggttactactattattatttaggtttaatttaatatcccatccaactaaatatttcatgttgtcatacttagtagcctactcaatatctagcccaggtgtcctgacaagagttgaatccatggaagcctaatggcgatggtattttttagataaattaacttgtgatggcattttgtgggactaacattcgtcgatggcaaaacatggaataaggttaatggcaacacttagaatatctcatgtaacattgccccctgtaaagaagttacttgacactcgactggagaatgacacacacgaaatggacagtcatggataccaaaaaatgatgcatgtcaaaattgaatatgccaaccttaccatgactaacaaaacttacacaaagaaaaccaaggtgggttcaccctaatgtcctcccttttgcaaagcacctcagactaatacacctttgagatta

SEQ ID NO: 80529 - DNA, 4811 bp, Oryza sativa
tttagtgtttttgagcagaattttttggaaggccgtagtaacgcatgtaggggtgaaaaaaaagctcgggctcgtgagctcagcttgggcttggctcgagctcaaatgccaaaggagccaagcccatgcctccttttcagctcgttgctgaaatgagccaagcccgagctagctcgtgagtcgctggtttggctcatgagcctaggctatcatgtatttatatggatgattttattttatagtgaagttattatttgtaattatgcaatttataatttataatttgtagaattgaatatataaacttattttagttatacatgtcgacgatttattattgatcatctacaaattatatatgaagagatgcttcaatgggaaggctcgcaagcctgctcgatctggcttgagccaggaaacgagccgagccgagctcatgcttgagcctagtttattgcgagccattgcaagccaagcctcgtttccacccctgcacgcccggcgcctcaggtctccatgctcaacctctcccgatctctttctcttcctattcttttatgttaccaaattaaaagcaagaaaagctataattttagtattaaggtgaccataattttaaatgtacatatctaatttctattctatctaaattgttcctgtatttataattaaattgacaattttagatccaatgttttgctatacataagtaatatgtcattgtggtcttcttaacgtctggtattctcggaggcattcggatgggcgatttctggtgatcttcaatggtgactccggcaccgccgggagggtggaatttctctcccggggatgcaatctgcgatgaagcttggcattgtttccgaccgccggttcatttctcctctaagttcagctcggttcctttccggttagtggtggatctacctcgctcaaattttcgtttaacaacttcttcggtggccttagccctcagggctgtgattggtggttcgcctgctgatctctctgtttcccttctcaaagatcgttctttctcttttttttgtctgctccaaacaagtgggtttatggatttatcgtttgagatcttatacttgcaatgattttgttctgcgcttctttctttggagaaatggtggaccaaattggtagtgggaacttgatgtttagagtcgtgaacaagagaaagaatgggtttttgtggctcctaagaaacgtgtttctgattctttgaggcaacctggtcgttcttatgctcaagctactcagcagcgggttattcctatgaagagtgtttttgatagattaaaggagtccttgaaggtgactggcggtgatactccggcaatcactgttccggtgaccaaagttccggagactaagctggtggctaatcccaaaattcaaaatgttagaggtaatcgggatcaactttctaagcaagttttaaattctaatttaatttgtgggcgttgctcagagaagggtcattctttgtctgtttgtgttgggccctttcggtgccgaatttgtaagagttcgggtcatgctgcccgtttctgtagctcaaagcaatctccctctgagggtaaattgccaaagtctgtttctaccccccgcattaatgcagttgctacggtcctaaactcccggggtaattgcaatcttgtttggagacctaaaaagcttgcgccggttatctcgtagccttctcgccttctccaatctactgttgagaatattgttcaagcctccccagcccaaagttccatgccaatggcagacctcaaccctaaccctcatcgtttccgccatcaaggtcacattgtgcatttgggaggaaatttgcgtgtccctagagttgatctcaccatccctcaaaggcctgttcgagttttgtgttgctttggtggagccgccggtgtcggagcaagattgggatcaccaccgcatgctaattcttcatcacattcttgatgagcgtctttttgaggtcagaaatagctaccgtcatgcttctgcggtgggtatgtatcaactccattctgctatgcatagagatgccctggtccatagtgggccgtttgtttatgatggagtgcattcggtaacttttgtgaagcatgatcaaggcccaaattggagagcatctcaatgccatagagagggttggttccttttcttggattaccaccttgactttattgattgggaccatctaaaccttgctacggctacatttggccaactttctttttggcttgaaagggatcagatcaaggggagagttctgataagggctaagttaaaggataatgattttgtgcctccaaaaattgtttttgcatgatccggtgggtatgggcggaggaggagaatcatggacagtttccgtgtttttgttggaaggggatttcattaacatggctcctgatgaagatctgccccctgcgggcccccaaccaaatcctaatggtctagatgatgatgatgatcctaatgtgggcaacatttggcagatggggcagcctcctgttggtccaggtgactgggatgatttggtccaacagcagcaagctgcagaggctgaggtagaggatgcttggggctaagactatccaatgggccaagtaatggaggtaaatcctgatggtctgcttgctttggtacctattgtttcagaggatgctagcccttctgttcctgctgttgctatgcctaatagggggaaaaaggttcaggacccagtccaagacccgaagatccaggaattcttagctaacttggataaactgactagaagtgaatatcctagacacccttatttttatccaatgtctggcctgaatgagaagattgacctcttgtgcaaagaaaagggaaccatgcaccaatttcttgcttctagttctgttcctgctgccatagatgtggtcaatccttttactgctcttgttttgcccaaaaagacaatgtttgatttttctcccttagtgggtcaagagacaagtgtttgggctccggattcaacaaagtctgatgttggccccctggaggcctagacccaagctgctatggaagtacttgatgtcatgcccttgtctattcagcctcccttcagcccagtttgtgaagcaccagctcttcctgtgttacctaaggctccaattaagaaaagagatgtcaaaactttgctttataacccttacaggaggcagagtgcaaggttgcagcagaataaggaggaagcagaactgcaagtggatcccagaatggacattggcaagccaaggggtaaatctgcaaagaaattgaaagagcttgcaggcttgcaggtatagcaaaaatctttgatgatagtagcattaaagagtctgattttactaaaagtgcctatgatgatattcattctgattcctttccatctgattgttctatctcattgttgcaaaagatgggagtggacatgtgcggcttaactcctgaggaggaagttgaatccagcatggggagtgagagaagaaagaagatgcccaggcctgacatggaggaaaaatgattttagttttcagatgtgttttagtagacctgtacttcccttttaattatcatgtaagggtctgtatttggaacttcccttttaattatcatgtaagggtctgtatttggacaagagcttttcagactttgtcatattttggttcagttgtatgcactataaggttatgttatttcaggctagttgtactagctctggttggtttctctttcaatcctgctttattcatgagtaattatataaatcttggaatgtgctttgctggaatattaggggaaagaatgcagagccaaaattgctctctttgagacagaaaattgaggactgtgagtgccaggttttttttgcattcaggagacaaaaaaaggatcattttgatctctcagatatcaggaagtttgccccaaaacgttttgattcgtttgcttttgcaccctctagtggtgcctcaggggcattttggttgtttagtcttcaagggtttttgtcggagctgtggcggaaattaatctgttctctgtgtttgttgatttcaatttgaggcatactgctcaaacctggtccttgacttgtgtttatggcccttgtggtggcccagagagatctgattttgttacttggtttaagaacattggcaaaatttgctataggacatccaaaaaatgcgtaattagctatgggacaccgtaaaaacgtgtatttgctgtagggcattgcaaaaacctggtaattagctgttggacacccacgacattattttattatttttggaggaataggagagagaaacagttgtgtaaatacggttatacccttcgattttttttctttttctttattcttccttattttttttttctctctaattctctttctctgctcttcattcaagcgagccccagggagagggagagcgtcgtgacggcgtggaccagtgcagcgcctcggctggggcggcgttgcgcggtcgtgcgcaagggtcgaggccagcacgacgcggcggaggtggcgcccgagctggagggttaggtggtgccggcggggttgggcggcgtcagcgcgcacgcaaggacggccgggctcagcgggcgcgaccacgccgggagcgcagcggctccgggccggatttgggaggctggaccagatggcgcgaggcggccgccaacggcgacgcggcgaggctcaagccatcgcagcgggcgctcttctcatgcatggaccttcagcacctgcaaacccgatgctgagc

SEQ ID NO: 80530 - DNA, 2569 bp, Oryza sativa
caaatttgtctttaatgattgtttctctctcctattcgtccgaaaataataaaataatgtcgcgggtgtccagcagctaattaccagttttttgcgatgccctacagcaaatacgcgtttttacggtgtcccctagctaattacacgttttttagatgtcctgtagcaaattttgccaagaacattagcattggtgatcagcaaaattggctttatttttagtgacttcgatttctatagatcagtgcaggatagaaacaaatctggagcagatatgaatgatatctttttcaatgacattatcagctcccttggcttgcttgagatccctcttaagggtagaaaatacacatggagtaacacgcaacaaaaccctcttcttgaaaggttagattgggtgttcacttcagctccatggaccttggctttcccaaacactacagtggtgcctttaactagaaatatctctgatcatgtgccatgtgtagtgaagattgatacaaaaattccaaaatcccctatttttagatttgagaattattgcgtgcagatggagggattttttgacattgttcagcaggtctggtctttggatccagggtttgaggaccctgctaaatgcatttcttttaagcttaaattgctaagaaagagattacttgcatggagcaaaaatctgtccaaattactgttgcttctgaccaactgtaacaaagtgattgattttttggatttggtggaagaaacaagaattctctcagtctttgaatggaatctaacagaaattgtaaaagtgcaaattctcaagttgcaggaatttagaaagatctattattagaagaagaggtgcactaacaggtggatgatgcttggagaggaaaatactaaatttttccaatctattgcaactgagagatacataatcaatgcagtgtcacaagttttggatcaaaatgggtagattgtgcagctacatgcacaaaaggcatctctttttcttcacagttttaagaatagaatgggagttacagctggtcctcaaatggcctttgatttgagtactctcttctcccgaagcacagatttggaatgtttggtggacatgttttccacacaggaaattgacagtcttatatccattgtcccagcagataaagcgcttggaccagatgggttcaatggtttctttatgaaaaaatgttggcatataatagctcaggactactacagattggcatctcattttcatgctggatgcacaatttggaaatcttgtagttcttatataactttggtttcaaagaagaattcaccagagacggtcaatgattacggacctatatctcttatggggctcagtttaaagttcctaaccaagctaaaggcaaacagacttcaaggggtaattctcaagctagtaagtgaaaattaatatggttttattaagggaaagacaatacaggattgccttgcttggtcttttgagtacatccatcagtgtcagcaatcgaagagggaaattgtttttttgaaattggactttgaaaaagcttttgatactattgaacactctgctattctttctgtcctgcaacatatggattttcctgaaaaatggatgcaatgggtgcaaatggttttctcttcagcttcttctactgttctgttaaatggtgttccaggaaattcttttaaatgtaggaggggtgtaagacaaggtgatcccctatcaccacttctttttgtccgtggagctgagctgttacagagagtaatgaataaagcttttgagttggacttaatctctaagccaattaatgaaaatgatgggagtgggttccctatcatacaatatgctgatgacaccctgatcttactcaaagcttctcaaaaggaaatcttctgtttcaaaactatcctgaacatgtttgcacagtccacgggtctaaaggtgaattttaacaaatccagtttgtatcctttgaatctttctcatgacaatgcttctttgctcgctggtattttgggatgctccattggttccttgcctttcacttatttggggttgcctcttggtaccactaggtctagagtggttgattttgcaccattggtggacagagtagaaatgagattgacagcaagctctatgtttttgcctcaatggggaaggttaacattgattaattcagttctttcttctattccaacttattatatgtgctctttgcaacttccagtcactgtcataaaggcaattgatacagcaaggaagagttgtctttggagaggcaacaacccatcctcaactagaaaagtttttagctttttgggacagagtatgcacacctaaagataagggaggtatgggtgtgattaacctgagagttcagaacattgctttgcttttcaagcatatggtaaaattatataatggtgttgagctgccatgggtgaaactgatctcacagacttattatgtttctagagcaccccatctggttttgaacaagggttctttctggtggagggaatcacatctctttcagatattttcgggctgcaggaa

SEQ ID NO: 80531 - DNA, 2130 bp, Oryza sativa
gccacagcccggcccctactgcatttcccctctccgcctccggaacaccaccgtcacgcgcaccacctctcttcgccgccgccgccgactccagccgcgcgccaccaacactcccaccgccgccgtgctgcgccgtcgcgcgccgcacatcgtcccccatctcctttccccaaatcccccaccaaaactccctcctcactgccaacctgagaccgccgccgctttcgccgcctcggccgccgtttaccgccgctcccagccatcccgagccatgccgtggccacccccagcgtcgctgtgttgtgccgcacctcggccgctgcccctcgctgccggaatcccacgggagcccgcttttccccgttcaaggtgagcttcaccattccttgccgcctccggccgctgttttcctcggcaccacgccttccccgtgccacctaaactctctatccccttccccagggtcccggaggtccccggccatcactcgtcgcccatcggccgccgttggagcaccaccgctatctcgcctccgtccggtgccgtgccgcttggtgagcatctgtaacaccctgaaaattcgaccaataaaaacaaaactctaaaaatacggaccttcgaaaactttttaaattaattgcatcatgccaattttattcgcctattttatttggatttgatttcgaagttcattaatcgcaaataaagaatagttaattaggaataaaccctaaaaataaattggcaaaataaatataatttaaaataaatattaggtaaggatagaaataaataaaatattattgcgaccatatttgtatgaattaaatttaaatgcgatggaataagaattaactctaattacattcaagtaaattatataaaaaaataaaaaaatgggtaatattaatcttgagtgaatccattggttggaataacacaaatattgagtaaaattcatatatgcaaaaattaggaattatagaatcaaatttatataggaaatagactaaaatagggttaaataggaaaagtcactattcattgccccctaggtgttcgatcgcgttccctagccctaacccctcctctgccgcatgcgcctggccgccccgagccccgtgccgcccgccgtcgtgtcgcgctgccgcccgtcgtgtcgtcgctttgcgccccgtgccgccgcgcgccgtcgccgtcgctgtcacgccgccatgcgccctgtgcgccgcgcgccgatgccgtcgcgttttgtcgccgctgccgcgccgcgcgccgtcgcccgtcccgtcgccgcgccgtcgtcccgtcgccgcgcgctgctttcccaggccccacgccccgtgccctgtcgcgcgtcaccgcgccgccgtcccgtcgccgcgcgccgttccctcgccgcctcgcgcccgtgcgccgctcgcccgtcctctcgccgcctcgcgccccgcgcccgcgcgccgctcgcccgtcgcgtcgccacctcgcgccccgcgctgctgccgcgccgcgtcgtcatcgcatagccgtcgccgtcgcgccgagccccgcgccgacccgcccatcgcgtcgccataaggccgcccgcccctctccacgccctattaagcccgaccgctccttttttccaccccacacacatcccctccatctttccccctctccctctcccccttctccacgcgccgccgttgttgtgccgccacgccgccgccctttgagccgccacgccgccgccaagaagccgccgcgccgcgacttgcaccgttgtcgccatcatcgccgccgccgccgctgtcggtaagccgccgccccccccccccccctcgcgttcactgccgttgccgcccgggtgggcaaggagccgagagagagagggagaaaggagccgggagggagagaaaaagaaaagaagagggagaggaaaagaaagaaagaaaaaaaagaaagaaagagaagagagaaaaagaaaggagaaggagaaaaaaaaggaaaggaggaaaagaaagaaaaagaaagaagagagaaagaggaagggaaaaataaatagaaaattagagagaaattaaggaggattagaaaatttaaaataattagaatttaattatagattaattatagtcgtagaat

SEQ ID NO: 80532 - DNA, 53324 bp, Oryza sativa
catcactgaattgagggtttgcatattgatttgctagaattagggtattttgtgagggataagggaccgagtgcataaatttaataccaacaaaaggtgtaaccaaaactggcaagacattgatcaagccagtaaaactgaaatttcagttaaacaggtgggtttctgccatcttagaataagggggtcaatgtggaagggaaggccagaagctcaatgtgcctggtcgtacagatgcacactctatagccttggcatgcgtcttggacaattttaagcaatgtatgctttatcatctcaaagttgatgatttctagtaatgctgattgggtgaaggagttacatgggtggagagagctcctggaggtctgcgaggttgagaaagaacatgagcatgggacttgtcatggttgtggttgggacgggaccaaacaggtttttgtggctggcccagccaagcattagtcaacatgcatgcccagcccttgaaattaaactgtagatgagaacttgttaattgtgaatttgaagaatgtgagccagtgatgcacttagctgtagatcattgtgctggagatttggtttccagcgcattccatttacaactaccaaatggctgaatcttcgatgtttgtttgaaatttaaattcaaggatatcgttgttttgacggctcaaacttcaaagtaaacgtttgctgctcattggatgctggttataagtgactagctggatcttccaaaattatcttacaacggtaaacttggatcgtgtagttaagaaatctgatgttcgttatattgcttattgtaactgggatttgcgtattgggttaattaagcgaagctatagtgtgtttaattgtgtgggacacttggagaagaacaaaaagcttctgtttctgttcctcttgattggtacaaggattgttcttgtattggaattgaactaagaaattatctgtgattgctttcttgtagttgtgatctgaatctttcctttgctaatgcaatttttgtgcactcaatatgtggtcaataaatcttatttctagtgtattcagagaataaaacaaaggacttatgtatctgctctttctgatgatagataattcttttatcagtattgcattttagattttaggttgagacattgcccggaacttttcttttgcctatttctgagctcttatgacctctttggcattgtaattgtcatgtgatcctcctaatgatgttttttttttccttttgctacaatggattgtcttcatgtattcgacgtgcatgcaataggcaagaacacatatcatcatgttacttgcgattttgcctttctgccacatttcttaaatcttgactttaaagtttgacagaggagagctaattttaacaagatttcaccttgtccttgcagatgtattatgttaaccaggaacttactgttgaggatttcctttatgatgataattacaagatgtatcttcctggatacaattcagatgttctcaataatctggaaagtactggtcagctggaatatccacagttcaatttgccacaagagttaccccctaatgcatatcttgatacgagtaactgtggacaaaatgctggagatgttttcctccacatgtcagacttgctcaatacaatgtctccagtacctgctgcattcctgaggcccaaatgcgctctcttggactgccctcggcctgctcaaggatcagaaaggtggcaagattattgcagcatgtatcatgctgatttggccgtgaaggaagagggtccaccaggcacaatgcctgtgatccgtccaagaggtatcgatttaaaagatggccctctgtttgctgccctcagtgcaaaaatccaaggaaagcatgttggtattcctgtctgtgaaggggctgcaactgcgaagtccccatggaatgcacctggtaagttattgctacataactcctcccattgtattggcatggacaagtgtttgaattaatcgctggttcatttctatcattgcagaactttttgatctgtacatttttgagggtgaatctattagagagtggctgttctttgacaagccaagacgagcatttgagagtggaaatcgaaagcaaaggtcattgccagattacaatggccgtggttggcatgaatcaaggaagcaagtgatgaaagactttgggggtctgaagaggtcctattacatggatccacaaccatctaacagctatgaatggcacctctatgagtatgagatcaatgattgtgatgcttttgccctatacaggcttgaattcaagtcctctgatgcaaagaaaactgctaaatcaaaattagcttgtaacccactgaatgaaatccagcagcaaatggttaggctgagtgcagatagccctgtcgaaaacaaacggtctgcccgcagcaggacaaaggctaacccaaatgatatcaatagcaacatctacttagttcagaacactacagttcaaggcagtattccaaatgcttatcaggcagtgtcacaaccggaccagatgacgtatttgaatggcaatgttgtttatgggcctcatctcccatacggttactcaactgaaagaagtgacttctattggagctcaaatgatggagcttgaagaagggtaaccatattttatcaacggcatatttggccttcaagttctaacagctccagctatacttatggggtctaatcttattggcatggcccccatcattctaattgtcatgggttgcatcaacatggaacctcttcgaaaatgcctgcgctgcagtcgtatttgtgcacaataacttcgacaatgtaatatagcctagtgtcttgacatagcatctcccttggtgcagagcatatgtaacataaattgccaggtttgctagacttgtaaccttttatgtgggtctatcagctatttgatggacccgtttatttgtgacgctgtatatgcatgaggctgttctgaatctgggagcaatgttggtggcctttgaaggcactaacctgttgataaaattgtgttctctatgattgaaccccaattacatgcttgagatgaaagcatcttgtagcaatattcagctggttcgttatctgttctgctatgctgtcgatggctaccaccatttttgctacagcaacgagactactggtacaacataagttgatagaacagcagatgcctaaactgatgaaagttgtcgattgaagtggcatggagccatcaatggttcgttctttgatgtctggtctggtcccaactgtctatctctgaaagagaagttattcctttgctgtccagctcctgacaagcctcccaagattccgatgggaccattatgttgccaatgaaaatagcgtcactggatgctcgttgatcgtgaatagaggctttatcgttccgtgaaaatgacaaatatctgatgatatatcggtacacatcagggattcagggtccatttcttatgaatggaggaagagtcattatttcgataaacttgattctaacatacacatctcccttaatttcctaatcttgggctgtgtaatagacgggaagatcttacgaataagacctcttttagactcctttggaacacatgaattgagaaaaaaaataagaacgagaaaaaaaaatcataaattggacgtcatgatatacacaatcttgtaggtattgaaatcgcattgaaattaaacatatgtttgaatattccacaagaaattgaataaattttaggggaaaatattattagaataaagttaagaggagagataaagtgccttctacttttctaaggaaataaacacaaagaggtttgagctcatatgtttgaaatctaaaaaaatgagggaaaaatgattccaaataaagtttgctagtccaatatttcgatgggggcccttattggttgcccatattttctaataagttgtttaatagcttattattgaataaaagtcaataaaagtttgtttacaggtaggatttgatatatgtgttcttttagcgacttaaaagccaatgctgaaaacaaaactacgttgaaaatatcttaaaattaactccaaaattaagtttaaatttttaaattttagctttggtttttggcttattagggcaaccaatgaggctttgagttatttgcaaatccaattctttaaagaaaactaaaaataaggggtttaggcccctttgattcaaagtaaattcatagaaattttagagcatttcattcctataggaatttttcctacaaagccctttgaatcaaaggaatgaatcctatggaatcctatgaaattcctatggaatgccttttcccatacaagttttagaggaaatttaacaagaggtaaaacctcatggaaaaaatcctttgagtctttatctcacctcaaaatcctgtgtttttcctgtggtccaatcaaacggttattcctatgtttttcctgtgttttgcaatcctctgttttacacttatattcctatcagaatcctatgttttttctattcctctgttttttcattcctgtgatttaaatgggccttttaaattctacaagaatcatatagaatagcgatcatatcctcgtcattccaacaccaaaggcagagagctacaatgctccatgccattaactatttgcctatttccagccgttggatcaaacatgggagcactagatcaaccgctacaatagtctacagtaaaccaaaacataacaaaccaacattattttagggtagctatggtaaagtactgtagcatacctcatattttaatgttcaattctaccgttcggcccctaatggctaacgatgtgaatctgcttctaccattcgccccttaatagcttagaataagtgacctaaataaatagtacaggaaagtttttgagaaaaaaaacatatttttagaagcgtgtagcaaataatcctcgataataattcaaccaataaatttaaaaagggctaaccatgtcatgaaaaagtagtattccttaacactcactcactcctttgaattagggtatttatgtgatgtccctaacaaaatgaatttctagctctcagaaaaataaaaacgtgagctagaaactcgagccttgatgttggccaaccacatccaaatccatatgtgatgtccctaaccttcttcaactctggagcgacgagagagtggtgataactacaacgagcgacagctagcgggcaagacgaggaacggatgatggcaacctccttcaactacggcagacgatggaatgacggtggtggcgaaggcgcgacagcctatggacaatacgtggagtaggcgacaacaacctcctttaactctgatttgacaagggaacaacgatgacgacagggcgcaacagctggttggcaagacgaggagcgagtgacagcaacctccttcaacaacgcacgatgatggaacgaaggcaacgacaaggcacgacagtcagcggcaagacaagaagggtatagtgatggcctcctctagctcgtgcgtcactgatctccactaacttctagagcgctgcaaccttctcaagccgcgacacggtggccgggaatggatgaaagacagggacgactgccgacgagcatttctaacattggaggcaagaagaagagtgaagagtgtagtgttcaggatggtattttagtttagatagtctgactgaagttgatattttagcaaagcccataaaactaataggattttaacaatttaggggctatttgattgatggccataagttgccacactttgccacacttgaggttaggcaagtttgaccatgttagatgagtgtttggttggcttccacaagtgtggtaagatttctattttgtaatctagatcccacatgtaagtgactctaaaaaatgtggcatggtttcattttgttggctagagtgtagtttggattttgatggcctcacctttggtaaatttagctaagaaagtatgataaatctagtcaatattagtacgtaaaccaaacagctcctaagcttatataatggtgtactacaagtgcaatttttttggggaatggttaccagtacgtacggtgcacgcactcgcgcagtcggtcgcgtcgcacccgattctcagcagcaccaccaccggtctccatttcctccccagattttctcgttcctcagcccccaccgccctgtaaaaagcggccgcggcggcagtagggtttcggattcccaccccgcgtgcagcttaggcgaaccctcctccctccgttccacacgccccagttccccgctctctccccctcacctcctcatcctcctcctccgctgccgccgccgccttcgccatgggcagggggaagttcaagggcaagcccaccggccgccgcaacttctccacccccgaggagatcggtaccgacgtcgcgccctttcctattttcgattcggccctgtttcgttttcactgagaaatctggtgccagccgtcagccgccgccgccgccggcatgggcgggctgctcgatctgatgctgcggcgggggggttcgggtttcgctaggctgggatgtgctcgtagaacacgagcggctgtgaatttgacttgaacgcgatgcatagagcgctttttttttgtgatgctgtacgggttagcatacaattcgatggtgtttgatggtttgggtcgtggaggagggagtgactcgttgatctaacatgggtcttagcttcggtgtttatgttgcctgattttgatgctcatgtagtcaggcacttatctgcatctttagatgcttggctctatcccatgatgcagtagtacagctcgattctgtttcttcgttttgatttattagttttataaattccagttcactgtttcagatcttcacggaataagggtttgtgtggagtttaaacgcagtgagaaatcgattgcacctctgtctttatctagtctcagacaaaggaactctgttgagactgtatacaggagtgcaataatatttttaagttcttgatgtacaattgaagaccatttctttttagtttgtgcttctggattttgatttcgtttttgatatcctgctaagtgcaatatatatatttttacttgcttctgatcatcttttccattcaaataactgcagctgctggtacttcaggtcgtccacgcacatttaagaaggttcgtccacatttctaccatgtgtcgctcctagatgaaccagaaaaaaaaaacttttttgtcagttacacggtttaggataatattaaactaaactattttgcttttggcatttcgtatttcaccgtgaacaatcattgtctgaatggataagaagaacaactatttcattggttagttttgtttgttgtcaaagcatctgttccagtgcaaagaatagcacatctaatcgcttgtatttatttatttatttatattctgggcgtttccagtatccacatggatgaatgttgttaatccgcagtaatgaaatcaagagcattgcaattgcaaatgtttactcaattatttgcaccaaaccttggtttgtttcaacactaccttgtcatattcgttctaatgaatgaactgagtatcaaatagaatttagctgaggaggaaaaggaggaggaagaagacgacatagaagaatctgaagaggaagaatctgaagatgagtctgaagggaaggctgtaagtaatcttactctctgcaagtatatgttcatagttcagttccttttcttacctatctgacatgttgtgcaacaattccagaaacataaaggaactgaaggtcttattcagattgaaaacccgaacttagtgaaagcaaagaatataaaagccaaggaagttgatgtaagttggtgactactgataatattttggactatattttctgttttcccccttgatcttcatactatttgatagttacgtctgaatctttttgttcatgtgtaccaattagtatatttttcatgcgtttgtccaacttactttgcattttacagctcggaaagacaactgagctctcgaggcgtgaaaggtaccttttcttatttcagtccatgcattgtgtttagctgttcaggaaaattttaaggtacaatacttcaaatatgtttgaattatagagaggagatcgagaaacagaaagctcatgagcgctatatgaagcttcaggagcaaggaaaaacagaacaagctaggaaagatttgggtgagaattcttatctatattatgtccacctcttcccttcttttggtgttccttgttggttgtagttacttatgtatttatatcgcatgcgacctatgagcgttcattaaatctggttcagtatacctatagaaacagacactgtaacaaaggaaaatagcttaacatgctagcatgatgtacaaaatttagtatcagtaacaatggataaatcagggccctttaacccagttgatatctttaatcagatataaacatcagtgggtttagatttgacatcttactggacattggatagtactgattcagtaccgatactagcattatactaaaaaaacaagttatatgtggacaaatcctacaattcttgcatatttttcagccgacttcactgatcttatggatgaagtttttgcgtcttgtttaatgatttttaaccaaaaatcttcttgtattctttctgaacttcgacctgaaaatttactaatgcaatcctcttagatgtctcacaatggtgcaaatgttttccttttactcttcaagataattgtctttctagaacaaagaagattctattttatatgtgagacgcacatctaccatttaatgtcagattcagtcagaactgtccatttgacattattatatatctttgtagaattggcattgtatattttttttgggtgcgttcaatattgaagaattacctgtgaattgccaacagccatgaccctttataattttgcaaatgcagaacgtcttgctttaataagacaacaaagagctgatgctgcaaagaaacgtgaagaggagaaagctggtacatctcccttgctatttgtatattgcttcatggttttggttttcttgtgtcattcagaattggttgcagacatatcatatatgaaaacatattgtttgatcatagcatcatggagtgtatattcaattgcttgtgaaattttgatgcctttgtttactagttttgataacattatgggtgcattttgcaggtaactaagtgtttagcactgagatgaagtgatgctcattttacacattcagttagtaacatgttttcttagattgcaatatgtatactgatgttaattttattcttggcagccaaagaacagaggaaggctgaagcacgcaaataactgcggcaaccatgtggacaatgaaggcgtgagctgcgtcggctggatatttatttcttatatatatgcccctagtatcttttaaactcggtctcgatttcgatatttccataaaattatgcattgactaactgtagtattgtcgacgtggcttgatgtaaacttgagcttggcagggtgcatatgtagtatgatcagtttatgcaaaatttgcgtttacttacgttgatatataaatcaagaacgttgtgaatactggagataatccatggtcatgctgcttaacattaagataacctagctatcttctttaggagaaaaataagactaatcatcattgagaacctgaaatttctcaattatgcccaacatcaagaagtcagctagtgtccatacattttgggctttgatctttgacaaggcaagacctgtaggtcgtagattcatactgagggggttgatcgtaggctcgttgcagtcactccatgctttcattcaaagatcgtaggctcgtagcagtcacttcaagctttcactcaaaattgcctatgcgcaagctgaagtagtgacatcctgtgattgctgattttgaatgatatgtagcgtcgtgcacttctggagttcttcatgggaattaatgagatataaaattaaaaccagatgactgattgattgacatgagaaagcaagcaaaaaaagaaaagaaaagaaaaaaaaagtaaggactcctttgaaacacaaatgcaaacagaaacataaggataggaaaatcgtagtatttaagtgccatgtcaccttaaatttatagatggaaaaacacatgaaaacaatagaaatgatcgttttgatagagtgcgggaaaaacacgggaatcagaaggaaaatgatcgtttggatggagcacagtaaaaacacatgaatgaagaaaaatggatgcaaatgaattttttaaagaggtagaacctcatgttaggaagtctccaatatttcagaatcctctaaaattttctatgtttggaggcaatcctgatgaatttggtgaggccatttctatatttcaaatgaattcttttcataggaatccaaccctccaaaattcctttgctcgaaaggagccttacataaaatttggttgcgattaattgagaaaagtaagtagataggagtatattttatgacaatttgaactccataaatagctactccctctgtttcaaaataaaatacaagcatttcacatttgatgacgcttaccttagttctaagagaatacatacttatcacatcaatcttcttttttttcttcaatttccctccacctccaccaagtattttctcctcaaccttattccaccgtctcttatttaatatgcgacacaaaagtcgtttctcctcaaccttattcactgctataacaacttggaaatacttatattaatattatgtaatagtaagaatattttaaaaaggggaagggagtatgttgtgtattaaaaaaataaatttcacaaagtcatatatattttaaccaaactattacaaaattacatatttaaatcagtgtatcacaaaactatagaattaacaatacagttattacgaaattatagatttaagacaaagtattgtaaaattgcatatacaaacttatctaaagcttgaatctaactttagtgccaagggtttaaattttaaaatatatagttttgtgataacaatcaataatattgtatgttttgtgataacaatcaatattgcaccagtagtttcatgatatttggtattaaatctaaatctatagttttgtgaaaaaatggtgctaaatactccctccgtcccataatataagggattttaagtttgtgattgcaatgtttgaccactcgtcttagaaaaaaattgtgcaaatataaaaaacgaaaagttgtgcttaaagtattttggataataaaacaagtaaaaaaaactaaataataattctaaattttttttgaataagacgagtgatcaaagagtgcaaacaaaaacgcaaaatcccttatattatgggacggagggagtatacagttttgcaatataatgtcttacatcataggtagatcaaactatatgtagttttgtaaaatttagctaaaaaaactaggaaactctacaaactcatgtcaacctgtcaacgattttatatctcagaaaaatatacgacgtaccaacgagcggtttcatgatttcatcagaaagcgaaatgttcgaatatacggcattacgtgtaaaacaatgctcatgacgaccttctgtacttctgtcttagttcatgcatcatagcgtttcaaatgatttcctttcatctctcagtaacacatgcccatacaaatgtgaacaaaaacaaccagcatcaaaagagactatagctgtcattttttcagcactcaactagaaaagaatactatgaccttcaagggcaatatctatggtcgttccaacaattactgtaaaaaggctatcaaaaggtataatcgccttccagaggtaatccatgttaccagcccacccaccctgttctgtatttctgttatagcagtagctccaatcacgggcttattcgttcttagcatgccgtgaatcattatcatcccacggctgaataaaattttcatgctgggtcatggtgaggaacgctggcagcacttgaaaaagctatccgccaacctatacataaataggatgcatctgcgccttttggattattatagactaatgtagcagcactcacaaaacttcgtttagtgtcactgaagcttcaatccattggtttgtttttcatcatcttacgtttcgtggcatccagatatttcttccgaagccgaatgaccttgggagtaacctgatgaagctcaaatgtcaatatgaaactccaggagcaaactggaataggagttggaacagttaagcttaaatcaagcaagaagattattttcttttggtaaaagattgggagtaatattccacaaaataagattattttcttaggataatctgcacttctaataaacaaaaaaaagctagcagcatgtagagtaacttaaatttggatttgaatgtggactaacatgcatatattgtagcatgcattttgttttgtaggctgcattcctacattccaacccatgcacagagaacacatctctaatttagatttctgataatcctttacaaatgctagtagcaaactatatagcagaaactgcaggtggatgcttattgattgctttctttgtttggttcttaatattgtttgtaacatgccattgtattatatggtagaaataacaatgcacccattcattagcctgcagaatctccgtctggcagaggatttttttctgaaatgtaagtggttttatacattggcaatagtcgtcaacaagtcatttcaaaatccaaaaaaaaaaccaggattttttttttatttctagagctaaaagtaacaagccaaaaaagaatcggaataagaatcgggaaaaatggaaagctcatctctatgcgctgcttgtgccacttagtcctcacacaagtacaagtagaatcatcaatagcaaatacagaaaacttgcctcaataagctcatctgcagcaacatatccaattgcctcttccaaactcatctgcatgattcagtgcctttagttaagattatgtaacaatcatttccgaggaagctaaaggaaggaagcaaatgacatttttcagcaaagaatgcacataatctagatttatggtctcctcagttcccaaaacccaagggagagtgtgacgcgaatattataaagcttgcaaggcttccgttggtattaagttgttaactagtgtttaaagcagcaccatttagtctgtagggtgataaagtgatatctcctgaatgctgatgtcttggtaaaagttaaaacacaacataccaatcgtggtggagaaagcctgacattttcatcctttcctggagctcgaatgtttgtaagttctttagttctcacaggattgatctgaacaacagaagagttatttagtttgtgtattagaagagaaacctaattcattgataagcatataatcaacttacatcaagatcactgtcacgtgagtgctctccaacaatcatgccttcgtacgccttaaagaaaggagaaagaaagaggaataaggaaaccccctactcttagatggtagatcatagtaacaaaatgaataaatgtcgatacctccatcccaggagaaacaaacagaataccacgagcttctaaactcataagtgcatgtgaagtgataagtcccttgccgacagatacctacatatacacataagagcacttacatttgtcatgttgagttgagcagaataaggtgcagttcatcaaatcctgcttacatttaatgacatattccttcttttatttcatttgcttaattcttggtttaaaaattcattgctgtctattattgcaaaataatgtaaaacttgtttggtatgaagacagataagagtaaacagaagaaattatgaaactgaaggaattggcattaccagaactccttttctaacattgcccagctgacctctgtatttagcatatgctgcaatcatagagaaaccaaggtcaaatactctcaataaaatctagttggtggcatcaatggcgtggtttacttcaaaaaaatgcataggcgagttaaggaaatcatctaggacttaataagaaatagcataccctggaaagcgcgatgcataaacccagttccacgtgtaaagctgctgaatattcctttgaatcccaccaaacccctgcatacataatgcatcatttcgtatcataaaaaattgagaaccagactgaaatacatggcaaaagacaatcgagtccaaaattggcatcaactataatatgcttttgaaggtgacacatcatgcagctggtaattatatgcactaatcacctagatgggcaggtcaaaaagatccgagttctcccagttgtccctggaacagggcccatgtccattacttcacccttcctgtgtgtcagggtttccatgacaaatccaacatgctcctcgtctacctacaatatgttcaaacattaacagtttatgaatacaagtttagaacaaagtaaacaactaaaaacaaagaagttcaaacaaggttccatatttctacctcaacagttacttcttcaataggctctaacctttctccacggtctgttctatacctatttcaattaatacataaattagttaatagtgggaacagtgctgccaaattgctcagatacagagttcgatatcagtggaaagtgtatttccacagaacagggaatataactacttcagggtgaaacaaagtaatagaacaaaatatctagctacaaacggttagcttctctaatactgttggaaagaaaattgaactaaagaacttcaggctgaagtgaaaacgtaagcatacaaagagtataatatgtggaatattggtgctcacatcacttttgggggtgaaactgaaagctcaaatccttcgcggcgcatattctcaatcaagattcctggaagttatgcagatcatcaaatgctatagttggcaggaaacttttcattatattgtacacgaggttgacgtatgaagtgctctcaaataaatcaagaaaaaaaagcagttaaatagcatatatcagaaaaagaagggatttcatcagtggtacatatacttacctaactgaagttctccccttccttgaacttcataagattctgataatggtccaggaagaacattaattgccaggttcgtttctgcttctgccattaggcggttgcctattttcgctccagttagctacaaaattttagatggacctcagaaaaagagggcagctattattgcttgatttattgaatacaaatttatattactatagcaccatacagattggtaattaggctctttccagactatgtgtagtcagcataggcaacctatgaagttgatttagaatagctgtggttggatctatctatgtcattcaaacaaaggagatcgaacgctggtgtgttttacttagaggcaccaaggcttccatactttgcatcgttatatcctaatttaaatttgaccgcaccattcctcagaaacaaatgacataaaacttcacattaaataaaagtatgtacatactgcccaaaaaccagcctggatagcattgcaaaaacacctaggaggctagtaccataccttggatttagacctccaagactaatggtgttagcttcttagtccttactctcacctaccaatttaaaacttcattcagaggactagctccaccgatagatttaggaaaacctatgcgctagtaactgaattcagatgattaaaaatgtatggtatgtttgccttctgattattttgacaggaaaattatgatctagtagtatcatgctcagcaagtcaacatttgatatctacccattatttgtagttcaagacttcaagtagtgactatgaacaagatctagtgatacaagttatattgcagtgagcaaatgttatattctctttttcttaaaaaggaaaaggtaaaataactaatatatttcagtctgcaacaaattttcagatccaatatgaattaactagttccttaaattttagaatcctgcatatgacatccccaaatccagagcaacatagtgcgtggaagttataacaccatctgattatcatggttccattaacatattagcagctcctacaggaatctgaaatctatcttaaaacaataacctaactttaagcaaaaaaacaaaataggaacatgaaaagcaaaataagaacactttgatgtataggaaaacaaaacaaatatgcatgaattttcatcaaaagcaaaaaggacaatgaaaacaatatgaggaataaataggaacactttgatgtctaggttaattgtttgctacttacatgagtgccatcgcggccagacagtggtgaatcattcacaccaaaagtcatagatattgtgggagggtccaactcaattgtaggaagggcagtcaaaatctatattgtacaaccattattagtacaaggaatatctgacaatagaaacacgttcagcagcacgaattagcaacctacatctgaatttgacacagtatgcccaattgctggagcagccaatccagccattgaaattatgtcgccagctcctgcagcctctactattaccatacttgttcctttctttttcatgagcttgacaacctgaatttgtttcagtagtttgcaaaggtccttaaggcatttaatgaatacaataatttaaacatattgaatgagaaaaaagtgtcttcagcgtttaagcattgccgagaagaagtgcaagaaattcagttaaacctttccatcttcgatcttctgaacaccatcatctgtgctacgaagaccatgcactttgtcaccaacacggacaaccccagatcttactcgtccagtcagtattcgtcctagataaaaatcgcgttccatcatggaaacctgtagaagactatgaattactggctccgcttaagaattaccagtacaaccttacataaatatcttcagaagaggtaaatttaagataaattctagggtggggaattagagaaaacttgcctgcaaaagttaaataacacacatttcggaacaagaagaagtgtgtgaagtcttaaattctgaaaaggaggtggaatcttacaaatagctattgactaagagtggagaaaacttggccaaaaacgaaggcatcattttgttttggttgctaaatcaagtggaactctattacaaataaacaaatcgccataatacttagtcgttcactcattctaataaacatgtcattagagatggatggagaattacaaaagaaatagcaagttttccctcgtctaaataaaatatccatttcagatgctgtgcaatacactaaccaacatttggaatggagcctcaaggtcagcttttggagaaggcacatgctgtaaaatggaatcaagcaatgcagacatatttttcgcattatcaggagggctcttggtgaattctagagaagcccagccttctttagccgatgcataaagaactgggaagtctaactgttcttctgcaaaacccgaataaaatagtgtcacatatttatgaaaaaacttccaaggcaccaaattgaagtactagaaatgcacctgtagcaccaagatttgcaaatagatcaaacaccaagctctctacttcattgcaggtctcttccgaaactgttggagtataattggttagttaaagagctatagcaaacataatatactagggatatatatatatgccaaaaataatgaatataatgctttatctatttctgagctggtgtatcccactgcagttggccatttttactttgtgggaagtgaatatatcgcagtagctcatctttcaaacaaaattattgctaacgctaaaaaacattcaatgctaataacaggctactcaaaaggaaaggccttctaactaaaaattacatgactggatatttctctttttctgtaaacatagaaaacaaaaggtagcctaattttgtgacgggaaatggaatattgtgtcattttggataaaaattattgtgtatttacccccaaagtatatgtttctgtttatctgcttaaactaaattacacatcaaaacttcatacttgctcagcttaagatcgtagcttgattcatatctaagacaattgaatcactttgttatgtacatgccatccattgctcacaaaatactgccatagtgagcagagcatctgagaataagcaaacctgatggcctgtcaaccttgttgagaaggagaattgggcgcaagccatacttcaaagcctttgaaagtacaaacttggtctgcgctaaaggtccctccccagcatcaacaaccaagaccgccccttcaaccattccaacaactctctcgacctgtcacataattggtgaggatcatgtcagataccatagaaaaatcatcatttcttcttgttcttaactgtatgaaattataaaagagtgctgagtgtgtacttcgccaccaaaatcagcgtgaccaggtgtatcaaccatgttgagttcgttctccttccaagagacagaagtgacctacacaaatagccgagacgaaaaaagtgagatgccacataaaaagttaccatactgaatgctatgcagctattggaccatcaatgaagaagtttcaacaaaaaaaaaaatcagaaggatgagataatgattatctcagcagatcagatttcgggagtgatttattgaactacaatagatgtgcaggctttacggagtacagaatgagcagagcagttgaaccataagtgacataaatcctcccagaaatttacttacgcactgaaatctgccaaggtgctcagcgatgtataacagggaaaacagtagcgcaagtttgagaatggcctttgaagcagatctcacttccttccccaagccaacattctaatccctcacgtgatgcacgcagtatgttcgacggaatggacatttaacctctcgtgtgccctcactaaccacgcggcgcgcgcgagtggtggaaggtgggttaccttggaggcaatggtgatgccgcgctcgcgctcgaggctgatggagtccatggcgcgctcgtgtgggatgtcggcgccgcactgccgcaggagccggtccatcagcgtcgtcttcccgtggtcgacgtgggctatcaccgccacgttgcggatgcgggacgggtcgagggcgcctccgggccccagggccggggaggcggctgccgacgcggcggcggccgagtagaggcggcggaggagcggcgagacgtagggcgccggggacgaggcggaggtcgggaagacagggctcgtccggctcgccgccgagcggaggccgcggagcagcatgcccgtggccatggcgttcgcggcggcggcggcggcggtggcgtgatatttcgcgcggccgggagaaagggaggcggctgcggccaagggttttattcgggcgtgtcactgcgacagtttaccaaatgtataaaagcccatctgaccacaggcctgggtagtttgtcctgggcttctttcggcccaatctctctcccgtcgagccggccgcctccgccgctggggcgttccacttcccgacgggcgcaggcggccggcgtcgactctctcctgtccaacaccatagttgtggcggccgatgctatcgttaaggatcgcggccgcctcgcgcctgcgagggctgctgggcggcggcgcagcgaccggggcgcgcacacgcgccttctcctatgggagggtggtggatgccgctgcccgggacggcgagctccgagttttcgtggtcgccggtgaggtctcaggcgactcgctcgcctcgcgcctcatggcgtctctcagggcgctctcaccggtccccgtccgttttgctggtgttggcgggtctggtatccctccctttccccccattttcgtttcagtacttctgtggaatcgatgtactagggcattataacttgagtttgtacattattttaggttgctcttaaatcggaccagcatttgtccaactttttgtttgatttgatttttcatgtcaattttcataggtccattgcgtgcttatagattgtttcgtttcacatgaacataaacaaaacttccattgttgctatgcttggcatgctcacacagtcaaagaaagacttattttggaaccgcttacttaaagtttttttctgaatgttgttggaaattaaattctaattgtattgtacgtagagctagattcatcgatgcacacttgaaatgctcaaatttgcatatggagagcaagacagagtttcagccaataccttgagacttgagcaaggtgtctagcatttagtggagagacaagcaacagatttttcattgtaattcttgttacaatagtatgtgatgctcttctctcttgtagtaggtttattaggttgtagcacattgaagaaacagtaaatttttattctaagcaatcctcaatgcttggcatataagattggaaaagatgaagagaaaagaaagaaaattgggagcaaaatggaattccagagttaggggattggattgttagatgctgacctatataagggtattcggcaagtctcttggatctaagcaacaaagatcaatctataatattccccctagttcatcaactcatcctacattccgcttctcatccctagcagccgatgccgcccggctatccttctggtggtgtttaatgcaattacaccttgcccataacagtgtgtatccatctgtttaattatgaagaaagttaactttttgtgtggtcaacattcccatgtaataattaattcagcatcattgcatcatttcacttctccatctatctgagttaatccaaacccaatttcaagttggattccatggttttactgcaagtatgatccttgagtttcttgcctcttaaatggagctcaatccagactcaatttcaagttggatcccatggctttacttcaactctgatccttgagtttcttacctcttaaatggagctatggactcttttctttgatgtagggaattaatgcgcaataaaggcttgcagtcactttttcccatggaggaaatttccataatgggattgtgggaactgctgccacacatatataatatcaaggtgcaatgttgttctgtctcatactctcatgctttgctttttgttcatgttctctggacttgtattttaattatgctcattttggttttacagaggaagattgaggatactgcagatgctgctgtattgtttcagcctcatgctgtagttactgttgattcaaaggggttctcttttcgcctcctgaagcaattgaaatgtaagtctattagcataagcattttttacaataccattcctaatttctcgtgagcaaatatgataaacactttctgttgtctaggtagatacaatcaagttgcccgtcctctacatgtccactatgttgcaccatcattctgggcctggaaagatggtgaaagaaggcttgcaaagttgcataattttgtggaccatttgttgtgtatccttccatttgaggaagaaatttgcagattaaatgggttgcctgctacatatgtgggccatccattattggatgatgctattggcttgaatatggtatggacttacgtgctttgtttcaacatcagtgccatcagcctaatatatttttgttgaattttaagacattgctgtccaaatctctcaacagttttactgcactttcttaagtgtcttctctatccagttatctcgttaagatttctttgcataaatgctttgcactacacaatgaatgcaccatctactacatagaatggcaatttaatgtaccagaatgtttctctctataaccagtagctattaaattactactgccgatgcatagcagcagtataagagaataaaggtaaggttttgtcatttattcattttataaagtgatcattctcattgatgtatagctactagtagcttcttttctagttcagttgttaagatatgtgcacaagcatctagtgtcttcatgggaatgagatgaagatgattgtgcgaaggatgtactattgtctttctactctgttaggaaaaatgttggcacggatggaataactagtaatggctgtcttatcgcaggtgatttaaatatttcacgtgatcttttatcaactaagcattttgatctggatactattgtctttctactttgtttcgaaaactgatgacatggatggaataactagtaatggttgtcttgtattgtagatgaaatatttcacattttcatttataaactaagcattttgatctggtaatctggagatgctcatggcatgtatataaattgctagtgctaatccactgacttgacttacatattctttatgcttgccaaaataatataggagaaggaactatcttctgtcaattccatgcatcaacgaagtggtgaagattttcgacaggagcatgaaatttccccaggtagattgtatgtgtaattatttgggtgtgcttcttttagtggtaatgcttatgttttgtttttgttttctgcttgtatttatcagttctatgaattatatatctgttatgtggtttatccatttctatgaacttagccgaggagacagacagcatcacagttacatgttatctgttaacagtgcaacttcaaatctgcaaactattcggcagttgcaactgccatttaattttgggcacacttgcacaccatcacttgtcaagtgctactatactatctttctgggtaatgtagtattgtataagtgaaaactcatggctgctgcatcaaggtttaataattcctatataattcggtgctgttagagtagtcgttgcaaagtaatctattttttgtagcaagttctaagtagcttactcataatatggtgctacaatcagatcagctttcaataatgagatgcaaagcattttttttacgggaaatgcaaagcatatattacacagatatttcaactttcttgtgaattgcatttatcataattttcacatgcaactctggtaaaacatatagttaaacctgaaagctacatgtataactgagcacatattgttttctttttatacactgcaaatctgcaggactatgcctggacctggatccttgcatttatcatgttatcttgtgcatctaggcattcactgaaatcatatctggatatactgctccaaattacatgttatcttgtgcatcaatagctagttagttctcctctatgaagctgcatcaatttttttttcataggcttaatcttatttgcatttttactctgtgttatttatatgtgcttgttttctaatgagaaaatccacttttgctagattccacaatcataaccatactgcctggaagcaggatgcaggaggtagcccgtatgcttcccatcttcttgcaaactgtgcaacacctaagtcatacatttaatgaactgtcactggtcatcccagttgctcctcatcgggatgtgagggtatatgttgataatgttgttcgatcagggccatttccagtggtactgataactggggaaacactaaaagaaagatatgatgcattcaatgtaagctcacatgattttagttctcgagtgccaattcaatttttgggtactattattttgaaatttggttatgtttcaaagtatcttatctccccaatgcttatatcatggacttttgtttttttacggaaggtttcatatcatgcactgcacctgtaccctgtgcttgctccagaacagtgttaatttgacaaagttccctgaattgctaagtctgtatctgaagtacattttcttgttgcaatatgcagacaaaaagttatctaatctagaacactgttgattactgcagctagtagattgtcccatgcatgttgttttaacatattctgtccctttcactcaggcagtatatgaaacaattccttaaccacagtaagattcagcattattatgaatgattagactagttatacacataagaaagattgtgtcagtactagttctttgttttctagagaaaaacatatttatttcttgtgaggtaccatatttttgttaaggtgcatctgttacgtcttttttttctcaaacacgtatctgctacacctcaagccaacatatcttatagtagttatttctattaatgaaagagaaacatgaaatttatatgatgtaattgatagttaatatgtgagacagatagcaacctaggtgggcttcttgtgccagcagcccagtactcgtcatgaaatttcattggtaatgtaattgcgtgctaaataccgcaggtctgcagtcgatttcttgcagtttccagaattcatgtgagtaaactgaagagtgttgtttcgtcttgcaggctagtagagcagcattatgcacttcaggaacagctgtcatggagctgatgttagcaaagctaccctgcgtggtagcttaccgggctcatttcatcacggaatgtttgattcatctgaggaaaaagatagactttatttctctacccaacattcttttaaactctccaattgtccctgagatcctttttggggcttgcacagcggaaaatctagctgcaaaactaaggtaatgtcccccacccaaagaaaaaactcatagatatgaacatagttatctcccatggatagcatccatatgggtataggtagcagtattcatatagattcatatgccttgacatgcctgttagttaacacaattgcttaacgtgcttccattgcttctttttttctgaatgatgttcattcttcattattgagaaatagtatgtatgtattcgacacttggacctgatcatatttcatcccattttgatctgaccagtgaggtcatttgtaatgatgaagcccgtcagctccaagttgaatcagctgaacagttactggagatgctttatgaacctatcaagcaacgaggtggcctatttcaagaggagctgcacaactcgagcctgccgtcaaatatctactccccaagcacgattgcagcattgacagtgctttatacagataaccatcaacaagcggtgcaccagaattgagtggatgtcctcagtagcagacaaatatttttatcagccgtgatggtcgctattgcgtgcaatctcatcttctccgtctgctgttcgtgatgaagagtgtactttctgcagatcctattggctgccctaggcccacaattggagaggcaaaacgagtttttaggtaaaaaaggcttttcagttcttggtttctgattctgaagtgccgcatgaagtcaggtcagcatcgtattatcattatggaggatgggaacgcatgtgttctggtgggtttagtgcgggtcctggtcatcattctgcgatgatgcgtttggcgcaagattcttccatggttagaatttcctggagtgaacagttggcagttgatatgtgagaacaattacaagagatttttcggatggttttgatactttcatggtcatcgaaattacgagatgaagtatgaacggatgcacagtaacgtcatcaggtctgggcttgcttgatggctgctctagccatagaggatcctcggtcagtgagaaagcatagattcccacgtagccggcgatcacgtcacggctgagctcatctaggtggtggcccatgcacgagacggcgaatcttccatggaaaatatttcgaaaattgttgcttcggttttaattacaagttgccggcattgccagtgttccacttgggaatatctaacgcttttcttataacgattttacctgccaactgcagcatggcatggggaaaagtcttgagccatcgtgtacttaaattgtgtaatcatctggtgccactagctatccgtgaacttcaggagtaagttgatctagaatggtgactggtcaatggaggccttgtaattgtaatttgtaaaacaatctaatgatgtaacatctcaaggcattgccagtgtggtcgcggtgcatggattcgtttccctggcatctcggtaagaaacagtaatatttcagtatttcacagtgataagtgattattagcattggacccggtcactcggattctgttcttttcaagagttcatacataggtcatttttttaatgtaggtttttaaaggttgtttatgaaaatggtcttaaaagtattccttttttatgaacttggctttacacaggctaaactgtcatcaatctagaacgctgcactttgatgatatcttggacatatcgccatgttacaatattttcttcgtgcttggaaagcacgattgatgccttcaagtgaaactttgctcacggaattggtatcacaccacgaaagatatcataaaaaatgtgagcactaagcacagagtaacaaactacatgacatgctcttggtaccactgtaccatcaataaggcagaacattaccacactaacactcaggccaagtgcctactgcaaattaaccctgggttttgatcctcatcctacgcgctgtacatgtcaaactgatcttcatttcatatcacgcactcaccgtcgctcatgccgacctgcttcgcggccgcggcggcgccgcgacgggcgccgtcaccggcgacagccggcgggaagttgagcagcgccttggcgccccgcatgcggaacgcggcgcggtcgtacgccgcggcggcctcctcggccgtgccgaaggtgccgagccacagccgcgcgccgtgccgcgtcgggtcacggatctccgcggcgtacttcccccacggccgccgcctcacaccgcggtagtgccgcccgccagcggcgccgcccctcgccgccgctcccctgcctccgcctccgccgccgccacccttgcgcccggcggggtggccggcgaccaccggcgccgtcgtccgcgcgcccagctccggcgacgacgacgacgacgacgacagcgccgccaccgcggaggcctcgcggaggacgtcgaagaggaccatgtccagcgagtcgttctcgttgagcgggaggtacgacgacggctgcccgttggccgcgcgcgccagcgacagagacacgtccacgcgtggcggcagagcaccggcggcctggagcgcgggcgcggcggcgaggcgatcggcaccgacgccggcgccggcgctaaaccccaaggagagagacatgcggggctgtacgcgcggggcgcgctagctcatgagacgatcgagagaggtggatggatggagagaccgagagagtggtttgcagtgtggtgtgtcaggtaggaggcgatgcgtgatgttgtcgcgctatttgaacccgaggaagagctagcactggaagtctggaactctggaaatggaaggattaattatttttaactaaagtggggccatcatgtgtcatgcaaaatgtgatttcgcaacctcctcgggtgcaaatcatgtggttcggttcatgcatgctttggcctttggccaattactcccatttttctacgtagttttgctgatgaaatcggccaatcggggtaggcccatccatccaccgttggagcagccagctagcgagcagtagcagatattctgtacggagaggcacacggcgagcaaagctaggcttttcatgtgtagctaaattgtaatatcccagttggattccttgcatctcacgtaggcaaagatgtaatatagcgctctgtttattaatgcacggatatgcatgtatggttacctactctagtgaccaatagaagaagatcctcctctaaggctgtgtttggctctcagggttgggaacacatatactgcacacgaaaatggaacggtgcattagcgcgtgattaattaagtattatgtatttttttttaaaaaaaagatcaatatgattttttaagcaactttcgtataaaaactttttgaaaaaacgtttagcaatttgaaaagcgtacacgaggaactcaagggtatcgaacacagcctaacttaacttcgcatgcaattgagtcactgatatataagtcccactttgttatgttccacatgtcagtggttcaattacatagtagttagagcacctgcaatggtaaattaaggtgctctctataaaacatgtacatctcaacaataaactagattaatagtaaaccatctcaatagtatgtctacatgggtatctatagctctctaatctattgcctcgtttttctatatagactatctccaggttagtatatagctttgctctctctattcatttaatttctttcaagtaagaaaatatgctgatatgaatattttgtagagagactataaataaccattatgggtgttcttaagttagaggatccctttataagggtccaagggatgggaggggttaatagcagttgatttcgagtcggctcatgctgtctcgctactactccagcttttaactttcttttcctccattattttttctttcatttcattgattcattctttattttttcagtagcgcttaatagctttctcgtgggggcattgacaggatgtggagactgcgtggacgctttttagcgccatatggtacacacacgtctgaattcttgggcagaaaagcaatacaactaattcttggccatatactccaaaagagaagaccagagaaagaacttgggaaaattcactgcagagccgtggcgtgatttggcacgtcttccttttcagatcggctaattattctggatcttctgtgaccgatcgaggccatcgacgtcgtgccggtgcggcattacgtacgcgcgcaaacgtaaacgagagtgagagtggccgaagcgacgacgagaggataggggcagcgatcgattgggccaggccagtggaaccttccaaagccacgtacggagacagcggtcgtcgtcagctcgtgttgttcgcgaagggccaagagcgttttctaatggctactacttctagacacagcgggcagacttgagctacccgctccctcgacgatatcggtcaaggcctcaagggtcaaaggagcattattgatccatccgtttcataaaagcaacgtcgtaatatagagtgcaacccattattcaaatttatagtagtagaatatgttatagcccgtgttttatttttaagagtgaaggagatatatttgactgtcattaccggatcgatgtggctctctctaataatcacccatcataaatgcatctaacaaggttatttgtgcatcgttgcattctcaagaacgtggcaactcgttagattaaatttaaggttatatatatgtgtcgcactatcaaacccagtggagcgcgcaatcggtaataggctcttccctgtcggcctgttagaccattaacattgggagcatcgatagttcgattcctgatcaaaagaacaaaagggaaggggaaaaggaaaaagaaaaaaaacacgtagattgcgcgaccgttgacgatcttcggcaagggtatagcacaatggtgttttggaaagagcgattcatcgaggtagcagtgtatgcttaagtataagttgtcatctccgtgacacatgctttatttttctaagatcggatggagaggcaagagggggatgtgagggagggaagacttgtattcgattctatcggccgacaagttatgctcgtgcgggagtagtcatccatttcattgcgagttccgtcttttgtgtactttctttatcacaaaatttaaaggatttatagattcgtattaggatgtatctatctcatgtatttaacatctctatatgttaaagctcacttgtgataatcccttagggtgtgtttggttggtgggatatatccggataagacatggctgccactttttggagggtgtttggatgctgggcgagagtgggatagggcggcccagaggggaatattccctccagatgctggatagagggatccggctgatttggccggatgcaaccgctcgaggctcgggtgagccgagcaagcgagttgcgtgactcgcgtcactcctcaccaccacgacgcgagcgaggcgacgagcgcggcagccggcgagaggggcgacgagctcggcggccggcgagagaggcgacgagcgcggtggccggcgagagtggcgacgagctcggggcggcggcaggaggaggcgagctgcgcggtgggaggaggcggccggcggcgggaggaagccggtgggaggaggctgccagcggcgtcggcgagcccagatctggcgctgctttttttttcttttttcttttttctatgtgtatttataatggaatgtgtatttataatggagtgtgtatttataatggaatgtgtattatgtattaatttgatgaggtatattcaccatctcaagtgagaggtgaccacacctacaaatccaccgtacttcctccaaccaaacaaaaaattggatcaccagatccacctttgttcctacaaccaaacaaaaaattggatcgccatattcacacaaccaaacaaaaaactagaccgccatatccagcaaaatatggaccgccgtatcccatccaatcttgaccaggaaccaaacacacccttaatttttcagtgggtatggttgacttgacggacgtactactccatactaagtcgcttaggacaatgtttaagtcaaatcttgggaatataaatcatgaataaccctcaagttgttgagtttgaaaatataaaaattatatgaatagatttgtcttgaaaaatacttttataaaagtatacatatatcacttttcaataaatatttttatagaaaaaaaaatcaaagttatgttttggagaccgtgtcgttgtccaaaacgacttcctttacgagtatggagggagtactgtttggttcggtcgggatggacccgaactccttgagatcagcacacccgggcggactgcgagcgcatccaacggcagatgacgacccaaccaccaagtcgtcgccaagtctcctcctccgctcccgccactctcatcctcctccacctcctcgccggcgccgccggcgccgcaccaccgctcgtcggcgtttctcctcaaggtgacggcagagccgcatacctaggcgttcgctccttcatatcttttccttactcgacctgaccaaatagcctctgcagacgaggcgtacttcgcgccggcggtcatcgcctgcagggacggctcgggatccttcccgaagcgccgcctcaacgacgggtactgcgactgctccgatggaaccgacgagccaggtctcccaccgcctcgatctctgtttccgattcggcccgaccttaactgcgaaatgcgaacttcggggtcttggggatctggtcgatttcgcgtgtgtgacgagatctgatggaatattgcgttggatgttaaaattggtgtgatgggaatatttatcttgttatggatttattacttgcgatagtacaatcctttttttcccaattcaccaaggagaaaaatgtgcgattttgttagtaaaaaaggatgtgatcttgatctttcagaggacatgaggaatgtgcgatttttacagtgctttcgaggattgcttttgctgtgttttacgccaactccgtgctaatgcaaatcatagattactaacatatttagctgccagctacattaaatcaagtttattgatagtattgtggcctgccgttcgtgtacactccctccgggctggtttattttgggacggagggagtacagctgaggtgagccagtgaccggccacaccgccacagcattcatttgtgacgttctgaatgctaacatagaaaattcttccacatctatgtgtttatctgttgcttcatagtagttgataatagcaccaatgcaaaagatgttcactaatataatgctgtccctcacattatttgtgtcatccaggtacttcggcttgtccagatggcaggttttactgtagaaatgctggagacacccctcgtttgttgttctcgtctgttgtgaatgataaaatatgtggtatgctattgcttttttcacaaaacaatgttaatatcaagagaatacagttttttttatcctatgttcaagttctctgtttcaaaaaatccgcttccatttactttcatcaatagcaaattttttttactgtgttttgttatgctcttatagattgttgtgatggaagtgatgagtatgaaagtggcatccgttgtccgaacacttgtaggaacataaatgatgttagaaaggatgatgatgttggtataaacagaaagggtgttatgaaggatgacggcgttggtatgaacataaaggatgttgcagaggatgatcatcatgataggaaacgtactctagatatagaagatctcatccaaaagctaaaaggtattatctctgttcagcatgccacttagatgtagccattccaatggatgtgcattttgttaaatgtgattttaattgtcctgtttgcaggattaaaaatggctgtagtcattgagataggtcttgttatatgtacatttgcagtctgcttcgctcggcgccgtaccagaacacggaggagacattatattttgaaacgtaagaaaacatcgcccccccctgcatattaaatcattttgtcttgtctagtaggaattctgtagatatcattttttgaagtaaagggcaggagcgctgccaaagtgccattcaatggaagaatatgattacaatagcgacacaccaatgcctgccacagaagggcctgaccacttaggccagtggcaaaactatgattacactagctagataagctcattttgtaaacatcatattctataacctaatttacttggtctataattcataagatctttacttgccaacgaacttatgatttttgaaattttattggcatgtctatttccttggcgtttaacccagtgagatgaccctctgtgtttaacctgtccgtttctgataacataaatgggagagggttcacctctctttctcaaaaagaaagaaaatcagtgtgtatttattgatagtgttatttgtgtaatattcctactatgaccagatttctttgccgcataagtatatggtaaaagtgtagttttacaaattaacctttcaggaccatcagtagctttatcaccatgtgaagctgctgtgaacacatagcccaatttattttcagtttgtgatgaagtattctcggaaacagtataaactcaccatagaatttgtgttttattttcaggataggtgagctgtcactcagaaagtccaaagattgatatggagtacaatgatactcatttgcaatcctcgaagtctccaactctccaaggatgacgggaaactggagatagaagaagggatttacacgcttgctcatcgagacgtctggaacatcaagtcgaggaaaaaaggcatcacgttgtatgagtacgattatgtgttatttttgcccgtattttaggtctcctcagcagagttgctggttgaccaaggccaggagatgatgaaatccatgtagagatgtaggataaactacgtgaatatggcatcagctggcgacgcattattgcgaggccttcctaaacttctctgtaactgtgattctgtgaagtgcactgcaatgattttaagttttaaacagctaataacatagatataaaaattttattcataaattaattttcgttgctttcttcattttattgtggcttatcaacaaggctcctcaaattgcacatgctaaactgctgctcccttgttctcgccataagctaatactaagggcctgtgggagagtttttgcagctgcaacttctctcaaaattagaaactcctaccacagtctagttttttattcagattgtaagaagtggttgtagaatccaaaaaatgaattataaactagaagaatccaaatccagaaataaattataagctagaagaatccaaaaaataaactataagacagaagctaaaatctcagcttctccatattcttacaagatctcagcttctccatattcatagaaggggttaccaaacagctatttttcaaaatcttaacattacaaacctcaagaagctcagtgtcgcatcagtttgactgcatttggcccgtttggggttattacatatgggcttcggcccatgatggaaagtccagcccatattcaaccattccggccgattagggttttacaccacctctctccgtgctcctcctctccacactcgcctcccctataaaagtcctggacgccgcaaaaccttccgcgccgccgccatctcggaccaccgtagcacgccgcctccccgcccagcgacctcggcaactccggcgaagatgggcgccttcagggttagcaccatctctcccgcttcctcccctccacttcgagggctggtttgatctcgcgagatctgatctgacgtttgcttcgttcttggtttttgcgcggcgcagttccaccagtaccaggtggtggggaggggcctgccgacgccgaccgacgagcaccccaagatctaccgcatgaagctctgggctaccaacgaggtccgcgccaagtccaagttctggtgagggttcggatccccctcgcgaatgcgccattgtttcgcgcttggtttaggtgtttggatgtcgttcagtgacgttactttgtctgcgtgcaggtacttcctccgcaagctgaagaaggtgaagaagagcaacgggcagatccttgccatcaacgaggtgatctattctttcccaccttaccttagtctcatgcgtgcatctcggtgctttcctttctgcagagtataatggcgtattaatatcaatgttgagcgaactacttagttctgcacttttgactctatatagtgtgttcttaatcggtgaaacgaaatgtactagtcatttcatgtgccatacaatgttattgctaatttttacacgaatgctagtctatttcactgatgtctttttttccatgctcggtgttagatttgattgcctactgctagacttattgtcgttttttttcctgatgtacaactgtgtatacttgtattatgacttattctgattcttctgctgtacatttaccccttggagattttatgataaattatgattgtggatacacaatgatttaaattggctgagttagttcacgcttagtttattatcagctttttcaatagtttacctgataatatttccttttgttgttttatctgcagatttttgagaagaacccaacaactatcaagaactatggcatctggctgcgttaccagagtaggactggctaccacaacatgtacaaggagtaccgtgataccaccctcaatggtgccgttgagcagatgtacactgagatggcttcccgccaccgtgtcagattcccttgcattcagatcatcaagactgctactgtccactttaaactctgcaagcgtgacaacactaagcagttccacaagtcagatatcaagttcccactggtgtacaggaaggtcaggccccctaccaggaagctgaagacaaccttcaaagcttcaaggccaaacttgtttatgtgatccaagtcgccttccatgttctgtaagatctgccagtatggtgtagtcgtagttcagaacttaagatgaatcttatccatatgaagcctgtttttgaaaagttctggtaggtccatgctgcggtctctctaggttctcgtatcgtatcctggtatccttttcttttgctttgtgatcatctgatgcctcatactgacaattcccagtttgcgttgatattggtttactgaaatattataacgttgctattttgctcactgcttatggtagcccaattgaataatccgtaaaatcatagtctgattgaactgtgtttcaattttcttgctgtatatgctaatcttagtgacttgcatcaattgggtgttatgtgcttattacgtaattctgtaaaacgaaaaatacaagttaattcttcatgattgttttttgtttcatgctttcatatttcattggttatttgtttggcacaaccgcacaaagctttagctatctattttggctgatattgggtatgcatcattttactgatagggatattgattgatgctggataaaaatgtttttcttgcatcacattcaaacttttgagtagttaggatggcaactttgccgaggttaccaacagttaatttggttccctttttttccctgttgccaatatctgattaactcttgggtgctctctcttttccataaacctagtggtttattggataagcatcctagctaacatcagctgctaaaataaagtagttttactttttaagttctcttactagtcgcattgtgaggttttgttaggcaactttgccgaggttaccaacagttaatttggttacctttttttccctgttgccaatatctgattagctgttaggtgctattctttccataaacctagtggtttaatggatgagcatcttagctaacatcagctgctaaaataacgatgtacttttaagttctgatcattctttcgttttgttttcataatctaattcaatgttctgtgactccataaatcattttttttacttgggctttatatctcttcctaatgcaagacggtatgcaaattttggtcatttcaattatgtacaaactcatcccagttgcatttgctacctgtgaagttgttaggcaactttgccgaggttaccaagacatgtttggtttcctttttttccctgttgcctatatcattagttgcttggttgcttgaactccattgacctatttggttttttgggtatgcatccatgccaacatataatattttccatcattctttttacacttagcactgcccaaatgttggtttggttcgtggactgagattctcgggaggcttttatgttttttgatcgaatggttcgtggtttctttgctggtttgtggttattttatcttcttggagtatatgtttgtcgagataattgttgatgtaaatgcagtcgtaaagctcttaaacgaactctaccaacagctcttattccgaaaaagtagctaaactgaaggatgaagaactctggttgggcggccgagcacctgcagcatcggccactgccttacgagtacttttcgtctgtgaggtcgactcgacatcaacccttgtaattccgtctgtgtggtacacaggatttgttatttagtaattgtaaccattcaaattatctactgctattcatttaaagttttcaacttacctagaagtgttttttgtcgctcgtcaatcgtcatgataacgaatgctcatacaacaaactgaaccagacgatacggacgaaactgcatgaagctagaatagctgtgtgttctagcagtgttgtctcgtagtaatactgtacgtaccagatcgtccagtacattcaaaattttcaccaagtgaagaactgagttctggaatcgttaagtgaagaactgagttctcgaatcgtgtgtgatttgtatagttccgagattagtactccctccgattaaggttttaatacgttgttagtaaaaaaaaggttttaatacgttttaattttagttaaagttaaagttaaactgttttaagtttgactaaatttatagacaaatataataatatttataatactaaattagtttcatcaaatcaataattaaatatatttttataataaatttattaattgaatatattttcataataaattgtctggggttaaaaatgttactatttttttatacaaacttggttaaacttaaatcagtttgactttgattaaactcaaaacgtcttataatctaaaacagagggagtactctctctgtctcattttaagtgcaactatgattatccgtatccaactttgattttccgttttatttgaaaattttttaaaattagtatttttactgttatgaaatgataaaatatggatagtaatttatacgtgacttatattttagttttttttaaataagacgaaaaatcaaagtcacacttaaaaggaaatggggcggcggagggaggactagtccactgataagtgataacgcatcattcaaaatgatcccgaagtgaaaaccgataaattctcaaagaggtgtgaattagaagtcaaactgcatcgacccagctgtccatggtcttcttccgttcgccctcgctttcttcccgcaccaaccccgcctaccgctccaccactactactacaccatcccctccaccggctccccctcaccaaacttccctccacgcctgcttcgcccaactcgttctcttggagcacctaactcgagctgagctcccttcccgcggaattcgggtccctccctgatggcggagccggagcagcagcagcagcaggcgaatcccgacgaggtaccgatcagccccacgcgaacgaggccattttcttctctcttgtagtatgtggtgtggtgagagtgagaacgcgcggcgccgtttctttgtgcaggtggtgctcgggcaggagaccggcggcgcgagggtggcgatcctcaaccggccgcgccagctgaacgtcatctccgatagagtggtgcgatttctttcgcttcgtgcattttccgatcttatgccggaagcagcagctggaagctgtaattggctgggccgtgctcggtttctggttgcaggtgtatctcctcgcccagttcttggagagctgggagaaagatgaggatgccaagctggtcatcttcaaggtgcgcgcactgctgccctcttagcaccctgcattgataaagctctagggcagaacataactaattataattcagacaaggataggttttagcctagtgatgtcatgcgtgatttgtttccaggagacagctcaaacaaatcatttaccttactctagtttgtttcttcaaagtccttgcaatgcatggagcacttggctagtagtacaaactatgtagagaaacgtgttgcttgtttaaggattcggtaaggtgtgcctggtcaacatttggactttactcagtagttagtactgatacataaggtaacgttttgatatggataagtttggcaataagacagcgatgaaatgaggcgtatcatgtcacaaatgaaactttttgttatgactttgtatgatacccatcgattggcccaagcatatgaatgtatggtctgctgatgaacagggggctggacgtgcattttccgctggtggggatctaaagatgttctatgaaggaaaatcaggtatggatatgatatgaatgtttcagtgtagcagtggtaccacatcacatgaccttactgtataatttgatttccatccccaagactcacatttgcgcacacttgatggcatttaaacctattaacagaactcctttgcagatgactcctgtctcgaggttgtttacaggatgtattggctttgctaccatatccacacgtataagaaaaccgcggtgatgccctcttttatgtttgtgggaggactgttttctaacttgggggcgaattctgtactcaaattctatggttttatttcaattcatgcaggtggctcttgttaatggacttgtcatgggtggtggtgcagccatggttgctccactgaagtttgcagttgtcacagagaaaacagtatgcaacactagtccatagtccagttcttttggaggctttttttattccatattgtgttatatgtttgtttgttggtttgctgtatttatctgtaaaagtgtaaatcacccctctacatgtcactatctcttcaattcagctagtattattattttggcaaaattggttatatagcatcaaaagttcacgtttttggtatgaaaaaaatagaaaggagagaacactcctattcttgaaacggacccatttggtatcatgattactctgtcttgggagtttcacggtgatgttttttgtgtgtttaggtcttcgcaacccctgaggctagtgttggattacacacagactgcagcttttcttatatccattctagactccctggatatttaggtaagtactgaattgcattttccattcagaggtcaaaccatcaccttactacaggcgtattgtctcttgagatgtaatgagaaatctgatagtgacttgtgtgacaaattaaacatatcttaggacaatatggttctgtaatgtatcacttgacatagatatttgtgccaatatgcttattctctttgaataattcttaggggagtacctggctttgaccggtgcaaggttgaatgcaaaggaaatgattgctgccggtcttgctactcattttgttccttctgaagtaaggcattcagcatttaccattcatattcacgatggttccggtgcatgatttcctcgattgttctacatgtagctcgacaaatcaaaatgtttgttgatatattgtctttctgtggttggactaaccaaaaatgattataatgtgaatggcagaaattggaagaacttgaaaaatgcctgctgaatttaaacacaggagatgagtctgctgttcgagctgctattgaagagttctcaactgatgttcaacctgatgaagatagtattttaaacaagttaagaactgatgtccttttccaaatgtaacttgctgcgcatgcatttattattctattattgaaataaattgacactggaatgacaatcttacttcgataggctcccaactatcaacaaatgtttctctgctgagactatcgaggacatcataaaagcttttgtaaggattctttcaattacttgcttgaaaagtgttgagttcctcagactatagaatattcatcttggtttcatgctacaaaataatctaaacaacaataagtggacagtattcatcttatgcccaaaatatatcatcgtcaaccaatagcttctggaaaaactagacacagtacactcaccaatcaccaccagtcttcactgtcctataacaaggcaatcaactttttcctgcaaatcataagtagcgtcttttgttgttgttgttgtttgtaggaatcagaagggagcattgatggaaaccaatggatcgctacagtactgaagggcatgcgaagatcatctcctacttcactgaagatgactcttcgatcggtacaaactctgacatcgtttctaatgctgatgattttgtctcgtcttaataatatttgtgtgcttcttatgtatggtgaatgcttaaaagctatagtagctgtccgcttctccttggttaacaatttatttatatgttgtgcagtgtactaatttttgacatcttgttatgtattgtggtgcatttacagctcctttttgcacaaggcaagaatgtattcttaatattaatggttgttttaattcttcagatcagagaaggtcggaagcagagcctgccggaatgtttgaagaaggaattccgacttacaatgaacactctccgatctgtagttactggcgatgtctatgaggtactgtgatttgccactatatgaataagtaacggtgattcttgatacaggcaagactaagatgtcattcatcataatatttgcacctaaaacttggcagggaattagagctctcagcatcgacaaagacaatgcccctaaggttctctcatacacactcttaaacatgtctagaaatttttatttttcatactgttttttaatttttgttgcgatacagtggagtcctgctacccttgaggaggtcaagaacgaggacatcgaccgtcttttcgaaccattcagttcagaaaaggagctccaagtcccatctgacgattccaacaggtgaacaattgctccaaaatccatttcttttctctgcccttcacacaaacaacagtgtatcctaatcatctgcactatttccaattttgacatggacaatgcacagatggagtggcaaatttgagcacacagtctatggcagaacttcagagtaattggcagcagaaatagatgttcatcatcctcacaagcatgttttaagtactcgtaaccccatgtattctcatacttccctgtataacattgtaacacaaaaaattgaaaattacataacgcacgaagcaataaagcatctcaaatgttttgttacatcctgaagccaatgaataagaacttttccggcgtgtgatctctgtaaagagaattgcaacctaagggttaaagtctagggagtgaatgtatgtccaagagagaccagtcatgtagcgacttgagagccctatgagcagttgggctccacaggatactctaactccaagtagtattgtttgtacttggtagttttcttctgagtgggggctttcctcactgacaaaattctcctcacagcagcttcttggtctttcgggaactccaccgccatcttcttcaggttcgttgcttgagttagcagaaagataaagagttccttctggtaccgttgaggcctgaatccaagaaacttgagctgctccaaactcttagttaggcatgataactttgaaagcctctcctcatgatcagcaaaatttggcaatgcagtgtcgtcttttgcatcaacagcctaagcatgaatggcaggtagataaattagtggtaaacttactgatgaaactcaatatagtaaagatgctaatgtgaatgcaagagtgaatgggtgatattgcataccgaaagagtcaactgttgcaggttggggcaactctcaagcagcttcagaaggaagatgagttctctttcatttgagaaatccaagctcactgacagtattctcaagtcttcaaattgtacagccaagtttggagtgtctttatattcagatgacaacaactacaaaataagacaaagataaatgaccttctgaaagagcaagagttacacatgtgttagaccatattcacattccgatgttcagttgtgtgatttacactccagctatctgtgctataagcatataatgttgacatataaattatcgcttcatgttaatatctatcaaaaacgcattttatcaacaccgtgtcatttgaacagtgcttaaacatcaatgcaacattgcaaataggagaatacgagtattactaacctactacaaagctcaatgtctgaaagttatacagaacaacacatttcctgattagcggtttcactatggccctgtccagagaaaagcaaattattcatgacagtgcgaagcattgccaaggaatatttggcctagataactcctacattaaatcattctattatggatgtaatctaagaactgttttacattaatcacaacttaaagcacatcacaaacagttccctatttcatcagaactacataaactaacatttgtgtgaaacacatcagagcagctaattaaccataggatgcaagcaaaacatatacaagggagagcgcaccttgatggccatgcccctgagcgtgaggcaggtcaaccccgtgccagcatccaagaacggccgtatcctgaactgcagtttgacgcgcggcctggcgatgtgcaggtatgccttcctgatttccggtgcaggatccagccgaaccgactgcaccttggggcgcgtgtacagcgtgatcgtcctcagacccgccattttcaccgtgacctcacgctgctccagagccgacttaaacaggaggttcctcaccgtggaggactccatactgcagctgccggcgaatcccatgcagtacaccatctccagcgtctcgagcacgggcgcggccttgaggatgacgctgatcatccgctgcgggatggcaacgtggtggagcttgagcgtgcggaggccagggcacgcggcggggcaccatcgcgggagcgcgcaggagtcgagggagaccacggtgagggagcggatggagaggaggttctggggaaggaacgcgctgcggggcaggcggacggcgagctcggagaggccgcggtcggcggcggcgtcgaggaggcggccgaacgcggaggaggagaaccggcgggtctggggggcgaaggagaggcggcggatgaaggacggccgcgcggggagcgacgggagcggcagggccgggtcggcgacgagcgcggagtcgacgcggccgaactgggacgggaggacgcggaagcggcgggagagggcggagagcgtgacggcctggcgggtcgtgaggcgggagaggatggcgaggatgacgtcgtcggggaggccggagaggtagtcgtggccccctccgccgcggcggcggcggcgcttgcgtggggttcgtgccatcggtgcggcgcggtggaatcggagggggaggagattttcgtggatggatccggaggggaggggaggggaggggggcaaaagagtcaggagcttctgatttccgaaccggtcgggcctcaagtagaggaaaccggtcgcacgcgcgataggttttctggtttctcctctctttctgtgtgtgtgtttatttacacgcacaaggcaagtttgactacacgtgagacccacaggagtccaccggtgatacgagccctattggttcagtgagggagggaggtgatacgagttaacaggaggaacaacgagatatgagatcttttacggtgctttgaaaggtaccctaggtatctccttaacgaattgttatccacagttaatctttaaagggtaatttaggaacacaaatttttattaacaagggtagcttagtaattgctcaaatcccacccgtcacccaatcaaccaagccgtcgcaccgttgattcaagattaaccctaatcaaccaagccagcccgtgcgacggtggcaaccggctggcgcgacgggctcgtcggcggtgacggcgacctactgctgcgtacgtcagctgcgaccggtgggcgctatgggcgcgtgcgtcggcggcggcgacggtgtccagctgctgctttcgtaggcgcgtacggcggcagcgagcggcgggcgtgtgaggcctcggcaagcggcggccttttacgacagcgacaaccagcagatcatgtaggttcctctcgcacgcgagcgttctaattcttcctctcgtttttttttcttcctcctgctgaaacgtttgttgcttctctcaaaagttctgaatttgtaagaatacgcttttgccctttaccgaaaaaaatttaataaaaaacaattaccattttaccctcccaccttccatacctggctcacccttttaatacattttttcaggtaccttctctttctgtccgttagatcattgcagatcaatggtcctaattaattccaagcattgaagaagatctaacgagatattttgaaatctcttaaccacaaaaccaaaaatatgtatctttaaatttacataaaccatacactcaaggtccaacaacagtataatggatggtttcgctgacatggcatcctagtcagaaaaaaaattaaaaaaagtacatggagcccacatgtcagttacaaatcattttccttctccttctcttctcttttctctcttctctcttctcttcttcagtgagggaggccggcgaactccccatccctcccaagcctctctgctcgccacccgccgaccgctgtcgcgctcacatgccgcccgcatctgcgctcgcccatcgctggcctccctcactgaagaagagaagagagaagagagaaaagagaagagaaggtgaagaacagagaagaaaaaagatgtgcagctgacatgtgggcctcacatttttttttaactaggataccagcgaaaccacccatatatactgctataggatcttgagtgcatgatttatgtgagtttagggatatacatttctggttttgtggttaaggaacctcaacaaatctcgttgttaagttgagagacctccagaacatattcctgcagggagtgacaaggcccattgtgcgtttcgatcctttttccatagtgaggcccacacaaaataggccctaataatgagtagagcaatctcttgagtctttgacacagttctccctcacgagtaaaatcatctctatgtgctgaatgaaggaagtctcagggcactcacagtgcaagcaccagagcccatgtcttagcccaaaaaaagacccaaagacactctttcccacagtgcaaggattctattttacgtaacctaattgaatggagatactgtggaaggaaaagaatcccacaatgggcgttaccctacgcgcgtgggacacgtgagccgaacgcagtttatttcctcacctacccttctctcctcactgctcctcctccttctctccttctaccgccacgcctctttcacctcgcctcccacgccgctcctccttccggtccgccgccgcgcctcctcgcctcccacgctgcggcggcacgccggggacgcctcgcgctcctcccccacctcccctcgcgccttcgctccttctccgcgagctcaagaagctcgcaggaagccatggcgagtctcgcatccggccccccatggatgacgtcgtcaccaacgcgtcgcggcttcttcctggacgacctcgacaacttcatcgctccactaacgcatcgcggcttctcccctgcgacgcctcctcatctcccccaccagggcggcgtggaggcagggaggggtcggcgtggccaggggcgtggcggcgctagccccgccctagagtgtggtggacgggctcggcgatctcggcggcggccgggaggagggcgcactcctccttggcgttcttggcggcgacgttcttgattttttttgtgtgattttgtgtgactcttgattttcttgtgtgattttgtgtgactcttgtgtgattcttctggtaatcaccgtgacgatctgtgttcttgattttgcttgctaattttgaggattcttggcgcgggagcagaggaattggtggcggcagagggaaatcggtatggcgggaatgggttttgggagggtgaatcggggatttcgcgctacggtttcgacgcgagggcgaggctacgccgcccacaacgcgcgctacccgggtcttctcctcgctgcgcgtcctggatttcgcgaggttttgcgtcgctcacctaggggacgaggaacctagtttaggcgcgggtccaagtgacacggcggcaaaaatccaacgtggcgcgacgaggtcccggtccagctcaccacactgtgagagcactgtgagaggcctcatgtcgtgcatacacaagtactgtctagagtttgtcttcttggagaagacccagaaaaaccaacctttgtatacaaaaatgcttaatagacatagtataagacacccttggatactatcccatcgtcatgtgaagtagcaaactatgttatgatccccttgatcttgtttacgcctttggatttaagatatgtacttaactttttagattagatagttttacctttgtgttactttggataccataactctttatcaagtaatattgattacatcggctatcgcacaccaatgacctcaaaaagtaatatgtagatcacacattcaatatagggtaagttgtatgtgaatggataatagagttggaataattcatagtactagtatgtatcgctccataagttattttgttgtaaatgctcacttacctaacttaggtactatttgtttcagcttaagattattgtaatctcttattaaatcagattactctaaactagattataataagctgacatagaataagctgccaattgtttggtttctctggattattagaggcatctaaggccttgtttctttcagcttggaattattataatccagattattgggagtaagctgaaagaaacatacaacttattgaagtagcttattataatctggtgcccagcttattataatatgataaactcatttaggtgagctttttccagattattgggtgaaaaattacccaccatgccaccccactccctctttagacttgcaaacccaataatctaggctctaataatctaggaaagaaacaactaaccgcttattctactacagattataacaatctagtttatagtaatctgactcaataatctagaatataataatcttaagctgaaagaaacagggcctaagagtagtgggtctttagccactcaataatttggaaaaagctcctctagtgaagattattggattatactaatctagtttatagatttgttaacaaccaaatttggtaatatcggcatcgggaaagaagattagatcgaagcaaagtcggaggtggagatcgagttcggaaacagagcaggaatcggctagagtccagatcggttatgattaggatcggctgggtctgagttgggctaggtaagccgatgcagccgattccgacaatgcaactcgatgtatgacatcgggttgaattgaggtgcttcaaggtgattgccgcacatggatagagtcctgagaagtcaattgtatctattaattaggatgttttatataatttccttagagatatgcttgggcaaaagtctgccgcaaagacttatggtatcttggagtttgttagagatagttgtcgtgtctgttatggacatatcttgtaattttcgggtataaatagacccgagcactatgtatcttttaacacacacgttcaatacaatctcggtgcatcgccaccttttttgctttagttttatttcgacgagttcttgctttcgggttgagctgcatcggtttcgatcttcaacaagaggtaaaacttgttatggcggcttgcgttcttgggattagtgcttccatctttatgacactctaatcttgtttatgtaattcgtcgagttatcatatatcctacataatccttggcaatatcgatatccaacctacaatcggctaacatccgtcaatagaaggcagccgattaggttaaataccgatgttgacttagattatataggatatcatttatagatttaactgcggtttctttgcttctatttcttgttgattacaggatcaaatcaactggcacgctcatacattcgaaggtgagctttggacctgcactggagttaagaagacggctcggctcagctgagtaacaaaggtgctaccgacagctctctaggaaatcaaggtgacaattctcaaggagtccatggagtgcaaggtgacggggtgcatggagttcaaggtggtggtgcccaggggttgcaaggaggagatcttaatcagaatagtgatacggcacaagattttttcagtaatttccaagatcgggttgactacgctgtgcatcatgctttgatcaatcaatctggggtgttagtcaataccttatcaaacatgatgaagtccatagccgatggttcaatagctgagcatcaggttgtaggcccggtttatttgcaaggaggtgtctttccaaattatcggtctttgattaccgatgttcagccatcaactcaggcggttccctctgttgcaccaacatctcagccgacggcactggcatcaactcccctacctgctccatcagcaatggcgccaggccagccagtgaaccctcggttgttaatgagagagcagccacaacatggcgggcaggttgcgaatcggttgacccaagatcaggttgctgccatgtcacgtcccaaaatgaccctaaaatatatcctttaaattatgcttagaataattaaaatccttgtgaaagcctccaaaaattaaaatgtgcaaagttaaaagtcaaataaggcttggaggatttttgtatatttcctaaaagcctaaaatatgtaaataaattttagtggaattttcagagcacaaataataattgttaagaaataaacaaagttgaaaaggttttataaaaagaaaaacaataaaaccctccctccctctcttgggccggctcggcccacttccctccccatctctcctcttcccccgtggcccactcggcccctccccgcgcgcgcgccgctgatgggcgggcccgcccgccaccctcgctgacgggtggggcccacccgtcatctccttcctcccgccgctcccgccgcctcacccgcgcctagcgccgccgccgccgcgaatcccgccgcctcccgccgtccccgcgtgcaataaagtggggggaatcattccccgtgatcccctctccctttccccccatttctccctctttctctctcgcattcaaacgggcggatttgctcccgcaaatctcgccggcaccattgatggcggccggacctcccggccggtttccttcctctcccggccgccctctcccccttccaaccctatttaaaccctccccgcacctccttcgcccgtttccaccctttgccgcaccgtctcctcgccggaatcgagctcgtgccgtcgccctctctctcctccgtcgctgacgacctccggccggccttctcagctcgccgggaccgtctcctgtcccggcgtcgcctcgtccggcttcgccgcaccgccgtcgaccccgtccaccccctcgccgagctcgccgaccgtcggagcgccgccgaccccgttgacccgagccgtgccgccgccttcctccgctccggtcgcctttttcgtcgtcgccgtcgacctagggtgagccgtggaccgccgcctcgtttccccctttccctcccctctctcggccgccgctccgccgtgcctatggccgccgccggcgaccataggggggcgtgggcgcgccgcctcccgccgaccgcgccggcatggccgccttcgggcgcgccgagtggccgccgcgtgaggcccggccgtcagccgcccgcgccctcgggtgtggctgacgcgtgggacccacagcgccggtcgatgtgagcccgggtgcgcccggtccaccgtggaccgtgaggctgccacgtgggccccactcccgtggacccggtccgcgcgcccctccctctcggctgacgcaataaaccatttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatgaagtgtcacgaccggaattaacccaacgggcattccttacgtgcatgtattattccttgtcccaggaggcaaggtacatcaaaagttgatacatttcagagtttatcaagcggaagcgtaaatagttaatttattacatgggcagcgagggcccagcacacacaaagacaaacgagaaacagcagaagactagggcgacgaccacaggcgcttgacggcaggcacgagctagacaccaaagccttcatcttccagggactcctcttctgggtttggaaaaattgagcaagactgagtacaaccaccgtactcaacaagacacacccacaagtgcaggataaatgtaaaggagtacaagggggttatgatataaagggttagggtttgcagtaaacagccttaaaagacacttagttgctcaaagctattttgtaaacacgtttccagagctatacaatattattaaacaaggctgtgaacccacacgagcctgccttaacccaaggcctacgatgattcagaccgaactggcaacccgaccctgggtcccagctcgtcccaagccaacccaggccatccgttccaccttttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtagccacgtgccacataccaccacggtatacggacggaagacgtgacatagtttccaacccatcctagtcatagacaagagtaccgacccaaccccacctacggctggaacccccgggacaggtaggcacgactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtatggtagtgctttgcaatagaggcccgaagaccggtccttatatggccgaggtgctactatcaaaaccatgcaccccgaacccagcctaaaaccattttggggattttgaatagagggggcggtgtgaatccaattccacaataatccaaccattccatagtgtccaggtgatgagaaaatcccacagtctagagttgtaaaaccacctaatgttgcctaattaaccagcgaagcatctacctaaaatcatactagtggtaccatgagtagagtgtccactagttggggttttgtttatgctagggtgaacaaggaaataataacaataacaataagaaggtcataacaaaggtaaataggcacggctagataaaacagtgataacgcgggaatttaaataaagcgatagtgcaataatttaaatcaaaataattttataaactgggattcaatatgttcaaggatgatgtgacttgccttgctcgctttcccaaacgtcggcttcaacttccacgaagagcggatcgtccgaagctgcagcgtctacacgaccaacggaaaagaaaaggcttttactctaataaactccatataacaagctgaaacaaagcacaaaaataggttcttgacttcttaaggaaaaattagagacatgaacggtccaattccgagttcaaatggccaagttatggccatttgaagtttatatgctctttaaatgaatatttgcgaatttcttcatttaaatttttaattttaaaaagggtttattgcgtcagccgaggggaggggcgcgcggaccgggtccacgggagtggggcccacgcggcagccccacggtccacggtggaccgggtgcacccggctcacaccggccggcgccgtgggccccacgcgtcatccgcacccgagggcgcgggcggctgacggccgg

SEQ ID NO: 80533 - DNA, 1768 bp, Oryza sativa
tttttttgccactaagcaatgatgataccttgtttttgctatgagtatctcacttttgtcgctagggctaaaaaacaaatgaatgacgaacgtgagatgatccttggcttagtggcaaaaacagtatgaaaaaaaaaatctgctaatgaaaaaaaaaaccaaaaatttcccatgaaatatggcctggtagctgtctagcagatatcactaagtcatcgcgaaaataaggtaatctgactgaaactaattgctttgatctgttgaaaaaagaagtaattaagcccttgtatgacacttttataacaaggataacaagtgcatagtgatgaataatccttcagcgttgtagatggtgaaagtattttttttccctttgtcatggaatctcggtacagatgcgattagcaagacgtagtttacatctaaatgtttggtttgcttgtgcaggccttaaccgtgaattttcaaagttacgttaacaccatgatggtaaatcttgccgtggacgaggcacaatttccagattgtcatgagcttttggatgatttttccgaatccctcaggcagataaaggatgcagctttgagcctaggaaagcatcacacgaaggcttaaggcactatttaatcattgcacacaggcatgtattcgtaagaatgattgtaccatccaaatatcaaatactactggcaagtggtatctatttgtatgcactgtagcaactaaacctaaagtcaaatgactagataaaaaccatcagatgctttatgatcagaagtttccagagaacaagctctggcttttggttaaatattctctgaaaaattaagaataaatggtagtctgctatgctttactttgcttaccatgtgtaacgtgcagcatagtaaagtaaatgcccagatattactcatcttcttcgaagtccataagaaaatcagtcaagttctcagaatctgcaatagcttcttttagcgacagttgatctttcttcgacttttcctagaaaaacggaaagaaataagcagtcatccgtgagttactgagttgtgatcactgacgaatgtatcctttacgacagggtacgttacgtgcttggagtgggagttgatacagttacaaactctatgcatgcattagacacttccatgaatttacacaaaattaaaccatatgcacataattaggcaagatagtgaataggactgctggactggcaagaatgctactcgctcagcatttattaatgccaaaaggctgaactttttccattagaacagaactgataataatgaaaaggtacctttggattttcagcctgtccggtagtttttagaacactccaattacgactgaccttcccttcagcatcctcagcatcatcaccatcatcttcatcatcctattggtaaagcagtataatacaaaggaatgacaagctttcaagtaggacaagtatcgataactatctcatcaataaatcaactatttccatgcacagcaagagaggcattcagcttccaataagcatgtatatgaactgaaagatctgttgtcattgccagtaataagaagaaattcgcaaggctacattgagaatcgcagattgcatgcatttccatcaagtaaacagtacagtattatacctctagtgactcaggctgcgcaacaactttgtcagcatcctcctcatcgtcatcactatcttcgttgtactatttgaaaagtagaaaacatcccagtgaaatgcgcgtaagtttgtatggag

SEQ ID NO: 80534 - DNA, 12728 bp, Oryza sativa
  unsure (1)..(12728): unsure at all n locations
gaattcgtccgatatttaagcttcgcgatagaaatttctaacctattatacggatataatactcgggctgattaaattaaaaacttgtgctaataaaatatttataccgcgaaatagcttaggatggataaattaagatcggattagctctaattcacgaacaaaaataggtaatgtaagaaactgacttccgctctcgatatcttcgtggatttacttggatctttatttgaaatctaaccgaattcaaatcgtttcttcgcacgtaattttagagccagagggagttgcggatccgagcgaggatcaagacccacagaactacgagcaaggcaagtcatcactattctttaaacatgttgatcccaattgcgaaactattttgtttacaaataaaattgcatgcaatgatgaacatcccacttgtgattatgccatgccttgattattgtttatccttaaatctttgtaaccatgattatgtatgagtccctagtcaaccatgacaattgcttagaaatgctactctagattcatgcatgctcatatttagcaaatgctatatgcctgggcaattacctttgggaaggtaattgagatgcgacatgtggagacaggagcgccacattgccatgataatgatgacatgatttatcaaagggaaataaaattaaacaactatttttgactaggacggacggaggatttgggtggtatctggaaaaggctagtaccgtccccggtcaattaaagaccgagccatgaagttaagcatgaaacaacccccgtacaaccgtacttctcgaatgggtatagacctagcggattagatagccgagcggaggcagtatccctgcatagatggttcacccctgagtgagacaggtgcgctacggtggggcagccgttgaggtagggccgagaggcgtgccctacattggtgtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttgagttcatggagcgggtactgccaatgcaaggttatcgaaaagctttgccgtgacgcgtctcatgtgttgagacgaggcttatgtgttgggcagtcgcggagtgcgggtaaagtgtacatccactgcagtgtgagtaaaccaaatctattcgaatagtcgtgctcgcggttactgagcaccgggacatgtattacacttggctagactctaaattcttaacctgtgtgggatgggatattgcatgatgatttttatgctgttggagccacttcctgagagacgggaaggtggacgtcctcagaaaaccatgacgattcaatggcgggaagctatccttgggatcacaatggatggtggacagaaccgtcgttgtctaatgtgaacactagtattaaaacttgatcagtctatgctaggtcttaggcttgtgaaaagaattacaaaacttgctttgtgcaaaagaaccatagccattccttgaataccctctatcatgtgcattgttgctgtggtggcttgctgagtacggttggtgctcacccttgcaatatacaaacttaatcagaggtcggagatgaagcttcggaggatccctacgcttactaccaggaggatgatgaagacgatggcgctcagtaggtcttagttacggtcgttacctgtggcaatggcgtgccgctgtcttaactccgctaccttatctacttctgcttttggaatgtatcccggaccgctcggtccgatgatctaagactatgcctgcgggcttatgatgtaataattagcactagactctcgtgtatgtgcatttggtatgttagctatgaactcgtgtgtaccagactacttgatccagggaaatggtactgtttacacgattgattcctgttacaaaaatgggagtccacagcatcccccttcctcctctcctttccgtcgcccttcgcgcgccctctcgcgccaccgctcaccgccggtggccgtgcaccgtcgcatgtcatgtctcggctgggccggctctgagccgtgcccgtgccctgggcgccctgccctgtggccgcccgtggaccacccgtggtctcggtccatggtgccgtcccggccgcagtggaccgtgtccaccgtgcgccctcccccttgtgtcactgacatgtgggacccgcctgtcggcaccggcttcccttgctgacgtcagcggcggtccttttcctttgtaaaaataaatattaatcgcgcaataatgcgttaataattatagaaatttatttaaatggctcaaaacttctaaaattcatatctaattcattcgaactccaaattgggccgttcaacttgcaaaattcatctaaaattgaggtctacatgattgtttacttttttatgtactatttgtttggtttttattagagtttttcctcgttttgcgtgccagcgagtagaatccatcgtttcggaagtccgcggtcgctaggaaaagagttcagaagatcaaagttaagaagcaagcaagtcacacattccccttgagcattttgatcctaatttacaaatgttttaccgtttgcaaataaaatttcatgtcttgctaattacatgggatcagggtttacctatctgctcgcttgtgccatgtttacttgatatctgtcctttgtcaaccgtgggtaataaatcgcctagcttgtattacttatgtgacctagctagaactttatgcttagccatgcttaattaccactagctcaattgatgggataattacagttttagacatctagtatcttgacaagctgcgtgctcgagacatctagccatgtttcatggtcgtaattatccaactaaaatgcaactgaatggtgggctgtgggtgcatggttttgttagttgtgcccatggcaattaaggaccggttcacgagaaaccctagaagaattacagtgcttaccacaagcgggagtgggtaactgcttgatctggagtatagctcgaccctttcctaggcaccggtggcgagggtgggcgtcatggagttgggtcggccggggtgtccggttgtccagctgccggattcaccgcggcgcacgaggggactgccggctgccttgcgaggagtgcaggtgaaaccttagcgtggtgtggatggttaggggagagttatatgaagggtcttgtcacaatcactcgacatggtgacgtgttcatcatgggcacatgatgacacggtgacatgccggtggattgtgtcttgtgggtacagttgtgcacctctggccagagtaaaactattcgaatagccatgcccacggttataggcgatcaaccagattcaccgtgattagtctcacacttaataaatcgacccaatgcactgtagttcaggtggattggttgggcctgttcaatgtggtgtagcgttgttcagtcgagagttaatattaccttaattactcaactgttttactgttttgatcaataaaatgttctacaaccgcctttatgcaaatagccacaaaccatcctcgtatccccttgcacgtctgcatcattggtatggcttgctgagtacggtggttgtacttagccttgctattgttcccccttttcagaagtgtagtgcttctgagctgaagccgaagttagaagaccaaggctcagaccccagttgagttttgcctgtggagtggagctgaagccccgctaggatcgccttttttcgctgctgtcgttctctttcggtgtgaggactaagtgcctcttctgtaagtattttacgctttatttacgtttggaactgtatattacttgtcgttttgtgtaccctggttggtcctggacagggatttagtacacaaaatagtctagaaatttgggctaaatttctgggcgtgacaaaaacccagcccggccgaggccgggctggcaacgatggcactcgatcgtcattccccctactgagggtgttgtcgtgccgtctcaccccatctagtggtggctgccgggtgaaagccctgtcaaggtttctccagaccttgacagacagcagcggcgatgctactgtcgcttctctccatggagacgccgtctaggtagcacccttgccaaaacctcccaaacatctgttgcaagctcgttctagagtcatttcctcttgtatcggcgtcctagtttatacaagttggctatgtcgaagggcctaggggggagagcggttctattattctctctcaccctctcttcctaaatccctaagatgtggatagagtgtgtttttgtgtcggttgtaagggttgggttttgagcgatcctagttgtagttcctttgttggcttagcggcggtcggccaagcttagaggcagccggtccgatgctagtcttctcctgggattgtgtttggcgtcgtcagtgtgtgggtggtggtattcttttttccttttcctggttacgatgtcccaggattgtaatcttataatttttttctattgtatcaatatgaactttgcactgactagttcaaaaaaaaatcttgtgtctttaggtagaccaaacaatccaattagtctgtgattttttttaaaatatgctcaaataataaaagcaaggccaatgaatcagggaagcattcaaaaaaatcacatcccaaaagtaatggtgcatctttagttatactagaaaaaattatctgggcattgcaacaggtgaaggctattttattttaatcttattattgtccactctgaaattcattgtgagaattcgatgttatatggtttagttaaggtgagattcactatgggaatttgcttggatatataattttttagaaaattatgagctgcagttaggagtccgttcgtatcaagttagcatgcgagtttttttacgactccttctgtattttcattcaaaagtgaacgaacttaaaacccgacttaaatacggatctgtattttcaaaagcaaacgaactaaaaaccgactcatacacggatgacgtacaaaattaccggtaaaaacattttatagtagtagagagttgccaaacttaaaaaccgactcatacacggatgacgttcaaaattaccggtaaaaacattttatagtagtagagagttctaaaaacattttatagtagtagagagttcccgtctgtgttctcgctgagctccttgaatcgatcccaaacgggtgtctcctacactgtgcagtacaattgaactctaaggccccatgaatttagccctcacatcccacagccaatccattcattaacttatataaaaggtgattgacttttttaaaaaagttggcaccttaggtgtaacatctttatttatcatctcacgtcatttgaacttaaaaaaaatgcttgcataaaataaaacaaaaaataggaaatgccaataagagtaaagcggaccaattagggaaaatcttataaggtcttagaaaaaattggttcttccttttcaccaaaattggaacacccgttaccatatccattgcgtcattttttagtgtttagatgctaatacccttcaggtggcattattagtttcactacatcatgcacacaaaagacataacccactaaggtagaaatatataattggtttaaaagttatattaaacttgatattcactttgtttttttcttaaaaaaatactatgggtctaacacatcgtagggaagcaggggctagataagtattcgaattatgtcaatatgaatcagtaagagggattgttaacttcatggaacaactgaaacataattatttgcaataatagttttaaaaattttgttaaaaaagagagcccgtaaacattccatttgaataaaaactacttacttttaatttacacttacctgtttccaaaacaaagtatacttttcttttgaatgataagtcagatcatagttaatttcttaccgaatgaatattgtatagtatgtagtgtaaagccaacgaatagcttagaaaaagttacccaagcaataccgattaataccgattaagaaggtttttcagacaagtcacaatttttgaaatatagtatgaataatccggttgatggtatataagtctctaaagctgacaataagatacacgcccgcacatttgcgtgggttacctttctagtctaatttaagaaactgttgggaacaaactcgatacaaattggtaaaacacctggagaatataataataaacaaactcgacaaagacagggttttggtgctgtcaagcagcagcattttctggtttatactcaatttaaaatagcaaatcaacatacatatcatgggagggcaatgccaccatgtgcgccacccccgtccacgtcatgtgccatcccacacgccaagcatgccacgcaactagacgcactccggcttgagccagcaagccacaagcaaatacagacgcaacaagacaaggaaaaaaaacagaaaaaaaaaaagaaccaacaagaaatgttccatcagaaatagacttcaaaaccattagttcattacaaacaatctagatcagtcatatgctgaacccagataagagataaacttgatatatccaccaatgaccaatcactgtagggactttagtgttgttcttccaagtatatgaatcttgtatggatcgatcatcgatgtcggtgaccgttgtagtcaattgaatctacctgcagttggaattatagaagaaatatatcagatttgcagaaaagaagttgtgccctttcaatatgctccatatatgataagttcacaatgcactataaaaacaggttctagtttttgacctcctggtataaaagtttgaatatttggtacaaacataatgtctgacatatgtacatgtctatataaatagaaggctactgcagaacactataccattccaacagaatagattatatataacgacatcagcacggtatcttagttagatctgatatttttaatactagataggtaccagatctagtaccgtggtacctgatacaatacccataggtattatatttggtgccaatgataccagatgatactgcatggtactaaatcctgctacctaggtaccnnnnnnnnnnnnnnnnnnnnnnnnnnattccgttagaacagtgtatcgttttgtagtattatgatataaataccatgcaattaaaatatcagaagaacaaataattttgaaataaacattttcatgtttaaatttatctaaacttggtgaaaggattccataggttatgaataaaaataatatagatgcatatgggttgcacactagtaaactagaccatatagcctttgcttaccgtactactaagtaacctagttgaaaacaaaatggctaattctgtgtatcttttctacacctccatcttggtgtgcgcacataattgttgctgatttactatgcagataaacaaggagtaccaaatgacagcaggccgccattatagccagcactcaaaagttagccacttagcttcaaacagtcttatcatttttttttttgccgaactaatattttggtgcgacttttcatcagatattttacagtgctggaacttcaaaagagtgcaaaaatagtttttctaggggaagtattgagaggttaaataactattcctgaatcctgaacagtgccaattaaaatgtagggcctgggtactgtgggcctgctggtttcctattagttggaaaatacagataagaatagtttgtttccttgctaatttggtttccctcagatatattcacatgtattaaagataaaaattacattgtagatagagttttatcttgtggggccaagccaagtaatctgtacaaaaaggtagagtgctagcatgtataactattactagtaagcaagcaatgaagatgaattaacctagtctctccccctttctcaaaattgttcatccaaatctatgatctcccatcatgtacatacatacatacacatacacgcacacacatatatatacctcactatgttacctctcaattaacactaaaaacatttctagttcccaaggtccggagaaaaccacgcaaggaaaattaacactaaacattttacaaattgcacttgtattcttctcttaccaacctgttacaaccaagaatcgcatgcctagtggtattgctagccatgcaattcatttccaataaatccctaaatttcaaataggacctttactttatttcccactatacaccactgtcctccataacttcatttggggtttctcaaaaaaaaaaaaacttcatttggaaaaatcaaccaatgatggaatcagcatgatcaacaaaataaagaggaaaatataataaagcagtgttgcagtaacggaaacaaacttgaaatggaattctgttatactagccatgcaaatctatagaatattttttgcttattggcttatagaggtatgtggatagatttgacctgagaatagagcctttgggcaaggccttcttatagtattgcgctgactgccgcttgtagagcaatgactgatcatagccaccttctttctgaggccacactaggttatcccaccaatccttctcacagtatactatgggtcttggttcatgcaatccttggacgtcaggcaggtgtctaagactacagcagcccctgatcatgatggcctccagcatgggagctgacattatttttgcctcacatatccctttcaagctgggaagctcatgcaggtggacgtgcttcagctttgggaaatcaatagcatcattgcttactgtccccttggagtttgctgtgttcaaagggaaaacatatatgaggctggtgcagtacaggatctgaatggtctccaagcttggtaagttgttggacaagggaagtacatggatgagcctaggacaggaatccagatgtatatactgcagtttcttgaaggaatcaacatttacatgcttgacttccatgctccaaatgcagtgggctgtttggagatgtgatgcccagaaggtctctagccaagagaaagctacgatttggtcatggtctctgagtttgaatacagaatgtaacttggggcatctctcaatacagcaccacttaatccgaccccaatttgatccaggaatactagtcatccaagagtcatcatgcacgtttagagagtgtacaatgtctatgaaatttcccaagatattgtcattcccctgcaattgttttctgtttctgatctctaccttgcagcttctgttgcactttgactctaaaggcagaggcgggcaaggacaaatcacaggggcaacactaagtgcaacaactctgtcaaatatatcactgcacatattccctgcaactgttcgatcaacatgggcattccttatttgttcactactgcactgcttactttgtccttcatctttgcaataattaacaaaaacaggtgacatgcagaaatgcacatggtgactttgcattgcaaacaactgtagaaaccgaagaagcctaggatccatgataacaacatgtgattggaataatttatcatcatcctggacaggtgacaagctattttgtcgtttgccttccagatgtactccaactgtatctacatgtaactcatccaattgtggttttgtaacatctgaccactttattgcacaaagatgcagacaaccaaacagaagaagacgattaagtttttctgcctgcatggcatccaggtcaagtttttccaatattgtgccggaaagatccaattcctcaagttttggcagtccactcaagattagcttttttaaccggcaacatccagataatgagatttttgtaatatttgctgcctttggatactgttctgatgctgcaactaagctgaattcctcaagtgataccggaaggttgctatcactgacagaatccaacccaacacaaccatcaagagtgacagtcttcagacatgttgccttggacaggtcaggaaaagcttgcatggtagagttacctgacaagtctagaatctccatcttttccatacctgagaatgtgaatgtgaatggatccttttcatctttggttgccgtatagtcttgatcaatcgtcttgattacacgaagcttctgtatcttgttatgctgccgtttccaaatatgtctcaagttgtgcagtttcactcccttaacattgagctccctgacattgttcatttcctcaatcatctgtggggagaaaacccactgtgtgtactgtaggtctagcacccacaaaccatgaaaacagttccaagactgaacctcctctccagcatcaatgttcagatcaaggcagttatcaagcccaaggaatctcaatccgcggcaacagaggaaaggaggtgaagcaaatctaaaggtacagaggctaagttttagcactctaaggttctctgcatgttgaaacatgtcattataattttgtaaaagatgtgcagggttgagctttgacttaaaaaaatattctactagttccaccgtgtcttttgattctgtgtcaatttggtgttctgccaagaaaaatgatgacactgtttgagccactgctgaggcagccaggaacccataattacttgaaatcaggtgacttgttgaaatccagttgtcagtgttccgcatcatgtggtaaagtccagggtcgtcccattcttgccacatctcttgttgtagagcatcagcaatctcccattcctgaatgatcccatcacacacccaatagtttgaagcatgaactgcccagtcatagtcaatgatgtctctgccaacaaaattaagtttcgatatatacaaccaacatttggcaattgttgtagggtgcagcttggctactccggaacatgtgttggaagcaatttctgccgcctcctcacacaatatatcccaccaatggctttgatcctggaactccatcccatatattttgttatggaattcggcagcaagaaaaacatctgccttttgcaccttgtcctgaattttggtactcagccgaaacctgcccctgaaggtccacaatattttgtttcccttatacagctgatatagaggcagaccaaaattagttacatcttttatttcattatcactcccattatgaaaaaccacaagaaatcttccactcattaggacatcattaacagctattccaacatcattgatcacgtctctggagctttcatcttttccattgatatcatcagcctcatcctgctcatcaataagatcttttgcttgggtcatctctagtttctctgcaattttcctctgcatttcccttatgcttttccacctcgagcaatcaatgtggattatcttttcaaacctcaattctgggtccgtgatctggcccagtgtaagccgttcggcaacagctctgaggacagcagatacacccaatccttcccaaccatcaaaatagaccacatttgatacatctgatttctttagtttgtcaattatactatcaacagcctcagcaacattctctgcggtaattacctgcagtggttaacagtaattaactgaggttagctcagctcagctgggttgcgtacaaagtaacacgactgtctagaagaagaaaaatcaaatgaacactatattcagagaaaaaaaaatgaaactatatatttagagggggggaaatccttatttgctactccactttgagctgtcaccaaactaggtatgccgatgtaggcgaggctggtgatgtggagacttgttgccgcagccaccgtcccccacctcgtccatggctggcgccgcctccccatcctaagcatcatcgcccagatctagtttggtgtcaagcgcatgcgaatggctgctacttggggccatcagcaactggatggcaactgtggcgggctggcggcaaggtcaggaagccgatggaggcgggagaggaagagttgatcagcaaatgggagacgaggatgggcggccaacggccatactgcccatcagccatggggatgggagaaatagcaagaaagaaaatgaagagggaggaaggcgatggttcatggaaatttaagtatttgctactattctatttatcaattatccaaatgccaattttaattttgtgctggtaaatttaacgccccgcgctttgttacgggatatatattagatagcgtagaaataataaaatgatttggattgaaatatcgtgaaaaagatgatttggcatgtgcatatttattttgggagtacctatagaacatttgacatttttctaggagaaaaacttaaatgtaattacaatctaactagtgtgtaactagaggtttactctgatctaacaaaaagtatcaaaaagtatcttgagtatcagtacatccaacgatcggaaacgatttggtaccgtgagataccagtacctcgaggtactttttgtttgaatagcgcaaatctcacgtaactaagatgtacttactccgtttcacaatgtaagtcattgtagcattctccacatttatattgatgttaatgaatctagatagatatatatgtctagattcattaacatcaatatgaatgtgggaaatgctagaatgacttacattgtgaaacggatggagtaatttatatgtaagaa

SEQ ID NO: 80535 - DNA, 12010 bp, Oryza sativa
ctcatactgtgccatggaagctgcctcatccaaatcacagctttgtagctcgaagtccggtctgcgcctctgtacttcctcacctcatcaaagaacgagtactgctccgggcacacacagcttgtctggttgttgctgccatcaaacatgcagtaactattgaatccacaggtgccactgcctacttttgtctgagcattgcagatgttttcaggttggatgctcactgctgtccatgcctgactcatgctgctgggcttcttcgggtacacatattgcctgaacacaccatctgggtcaagcgtagcacgatggtagtagtcctccatggagcggatcaccccagatgtcatgttgaattgtgttccattcttcatgctcacgtatatcctaccggtagtattgaacaccagattggtgacctgatttgtgacattctcatctatgggtgtggaccaatatgggtcataaaggtttccagatggaactgccatggtataaagtgcagctcgttgagtttccatgttaagaagaaacctgccattggagtaatctgtggtaaggagtcggctgcggagcttcattccaggggacagcgcttgtgtgaccaggatggtgtctgttgggttcttgaaagtttcccagctgatagtagagcctcctgcagcagcaatcacaaaattcccggtgtcgagcatgctggcatagggtgcaccagttgctcctggattccatacctctctattggtgggatctcggagagaaagtacaccagttgaggtaaactggaggatggagccaatggcacttgtatcggctgtggttcttgctcactggtcttggcataccatgttgccgtcttgtcgctgatcttgttgaaccagatggcgaggaggtagaaggaggagttgccatcgatgggccggaatccaaacgcgaagtcgcctgatggcgagagccatgcgttgtttggcccttgggttgttaatgatgtgcccaagctgatgttctgagcttgagcagatggggaggacagtagcaccaacaattggagggagagcaagaagagtggaggtgccatattgcttgttctgattattgcttccatttcctactttttattgcacaccgaagagttgacttgaccttacaagttatttttttttgaacttgtaaggtcaagtcaactcgagatcctgcccaccttacaagttatttctaaggtaaaatgtcacgaggaatagtatctgtaggtaaatggtcattgtcttagctggccttctatataccacctggattttgtgaactgaaatttgcatatacatacaacatcccttgcatcctccattctaagaaagaccatgatagccacatactttttctaagattgaactggtctgtcagtaagactattccatgcttgacttgctaaagtcttccaacttttcgagtcttccaaggtggtcaccacatcaggtcaagacgaattttagatagagcttcttctttggcactttacagggtagaagacaaactcttgttcagtttctgtttatctttatggtagtgagtatacaatgtccctatttctttctaagcttacaacttgaattccagttggatggtcttacaataatctctgctggatatctgtctatcagatcactgggtctgttactgacagtcaggctagctcaagctaatattccgttgtttgcctgtttgtcaggttgtaacaaggagtcaaaattttcagctaagtagctaatatatcaattttctttgcaaaatccgtagagattttctatgggtacattatttactcaaatttccttggaatctatattttttctccttcagagaattaagtaaacaagccataccaagtcttgtttggtgacagctgagaaagctttgaccttgtccttaataatgatgctgtgattggaaatgcgattgaccataactatttgtattgtacttagcattatttctccttgtctagcacaccagactactgaccaacgatcacatcatctgcagctgaaaagaacttgttttgcctgcattttgtacatctcagtctacatgttttgccaatatactcagttctagatactctggtcaaatttgttttagagcaattttttgttttatcttggttcaagtttctagtttttaccacaataagtaaccttcagttttttatatagctttgcttaggagagctcatgggtgtatctaatattttaaatttctaatatgcaccatacctatcggggtgacctgttcatcggcacaggctgttttacttggctgaccccatatctttgtcccacaatgcttgtctgaagggccaaaaggcctatgatatattgtaattgtaaagcaataaaaataagcatgttattgaaatagttttatttcgaaaatgacaaaatatctgggtttgtttgactttgggactactttgtcatgtgaagttaatctgggcttaaacctgttttaggatctccttttatctgttgcatggatggtaccttagtttcattctttcattctaggtatttggtgagttcctcaatttgcagcaagtgttacttgactgcatgggttttttcagaaatcaaggattcttggtgagctttgttggggtatatggcatgagaatataaggtagactaatctgttatgatgaacatgtatctgattctttctgtttacatctaaatttggcacctatggatgaaatagggaaaaattgccaaagtttagaaagtgacgggtttccttcacagggccggtcagaccacaggtgtatgggcggtctgaccggctagtagggccggtctgaccgcaggtatgtggcggttagaccgtcagggtccgagtccgagtctgttttcgtcgggtctcgggtttccttacttgggaaggcatgtttcgtgtttcctttggtttctatccctatttaagggacaaggccggttcactgtaaaacccccgaatacaatctacttgaatagttcttttactatgttttctattttaccctaatttagtccatctttgtcggtttgcgccgtaaaccgtccgtcgccgctgcgagactgcgacacccttttataggtttgtctgaaaaccttccgtttgcccacgagacgggtagttatcctcatatcgatctaaatcggcctagaggctgattttgagctctaaatcggctccgctagtcggtttagctgtttttctacagtacccatgttgatctggccctttggctagattgaggtggttggcgactccatatcaccacaaggcgtttaggtgttgcgatcgtacttgtcgacttgtcataaaaagttgccaacgtgatttttgacgactccgctggggaacgatctaatcggccatatcacggccgaatttcgtttaatctagtaattactgttcatcaaatcaggagtttcggcggcgaagttaattatctagtcgtcactgaatccatctgaatacttgccgttcagcacgccgcgtataccgaggatcatcgtcaggaggcagaggccggctcgatggcctcgtttctttttgtttcataaggcaaacagagaaaatatcaggcttctagagccgatctacctggcagacaagcagcaggagctttgtttctttttattactgtgcacgtgctaaaacaaagatcaggctatccaagccgatctacttctgttcacataaaaaaaaagccgattcctgctatatcggttattcccgagaagcttcaaattctccaatttttttgctaagtacagtagcatacaaggaaaattacaagaccgtatattaatctattcggtcagcgatttcggctatgatctatatggccggaattaatcaaggaatttcttcatcaaccatgatgagcgggaataagatcgacgaggtcacatgggaggatcttgacgcggagcaacacaagatgatggtggttacgcaggagctgttgatgaaatcatacatcaggaccaatcaaggcatcgtgaaggaaaacgtctcgcttcctcaagttgtagttttaccaaaggtaacctccgattcgcccaacccgtcctttgctaataatcactgtgtagatgtatatactacttctagttttactcctatacaatatgcttataatgctatggggggtcaatgagtgtttatacggctgattacacaggaatcggctatatgcaaaacctagataacggtatgactggtcatgacaccggtctaaccgcatcctatgccggttagaccgtgcccaccatggccggtcagaccgtgtactacgccggtcagaccatgcctaccataaacggtcagaccgtgtcctatcctggccagatcgcgcctcctgtggccggtctgaccgtaccattgaccaccggtcagactgggcatgggctggtcagactgggtgcttggccggtcatacctcagactggttccctggaaatttctccaggttttcataccacgactagcagtgctgattttaattattattcatcatctgttaatactgttagtcatgctactccacatgtccctaatgcttacaatgatcataatagaggatattctcatgacaccgggtacggccaatatgacaatattgcgccgcaacaaccaccttttaggccatcaaatccaccaccaaatccaccaaggcctgaaatcatggaggtaaggaatcatgctagggtttaccaaatgccgtatcctaatttttatgatgttgtcccatatcctcctgattataaaattcctgaatttgccaagtttagtggtaaggatagtaggaccacatgcgaacatgtaggtcaattcttagcgcaatgtggtagggctagtagtatggatacatgtaaattgcgcttgttttctttatctttgtctggtactgcttttacatggtttacttctttaccatcaaattctatttctgcttgggctcaattagaacaaaaatttcatgattattttcacactaatgaaactgagcttaagttgtctgatttaacattggttagacataaatacaatgaatctgttgttgattatattgaaaggattggagatgttaaaaaccgatgcttcaatttgaaaataactgacaaagatttggccgacattgcatataatggattgcttgattctattaaagagaaattgaatggccagatatttcttgatattgatcatgtgttgcatgaagctctggctcaggaaagccgagtggatgacaatagcttacaagctagtttagatgaaaatgcaatatcatgcatagccgaaccaagcgatggttcggattgtgttaataatttgtgcaatgatgctgtgacaagtatagctgaatcaaatgttggtccggattgtcttactagcttggatgataatgcaacaaccattatagccgaaccaagtattggttcggattttgttactagtttagacaacgatggaatagccgaaccaagtaatggttcggattgtgttgctagcttagagaatagcatcattgaaaatatagccgaactaagtgacggttcaggttatatcacaagcatagcattatcacctaagaccgagtcactaatcggttatgtggatgttggaaaagatgatgacaatgtcttgcgggatagtagtgagatagaacccaaagtagctatgcatacgtatcaaaggccgtatcctgaacatgtagattcggtcccatatccgcaaggatttgaggtgcccaacttcacaaaattcataggtgaggatactagaacaacaaaggagcatatcggccaatttattgaacaatgtggtaaggccggtagtgatgatttgcttaagttaaaattgtttcctctttctttgtcaaactttgcatctacatggtatagtttacttgctcctaattcaatttctacatggtcacaaatggagcatgagtttcatgattattttaaagatgcaagcttgatagagaaaagaccggttgatgatttatcggtcacttgtgagactatttcggttacacctatgcctaagaccggaattgttagtaatcctttccctattagtcctattgatgatgacaaatggaaagggaaaagtgttattattggggatcctcggcctaagaataggatcaaaaatgcgaaggccgaagatcataaagttgcaaaggatgagtcatctagttcccaaaagaccaaaaagccgaagctcacttttgagatgcttatgggtaagtacaagaaaggattagccggtcaacgatttgataatcaaactagtgattcaaaaagaccaagatcatctcgtagggagagatttggtcaaacaccaaagcaatcggagccatcaactataacaactccatacaaacctccggttgtgatgccatggtatccacatccaatgtcaccatttggttatccttttatgtattacatgccatggatgcctcaaccacctatgccgtgtcatcaaggatggaagcaatcacctaggacagtaccaagtaattctaactcaagacaagaccgtttctcacaaaagaatcggtccggtggatcaaaggtgaaaaaggtgtgggtgaggaaagaagccaaagctccggaggtcgttgctatcaaggagaaatctcaagatgttcaagtacctactgaagatgcggcgaaaactatacaagcggagaagactgaagccgacgccgttgctgtcaacatcggtggtctaaccaagctagttggctggtctaaccgccagactacggccggtctgaccgacggcttgtggccggtctgaccgggcccagaggccgtctgaccggggggcattggagaagagtaggaaaattgtgagcaacataggagcttccacttcgaccaaaaatatgaagaatcattgcttagctcctggaaaacaatcacagccgaagtggataccttctggcttatctcgctctcaaaagaggaggctacagcgtcttcgggccataggtcaaaaagaaaaggaggccgaagatgtggagaacaagacatgcaataatttagagcctcgaacagcacctaggcaagtgtggagatccaaagaggtaaaagttaagagaccggtaatttcccatagtagagataaatccaatttgatgacagaataatcatcagtcattagagataaatctccttcgcatgatactatggatgttggtgcggtgttcgtcttgccttcgaaattgtgcagtcgagaaagccgattttgctcagggggcaagacattaatatgctcatgaggaaaccaagagaagatgaacggtgatggatataacatcacatctttgagccgccgtttgttggatgctaaggcaaggtatgagtttattgtgtttaccattatattatatgcctatgccatgttattagaacattgcttgctatctagcacatgtgtgtttttgcttatcaaattcatattatacatacatgttgcaaatgccagttctaagtagaggaattggtaggttggcgtataatttgtttgaagtatgatttggctcatgagtctttgatatttatttaaagccaaatcatatgtgtttttatggatcaccatataatatatagatttcatatttattgcaccatgaaagttttgcttattagtaattcggttaatgtcaatggtcaatgtgatgatttgctttagagttgttttctttaggaacattggcattgttaatattttgcatacatgctcaagccgattacttacatttgtagtttattggaatctatgcatgtgacacatatgactttggtgattcattattgatcatacttcaattggctaagtgttttgatgctatgatgattattgtttcaaaagccacttgaattagtattcatctagccatattagttggatattataatttttcatatgtcgagagagaaggaattttggtccaataatttggtacaccaagcatctggctattatgtgaagaaaatttatatactaaaggccgatgcttgatttcaaaagtttggacgaaattggcaaagtcatagaccaggggcggtctgaccggcattgcatggccggtctgaccggtggtatcggcggtctaaccggttctgcatggccggtctgaccgggtagacaaggcggtttgaccggcattgcgtggccggtctgaccaataccaggcggagaattagggggcatgttacaattgattaaaaggccgaattaattgtgaattcggacatttgtgcccatgagttagaaatagcttggagaattcctttgattagatatttgaaagatcctacacataaggttgatcagaagattcggcggtaagcgttcaattattatatcgccgaaaaatagatggagtattacttagataatgatcaatctaaagttgctaggagagtagtacatgaaaggatttgtggaattcatcaatcggcccgtaagataaattggttgcttaggagagtggggtttcattggccgaaaatgattgatgattgtttcaaatgctatagagggagtgaagcttgttaacggatcgacaatgtttaattaatgcctaccgctgtgttgaatcctatcattaaactatggccgttctgagattgggctttggatttcattggtcaaatttatccttcgtcatcaaaagggcattggatcgtgctagttgcaatggattacttcactaagtgggccgaagccgtgccgctcgagaatattacttgtaagcatattgttcatagatttggtattcctcaaacgttaaaggagcttcttttatgtccaaggaagtgagaagttttgctgaatcttatgatattaggttgttgagttcttctctttactacgctcaggctaatggataagccgagtcgagtaataaaacattgttgaaattgtcgttttgccagttgaggtaaatcttggctctctttggtatttcaagctagacgacttgtcggttggagattacaagaccttgatgggaagcaattttgaagacgtcatcgacaagcgtttgaagactttgaaggagatgaagacactccaagacggtgttttcagagaacaattcatgggaaatacttgaagaaatacttcccgagtatttggcaagatgcttaggaagtcctatggccggtaattggattatcgccctgagataacatgttctatgcttttaggttcatgtatgttcactaaaaaggcagggggcatgtgtttacacccaaatttggcacctatggacgaaatagggaaaaattgccaatgtttggaaagtgacgggttttcttcacagagccggtcagaccacaggtgtgtgggcggtctgaccggctagtagggccggtctgaccgcaggtatgtgggcggtcagaccgtcaaggttcgagtccgagtctgttttcgtcgggtctcgggtttccttgatcgggaaggcatgtttcgtgtttcctttggtttctatcccgagttggacgtggagaagacctgtagagggggagaccaacccctatttaagggacaaggccggttcattgtaaaacccccgaatacaacgaatacaatctacttgaattgttcttttaccatgttttctattttaccctaatttagtccatctttgtcggtttgcaccgtaaaccgtccgtcgccgctgcgagagtgcgacacccctttgtaggtttgtcctgaaaaccttccgttttgcccacgagacgggtagttatcctcatatcgatctaaatcggcctagaggctgattttgatctctaaatcggctccgctagccggtttagctgtttttctacaaaacccatcttgatctggccctttggctagatcgaggtggttagcgactccatatcaccacaaggcgtttaggtgttgcgatcgtgcttgtcgacttgtcacaaaaagttgccaacactttctttttctcaaagaagatttggtttgatgctccagtcaccaggtacgctataaataccctaagaaagctcagtacaatgtacccataactacagtacattcatgtctatatgctttctgatccaatattcatcatttgcgaaatggtcacactaatttgaaattaaaaaaaatacccaaagctgctctcttctcctaaacatcaaaactattctatgcaccatttcttgcaaaaccaagatcctgaagcaaattttaactttcctttatctgcttctaataactgttattcaacaaatgcaggtcgaaaacacacagaacgatacagaagaggtccagcactcaatgcttttaagaataacttataaagagtttacattttcacgcatttgtttgatctgaaatttttaggttgtttctacacgcagaaagctatctcctgacattgagctacatacatcttttgttttgtccccggcagggaaagatgaattgcaccgtagttctgttttgtgctttcagtttcagctattcaatcttggtgtaattgactagtctcaataaagcttccattatctaaaaagctaatcaatcttagtgagcactctgatattgaccttatggacccattaacatgaatcataatcctcaaatgaatcctccattcaaatgatcaattcctatacagcgctaggccaggatggatgcaaccaattaatgatagttcatttatttgtagataggtaccatataaatttgggaaaattacatccataccacaaacttttgaacggtaaaaaaaaaataccacagatcttcccaccttcccagcaataccaacaataccaatatcaattgaatacttcgattgttattctttatatttatggtgttcttcttagtcttgtgttattttatatgcttatgtcgtagaaaatgagggcacatgtttaataaaaatacacaagaaccaaaagtgcataatatcattctaaactgagccttgaatttctgcctttttgtgactcatatttttccccttctttcaatgaccatgatattattccatatgtagcttgctgggattagaactttggatgatatatatggagtgcaagtacggaaaggctaatgagcgggtgatcgctcccccacccgcccagcgatcacctgcccaccctctcccctatactactagatgtactcctccctcttctcccccttcctcctctccttctcctctttctactgcagtagaccacacaattttttgaaaaacaaaagttagaaaaatttatgtatagaaatactatatataaaaaatttgaattcaaattcaaatttgaatcgggtatgtaaacttttgacttataaactttgggtctataaactttaggtgtataaactttagatgtatagaaatactatatatagaaaatatttgaattcaaattcaaatttgaatcggatataattcaaattcaaatttgaatcgggtatataaactttaggtctattaactttaggtgtataaactttagatgtatagaaatactatatatgaaaactatttcaattcaaattcaaatttgaatcggatatttgaatttaaattcaaatttgaaacgggtatataaacttttgacttataaactttaggtctataaactttaggtgtataaactttagatgtacagaaatactatatataaaaaatatttgaattcaaattcaaatgtgaatcggatatataaacttttgacttataaacttttggtctctaaactttagatgtgtaaactttaggtgcataaatttactaaaatagaaaagtaatgtggtgccaaaaaaggaaaccaggtggagggagggaggggggaggtggggagcgaatctgatcgctaccccatccgcacggcgatcgatcgcccattaggggtacccgtgcaagtatctataaccatcaatgaaccagaagtgagag

SEQ ID NO: 80536 - DNA, 5906 bp, Oryza sativa
ctccatccgccgcgccctcccgttgtttcccgcgcgcgcgtgccgagtggccgaccgcctggtcaccgctgccgtcaccctgtgccgcgccagcccgcgcctgtcgcccgtgtcgtcgcgccgctccaaaccgccccgccgtcatcgccgtcgtcaccgcctcggtcccgccactcccgcactagcctccaagggacggaggcagagcctccctcctccctctgccgcgacgcccccgctccctcctccttttcccgaagaggcaaggggacaagcccctttcccccccctccttttccccttttcccccgccggcgtcatcctccctgtcgccgctttggccgcgaccgccgagcgccagctcgcgcccttgaccgcgcaagttggttcccaaaccgacattgctgcccatttaaaccccagctccttcccctccaatctccctcgttttcgcctccgtgccattgccgccgcccccgtgctctgttcgccgtcgccgttcgttgttgcgcgtgtcggaggagttggcacgagcaaggacgcggaaggggacttcggccgcgccctctccttcctcttccccggcccgaggccggagagattactcccgcgccgtcggcctctcgtcacagcgccccgtcccgcacggtagtgtctccctccgttcttcctcctcgctccatctcctccccctagctttcggtagtagcccgagtagactccccgtagttagccggcgccgccccgaccgttgtcgtcgctcgccgcgtgctcgccgccgtcgccgctcgagctccatagcacccgctcgtcgccagcctcgctcggcgtagctccgtccaatccgacgctagcatcgagttcccgaagccgcgtagatgctctcaccgccgggaatcgacccctcgtggcctcgtcgccgtttccctcttccctccccgccggttgtcgccgctgcgattcgccgccgtcaagctccctccggcgaatccgagccgttggctcgtctcccctcatcacgaacaaccgcccggtgtgctcgcttttgcccgtatcgccgtggttcgctccgccgctcgccgccgccgcccgccgtccattcgcggccgggtcgtcgtctacctcccgccggcccgcgtggcagccacgtaggcgccacgtcggcgccagctcagcctagaccgggtcgggccgaccccggtcagtccctccccgtgcacgcgttccaccgcgagccgtgaggctgtgcgtgggcccgccgcacccgcgtccaccgcaaaccgcgcgcgtgcaccgtgtccctcccccgcccgcgcgcgtgcgccgcgtgctccctccgcacggtgagccgagccgctgacaagcgggtcccacccgggaccgcgcgtggtgagcccggtccaccggccctctctctcctctcctcccgcgcgcgcgcacttgggccgccttgggccggccggcccatttaggtcggccggtccgctccttttcccttgggccgcgccctagccgtccgaggaaaagtctataatccctccctccttccttttctttttccaaaagggtttaaataaatcctttttccttcagaccaaaaatccaataatcttagaaattcaatatcttcccaactgtaaatccgattgactccgttcaacttccaaaatttcccaaatctcgagatctatctaatggcacgcttagaggtcattaatagggccttattttttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacataatctgttgtcccgtctgcaaggcagattggcagacctacctaatttgttgcatttgatccttcctttgttaattgttataccatgtccccttgtaaccacccagtcgcgcctcgatattcgtgcactctgtgcgagtatcgacggtcgccttcaaacttaaaatctgaaaaacaacttgggtaaaactggagttttacaaaagacttggaaaacccgacacctgggtcggtgcttgcgaactaaatgatttttcaaaaccgcggaccgggaaacgtaccgggtgtacggtttcccgctcttgcacttaaagaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaaagaggttcaatgtttgaaaaatctgtagctgacgggatcagctaggcccgggtggccgtttgaaaagttgttggcccgggtggccgtttgaaaagttgttggcccgggtggccgttgaaaagctgttggccgggtgccaaccttgttttaagatgtaaagactgatacattgcacatactccgaccggacgggacgcactgtctcaaccgtgtcgtttgagaagcactcacttagttgtttcagaaaagagttcaaataaaatcaattgcaaaaataccggcctttctttgaagcctgcattaaacacttatttcccctggcttgctgagtactcctgtactcacccttgctctatataaataacccccccagttgctgaagaagatgaagcggatcctgctgatgaggagttcttccaggaacaagccggttacgatgagttttagggtttcggcctagttcccaagtcgcgcctgtgttgtttggtccaagccctggcttccgtttcccttttgtaatgcagttgtgagctcgggatctgtccgcagcccaacatgactgtactcctactctataataaagagacctctgttgctgtgatattctatcttcctgtgataccggcactatttcctgggactggtatcgattaacaggttaatttggagcgtcacgggctaattccagtcgggactagctcggggcgtgacactttgtctttagaaagccagccaccggcaacaccaacagtagagagcccgagagcgacgcgtcgctgttagttctatctttagaaagccgcactcgacacgttaacactacaaattctcctagcatcggaccctataaatcaagtttgaccaataataaacgttggaccgtacctactaattagaggctcggtgttattaagaaatgtgataaactaaaagcatatttgtccgtacaatgcatggctccccttagttttgtattatatgatatgaaaaaaaaaacaatcgggtaaaaagaataggaaaaaaagaaccattagtttcatattatatgatatagatacccttttaaaataatattattctgctgaataaaaatgaagggagagctagcagagggacacagtcattaggggatcacgttaatcacataaggaatttccttaatttttatcagtaaggtacaaaattactaatgtagtaattaaccaattttgtaaaaaaattgagatgtatcttttttttttcaataaggaaattccttgagttttttcatgcgtagtttgcctccaaatacttcccgccaaactcaattttccctccaagtagtaccgcaacattagataacaaacctgctaatctctctccacatctctctcaacgaataagctccctatataatccccattcaacctggaatcagttagtcagtcttctgctccccattatctctcaccagagcactcctccatcgcctcctctaagatcgcattctcaactgctcagccgcgcagggcctccggccatggctctccccctcatctggccatctctcgagactctctcccctatttcttgagttgtggaatctgcagactcgaagatccaaaccaccccatccttttcgcctgcgcttggtgagggcaggtcacaggaatcgacatttcaaccaaaggattcctctctacagtttgtgtaccttctctctaaaattcctgatgcttatttctgagagttagatcaactagggttaaataaaactggatggcttgctctctgttagagctatatacaccatgtgttcgatgaaaagcaccggtaccaccatctaaattccatgtttatttctgtacaagaaacaaaattagttcccactgatgattattgaagttctgatcaaacatgcagttatttgataaaccgtggtagcatctgctagacaatctgaacaggttaatgacatatgttcagtgacattgattacattattgtgaaatgaattaattggatttatgttgccagatctatgtaattagttgtgtgcaaaatattcctgtttagatatcttgataatgctaagtaccgaatcaaaatgtatgctccgactaataatcaaagtttatgcaaagtacagaagcaggggaagattcttgtgtgaaatagtcaattttaggttactgcattcattctcacttttatctccacctctaccatgtggaactgaaaatttgttatgctcgtatctctggctgtacttccaaacccaaacaagcaggtcatatgtgtgttcttgtctataatgaatatagtgcccctgtcttaactgaaagtttagtagtacttaccgcatttaagctcaattatatgcatccagtttgacggagcgtggggctcctcaccgggagaccgcgctggcccccctttgccggttcggccggggaccctgggtgagactctaagctcccaatctgtggaaggttcgcgagacaggaagcacacaagacgccggcgatgtatacaggttcaggccgctgagaagcgtaataccctactcctgtgttttggtggattcgcgtatgaagaagctacaaagtatgagccagcctctcccttgttctgggttcctaatctggaaaagtccagtcccccccttctctaagtgggcaaggtcctccttttatatcttaaggggataccacatgcaccatttccctcttttttgtgaggacttcccctaccttttcataaatggacggagatttgtatagttgccgtccgagtcaccttctgatgggatggcctacaactacctccactttcgccgggagcagatgcgacgtggaatcgtggctgtctgctgtcgacatgaccggagtcagaccagtcacgtcggtcattcttgtccaccacgtgtcagcttagcaatctacatgttcgcccttcttcacacaacatcttgcctgtaatggttaggatgaagcctgacatatatctgaccaggactaacgtgccatctctgggaggtaacacgctagctccagctggggacgagcgcctagaagccctcgtcctgacgggatggggcgaggcgtgcgccagatcgcctgtcgccacctaacccgcaatctgaccggtctgtgactggtcacagaccggataaatgagtgcactgcactgcgttacatgcggcgtgacacgctcagccaaatcacaataaatgtggttaggtg

SEQ ID NO: 80537 - DNA, 7670 bp, Oryza sativa
gaggggtcggggcgcctcggccctcggggatgaggcgggtgcggcccgaccccctcggggggactaagaggagggcgaacacatcaccctcgggcccgacgtcccccgagggtgccaggccacgtgggcgattgtgtctgcctcaaacctctagtcatgatactcctgatcccatgtcaccgacacagttatatcatattaagccatttataatttatagttatctctttgaacaattcataagttttcaatagatgtagttttccaatttctgcaaagcatatgattttcatgtagaggcggtcaacctatagcttttctcttgtagctgccatattacactctgctttagctttaacatttaagagcaattgatgatttatttgctttccagtactgtgggaatggaaggtgctgagaaaaaggaatatttatttgtttggttcttttctggattcttctctagctgaaagtgctacatccattatatttttgtcatgcatatactacacttataattgtatagtcttctaatcttttactccttgtgcagagatagttgtagttggtacaatattcccgtatagtcaagcatacttacacatagattaattcgtgctcttgaaatacagtaagccaattttgcaggcaaaatggctagaaagaaaaggttgaacatagtacatagcagctgtcaccatggaaatggagagggaagtagcagcggacaatcattgccacaagtcgagcctcctctaccatatgaagacgaggtgattcatgttgagcagcaagatgatgagcccctcaacatgcctggtaaaactttaactacctgaatcccaaatagtttgtgattgcatatatatggttaacctaaagttagtgagccttatgtcaattaattttgtagtacaagatgaagaggtgaagaagcgcaaggggacaaccttgcgatatgtttgggatcttccacctgggaaacgtatagttgtaaaatgcaacagattagggcaacctatcggggatgaaggtggattgctaggacagtttttgggcacattagcaagaaatggagcttactgtccattagataagatgacctggagaaagatcaaagcagatgaaggagatttaacaatactacaatttgtccaggtacctcaaacgctaaaatagcataagtataatgctctgtttgtattactagtcattactttttgcctactctcagattgatgcatctgttcatatccatggcaactgaatgttttcgattcaatgtttatatgtattttacagatattcaatgctgagttttcttacttgctgttatcccttgcctaaccattgacgtaatcatgcaaattaaaatacttctactctcattattcctatgtatttcagacaaagttcctataccctccatcatgcgttcaatggatactgaaatcaattggaagagattggaggcgatacaaggctgcactaaaagataaatattttaacccaaagaagaagcgttctgctctgtataagctttgtccagacgatgtagaaaaagaccaatggattccacttatcaaatattggaagtcaaaaaaaggaaaggtaaaaaatctgctccacaatctgtactattgtctcattgacatatattgtactgttgttcctaccgtaaacaacattggaagtgtgaactcaatgagactacattgcttctgtaataggccctcagtgcaaagaacaaaagaagtcgttcaatgttacagaaccctcactcagcagggacaaagagttatgctcgttggtctgaggacttggtgagccaatttgtttcgttcaaaattcatctatacatgttcactttactttcttacattacctttcattttcagagacaagatgatccaaataagaagcagccacatagagcaatggtttacttagcaactcacaaaaaaaggataaagataaaaatcaacacgtggtatgccatatacacataatccttccataaatatctaatatgtatgttatctaccttgtacagtgggcatatattttttcacttgcaggtcacattggagaacctcatcgatgaacaaccagagttggcacaaaatgatcaaggaagagttgcatgggaaggtgatgcgctaaataaagtattgggcaaagaaaaacctggccaagtgcacggaatgggattacttcctgttcctaagcaggtttatggtcgtacatcacatcatctcaagaacataaacatcactacagtgaatgactcatcatcggatgaagagacacatgttagaggggaagtgggggaattaaaaaaattagtcaaaacactgggtcagcgtattgaggagttggaaaacaaaggaacaagcaatgggaatagtgaaccaactatggtaaacgttataaatacctttgtccttaacattgaatttttagctacttctgatttcatttttgtagatgcttgtaaaataaaaaatttatgtgattcacactaaaatcttaccccttcctgatttcattgctgtaggcaacatctcagagaacttttgatgatggtattgaagagggagtagtacggactaatagaaaggtaatgtcaaagtaatgcattctatgtttctcaccatattttgtgcaacaatatttaaatatgtgcacatacagagggttcgatgcagtagacctgatcaagacgactcaatgagtaatcaaataaatatatcaatggtattttgtcgtttctaattgataaattttatttgaacactcaatacacatactggcatgtatagtaaatttttattgtccattccactatagaacaaaagaagatgtgaggaacagcaaaatatgcaccatgacaatattctggatctttgtggcaaaaaggttaggatttgttgttttcattcatatggtgcaatgcaatttatatatggttttacatggattatatatcatggaaccagcaccaggaggctgataacaacataggatcaccatgtcaagatgattcatcatcacagccacaccttgctcatgatcttcggtgggaggtagttcttgaatgcctattaaaattgtacttgtttctcaatgtgttttattcatctcactatgatattagagtgaaatataaacacgttgttgggagaacccctagttaggcaatgctacatctgtgaatgcatcatttgtgtgaaacataaacataatcttttcaaggagtactgctatatttttatagacattaatcaactgaaaattaagtagtagcttctagtgctcaagtttagctttggacccttcatctatgccatttagtgttggcaaccgaatgataaacatgaaaggatattaaaagcaatttgtcatatcttaataaagttggtcttgttcatttgtgctattggtttgtatataccatttacatgatctaaatactgttatatgtcatgtccttccatttttcctaattataagattaatgtgcagagttgggttcaaagtacaaaagttatgtaataatgcaatatgttctgacctctttgtaatgtaacaaaatttcttatgtctcaacatagatgaataaaaagaagcaccgaaatttagagaaatttgcaaagactacagaaaaacaggacactcagaagaagactgcacatcacatggcccaaaatagggtgcattcttcttcagtgaaggtagtaaaaacatacaaagatggtactactaaattattgtttaacaattaattattgtatatttcttaatgaatacattatttctattgtaggttggtaccacaataatcttggtgactgcaaaatatcctaacaaagaaactgtggcatatgctacttatttgagtagtaacccaagagacaaagtggatggtgttgagattggtaacgagttcactaaagtggttgtcaatcatccacttaaggaagatgaagagctcgtaaggccactaaagcactgcaagacaattggtgatgcccattatgaaggaatgtcgattgcttggccttcattttgtgtatgctcataataccttcatgtaatatatatatgatgaatactatatttgcaatgcaaatgctaatatataaatttgttatgtaggttcaaaagatcaatggttaaaattctcatgttttaggatcacatcaagatggaatcaacaagatatggagctgatgaagattacataagattagatatattctatatttttttgctagtagtttgttgctcgaaatatgtatttaccttttcaaaggacatgactctgaatttgtttgttttcaattgggatgatgtaattagagtgctcatcaaaactttcttattgcaaagtaatatcatggttacatcacttcgtttatgattatttgtcctattgtgtgtatgtgcatttactttattacaccattttcttaataaatgtattaatattacaaagtgcactacagttcttttgtaattatgttgcaatatgtaaaaaaggtgttacagaatatgttgctacaagtgaaaaaacaaattacaaacagtgttggtacaactagaaaaatggtgttactatgatgtatggtaacacataaatacgtgttgctatagcactaatgtaacaccttttcttttctacaggaacggtccaatgtgttacaacaaactaaactatagtaacatagtctatagtaacagtttactgatgtgttccaatagaccattgtaacacctttttagggatatagtaacacaaaatcatgttattaaatgcctatcctgacgtagtgacaatgcttgtacgtgtgcccacgttcatcgcatttgctgcaacgcttcaccctgccagcctccgactcgtccatatcgttgcggatgcgacgagtcttcctccttccagtcttacctcggagcttcgatgggtcaggaatattgagtacttcatcgttagtctttgtgaactccccagctatgccgaacccataatctcgccactccatgtatgatatactgcttgcttactgaagtactgtgacacatatactgcatctggtatgccacactccgttgcggcagcaatgacatgggtgcatggcctgtggagcagcttcggctttgcacaagagcaatgacatgtgccatcggctttgagaacacattcctacttcactctcttgcggtagatacccctgcctgccttatcttgacatagtatctcaaacctgtgctgttgggtaccttgcactagagctagatgtttcatggcctttttacgcaactcctctagctttttctgcatgaaagttccgaataaaatgctgttgttcggtatagagggaagaactgcctgaaaccgatccctaaaatacctgcatgtcccatgtaaaatgaactccactatgccaactagtgggagtccacggataccgcgcatcacccagttgtaaacttctgccaaatttgttgtcattattccatatctagcaccacctgtgtcatacgccttggcccatttctcttttggttcatgcagaatccactgagaaaatttccgaatctccactccagttcttctaaccaatgttggactatccgttgggagaggtccaagagcttgaggagggtcagcaacggtggtcgatggagccgctgcatgctgatcactgcatttggctgtcaactcatctaatctcttccaaagctcattgaattttttctcctggttctgattgcatagcctcttgaacatgttcatgagctccttgttcttgaattgcttgaagaaattagctcccatatgacgcatgcaccacctactctgtacatcttcccactcaccagggtatcctcgttccatactcccaaactacaactcttctatcgctcgcagaatgccagcgtgtctgtcatgtatcaggcacacatttagcctcataccaacaacttttgttttaaccaatttcaggaaccagtaccagctgtcggtattctcactttcaacaaaagcaaatgccaagggcaatacctgattgttcccatctacccctattgctgttagtatctagacccgatactttccagtcaagaatgtcccatcaatgcagagaacaggacgacagttcacgaatgccatcttgcatgcatgtagagctaagaacgccctttgcagcacactcttgccaggatgttcagttgaggggaatttcttcactgcgtaagagctcccagggtttctttcttcgataacaccaagcaggcgtggcaaattgtcatacgaggtttcgtaagttccaaatctcatctctattattttctgtttggccctccacaccttggcatagctaatagtatacttgtatgtctcttcgatgtgtcggattattgaccttggttcatatgtgagattatcgatgacatacgcatacatctcagatgcaacaaatgcacatgtaatgttcctgtggtatttctgaacaccaggtagaaaacatgtatgcttggtaacgactgacactgtctaataatccttccattttcccttataagcgtgcactctccagggacaaccatctttttccttaacacaccgaacttcatattgcgaccggttggacttggcaacccaaaactctctatgaagtgacactgcaaaatgttttaccacctccttcatatcttctgctctagtataaatcgctccctgaataacctcattttctttgtactcccatctcacactatcctctttagagacgaccagaccagaaaattcctcactagcccattctgctggattaatatctgactcatcatctgatgaatcaccttcctctacacgcttgttgtcagaatcctccctctccatttcatccacaatggcaccgacagtctccctctcgtcggccactccacctggttgaatgcccactagagctactacgcccccgtcctctcgtgcgttgacctcttccacagaagtctcatttacttcagcacttggtccatcgccatcatccatgttcatctgcacacctggatccttcgggtgaacaaacggaaccatagctagaggccacccgcgttgcaatgcattttccacataccatctccacactcgagagttttgaactggcattagttcccaataaaaaccctcagttgcccgacttactataacattgattgttatgtcacttgtctgtggatcaactctcaagcccctcattaaccatccttttatagaaggtacactcctctcagccggtctatcaattcccctttctgatacaataaattctgacagatctaccccagttggcccgtaacggacgtttcctgggccatggtaaacttggaatatttgtttgttcgacatatctgtcaacgaaataactagatcatattattatttcatacaataaacacctacaacgtaatatcttcttgtgtatgccaatgcaacggtaaagtactgattccaaactagcagatctacgtagttaccgatatctacaatacgcacttctagattagtacaactaaaaccttaaaaatataatgcatttattcaaacaaagttgtaaaaaatacacagtatttaactcaataggcacatataggatcta

SEQ ID NO: 80538 - DNA, 1987 bp, Oryza sativa
cataataaactagtcctataaatataagttttttttaggcgcctcaaaagattagattgtaaatgccttttgaacaatgcttggagaaactatctgtatggtctcaatttcttaaaaaaacattttgaataaaaaatcagaagcatataactcaacttgtcaactgtctaattccctcaaattataaaatatagagtaaatttcacaaaactataggtactttaatcaatctatctgaaaactacagttttaaaaatgcatatcatgaaactacagatttaaggtatcgtatcagaaaactacgtatttaaaaccagttttatcataaaactaagacttttgtaatctcaattgtgatatggatataaactccaaaagatgtagttttctatgacttcttcactaaatatgtagttttgggatacgatatcctaaacatataattttgcgataaatttggggttaaatatgtagttttgtgatacatatttctatatatgtagttttgtgatagtttggtgaattcatttgtagttttataaaatttactctaaaatgtatgcttttatggccatcagcctgtccaatacgccgaattggctggtttggttcacctactcgtttgcacgtatcaattgccagagcttaatcacgtcgtctagctgcacgtgtctctgccttttttaaaaaaaatttctcgactgtttgatggcacgagatggtcgcgatttcagcagtaattcgttaccggtaggagacattggggcctcgtagtttactctgcaaccttatcaacctctgtctaaactttaatttgaagttaattttgagtattttcaacgtagtcttttttttttaaaaaaaaattagcttttaagctgctaagagcttatatatatatataagttttatacatcaattatttttttattactaataaaccattacaatttataattagttttggtcacgatcaatgggggcaatttcttgtgtcttcccggtgcagcccaaccggcaccatcatcccaggaatctgcttgtcctgctcgacttggaagtaagctacagactactacagcatatgcaggaccaggcagctccagaacacacatactacgacattggatattcaacaaagtaatactagtactaaacaacttcgtttgttacagtactagaatatacttattactcatacataagcttgaaactgttaaacctcaaccactcatgtcggcatctcttcagaacttatcagcaagcgaaagactggagaccggagagaagcagtagcagcagcatgcagtaatcaaggaccaatgcctaatgctacagtactctctgtttagtatagtgatctataatctgtttgttactgaggctctgagcagagaatgcagcagtacaagtatggcctgatggccagcatctaccctgttgatgattgctttttatgcactgcgaaagaagagagagcgaggcacaggcaggcaggcagtcagtctcgggcctgcactgcctgcttctgcgtgtgtggcaggagaggcaggagcaacggctttgacgcgtcaataggtgaaattctaattacctgttcagttaataatagtagcattttcaagtaaacttggataaatattactgtaaaaacttttactaatcttgatatgatctttgtaggtatagccaagctttaggtggtgtttttttcttctgaagatgaagataaagatgaaaacgattggtattaacgtatgattgattgagttttaattattataaacttaaaaaataaattaatatgatattttagagcaacttttatatagaaagttttcgtacgaaacgtaccatttagaagtttgaaaagcatgccatgaaaatcttaatcttcatccaactcttattgaagaaaagaacgggaccttagtagtgacaactttgtaaggttccatattacttgagtaatgctaaagtcacacaa

SEQ ID NO: 80539 - DNA, 24512 bp, Oryza sativa
cctccgctgccggcagctagccacgcctcgctggcctccgtaccgactgcgcctcactggcctcctccgctgtcactgcacctccacacgcacaccgtgccgcgcctccgcacgcgcactgtgctgccctccatcaccgtcgacgccgcgccatcgctagcgaatccagctgccggcctcatgccagtgccactggtgcgctgtctcagaccagatccggcgcgatcggtgctagatccgagcgccccgctgtcggatccaaagtctccgctaccaccgccgtcgctccaccaccaccctcgccgatgtcgccattcccgccgccatcaaggctcccgtcgctgtcgagacctcgctgtccaattgccgagactctgccattgccatcaccatctccgccgctgttgctgacgccgtccccaccgccggcagacaccccgccagatctggccagagcggcacagatatggcggcggccgccgccgccaccctgggtgactcccctggctgcctgagcaggctggcgagaagccccaccactgccttccttgcggccatgtggctttgccggcgaccgctcgggtggcggcgaggcagaggaggaagaaggggggagaggtggcggcagggtcttcgcctcccgagccgcccctggggtagggtgacgcgagagagagtgtacacactcataagtattcttgttaaacacatggttaatgtcagttataatttggtactctcttttttattttggctcatgagccagcagcttataagacaaaaatactaaaacccaaacaaacaaacaacattttggttgattatatttaaagctataaagcactcctacactattaaaatcaacagtcatatttgtgtagcttttcatatgtcaattatagatgtgccctatttttttggctcatgagctaaacgaaaaagtttaagccccaccaaatggtcagcttgttcgttgcacttgttttagccatattaagccaaaataaaatcttggttcaagcagttcttttaatttgtgaattagacataggacttcaccttaaactcgagaattactagtaatgtgtccgtgctaacgctacgtatcacggcacatggttcgatatcaagtatctaatatgataaatttaatatttaggaaaaaagaactacggagagagttattatattgttgctaattgttaaccgtgcaatttggtaagcccggagtatacatcggcttagagtcagcatcggcttcgaaatcctgagattagccgatgagagttgtcaagtcgtcagttgtcggattcttgctatgttcggttaaggaaattgatctactaaaggaagcttatctagaagagaccgagttcaaagagaatgcggcatggcaagttatatattaattaggaatagtttgttagtttccttttatctctaggaaagtgtgtttagtgtcctataaggactttatcttttctttttatctttaggaaagtttctttcttatccgacaaggacttatatcaacccatgggtataaatatgtacacccggggtctatgtaatctatcttcatgatcaatacaattcggcgcatcgccaccttttaccttttctactttattttatcgtctggcgggacttggcacctgacgcggggctgcatcggtgttcgatctccgactaaggggtaagtccaatgttccgccggcccatgcaattgtatcgtttacgtcggcgtcgttcaaggctgcatcagtacattcgacctcttggattgctctggtttggatgatatatttgcctacctatttatcatatgtctctgttaatctagtcttagcatatcaatttagctctatcagctgcttctcgttttagggtttctgcaggtatcgactaaatcgcgttgctagattagattagcttagacatctaccaccctgaaaactcagtcaacggcttgattgtctagatattatgtttcttttcatacttagtgttgtatcagttaagtttgatctactaagtcgtgcttagaaccataatctctagcctgcttcttgattgccaataagggtttcatcggggttttagccggtgagttatctggacgttgcatcggctcataaggaatgcatatacatataagttggatttagccgataacaacaaaggtttcactgtttaatctaatcttgtggatttcatgacatcggaccttcagccgatatatgctttaaccttcggatcgatgcttatttatgatatcattatttgccgattggtttatactgaattatattgttattttattacatcatcatcagccgattgcctttatatcattatctacattggacatatagccgattgcttaaaccctatcgctatcggctggtatcgggcatcggctattatcggctatcggttggaactactccatcggcttgtcagccaatcgactgttttaatctactatttgcatatcttgtcagttgcaggatcaaactgactggcacgcccgcatctcatcaagatttggacctgcacaggagctaagcagatcttctaggctggtatgttcgattctttcgtcaacactaattatatagcctccaaaatataaaatcacaacttttgtatcttaggaatacaaacaaaacatattgcctacaaataatacaaaccaaacttcatattacaaggagaagcgttttgattattttataaattatattaatcaccgagacaaatttcacctaaatggaaggatataattagacagaaatgaccttgttgtctagctcaagtataatcataagtaacaagaaccctatctgaaccagtcctcgtgccttcgcaaagcatgttagatagtgcaaaagcattttttgtcattctgcataataaattgaaatttgtcatttatgaattagtttatagaacatgctgtaaatttgaaccgtaaatgtatagagtataaggatataccaactatcatgaattctttcaagtgcatgcaatcctataataaaccagatattaagagagttagtatttcatcaagtatttgctactatgattatcttttaaaaaataaattgttataaaatggcagcaaaccaccagcagtactacttcatgctttgtaaaattagaatatacttgaatcaattcagatgcttcaatggctgatgaatttttcatgcataattctacttactttcggttatgaagaatatagatagcacttaccatcaccaattggcttgccatcccatttgacaatgggcagaaaaggatctgactgttgcatcctagcacacttccttgctcgttggtcatattaaacacaccggcatccaccatcctgggtaccagtgctgcagccacttacagtagcggatccagaaaattggttcgttggtgtcataacgtgtctatcggtgtcatagtatgctaattatgcttagaacatgatgttatagtatatagataaacagttttgctataggttttgccgaaagtcgtcggtgtcgcctgacaccgatgattatactatagatccgcccttggccacttagccatttacctagtcacccacagcgttgaacgccagcaccaccagatcaccatcgcccgtgtcgaacaccacgttcatcatcggtccctcgtccatatccccggcctcgatgagccacaccaacgcgcacacaccgtggacctgtaccaaatgtgaatctacctgaccaaatcaagaacccactttgagtctaaattcagtaccaacaagctcctgcagttgtatttttttagataatggaaatggattacatctccggcttctgtcataagacacacagccataagtttaaaagtaataaaaaaggtaagataaaaataaatcaaaacgagaaataaggtgatgggacaaatctccaactcccctttattattgactagcgttaaaccacgtaaaaatttttagctagcaattcttatggaactatgccacccatagtggaataagagacccttggctaccgattccaagagtgtagcaccattgcgcatagtatcctgctcctcatgtggtagcattgtagaccaaaagtggagccagtaggaagacatgaagataacctgcatagggttagataattgtttaccattaaaaactttatcattgcgacaacgccaaattgaccaacatacagcactagctccaattagaatcatcttcttaatggacctagatacccctctaagccaattaccgaaaatgtttttggcgttacggggtggggggatattaaaagcaaaaaacacacatctccaaacaaactgagcgacatgacactcaaagaaaagatgttggattgtctcttgtgtatagcagaaagaacaatgtttgtctcccccccccattttcttttagccaggttatctttcgttagaattactttcttgtgaagaaactacataaagaccttgatctttagtggaactttcaagtcccatagaattctctttttgatccgaacattacagttcatgatcgcggcatacatagatttgacggaaaattgaccattcttatggagcgaccatataaagcagtctttttcatttgacagagttatattagctagcttgaggatcaaatcgttccactcgattagcttttggccaacaatagctcttctaaaagagatatttagcggtgttgtgctcatgacctctaccacagtagactgtttctttcgagccacattatataatgtagggtactgatctttgaaagcgcgcgatcccaaccacgtgtcttctcaaaatcttatgtttgtcccattaccacatctaaaagaacccaacctaagaaattggtctttgactttcattaaaccggcccagaactaagaaatacctatcttgctggacataccagaaagaggtttaccctttaagtatttatttcgcaaaaggtcttgccataggccttcaccattaaacaactagaaaagccatttgcttaataagcagctattttttatatcaaggttatggacacctagtccaccttgatcttttggtcgacatatgttttcccacttagtctgtattttcttttccggtcatcattactccaaaaaaaacgtgacctaaagtaatccagtctttgaagtacacctcgtggaatttcaaagaaagataacataaacaagggaaggctcgaaagaactgtgtttagaagggccaatctcccaccatatgacatgtttttgcctttccatgtgctgagtttcctctcaaatctatcttcaactcatttccaatcaacattccggagttttcgataatgtataggaataccaagatatctaaacaggaaagatccaaaattacaaccaaatagttgtctatattgatcctccacttccttggctttcccaaagcaaaaaatctcacttttatgaaagtttattttcagccctgagagttgttcgaacacgcataggatggctttcatatttttggcctgttcaagatcatgatctagaaaaaatattgtatcatcagcatattgtagaatggacaaaccatcgtccactaaatgtgaaatgactcctctaatttgaccatcgcatttagctctctcaatgagaaccgctaacatatcaaccacaatattgaaaagtatagggacattggatccccttgtcgcaggcctttgtgcgtttgaaaattattacccaagtcatcattgacttttatatggacacttcatccttcaaccattttagaaatccaatgacaccactgctgagaaaatcccttcatgcgtagtgtttgttggaggaattgccatttgactttatcataagccttttcaaaatcaattttgaaaataaccccatccatatttttcttgtgcaactcatgaatagtctcatgtaaaatcaccaccccttccattatatttctaccgggtaaaaaagccatttgggttgggcgaatgactttgtgagccaccgatgtaatcctattggtgccaacttttgtgaaaattttgaagctgacatttaaaaggcaaattggcctatactgttggatttgttttgcatcggctcttttgggtaataaaacaataattccaaagtttaagctaaaaagaggaagagtcccattatgaaattccttgaacagagccataagatcatccttgatgacctcccaaaaaacttgatagaactctgtaggaaaaccatctggacccggggccgaattatgttccatttcaaaaactgcttgtttgatttccttttctgaaaattcagcagtaagaatgtcattttcaaggtttgatacccgtgggatattctgaatctgttcctccatcaaagaaacatgattcacttccgttgacccaaataaacctttataataattggtgatgtactctttgagatttttatcaccggttattatagccccatcctgctccaattgaaagatcatttgtttacgatgcttaccgttggctaaaagatgatagtattttgtattactatctccctcgagcaggtgtttggctttggatcgttgtaccaatatagctcttcctgtcgtagcagctttgcctagtcatttttggcttgcttcaaagaagctaattccgctgttgagagaactgaaaattcagcttttttgtctagcacatcaatgaaagccaaaagctttaatttttctttcttgtatgcgccacttgtacttcgtgcccaaccacttaaatgttgtctcaagtgggcaatcctatgactccaacgctccatgggggtgttccccttatttatgttgtgccattctttagggaccatttcatagaaaccgtcccgttgaagccaacctagttcaaagcggaagagaggtttccaaaatgggcatgtgaaccagatctaagaataataggtgaatgatctgaaatggcgtgtggtagtgcttggcatgttaccaaagggaatttttgttcccattcagtgttcattaacactctatccaacttctcataagttggattttcaaggttatttgcccaggtgaactgcctccccgatagatcaatttctctcaaattgagactattgatcacttcattaaaaagaaaaggccaacggggatcaaatgaattattattcttttcttcttgcgacctgatgatattaaagtctcctcctaccaaaaggggttgagactcattactgcaagtatgcgctaattctgttaagaactgttcttttaaatcgggttgcgcagcaccatatactgccattagaacccatttaaaaccatcttctttatttctaagttgaaatttcacatagaaatctccctctgaaattgaaccgatatcaaaaacggctaaattaacccctaaaagaatgcccccgacctcccaacaggaggtttctcatgccataaaaaatcttttccaccacataggtttctaagatttgctgaagtgaatgacggttttctggtctcaaagatagcaataaaatccaagtgatgttccttaacacactcagagataaatctgaatttagctggatcaccgaaaccacaactattccaaaaaattcctttcattttttatgtttgttgcgtttcatttttggcttagccaaaggtggacataccactttatttttggcttttgtcaaaattttctttctttgaggtgcgttgcatgaatcaaaagactcgtcagcgctaccctcactttcttcttgccaatcactacataagtgctggatagaagataattttaaaagctcatccttgtcattatctacattactagaagaaccattgtaaacagaagaactagcatgtagagctacaaatctatcaacttcagaaatttttgtaccataaatagactcatctacttctatgtcatttctacccagggaaactcctagcttagaaatatttgcaagtagagttttgttaggcaaagatagaattgaacttgtagggttgaatttgttacctgctaccacttcgaggttatgaatcttttttagaaactctgctcggtttgccaccggtgcatccccgtttgccattgccttctgtcattcactttgacgtgttggtgtaggatgaatcagtcgacgagagcgacgtttagcttcttgagagggacgcttcccacctgcttctgcttgcacctttgcttcagcgatgatggtgcgtgctgcatcaagttgtgccccatcggcagccaactcaattaccgtgttaacacctgcagtcccgacatccaaaatcatcgagtcttgtgatgtggttacctctgtcacctcctgattcaccattggagcagcgtccattgtgccagttgacgaggacggcaagacctgagttgcatcgaccgacaaagttggagcatcggcagccaccaagcccaccttgtccgactcgatctcctgggctgcgtcgtccatgacaacaggagcagccaatgacacagttacagccccttctagtgttgatgctcccgtcgaagcctccgagagagatgcacaacctgccggtgccatctctcccgcatccgtcaatgtcgttgtaaattcttcctctgagatggcagccacactatccggtacagccaaagacaaagcagccacctcttcatttgccaaggtcacgttctgtccggtagttgggatctgcattgagctctcttctggagccttgttcatcaccgtttccaagctagaagccacgcaaattgttggcaaaacctcctcagcttgctgctctactgcagaatcatcaacaacagtgagcaaccctgcgatcgctgaaacacaatgtgaattaagctgagagtctgtaactgagcctcctcttaatgacattgaggatgacgcagcttcattttttagtcgctttggattccgatcttccataatgacatcatcatcgttcctcttttgttcactgtcatcacgctgatcatcttcgtctaacttttcctttcctttcgattcctcctcgggcatttctggttcaaagaaaatctcatacccatggttacggaacacaatgtacacactgggcggcaaagttgctaaatcatccaccgcaacctgcattcttacgaccccgtgtttccgaagataaaccatatccaccatcgttgtatttccaatgacagaaccgacagcatgaaggctaagaaagtccctaatttcatatggaacaccatagacacgaaaccatgtcttcttcaggacaaactttgcctcaatctcctgttcccatttgttaaataacaaatcaacaccaaaatcaaagctacggactctgccaaccctatgcaatctatctaattcaattgtagagggaaactgaacaacaaatgtatcctgtgccgtctcctttacttcaaatctgacgggaaccaaccggcgcagctcagtggtgagattatcaattgaaatgtgaccattctctacgcgaactgttgcagtcttactaaactcccttggtcttcctgataccttagctggtgtaggaatcatgaagaagccaccaccctctacaccccagccacacaattgcagtgggtttaggagcgagaagaagtgggcaattagagcatccctagcagctcatccatatttgatcctccaaatacctatatggatggtcatccaaaaaagattcatcattcatattcctttcaactctaacagatcatctatattacatcatccatatcccaccctcctatattttaataatatcttccaactaactttatatttatatttttaagggatatattttgaactactaaattttaactgcattttttatcgcaataatattttgaaatgagtaaattttaaccgatatagttttaatgaataattttttaattgatgatgtatttacatgaatggacttctaatccacattagcgctagcgactgaccttatcctctcgcttaaaaaaaagaaaaacagaaaagaacggaccttctctcgctaaaaaaaaataaagaccctaccttatcctctcgcgggtgcgtgcgtgcggcagacggaggggcgatgcgggacggcgcgggcggcgctgcagggcagggtggtgccgagctgaacaacggtgcgggctactgggcgacggcggaaggtggcgtccgcgcgcatggtgacgacggcggcggcggaggatgcaagcggcggccgcgagcatggcgacggcggcggcggcggaggaggcaagcagcggccgcgcgcatcgcgagggcgccagcggtcagccacgggcagggcgacggctacagacggcggtggcgcggctccagatctggtacacctctcgatctccactctcactccaccctccctctccaccgtccgctgactcaccttcaccggccggcgacgacggcgatggaggggaggtcgcgctggaggtgaggtcgcgtcgcggaaaagtctggatgggggcgggagaggcggctgttgcaaaatggcgtgaggagagaaacactccatttttgcttcttctctctcctaatttggcgcatccgccccttttggagggcctgttagcgtatctgctcgagctgatttttccccttctatacggcaaatgaaggacggatgaccggttagaggaactgctggggatgctcttaggtgccaaatgacctgggtcttcacatatgtcacaaataactgcattacaatcagtaacacggaaaaaaattctctgcggcagtgccgcacgccacaacccgtgcgacaccccgcagaatagcgacgcgtgtttaatctcctgctgcaggccgagccctctttggttggtgtcgagccgagtccatttcttccgctgcttattggagtcaagctgtccagggcacatgaatagtttttgtattaggtctgtaagttttcgggttcctatgtaagggtggtgtcttgcctctctttttatttctgcaatatagaccaaatgattttacatgctgtataaatatgatgtaaacgtgccaacctaatttcaacaccaggtgtgcttttaagttgtcaatcaacacatgtaatttttacttgtcaggttgggtatagcgctagaattggtttgtatgttgcaaactttcaggctttcatgttgttggtattcctatatggctatatagctccgcacctgtacaattaaaaattttcggagctactactctatgccaataaaagacaaactctagctacgaacctagacacaagctaggattggactttttttttttttgaacggagggagtactccttaaatgttccgtgatttgttatgtcatcaaaatgtaatttctgagcacccgagacatcttgataaagtttatgtaaaggatttatatattacactagaaaaatctccagcatattatcagcaacagttgcataaaaaagctctattgaaaaatgaaattattcaggcttcatgtgtagccagtagatgcggctcggtagcattttcaacgagctgacaggtgtgtgggtgtagtataccaggcatcggctcggctccaaagttgggctcaggccggctggggctgcagcgcgctgatggacaatggacacgcgtcgttattctacgcggtgttgcatagggtgtggcttgcggcactgccgcagagaatttctttcccagtaacaccatgtcccttttctttgcacctgaagcagcgaattttttacttagccgcggtctcatttgctgccttagtagccacaacttcattctccgttgcgtctggggcaggagcagctgcgaccgccgccacgccgtgggcagctccaccagtgccagcgccacttgaaggaacagcgctgctatctcctccaacggcagcacgacccctccccgctggatcacctcttccaacgtggccgtcagcatcagcccctgtggcgtgtaccagaacctgtggctgcgtgatacggatttcggcccctaccgcgaagaccgcgcctagggcctcttccacgcatgcggcgtccacctccatctcctctgcctaggttgaagtgctgaacaccagcggcagcttggttggttccatcgcctccgtcacgccggacgaatctcccaccgccgccagccatcaccccctctcgcacagcctcaacaaacgaacgacgaaaagtagggttttgcgacggtcagaccggcggcggcgacaggtgcggcgagcgactttggcggtcagaccggttgatctataccggttagactgacggcatccacacggtcagaccggcagattaatctcggtcagaccgacttccgtcgaattcgagggtaacttttatttccgctaaaagttttcggtttttgggtataacaactattcaccctccctctggttggcttagttattgtgattcgattctacagcatcgatctatatctctccatgagagcagatgggacttcacgcgagcagacgaacgctctccaatcgcccttcatccattcagatatatatccgcaacgatttgtgtaccgtcactactactagaaagattctcgcgtgcggtcaaaaccggttttcgcatgctggtgggcggcccgcacgcacccagagatctgcaaaaatcgcgattggagagaaaaaacagaaaattctagggcgcacccacacgagatatgtcgcctgcacggaaaaacaaaaatccaaaaaaaaataaaatttcaaaaaatgaaaacccttgaatccagcggtgccgccgccgccgcctcctcgtcgtcgtccgaggacgccgctcccgccctcgtcgtcgtcagcggcggactccgcgccgcccgccgctggatccgtgctcctctctggcgcactgccacgacgcccctcccctccaccggatctggggagggaaggaaggggagtggaggggagcctaatccctggggggggaggggggtgagggggcggccggcagccggatccgtgcgggggttgaccgccgcccgccggatcccgcacctccaccaccgccgccgccgccgctgtcgccatcgtctacacccaccaccgttgtcaggaggagaggagagggcgtagatgagtgaggccgctattgttgactgatgattgggaagaggaaaaaaggagaggagagaagaaaaagagatagacaggagaggagagaaagaagggaaaaattaaagtgggtcagagggaaaagagggagtggatatttttgcgtgtggccctcttaataggtccgcatgcgaaaattggctcattttagcttaaatgagcttattttttcagacgcgatcagttatgatccgtctgcaatctaaatgggtccctgtacaaggaaaatcatttttttagtagtgcgtgatcctacaggctttagagtcagaactaccttgcgacacgaagacttcatgataggctcatcgggagcacacgcaacctgaagacttctacagctcaggtgctgaactgctcaggtacaattctatttttttaatcaatcaggactctcgattttagcttctactgtattattttccaatcaagattagattataattctgttcttctctcatccgaattctgaaacgacatgaatcattactcgcccaagccatgtatcatatagatccatgagtttcaagttttagattaaattcacaaatcgaaaaatccccttgcattcaagaagatctattggtgatagtccaatgtacaatctataaaggtatcctatatacctatacaaatcatccccactactacaattctctgcttcctggtgcttccacatcatctctttccccctatccgttcgatctaatcgagcgatcaaccgttgctcggatcgacttagagcaagtataatagtgctgactaggttggcgataagaaactccacgtcagcatattcctacgtggaggagaaaaaaagaggaaagagagtgaagcgggcgattgcagaagcgccgagcgttagcatgccggcgcaggcattgccgccctcccgcagcaggtgcggatggtagttacgcagttattgttgatcccgtgtgcataaataattctgcctgctctcacaagtgcaacatgcaaaagattctgctctcatccggcatgcgacacacagatggtcacacaaatgaaagctagatttgatcatactcacatgcagtcaataaatgtatccaaacttctatccagacaatgtatagccaaaccattataccatccagctactgtgctgtcttcagatgacttggacataatctaccgccggcagcaagctatagtattatccttgctcttatccacccgcatggtcgcactcgcaccgcgtcggctccctctcctgcatcacgccatgccgcctcaccacagcgtgcttgctgcaccgctttctctccctgtcccgcatcacgacgctccgccgccctcaccgcatcgctctcgccgtgccgcatcctctccttctcctggatcgcgcccgtccagccgtcccagctgcatcgcgctccctctccacgcctcccctcccctcccctcccccgcccgattcccctacctccacgacggtttctcgcctgatcgctctgctccctcttcgtgaccctagccttcgtgcgcgcaaaatcaggaaaacggcatagacacctcaactgctccttgatggctaccgtgattgacgcatttaaatctgagtgctatgcccatcacaggtattgtgagtctaataactggtatccatcgggtgattatcaggtttggtggtttctatctgtagctctggtggtttagtagcccatgaatactagactccgcctttgctatgtaactaattgttgcaacacactagccaatttgttcttttgataaaaaaaaagatggattagccaatctccatcttgattagggattattggacgcaaacggcctcagctaattcatcctccagcgaggcagcgacggtgttgcattgcacacaccagcgacggtgtttcctatcatcctggcctgcactatttttttctgttcccaattggatcaggtgcattcttcttttcccttattctcccctattgagtttattggttcaccaaattaaaacatgtgtcttttggatgagttcatcggctgtactcatttttttcccatttagtactgtaaaaaagaaatgtcccaggtgtctgtcttcagtatgccagccaagatttaatatcagattcccccttcctttagatgaagatcatatacttttttgctgatggattttatgctgcatgttctcacctaattagaatgtaaattttggtcactaatttctatcttaaatcatatttcagctatggtatgattcggaagagattcagtttcttcttcagaggcattgatttctagaaattccaggctgtacccctcaaattagcttatttcttatactacaatattatttatttctatcaaataatatattaccactcttgaaataattgtgcaactgatccgtacttagtttgaagcagagcacagtaaacagtggccgttacacggcacatactactcaactttcatgatcacatcagaaggttagtattttacctattttcaacatttgtagtcaataaaattcattttcctatagttgatcaaataagattgtgctttgttagaaaaatacttggacctattcaaccaactcattttcctatgatcggtctaataataagattaaggtcagttggaaaatacttggatctattcgactaataaaatgtgtaaaatgtgatgataaaatgttttcataaaagtaatgtttttcatatacactatttctatttgtgatggatcaaacgttctcttttctttgcatgcacaatgtcccgatgcaacgcgcggggtaccttgtagttccatcaaactcataggccacatgacttatttaagaatttcttggattttggtttcaattgaagtaataaatatgctgatgatgttttgtctattgaatgataaagttcactgaaaaattgtatcgtagaataattttaagcagtgaacatatatagatagtatatatattgtatgcattacgtcgagtctgtataacgtattattcatggacatgtcattggatttttatccttctatgtcaattttacatgatagtagtcccaataccactaataaatcggttgcttcgtctggaaacatttgttctatttcagccaatcaatatatgtaatttatttgataaaaataatttagcagactaatcagcatttgatatcttcaggcacttttagaactcatttaatttgtgttgtgcctactattcgctatatggattctatagtaggtcaaatttccgtaattcatagaacttgcccgtaaaaatcacatggaccattagacttagaaactataaatcaacaaaataaatattataatggtttatatataattactaattttgttttcttggaacatataaattaaaaatattagtacacataacttccactaaaacaaattttacttataaatttgacgtatatattttaacatttataatacgaatagcaatatataaattcatcccgtgcaacgcacaggttgacgactagtaatctacagtctgacacatttatcttcagtgttaaaagtgcaggtcatcacagaagctcacaaaggagtgcctcaaagtaaagagttctctcaatgtaggggaattccgtaggagtgccggagttgtcggcactccctccactggagtcctggaggaatgccggatactttattcaataaagtaagtatttgggatttccttatggtatttaattagcttacttaagtgggatatattctcattggtgcggatttgtcgcttagcacttatacagagtgctctagtactaagactcgggataaagaagaaagttcttggccgaggctagagtattaatcgataacgtagacatggtgtgtagattagctgttacctccgtttgttgtgtgctccacagaaagtgaggtacgtgataggtggtgacagccctatccgtcctttacatccctccatgttcgggtatgtgatagagcttaaggccggactcagcctggcagagcaggagaggaccggtgcccactactacaaaaaccctcatagggaccggctcataggtgccggttcatttaaaaccggtacttatagagcttttcccacctcccagtaatagaaaaatgtagaaccggcacctttaaccatgctagaaccggcacctatacctttgagccgagccgatgagccgataccatccgcgcacgcacggtgcaccgcacccaccgcatccttatctactgtgacatcccagcctaaggcttaataggaataatagaatactcatatcaacaagtttcaacttctttttcggaaaccgatctccaaagaactccagggttaagcgtgcttggcctggaacaatttgggagcgcacgagtgaggacaaagtgtgcagaaaagacttatgttggtctgtgagggcagtctatgacctatgaaagctgccagatgtaagcgtgcctggcctgggagaggcgggacgttacatctactccctccccttctcgatctctcgcatatctctccctttctctctcgcgcatctcgatctccctccccggcagtctataacctatgaaagctgccagatgtaagcgggcccggcctaggagaggcaggacgttacatctactccctccctttctcgatctctcgcatatctctccctttctctctcgcgtctctcgatctgcctcccccctctctctcgcagcggctgccccgcggaggcagggacgtagggtggcggtgggcgagctcccaaagccagtggcgcaggtacagccagtgagggaggcagggcggcggcggggtcctcccctccggacccctcctccttcacctcatcctccgccgccctcccctccccccttccacctacgcgacgggcggtgtcccccttcccctctgcccccccatgggtggcgtccccacgggcggcgcatggagaggcggcggatcgcagccggcatgcggcagcagcgggtggagaggcggcggcagcggtggccgcgacctcccctctgccagatccggctgcccggcatgcggcagcgggacggggggcagcggcgtgcggcggcggcgacggcgtgtcaacgtgttcctgtttgtggttgtgttgatgccttgatgatgctcatgttcttgagttcttgatgctcatagagttcttgatattcttgggtgaaatcgggagcttctccatgcattgttgtttgttattgatgtgtgattaggattttgattttggacgtgaggattttgcttttggatgtaaggatgtgtagggttctggattcggctcgattcgagccgggggatttttttttggctcgtgcagacataaaggtgccgggtctattttacctataggtgccagccccagtaataggtgccgaccaattggtgtcggacggaaaaccgacataggtgccgaccaattggtgtcggacggaaaaccgacacctattgccagttttcaaccggcactaatagagttttctggactagtggcccgaagcattcgataaagttttacctttaacttaagttagctagttgaattcataggaatcctctctatcctaatattaccatttagttgtttgtccttggttgaatcttgtttttagatatacacacacgttcattgtgttcgataccattataatactctaaagggaagtgctatagtggtatctatgggcttgcggatttatctgtgtgcgtaacaaataccaacacttggatcagatactcgcataagagtccatgaagaattactaagtcctgagtagaataatatggaaacaattgaagaaacaaactcgttcattttgaattttgagtttgacttgaaatgaaatgtttgtcagaatccaaatcacacttacggttgcaactaaaagctttgatagatggaagccaagtacatcagtccaaccacacttagaaagtgtccaaggtgcatagcttcgaagtagtcaattatagataaaattgggaggaattcccaaatagaagtgtgtgatagtagcactcaaatacttggataattgcattaaactgaactaaccatcgttgaactatgaagagcctcgacatggctgtgagagatggttacactgccccagcaatcatgttttgaaaattatcttatcacccatcattttagaataatgcagcatatgacgcacaatgcaaatgagtcacatgaacaaactcactaaagaatatgcatctccatgttcttctatggacatgaatttcgtacaagcaacaaaatattgaatgctaagttatgtgaaattcttgcagatttgaccactagatcattgtacatcttctcttgaatagatgtgtccgaggaatcggaacaatgagacatatagaaatgcaaaattcagggggagaatttcactgactcattccaaaatcttgatatagaaaatcattgccatcaagatgaggcataggcatatttgtggagtttttcccattgggtttttgtggagttttgatgaggcataggcatcatgcaatgaaagctcaagagggattgttaggaaaccgacaggcccatgaaggcatggcctaggttatctactaatgggccatcactaaatatggaaagttcatgaggctatgcctatcaatagatgggaggaggtgatgtattgtacactagtgatatgcaatggaaaagtctcacccctacatcttgtgtcaacactttttctagaattatgcaatccctcttagactactatgtagcaggaggggttgcataataatgacgaatagtgattgacgctcatgtatatacacacactcacactttgtctccaggaaggatcacatcaacaccctaccctacctgtcagataaatgggaaccagggttctcattacaggctgctacagacgtccatggacatgtcatcaagatcatatgacacatgttgtcgtcaaccagattcaagcgacaattgagatacatcctgtcggtgacatggggccgggggtatcgtgactagaggcttgggtagccgtgatcacccacgtggcccgaccccctcgggggggtcgggcccgagggtgacgtggccacccctccctctgtctccccgaggggtcgggccgctcccgtttcggccccgagggctgggacgccccgaccccctgtggttttggcgccacgtgtgtgggataggtgagcccagcggggctcacctaaccgcatttatagcgggttggacgagcgcgccacgccgcatttaatgcggcgcagcgcacgcttatccggtccgtgaccagtcgcggtatgtgaccggtcacagaccggtcagatcgcgggttaggtggcaacaggcgtcctgtcgcacgcctcgcctcgtcccgtcggaatgatgagagtttcctggctctcgtctctagccggagctggcgtgctgactcctggagttggtatgtcagtcccggtcagatccattctaggcttcagcgcaagcatggcaagaaagtcgctggccattgaatgaaggttgaaacgggcgtccaccgggagagctgacgagcggagcagaaggcgtgtgcagtgcttgtcagaggtcacttccggctgtagactagccctcattgtaaaaagcatgtttcctttcttaggcagctagaggcccatgtggtgacccctgaccacataaaaaggaggcccaggcctaggagagggggctggactctggccacttggttctagagcctgagctctctctggttctctcgagctgtattccttcacacacagatccaccagaacacaggagtagggtattacgcttctcagcggcccgaacctgtctacgtcgcccgtgtcttgtgcgattcttctcgctgacattcctcagatcgagggcgaagaacctcacttagcgcccccggccgaaccggcaaaggggggcctgcgcggtctcccggtgaggagccccaagctccgtcatctggcgcgccaggtagggggcgcgcgtgtctttctaagccctcgtcctctttcgtgtgcgccaagcttctcccgctcagcccaatggccgaacgggcagtggcgcacaacctctctccgagcgctagcggtgacgacggggagcagaacccgcgccgtcgggctcgcaccccaccgtccccctctcgccgaaatcttgggcggggggaggcgctcgagggggtcgaaagatccgcgacttcgccgcccgcgggcgacgggggaggacggcgagacggggcgcgtcgccgcctcgtctacggcgatggcggcacgccccagggcgcgctccaggctgcgggcgcgctcctgcgtcacccgcccgtcgtccccgatccagagactccagcccgacgttggctggatgacgtggccgacttggtcatgacggcgcagcagcgcctaggcgccggcgggcagtcctccgccaacaaggcctctggcgctgccgccgccggctccacgtcgtcgaggcggagggcgcggcgagcggcggccgttacccgccgttcgtccgccattccctcgtcaacgcctccgacccaagaagatgtgcatggggggccggatgcccggctcgatatcgagcgccggcgcgacgatcgtcgcgccgcccacgcaacggagggcgcttcctcgtccggagcgccacttcgttccgggcacgggggccggccccccgtgtccccggttgacggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggccaggcgcggggttggttaatgaacttgccacccgcgtcggtccactcttgggaggatttgtgccagcagttcaccacgaacttccagggcatatatccgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcaggggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagctccggccgcccccgggtccgccgcacagccagggcggcgggacaggaggaggaagaagaagtcggcccgttccgacgacgagggtcatgtcctcgccgtcgagggcgcttcgcgggccccccgaaaggggaggcctgcgagcgacaaaaagaaggaggccggcgctcccagtagggagcgcccgaccggcaagtggtgtaccgtgcacaacacctccctccacgacctcgcggactaccgcgcggtcaaaagtttggctgagcggacgaggaagtgggaggaggagaagaggcaggagcgccgtgagggcaaggccccggcggctcccgccggcaaccggcgaggtgaggccaagcagaaggccaccgccgaggacatcgacgatggcaatgatgacctggggttccaggagcctgaggccaccgtcgccaccgtcgatgggggagcgtgcgctcacgcttctcgccggagcctcaaggccatgaagcgagagcttctggccgcggcccttacccatgaggcgacgcggcgggcgcggtggtcggaggttgccctcaccttcgaccagatcgaccacccgccgtgcgttgcccggggaggacagatcgcgatggtggtttcccccaccgtttgcaatgtgaagttggggcgtgtcctcatagacgggggtgcagccctcaacatcctttcccccgtagcctttgacgccatcaaggccccggggatggtgctccggccgtcccagccgatcatcggtgtgacgccagggcacacctggccgctgggtcatatcgacctcccggtcaccttcggtggttccgccaacttccgcacggagcgggtggacttcgatgtggcggacctcagtctgccctacaacgcggtcctggggaggcccgcgttggtgaagttcatggcggcggtccactacgcctatctacagatgaagatgccgggccccggtggccccatcaccgtccatggcgacctcaaagtcgcgcttgcttgtatggagcagcgtgcggaccacctcgccgtggcgtccaagcccgcgggtggcgacgagaggctcagcacctcgtccccgccaccccgaggcagcggatggtcacgtgcgacgaggtcccggtcaaggaggttgccctgggcgacggcccgtctaagaccacacgaatcggtggtcttctggacgacaaataggaagacgcgctcgtctccttcctgcgggcaaacgccgacgtcttcgcctggagaccggcggacatgcccggggtccccagggaggtgattgagcaccgtctcgccgtgcggccgggcgcaaggccggtccggcagaaagtgcggcggcaggccccggaacgtcaagccttcatctgcgaggaagtggcgcgactcctggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcgttcattaccccaataggaacttattgttatacgacaatgcctttcgggttaaagaatgcaggtcctacttttcaacgtactactcgaatttctttgggtagccagttaggacgcaatgttgaggcctatgttgatgacttggttgtgaagacgcgcaaccaagagaccttactctcggatctagcggaaactttcgaaactcttcgctccgcccgcataaagctgaaccccaataagtgcgtgttcggcgtgcctgcgggcaagcttctcgggttcttggtctctgcccgaggcatcgaggccaaccccgagaagatacgagctatagagcggatgcgcccccctag

SEQ ID NO: 80540 - DNA, 6234 bp, Oryza sativa
ccgcccatttgcagccggccccccgcacagtagaaaatcgccctcgcggagggcggcaagggggccgcctgcaaatttcgttgacggccgtcgcccgagagcgaacggccgtctgccacgtcattttcgccgccctctgggagggcgatttttaaaaatcgccctcccagagggcggtaggcgactatttccgttaattttcaaaatggaaaattatttttgtaaaacttttaataaaaaaaattataaataaaaaaaattccttcaaattcaggctgccggtctccacgctcctccaaaggcctcgtttagcatgggccaatttatgggctttacctgtgatgggccgggacaggattcggcatatgctaatcaagccctctaagaccagtcacaacccaagacactagacatagtttccatacactccacatcatcaagaaactacactactctcccaatgcaaacactactatttcatacttaaatttaatgctacttatctcacatgatgtcttgaatgttgtgtagaaaccatgttgcatgcaagacattttccttctctttcctcatttattcacttgccatatcatttttcattctaggtggcagtttatttaatgttatagacaccatcttagttattgggttaggaatggcctaaaccggctcgttctggacgaaagtggaacagacgaaatggagtctaggatagggatacactagtaattctcaagtcctaaccgtgatcaggttcactaaaccgatcggtttgcatgaaaaccaatgatattccgtttgtggaagccgacctgtattactcggtttatgtacgacgtttactaaaagtcatcggttttattgattttcattttttattgattttcagtcggtttttcataaactgatgaaatacggttcttacttttaaaacgaaaaggtaaaccctctccgtgatattcgtttgtcaagaaaccgtgatatattcccttgtgtttccagtgcaatctctaagctctggcggttggcaaacaatcgaatgatgaagaaacgaccaaaaggtattcggtgtatttatttttctgacatcgcccaattctttttctaagcacaatttcctgcaggatgagatatagctggatgcatggagagcacgtatggtacgacaggttggcgatgaattttcaggacgtcccattcccacacaaaaagaaaaactggtacaaagtgtcaaagcttagcggttgcgaattgtgatgatatttagctggatatggctgtcaccacagccaaacagatcacaccagagtttttctcttttccgacagatgtgaacatttagccgaagtccttttgctcaaccttttgctcaaaagtaggtggatgctgagaataattgtttgattctctgttcctctcaattctcattaacacagttgcaaagaaaattaatcaactaccaaacggaagagaagcatcagtaagaaaaaattgttcgccagatcaagataacacggagtggacaacaatccataaccctgaacgtctatacagcttgaagtaaaccagcataaaaaaaaagggtactacatagaataaaagttcaagattggtgttatactagatttatacttgtaaaacaacatgacatcagaaaaacatcatagtccagtatttcagtatatgcatgaaaatggcttatgcaacaaacaccatctacatagcacaccaaatcaatgatacctgtacacgagaatttttttcggaaaaaagtgatactaccaggctctctgctaactaacgctgggctctgaccaaacacatcagaaaggcaatgaaaatgaagatggtcttgcgcatagctttcgtatacagtaatagagatcaactggtggttaataccagcggtagagtacaatacaaagccaataagtatccaagtcaccacagcatggacaatatacagcacaaaacaaaaatatctaatatggaacaactctctgacttccaggtccataaattgacagaaaatcaacatcacaaactcatgagaatacgtttaaagaataaataatgcctgcaggtgacaagcaaagactgttagctcaccgtcccttggggttcatgatctgtgagaagacagcgctaggagtaagcccgtcggagtctatgctagcaacactttggtcgcccatgcttatggacgtggttgtggttgtagtggtgcttgactcgatcgatggatcattgggatccttctttccaggcatcacaaggggagtgccctcatctgacatcccacaaccaatgcttccactatcctctgcactttcctgcatttgaagggcaaattccaagttccacagcacatctcccattgaaggacgatcgatgccttcatctgaaacacatttctcagcagtctcggcaaacttcttgaagcactgtggagcgatctttcccttcaggtggggatcaacaatctgatcaagaatacccttcttctggcagtgcagggcccactctgccaagctaacttcttccttagcaagagtggggttcaaggcagggcgagcacagaggacctcaaatagcacaacaccaaaggagtagacatcagatttctcagtgagctgctgcctgcggaagtattcagggtcaaggtagccaaaacttcccttgacaactgtgctcacatgtgtgtgatccatcgatggcccagtctttgacagaccaaaatctgaaaccttcgcgacccacttctcatccaggaggatatttgttgtcttcacatcacggtggatgattgtgtgcttcgcaccagtgtgaaggtagtgaagcccacgggcagcaccaatgcagatctccaagcgctgcctccatgtaagtggtgcattcttggtcttgtacaggtgctcacgaagagttccatgagccatgtagtcatagaccaggatcatctcattcttctcctcacagtaaccaatcagtgacacaagatgacggtggcggagcttcgacagcatctcaatctcggtttggaactcatgcacaccctgctcagacagtggattcccacgcttgatagccaccttggtcactccaccatcaatctccccacgatacactttaccgaaaccacccacaccaaggaggagggattcatcgaagttgtttgttgcagccttgatctccgcaaatgagaaatggcggcacaggttggatggcagcgatgaagcgtagctcccagtagtatgtgatttggctgagccagatgagtgtgagttgccatagagtgaaagtggcaaccatccagaatgcccatcactcatgcctgtgtccttccccactctgctccgacgcttgcagatcataaagcagcaatatccaagtgcaagaaccaccagacctccaatcactccaccaacaataggcccaacacttgacttcttcactgctccaccatccaacgatggctcaacagttggaacagggttgagcccagcaaggctcccattactaagcggcaacttgaacacctccagtccattgaggatagcatcatagtactgtggtttagcctggacatctggatagagagctacccacaaatccatagcccctgaaccaactgttgtcactacaaagtcttgatacactggactgccgatcccattgttattagtccatgcaatcacatcggcgccctgaaaagcagtctggttgttgatgtaaatgttgaacacccgctgattgatcatagtgattggatattgtatctcacagaaatgaagcctcacaaggtatgtgaacccagcatccacctgcattatccaagtgaggttgtatgccaagttcacgttcttgtccggccccatcgaccttgccgtagcatagacatccaccggcgccacatactccggcacattgctagggtaggcaatggtgacattgtcatcttttgggtaggacaccccgaacgccgcaccaaaaacgtatggcgagtcatcgtcccacgaacggtaaccgcccgtgtccttggagggggagatcgcctggccgccgacattaagtcggtacattgtctgcagagcagtgccagcgtcgatcgggaatggctgattgttgccatccccggtgaccagattcggggtggagatgtcgaagagatcgggggaggagacaacctcgatgccgttgacgaacgcgtaggcgttggggtggcccttctccggcgtgaaggtgagctccatcgtcggggtcgtgacgttgacggagaactcgcggacgatgtaggcgaagttgagggcggtggcggtctggtaggcgctgaagttggagaggagcgtgacgttggcggcggggacggagacggagaagcgcgcgtcggcggcgtcgcggctggagtagttggccgggtagaagtggagcctgaggaacttgcggccggcgccgagcgggaaggagtaggtgaagggcgccgcggagaccctcgcggtgaggtagggcacctgcggcaccgaggggtcctgccccgcggcggacgccgagccgaggctcgccggcgcgtacttggacccggcgtccccgctccacacccgcccgtccgtgtcgttccccttccccgtcgcgccgcagtcgagcaggatgtcgtcccgcggcacgaacggccccgcccccgcagccggcgccggcgccgccgcgctgctcgagtttccgccgccttgcccccgcgcgacgcaagccgccacggcgaggaggaggaggagcaagagcacgaatctggagcttcccattgtggccacccccgctctcaactacaactagctaactgcttccgcttcacagatcgggcatcgagctttcctacctcctcgcagatctggtggatgtgggtgagaaactcgggttcaaggtggaggagacaagcaatgtgggggagggaggtttcgggactactacggccgcggcgttatgcgggagattgggggcgacgtcggcaacggcaaagcaagcgagctcctcgctctgctcggttgctcgcgtttttggttcactcctcgtggtgggatgggtttggctgacgggtggggacgggggcgggaggacgggagcgcacagcggggagatggctggagttatggaggacagctcgcaccgtcgtggcagcctgttcggggtcgggttgcgcgggatttttctgttgctttccttcggcgacgcggttgggaggggaagggaatcgtgcccatgtgcgggagacgggcccaccggcgagcggcggacgcggacgcggacgcgactgatcatggccaggtggcagatggttgttagatcgagaaacctggaaagaaaaactcaaaaaaaataaagaaaaaaaaacgaagctcggattgtgctcggatcatctgagttcagacgaaggtggcgacccaagttgccaccgaagagcttttcgtcatcgcaagggcaaggtttgtggggtgagaggggatcgaacttagacctcaggatcactcaatagctatgagacctacgcgctagccaactgcaccaccaccccttgtgtccaaaactccagattctgataaacagtcctaaacttttacaagagcagatttccgtgtcacaaagtactgagccggacaggaattgaagaacatggccgggaatggagaagaaggaaaataactaaagaaaaaaaagggaaggaggagaagaagagagattcggcggcgattagcccgttaccacgggctatttaactatttgttacttatctaaatgcccctatttgatttgtatttagtaatttaccactggagataggtgatttcttaacaatttgccacttttgtctacgtaacgagccatcgtggcgtgcccacgtggaaagcgacttggtccccacccgtcaacccctcccctctccttcttctctacctctggccgccatatctcctccacctcggctcgccttgccgcatatagctgcttgtacgccgacctcctcttgcggcagcaaccggcgaccaccgcggcggggtgggcggaggcggacgtgggttcttgccgacgtcaaagctgcttgacttgcgcatgctttcttgagaaggaggcagaatgaaccgtcaaggacgaggatgacgactatgacgtcgattgggcctaccgttgtttacttatgtctgagagggccacccgcacgtggttgcccttatggtgtgtgtggac

SEQ ID NO: 80541 - DNA, 54871 bp, Oryza sativa
  unsure (1)..(54871): unsure at all n locations
cggttgctcgcgtttttggttcactcctcgtggtgggatgggtttggctgacgggtggggacgggggcgggaggacgggagcgcacagcggggagatggctggagttatggaggacagctcgcaccgtcgtggcagcctgttcggggtcgggttgcgcgggatttttctgttgctttccttcggcgacgcggttgggaggggaagggaatcgtgcccatgtgcgggagacgggcccaccggcgagcggcggacgcggacgcggacgcgactgatcatggccaggtggcagatggttgttagatcgagaaacctggaaagaaaaactcaaaaaaaataaagaaaaaaaaacgaagctcggattgtgctcggatcatctgagttcagacgaaggtggcgacccaagttgccaccgaagagcttttcgtcatcgcaagggcaaggtttgtggggtgagaggggatcgaacttagacctcaggatcactcaatagctatgagacctacgcgctagccaactgcaccaccaccccttgtgtccaaaactccagattctgataaacagtcctaaacttttacaagagcagatttccgtgtcacaaagtactgagccggacaggaattgaagaacatggccgggaatggagaagaaggaaaataactaaagaaaaaaaagggaaggaggagaagaagagagattcggcggcgattagcccgttaccacgggctatttaactatttgttacttatctaaatgcccctatttgatttgtatttagtaatttaccactggagataggtgatttcttaacaatttgccacttttgtctacgtaacgagccatcgtggcgtgcccacgtggaaagcgacgtggtccccacccgtcaacccctcccctctccttcttctctacctctggccgccatatctcctccacctcggctcgccttgccgcatatagctgcttgtacgccgacctcctcttgcggcagcaaccggcgaccaccgcggcggggtgggcggaggcggccgtgggttcttgccgccgtcaaagctgcttcacttgcgcaagcttcctgagaaggaggcagaggacgccgtcgaggaggaggacgacgaccatgacgccgatggggccaccgctgcttcctcaggccgagaggcgcacgcgcactgacggcgctgctgctgctgctgacgctcatcaccaggacagcggtggcacaggacgtgaggctcggggacgtggcgccagaggagaccacggtggtggcggcactcgcagttgagctgggccagctcagggcgaagatgaagggggtgcgaaggctgaaggtggagaagaaggagaagggaggggttcacgggtggggaccacgtcgctttccacgtaggcaaaagtaggaaatagttaaggaatcacttctctctagtggtaaattactaagcgcaaatctaagaggggcatttagataagtgacgaacctaaaagtggtaaagagctaaattctccgttaccatgagtggcggcgcgatgagactattcggtagtctgttttacagctattaggattgcactgaacaacatagttgttcggctatcggttatgcatctcaaccgttgctagcgagtactagacgttgtagttgctgcagcagcactatcttacttgggcctccttatttggatcgaattggacatctatgggtcgtttgatcggaattttgccgaccacatcaagtagacaagtagaaggccagaagctagtgacgcagggccttttctcactatagaccccgcgataagtcccatacagcatttactgttactgtctaatttgcatacggccatactcctccatccaaaaaaaagagtaaatttcactttgggtcacttatattgacctcagttgcacattgggctaggggtgggtcacttttttcactttataccacttatttttaccatcctttgcaagttggaccaggtttattgattgggccactaggctgggcttcggccacgcaagtaggtgcgtttactagcagccggcaatccccgtctacgggctccggcgagggctccctcgacaacaattccgcctcccttctctggtacgagtacttccctcccaacccaaaaaagtctctgttcacacgcggttattgtgcagcggcgtgaactcaacaatcgacacacaaacgccaccgtctaggtccaccgaccaccggcgccaaggtggagcaagtctcgtcatccggccggggcgaagggcctctacctggtggacgcccatgccacctcgatcgatggcttcccgaggatggaatcactggggtcgttggctgcctcattgataggatgcttgttgggtttacgaggtagacaggtatatgcatctgctattcgatcatggatcaatctatggaggaaagttttgacccttggacttgggagagtgaaacaaagcaatgtattcagtaattcctatgagatttgggttttgtgggggtaatcaatattcctcttctgctcttcgaaaaaactagagtaattaatctgtgttcctcggttggtaaccggaaacatgtcgaattttcacaagaaaagagaagatcggatcttgattactgctaaatggaatagttggcctttgttttttttttcacatgcatgatcggaatgggatagttctggtgtggtctcagatcctgtcaacgtaatcagatgtgccgtagtattgttttgagcgtgacagggccgagcgtgatcaccctagagtccgcgtccactggacgacgacatgctcgccctcgccgatgaccaccccgacgcgtcgcgcacgctactggtatcgcgcaccactgccaccatgagcaaacaccagctgctcgcgtggattaggccgaaacgcatccctcccatgccgtaaacctggtccaacctgaaaaaggtggtaaaattaggtggtgctaactgttaagtgaaaagagaaacttagccctagcccattatgccacattggttaatataggtggttcaagatgaaatttactaaaaaaacaacttaagaggagattctagtgcaacaaatctggatagagagctgtttagattcgttgtctgaacggagggagtacgcgggatacaccgtccgatcaagactcgattcgttgtctgaacggaggaagtacgcgggatacaccgtccgatcaagactctgccgtacctgaggactgaggctctttctcaacggaacacacggcattaacacagtttactgtctgtacctttctcgagttggatctcgtactgttaccgagtgatggagctccccatgggccatggcgggggtccgccggtccgctgctggcgcccgaacttcacatggatcacagccatgctggcaggccatcgagcttcgtcggcggcttggactgataacgcgtgcaattgcttacacatcgacttcttcaagtcttcaacgacgacgatggtggtggtgtgcacacgggtaggtggcgaactggcgatggctgtgcgcatgtgcggatgtgcccccgagcatcgtcagcgcctgcaacaaagagcaggaggaaaacgctcatgaggacgacgatgaagtgccgtctcgatgtttttttgttaccctggagctcacctgccactttttaaaaaaaaaaatacgtgcaaataactgcactacaatcggggtaacaaaaaatcattgttgcatagtttgtggaaaaaaaagggaaaccaagctcagttttgctctatcatctgaaatgggcaagatgtgtgacgacccaaagtagccacgagagcttttcatcatcacttgagtttcatatggggtgagagaggctcgaactctcgacctcaggataactcaatagctatgagacctacgcgctagccaactgcgccaccacccccttgtgttcgaggtggcggccagcacggtaaaatcatattagcatggtaggccaacagcgcgctaatacgaacgtgtgctccactcgctgcatcgctggtttggttcgtgctccgctgccacgcgagcgagggcctgcactgcatctgcacgggcgaaacgttggggcaatcgtttctcgaatctcccaatgcaacgcgagcaccggccgttgcgcgcgggtactcgccggcggcgacagggcggccgacgagctcaacaggatgttcctggtggtagtgaaggccgaagagagcacgcaccggagggcgtaaatgagttcttgcgtggccagcgccaggcgtttgcaatttgcaaaaaagacaaaaagacctctccgcaccatggggagatagtaatacatgctgcgtgtcgggaacggtcgtgttttaggacctaggactttctaatcatgtttccttttctactcgtacgtacgttttgagaatcctaaatgcatggcatggccaaaatacattgttaaaataaaattgtgaaaaagaactaatcatgtttccttttctactcctagtacgttttgagaatcctaaatgcatggcatggcaaaatacattgttaaaataatattgtaaaaaggaaaaaccaagctcagttttgctctatcatctgatatcggcagacgtgtgacgacccaaagtagtcacgagagctttttcatcatcgctcggatttatggggtgagagaggctcgaactctcgacctcaggatcactcaatagctatgagacctacgcgctagccaactgcgccaccaccccgttgttgaaaccaattactccctccatcccataatgtttcaacctaagattcgtagtcctataatgagataggatgagtctaatctcattctagattgcaatattatgggacggagagagtacaataatccattaacataatatattcctcctgttctagtttgcgagctagcaggcgccatatatcatactacctccacccataatataaaagattttgagtttttatttacactgtttgaccactcgtcttattcaaaaaattttggatttattttttattttttttgacttactttgttatccaaaatactttaagcacaacttttcgttttttatatttgcacaaattttttgaataagacgagtggtcaaacagtgcaagcaaaaactcaaaatcccttatattatgggactggggggagtatgtgacatttaacttttttttaataattaaggatttgtgtctatgatacgtgggctctcatatacctataatatgcgagtctatgggtaaatcatttatcaccagtggtatgagtggcaaaaagaagttaattattcctatatgcaaagtgcattcttctacttaacatggtgacaagaaaattgagaaaaagcatgatttctcattcgtgaaaggacggagtccggtacaccattctctttacagttacagatattagccactcactcatcttgatcttacttacaccgacatgcatcaaaatgtacatcaagatcaacaaaaaatctccggtcaggttaagccccaggcagtcaaagttacccccgctgcatacgccggatcaggcagatcctttgccatattacagcgttcttccatcagtcaaatcatgaacggtgcacaaccttggagataactgagaacgggatcatcacccggtggcccttgtcgccgtagaagccgacgctgccgaagctcgcggaggtgccgttcatggtggcgttgacgacgaaggtcacctgctgcctctgcccgctggggatgaagaactgggccggcgacgcggagacggcgaccccgtaaggggcgctgtaactgaccgtgtagcgctcgtcgctcgccacgttggttacagttcttgttatcgttcttgactggttgagcactgcaatggtgatggaggggaggttcagatcagcccctgtcatggcggaggagctgcagctgttgccggtgtaattcatcactactggagcagagccgtttatgccacatagaaaggagaagaagtcgtcgtaacctgtaaagtcatgccgctgtcaggattgaataattactaaactacactgagaatttcagtctgactttatagtgagaaaaaatgttgcattgcatgtatgacattcaagctatattgctgttgctacttgctagtttgtattcatactatcaggtactccatccgttccagatagaagcatcagatacattttgaaaaatgcatagaaaaaatgcttatattttggaacggagtttgtataacataggccccagtgaactctaccaaaggtagaggtactgataatagtaaaataaacagaagaaatggcagttgaacttactggaatcaaatatgagcccaggatccaaagcagcagtagcattgacaaatccatttcccatgtcaaaaggtgtagctggagattgagttgaatttggattgccgtatgttctctgtgccatgattggattcccctccctgtcactgagacttgtagtagtcgataatgcagaacctatagctgcagggctaaaataagggaacttctgcttgactagagcagcaagcccagcaacgtgtggtgcagccatacttgtaccggaaattattgcaaaactttcacctagacagtaagtcaaaaacaacataattattcaattaatctatgtaagaaaaaaattattatataagcaaatttattaatagaagatgttataggttggattctaatgctaaacgaacatcttattaagggcttccacaataactagaacagtttttatacaaccttttctgtaaagcattatgtctagagcatgacctaaacttaggtgttaaaatgcacaattaaagagtgaaatcatgtagcgctttctgtgattacttctacataaaattttgctctatcactctatcagcgaggtaaagggaatggactaacaaaaatgcagaacaactgttggcacaaatcaatgccaaccgtaatctacaaatgattcatggtactattgaaggggaaaaaattaggctgaatcttcaattcagacataagctctctcattaacaggtattttagcacctaatagaactgttaaaaaaacagaaaatgcatgccactgttttgttttattgctattttatatgcctgatgattcaaagaataaaacttatgttctaaacaagattagaaagtaggtaaattgtcaagttaccagcaaattcagcagagtccaatccaagagaactccaagcaccccaaatggaactgccaggtgctatcagatttggcttcaggatatcagcattggccagtgagttgtcctcaggatcaggacccctggcagaataaaacattacttttggggcagaaataccataatttggattttggcctcctagtatttttgcaattgcaccaaagctgacgattttgtttgaggtctcatctctcacaagggactcattgtaataatttagaaatacctgagaatgttgcatcacatttgttaattttcttcatatcagcaagggatgagtaataacaagactcttgctttggctgtcataccttagagtcatcagatgatggtattataagtccaggcatatccattggagttggattcagctggaatccaatgacaaatggatccagatagaatataactcctgcagcactgacattctttgcagtatctaaagcttgcttcacagacgacaggccaagtacaaatcgtatggaatagctgcagaccagtatctttccccttatcagatcttcatcaaggtggcttgaatcttggcactcccctagggacatttcagtaggactggctacattgtttttcagtgcatgaggtgcagcaactagagtgaacatggaatcaccatctgttccagctgtatttgtggagtaacacaaagttagaatcaaacaacaccagccatgtgcagttgcgcacaatggaaaatactactaggaacttacgagcaaggccaactcctgtaatggtcagattgttgccaagtacaacatagttgttgtattccctgtcatgggcagatgctcctacagtaaaaatccatggactgtatgatgacatgctcttgggggaaggacctgtatttcctgcagcttgcacgacaaatatgccagcttttacagctgaaagaagagccatgtcaattggattaaagaaggtggctagtccaggaggccttctatttggggtaatggataagctgattatatcaacattatcttcagctgcctgcaatatgatgaatgacttgtcatcaataaaatgtcacaatgtgcccatatgcattgtagcattctaaaatgtggtattaatttgtgctaaatcaaaagaagatagttagcttgcaggtaaaccattacctgatctattgcagctactacatcagcagcaaaccctccaaagcttttgtacagagctttatagacagcaatgctggaaattaatttgtcattaacatttgggaataaagtggatcttatatgtctccgcagaaaaaggtaatggacttactgtgcacgaggagccattccacttgcattcccaaaatgatgcccagccacaacaacaggaattccatgattaccagctgctatggatgctgtatggctgtacgatgtacaaaaaatatatatcagaaaacagatatgctgacaaaaaaagagccacaatgacatatggagtgaaaaatgtaaatgaaatatctatgaataatttaggcagaagctgcagaactggatagtcaaacaagaaaaataagaaaactctactgtagcactatgaattctcaagaatgctactattttacttaaaatttgcaagcgtgattggacaatgtaacaaaaccagtagtagattggtaatggcttcgtattcttgctccttcaaataattttaaagggtgaatcagcagatagtacttacgtcccatgaccatcactatcagaaggtgaagcatgatcttgagaggcattgaacactcccctggttattgcagaggctgcaaaatgcctagctcccacaagttttctgttgcaggatccagatggaaaatcatttgtaacctcgcaaatgccagagtaatgagcaggaacaggataactgtcagttatcaagtcgtctgcgaagctgggatgagttggatcgattcctgtgtcgatgaggccaacaacaacaccctgaccagcacattgtgggccaccctcttgaacccatgctccttgtggcaaaccaaggaattcaggggtatgagttgttgccgtcctaactgagaagtccaacattacatttgccacttctttcgtcatagatagcctctctgccttttaaattttaatgcaaggaaaaccagttaaaaccttattgtcaatccaaatagcttcgatattttttagtgctataaaaatcagttgagatttagagaagtgaccaaatctaaacaatcatgcaataaacctgacaggttcttgagaacgatgataaaacaaccaagggtatacaaggtacaacattttaacatgctaaaacatagcaaattttagagagagatagcagtagaagcaaaatcataagtgttcagtgtatgtaacctagcagatatcaacacgccataattcatattgccatggacttttctttcgagaacattgatgcagcatctaatagtctgaagatttcagaacttctttttgaaatgcaacttaaaaaaacttgtaatgtgacgttacagaacaaaggtgcaaaagtggtggaatcaaagaaaaaaatgatacctgctgaggagtgatgacaacagcaaaaccattaatcagatagcggtagctgtagagctttatatagcgctctcctctcagtgttctcttcaagagtgaattttgaagacgaactaagtacgagccataattcataggttgggctggaccatgcctgcattacaacactggtgagcaaaaaaacgaaaacttaatttgtgacaagcaagggaaaatacttgctaaaaacttgtcagataaacagtaaagtacagaatcatcaatagcacgctagcagcacagccgcacacacattgttcatgttggtattaaattccatatcttttgtgtgttaaaaaaaccaaacatttctactgcaatagtgggttagccttcccaatattagcagcaactacaccaatgaaccgagctgtcggcagataatgacgtagcatctctaacatttcactatagaccaatcaaaatcacccaaaaactcctcccccaaaaggagagattctcacccaaactgaatcgtacatacatatttcgcataaactgtaaagatagagcaaaaccaaatcatagaggagtaataaaccatcaaaaaccttggcttcatgaggatgctagtggacggggtgtcccccccgccgccgccgccgccgccggcgactctgctgctcccaaacctctccaggtcgaggcgcttgtggaacaccggcgcctgcttcatggtcacaatgtacaccgccgtgccctcctcgaacgcgccagcggcgcccaccagcgccgccccaagaaccgccacggacagccatgcaaccgcccactgctccctccgccacgcccaacccatcgcctcaaagagagctcttcaccggtcagctcccaaagcgccgcaagaatcgccaagaaacactagctgcggcaagaatccattgggggagcaaaaagggcctcgctcgacgagacgatctcttccgagcgaggtggagctgatgaagctagtagcactactactacggcctatggggcttgctccaggctcattaatggcgatgtggaagtggccgccgcccccgccgtgccgtgtgcgctttaagccgcggcgagagtgagagagagcgagtgggttgcactgaggctgagctgcggcacaaagacgagcagcgagcacacccaataaagagcgaggcagaaagccagaaaagcgcactcctccggtcctccccttttatgcctactttgatttgattttaaaacttcggttcgtgtcaaaaataaacatgtaatacgaaattacgatccatcgtcatagtatcttatattatatttgtttattagcagagatgtaagcaactgctaaattctaatttgtttttttatcatgtagtactacttatgttttgtattataagtcgttttgattttttaaaattaattttttaagtttgatcaagtttataaaaaattatagtaatattttaacacaaaacaaagaaactattaaagtatatgtaatgttagatgtaatagaattaatttaatgttataaatgttgttatatttttttcataaaatcaaactgctaaagaggtttgttttagaaaaagaacaacttataatataaatgaaggaagtaataattattagttattctaaaagtctaaataataatctatactgtttgaaaatgctaaaaactttaagtgaaacttatggagtccaaacatgaattgacacagctgctgcgtctctcctctcagcgaaagagcaaaacacacagctcagcgttgcagagagagtgaggcagacgaggcgaggcctcggttttccattacctcgtgaactgtgtggtactccggccttctcttggaagaagccattttacagtccatttttactgccagagtacgatgaagaaaggtggtggaaaagattgatcgaacggagattgatcgaatcgctgcttgcggcacatgacaccagagttcacagtgcagtgctatgctaatatcccgatgtttcagacaacagaaattgccggtgttctgcttctgtgtacctcgcgttgcaagatcagtagtggagtactactgtcaacaacaactgctgctactgctcctttttgactaagggctgtgtttagtgcacgctaaaattaaaaatttggttgaaattggaaggatgtgatgaaaaaattgaaagtttgtgtgtagaaaagtttcgatgtgatgaaaaaattgaaagttcgaagaaaaactttaaaacaaaacacggcctaataatatttactcgtatcattttgaacaaggttattatcaaactctaaatgtcttactatataaataacttttaaaatatgtcttataaatatggtgaccatataagattttaaaaagtgcttgataaaatcatatacttattgatatttctgtatgtattgtaataaaaaatagtgatcaaaattggctttgaagatcatgtttctatccaaaatgttaagtaatattatcaggttggagggagtagtactaattcagtatatgatcatgaagtccgtgaccattgttttactcatgcacctggtcagaacgggcgtgctgtaacggaattgtatgtgcaagcgttgcatttgcactgttgcagctagagtgaacaggctgtagaacagtgctagcgctatggatttttctcttccgtttttattgatctgtactgctgtactgctatgtcacaaaaggaaaaaaaatccataccccatgatttcaatggattattaaatgggttggcccagagcgacgcatcatccgtgcacgtcatccaacggtcaattctctgggctcattagaattttctaacagttttttaatcgctctggagtactgatcttaacgtgatgctgcattgtctacccgaaaaaactgttttccagattctaactgcaggtttttcagaatcttgtctttccactatatgaaacactgttcttaccattcaagctcttattaacatgttctattagtctagtgctactcaattatcagcagctgaggtggaaagctaactgaccttaatatgctcttattaacatgtactcctacctactaatctaatattgtctctgttataaaaactggcacagaccttaataagctgaatagaaaaaatatcatagaaaagtccaaactgatgacgatctcaagacacaatatttgttactaataaggtttaagctgaaaactgaattactggaaaacttattacgaacaccacttcttgatttaacatattacaatgtatttagatatcatgacccttgattgaccatattggcgactctaattctatttgaacatctaatataactttaaattttaaactgtaatcgtttttatatacatgtttaacacaaaactcttaagagtttcaactgaaacatgcaaagcctgaatttccagttggaattctccaaccgcaaaggatcttggccacgttcagcgccggtcccagtttatcttttataacccagcactttgagctttgaagcacaataccaggcatgtccaattgataatgctgctcggtgtgcactttgactgcactttgtcgatgaccgattataaaaaccgtggtgtgcttcagtagtcgccggcagctcatgatttcgttgatcatctattccaaaggtgcacatctccaataatcatcaccaaaagtttcatggatccaaagcacaaaaccgagagaccctaaattcaaggccgtcccacccctgttgctaatccacctctgaaaatggggataagacatagcaaaggcatttgcagaaaaaaaaaacgaagtttgagcctccccaaaccaaaatgactttgatcatgtactaccacgagacaatccaagaacctttgtccatctctctctctctctctctttttgtcctaaagaaagagatctgagggagagtgtgaggcatgttaacatgcaaccaaagatactaaccgatggcgacagaacacaggccacaagaaattggagtacgtgatcacgtgatgagtagtagtagatcaatgagcaaactacgcatgcactcctggtcacctggggccagcattgctctcggctccctgcaaccagtcaaccagatttttttttaaaaaaaaaaaactgggaaaagcgactcaccaacactgttagagtaggtgacaatggcattgcagcagctgctagctagcttgctgcatctttactgtggtcctaattaacaacttgaaaagtgcaaacacttcatttcatggcctccattgggaggtagatgatggtagcactgaactatggtagccggtaggcgccaaggtcaccttttttttttttttttactgctgtctcctctgctttctgcttgcccggccggccaccaccactcggctgcagagaagcgtagtgcagcgctacgagctggtccattctcgtatcctgaccggctcgatcgatcgatcgatcgaaatgtgaggtgtttctgacgaagagggcagctagctactagctaagctgtgtgcagaagcagacgaggagaaaagggatggaaaagggttaaaggggctggaattattgcgcatagtgagtcggcgggctaaagcttggccaagcatgtccggcaattgttcatggcatgaattattcgagagcacgtacaccggcggagaaacaatgtttacagatcataaacaccactttaattagttaattatatacttggtagttttcaagccaaagtttatcatacaaaatggaaagaccatcgtagctgcaccaacacgagcatgtaaacataataaagctggcttgcacgctcgacatgatcgccccatcggccaagattccttcatatccgcgggctaccgactttgcaaatttctgtactactccctccatcctaaatgtttgacaccgttgactttttaaaatatgtttgaccgttcatcttattcaaaaaatttaagcaattattaattcttttcctaccatttgattcattgttaaatatacttttatatatacatatagttttatatatttcacaaaagtttttaaataaaacgaacggtcaaacatgtttaaaaaagtcaacagcgtcaacatttaggaaaggaggtagtatgtagtataatctgttcctacttcatcatagcacgcactcactcggatgtagattatacactactgcatgcgtactagcagtacgatttttctaagccgaagctgcacttcgctgcagggcgagcattatccggtcagtccggttcacgccgcggccgcatgcatccaaccgcttataatttgcaggttcgccgccttgttttctcctcggttccgggcggtgcggtggggcctcggcgcggctaaagattcggaattagggggtgctgctggtgattcgatcacgggggagaatgtctctcaattccactttagtggtggtatctgctgctaatctagggctggtttggtttgtgttctaaattggccttatcaatttttatcaatgtcaaattttgataacttttgacatgactaattttggcaaaggtaaaattgtgtttggattgaagccaaaatagcctaaattaactgttgaaatgacctattttcttagtcatgctaaaatttggctctaaaccaaatagataataaacattattaaaattatcaaatattgataagtccaatacaggcctcaaaccaaaccaaacgcctaatctgcgtcggctgtaatgtagcggccgtcgaacagtgcgggcatgtgtggcgacaggtgtgcgtgcccgcgtgggagacgttgcgagaggtaaccgttggataacactgacacggaccggctaaaaggcttaaaaagcagctaatacacagtacagtactagtctatacccaccaaaacggtccggattaggggctgattggtttggtgccacacattgccacaccacatgttagacatgccacagattgttagcttagcgtttagttgcttgtttcagttgtggcaagccacactttcttgtttcatgggcctacatgtcttatacttattttctagctaaacattgccacacttgtggccaacaaattattggccacactttatttgccatgctacatctatgacaaattaagttatggcaatattaggcaacaaccaaacaaaccctaggacaccaccaacggcatgtctccgtcgcagtactacagcggtacaaccggttggccatcggcgagagtacgtaccagtctgcgtgcctgtacgtgacgtgacacggtattcgtgcgtgcgtgagccaaaatcctcgttgcgccgccgcgccgctcggctgtgctgcgcgggcagccgacgggagcgggaagtgggtgggcgcgcgcgcgcacgcacgctggcaaatcttggcctttttttacgtcctcggctcacgcgcatccccacgcgacgccgggctgcagctttccaggagacgcggccggcggggtttccgccggctatgggggttaggtatgcggtacacgctcgcggactcgcctgtcactcgattatcacgggccggtttggctgaattatccgtggacggtggacaaatggatctcgcaccctgcagcgcagtggtccgtccgtccgtcctctttgctgcgctggcgaagtggcaagtcagtgaagtcgcaagtgagaagggaaagtaggtcaatagtaggtggtggcttcagatgttctctgggcctctcacctctggctggaaaagagcaacgttttaatgccaatgtcacgagctttttactgatgtgatatatcggttttagatggagatcctcgctgtcattggaccggttgggtgggctggcgtaccatacggccataccaggcaggagtgaaacgaagacgacaagatgtgaatcgttcacggcttcaagcgtggatcatagggaacctgtacacgaagatgctgaagcagtgtgaagatttttactagtaacactgtatatatatgaggggatatgaaaggaaaggaagcagcaacaacttttggcgtcgttcaccgtacggtcgtgtagtggccggccacgttgtaaatcgcactctcgtacgattgactaactagccgcctcttgtcagctgtgactttatttagcccagttgagatacacaatctctctctctctctctctcacacacacttgcaatgtcaatgcattcattggcaagatggcaagatgggattcatcgttcatgagaacttcatgtcctgcacaggtcatttcattaaccactttgtactactcgagttttagccttttatgcacactggtgactggtccagctatagggtacaatagcatactattagccagctatataaacatattttaataagataagagatgagagaaaggagtagcgggctataaatttatagctagctacagcacggactacaagtcacagtgtgtgtataacagatgagaccatatattaatagtatagtaagcaactattgtataaattagctattatattggctataaatgaattggagctagtagtgggctacccacaaacgcatgaccctggcagtccgcacattgctaaccaacaattacagtgttacacttttattccccacttctgtagcggggatggattctaatagctcgagtggacgtccacccgtttatttcatgtcaactaaatggctatgaaaaattttcaaaaaaattggcaagatagatcaatatgtaatatatcacttcacaaacatgcaagttaaaattcaacttctacaagttacaacaaaaataacaaatttaactgtaaatatacatatagtaatttaagttttgtttgttatttttgttacaatctgtagaagttgaattttaacttacatgtttgtagattgatacattacatattgatctatcttattcatattttttcaatttttttcataaccatttagatgacatataataaacaggtggacatccactcgagctgttaaaatagtttccccttatgtagctgtttgctggaatgaagtgtagtgccgttactgcagtaagccagtaattgcactatgtggaaatgtgggatgaatggataatacatataccaacttaccaagaacaggattttcccggttataatatttcaggattgtaatcttgttttttttccacagctatattaatatgaaacttctcaatggtataagtcgtttaaaaaaatgtagggtcatatttggcaaatgggatagggaaatgatttcccacccaccataagacatctttaaatcctaaccattcattctcccccttccatttaatcctaaccattcattcatttcacaatctcaatcccacccctcaacggaagaatatatttttcttcttattcgcacgcttgtcgcatgccgtgcagtgagtagtgactatcacggttcctgtgctcgcatgcttcagaacccaggtgctttgtagcctatagccggcaatgcgaaatgcaaagatgatttcatgttctctaccaccttgggttcttacttcttggcgagcttatcatgagatgcgtactgtctgcttgtcatgaatcaaaatcatcctagctatggatatgggaataaagtacttgcatcttttgtttcctccagcctttttcctttgtttttctgctctcttttacttttgccaaatgatgaataaagcatcgcgtaatcaacgataaggggatatatagcttcattctgacacctattcttacaattgcttccgtgtatggcatcaaaagaaatgatacaacaatgaaaattgccctctcaagttctctattcaagagggtaactacagcaaaaatcgaaagtgtatatcagtgtatgcatatccaaaaagaaaaaggcagggatcgactttctgaagaatagaatgattatgttgccctcctttttgttctgctgctacaaatataggcacagaaagaatccgatggtctttgtacgaaggttacttgcctaagatgaagcaggtagcttaggtttgttattcctgaccaaattttggacaaagagctctcctgcacgatatgaagaccgaacctgaaaaaaaaaatcacaaaatagagaataagctcatgtaagacactgacttggttatccaacattcctacatattagtcgattacagaatcgtacaacaaataataatagcactggtagctgtgttcttcactaaatttccagaactttactcatgcatcatactgatatttgtcagagcaaattatacagtactacaatttcctatttgtatttacaattttaagggtgacaactgaagagtcccactaattagatgtagcacttaccaggggtccactagcaacatagcggaaacccaccgattctccatactccttccaaaattggaacttctcaggagttacatactcccttactgtcaaatgtctttcagtgggctgtaagatcaagcagatggtttgcatcaaagactgaccagttattcttgactaatgataaagtggtactgggctaacctgcaaatactggcccagtgtcaagatatcaacaccaatggcccttaagtcaatcatggcttgtttcacctcctcgtcagtctctccaagaccaagcatgatagaggacttagttatcataccctctttgcaactttttgcatgcttcagaacagctaagctctgatcatatctgtaagaatgaggtaagaaaaattcttacaatgccagaggatatgaggaaaagaactgtgcatagtacaagttattaactgcacattgccacgagatactagaaatatagtgtatgcgcaaaatcgaggataaactggataaactatatcctaccactatacttccttcgaacagattctaagggaaaggtagttgatcaggcaaaataaatcatctcccaagattatgatgcgagaaacgttcagaaataaataagagtaccacaactcaccaatcaaacagattgcaaagctttgatatttgcaaaactattgttatgtctcatacaataaatacagcaaggaatatgcaggtcatcagatagaaaatatctatggctgtttttattttgcaatgttacagtctacaatatagtttacacttcagagacaacaatttgcaacctatatataagcactattacactgtaaagtatgcatagctcaataataattagattcatttttactcggggcgaatttaagattaatcacttaaactaagacacaccaatagcctgagaatgatcatatagtcaagctgtaaaattgatgccagggacagaatactcgaacgcagtgttaatttgtctttttaggtcagtttaagacatgactgggcacatcagtcttgtaaaaaacaataacctgaatagaatggtactccattgaatagagtaaaccacatggaattagttttaacttttaacagaaaagcgcatgcaacatgtgcatgtggatattattcaaagtttggattatgtagatttcatgtacctgtagtgtaaatgaaaatctggaactaggtacagtttagatgttcctttccagtaggaagtaatttcattagggtgatgccttgggtgaattggttattgattctctaaattataaatgtacaaatagtcctaagcaggatataatagtgtgccagtaaaatcagtgaatcacattaccctgctcgaggatccctaacaattctttgcaggctcctcacagtctcgatgttgtgcgcaaatacatccagaccagagttggccaaagctgaaacagcctccaggtcacctcgaaaatctgaggtcaagcactccaccagtatcccaggtttgagctcctgaataggaaattcagaaaacttcagcatgaaacttctacaaataaatgcccaacttctgtcaacacaaggcataaggtagtaaacctttaaagctctcactgtctgcgcaaaatggctgctaccaccatcaggcaagtcatctctgtcaacactggtcagtacaacatagtccactctgaaaagagcaacatttgtcagacaatctgtactaattttgccacacaaacaagtgcatgtgcattgattttctttacttccagacttaacaaaatgcactgttatctctgttccttcctacaactatcattccatcgatcagtaactcagacaattcggaaggcataaatggctaatctggagatggagcgaacaggcaaagttaccatacccccagcttgcaactgccaaggccgtgttcagaggctccaggggatccggtggtggaggcttgttgctagtcttcacggcacagaaacggcagccgcgcgtacaggtatcaccgagcaccatgatggtcgccgtggcgatgccgtcgccttccccgcccgcccctcccccaccgttccagcactgcgccccaggagcaaaggatttagctgttctcgcagaaattgctcgcgaggatcaccttgctctagtcccatacgatacgactgaatcgcgtacctcgccgatgttggggcactgggcctcgacgcagacggtgttgagcttgagctcgccgatcgactcccgcagccgcgcgtacttctccccctgcgccgcacgctgccgcagccacgccggcttcttcacctccgggtccctcccggtgtacggccccgccgccctacgcgccgccggcgccggagccggcggcgcagcctccgcgcggcaccgggccacggagaccgagccgggccggctccggcagacagggttcccgcaggccggccggatcgggggccgcggcaacggccgcgcgagcgagctctgcatcatggccgacgaattcggcgccgccgctcgcacccgcgcggagtcgtgtagccgtggcgcccgccgccgtcgtcgtgcggggcgatgggttcgaagcgagacttaaagattttgcttctgccgattttacccctctgctctggccgcaaatccactggatggttggatgggttaggggtaaaataggaattatagaattagccggcgatgataccaaggttgctgctcaaccagtttgacacccgctgccagttgtttgctaccagagttttgatttgttgtcatattgatattgaaacgtcaaaataggcaggaatttcacataaattagtttagttcttgtaaaattcctccatttcaaggcctaacaattgctgaagatttcatactgaaaattcctcctttccaaaagaggccctcacagatgttggaatttcatactgagatagtgtacatcaaaccgttacttgaggctagctgtaaccaatagcagcaagcacaagaccagcatattgacaccatcaaaaagacaaaagcattcaaatgctccagtttatatggctgtaataactactacacaaatttacaaataaaggcatgcagcctcaatcctggcaggaagtatatagtgcaaccggagttccctttaaacaaaatgtaggcagagtaatgaacaaaccaaacatttatgttcgcacaaggctaaaagccgaaatcttgtgccaatctgaacaagtgaagaaatgaaatgacaacaaactgtaacgatttacaattaagagatatacccccagtttccagtaccccaccatatagtgtcagtaggcacctggaaatacaggcatctccatgacattttaagtatccttccaagaaacctaataaacagaacttcattattccaacacactttggtcctgactaaaatagattaagaccagactagtgtttacttgacgctaggcaccttccacaccagtaaaacgacagacaggaaggccctagtacctgtacaaccactgctgctaagcccactaatcttggacgtcttcttcgctggggaatatgaatgttaaaaactaaattttgcccccaacgagttggctagttcatcacagcatagtgttacaacagtgtacgtacatatgcatatcaggtgggtgctatataaatgacccacagaaaggggagatcgttggtctacgagattaatctgaaacctaaagtcacaatctgaagaaggctagtttttccctgagcaaatggaactttcttccaagctcacatcttatgaagggcatgcatgtctccagatatatatgaattgccatctgcaagacaagtgcatcgagtccttttaagcatttgcgatcgaccctttggcatcttcagctatatcaaccaggaacagactcagaggtgatgtacccaccatttgccccagtgggattaataccggtcactggcattgttcgctgagcaaaatcaagcagcagctggcgttgctgatcgtttgtatgaggaaggcttgcacgtagcaactcaactggcatctccctgctggttgctttcgagacttcagatccagttacagagcatggtgactgcatgacaaacatctgcttaatactttcatacttactgaggcagtattttgtcaggagtccaaagaaagcatcaaatgatgcctgccagagagttcggtttgacactgtatagctggctgcagcatggtggtcagtcagcaactcggttgctcggtccagtactgatttaataataagagaagccccatcaccagcagagctagcaagaggacgcagaggtggctgctcagatgaacatacgacagcagcaaggcaagcactaagagcacctagttccatatggagcacacaagatgaaacagtctttgcaagagcaactgttgtttctgctgcactagaatctgatggtaaacccccaaacaagtacctcagatgtcgaaaaatagccatgcatattatacgggtcaactcgcttccaggggtaagaagtcgaaggtaccgtgacaaaagtttgcgtcctttaggaagagaaacaatccgaagaaaaacaagatcatccttaggggccaatccagatgaatggcttgatttgctcggaccaagagggtcaacaagctgaagtgatgtagctagaccttcaaggaggacctgccgtcttcgcctcagttggaaactgttatcttgtgcctggctagactgcaatagacggtcaatatcatccacctcaagaagtaggcagatggcatcttcaacagtgactctagctgccagcattggttctttctccaggggcctcagagaagacttctgatcatgagaaccatcaccagatgaaggaaggtcaacttcaagaagagaccgaggcctacgtatggaagagaaagaaaccctccctagagcatcaacctgaagatatgcatgatggtcactgctagatctggacttggaaggtaagtctttcattgatgttggggcaaaattggccttttgcctggaactggcacccttttttgctatgcaagcttgatggtaataatcaactacataaggatcactgctgtgacttgctgaatgctgcattcttaagatagattcgatctcttcagatgacatgtacttagacctgaattttagtccaccactatcaccattttgactaccagtatcagtcaatggttgagaaaaacgtgtgctgtgttttccccttcctgaccttgacctcttgtctctcaatgaaggaacattgctgatagaatcaaaccttcctgttaactctggggagtgatgttggtaaaataggtgaggtggtaaatttaggtaattctgatgggatggctggacttgaacttgtgccaatctctgctgctgttgagaaaatagcagtgatgacattgggctatttggaagtgatatttgtttctgtaacatgttcggaagtagattaaattgatccacagcatacgggttggcttggtttggccaatcattttgtattggattgcttccaggaagatttggagaaccaaaggacacgctccctccatatggtagtccatgagatagtccagccatatgatatgaagaacttggaagtgacatgcttggagaacccatttgtagaccagcaccaactgatggaatgctcccatgacgtgtaaggccttgagcagtataaggtgatctagcacctggaggtggaaaggatgtaaatggaggagattgtggtgcaatgataggttcacttgcgcggtgctgcaatggttgttgaggatatgaagatgttcggctcaatggtttggcatccccttgctgccccagagaacgtgactgtgaccaccatcttttactttcctgaagttcctcaccctctaatatgtcttgatctacccagttgggaaactcagcatcttcagcccaatcaacagttagagaacctgaaaaggtcatttgcatagttcagtaacaagttcagccttccagtgttcatttgactttgactacaccatagagtttcaatagcatggttgcttttcaacaaataaaggtgtaatagacacaagataacctttcttccagccgacattgacggcattaaaattttgaaaacatgtgtagtaatgcagaatggaagcatttcataaatgagattacatagagctttcaacaatgttgcatacaaaagctacactatagaacactcttaatgaaaacaattataattcataatgttttcttttcttttctacaacagactgttgacatgataaacaaatccacaactgtgtacagcaagtcaaaattataccaagaatgagttagaaatgaaatgcaaaatggttgacttcaacatattttaaaaatgaacaatcatgcacaaaagacatgcatattgtcaatattgtagtcaacatctttaaaaacaaaacatcattagtcattttccatcagaacataatgctgacttacttcctcttgagatggatcttctgtcaccaataacaccaggattccgtgttccactaatgcttcggttcaactgatgataaaaaaaatgtaaataaatcaatgtgcaacagcagaacaagcgcataaaagaaacaagaacagaagccaaggttaaaacaaaatatcatgcaattacggatccatatgcaagcaatatgtcaggtgtagataaaagttgaggcctcattactcattagtgattatcccaatcctcttgggactaagggatgggatatataacgtatccttagaaaaagagcagcagcctagttgatcactccgaaacaatttcagacattacagacttggtagttggtacctactcctagatcttctatgtgcaaatgggccttagatggggcaaaatacttacagatgcaaaacaggctaacgcaagaagaagctacattcagcctaaagaccactaatatgtatcatttatccagtacatgcttggggtagcaggcagcccaattgtagtggaaataatcagatagccagaactacaaatgaataaaatgggcacttaatgtttagattatttcagcttttggggggaggggtataagttatatgccccacaaagattgcacctttaggatttgcacctgcatgtatcgttgacatgtggcctgggggtgcaattttctggagaaatataattatttatcaatacaagaatgaagtatggaagagtcagagtaaccacttggccaacactggtaaggcataacagggccttaacatatctaatacttaaacggctactgcaaagtgaatccatccaagcgaagtcactttttttttaaataatgaaacatcaatttataacactggagtttgtgaaacaaacctttgcaaaagtgctcgcaagatcatcaatttctgacaagttactcagattatcaatctgcagaacatagtaaattgaatcagaataactccacaacactaaagacgatagtaaatccataatttatgatgagaagaagaaagggaaagcgctacaaaagtaaaattcatgtatggggtgcaaggctgttcaaacatgcagacatccctaactccttgtagagtcttaccttccacatgatacagttccaaatattgatggcaattgtaatgtaatattggccaattgtaatgaaatattagacgattttttgcccatcacaataaactccaagtggctatttagaaatgcacattaactaattaaattcaacccccctaaagttgtttcatccaaccagcataagtataaagttgttatacattacaattgctgaaaactagttgtgttaaccagcacaagcttaggattacatgatattgataataaaaaccaccatttgatccatagaagatccaaattacctcataacatttcaagcatgctcaatagtaagccctgtcaatacgatctatcaataatgcagtgaagattggagaatgcaaaagcaacttgaacattcaagaaatggcatacagccaacagtagaaacagtgaactctagcattctgtatcaaaataggttatatgttttttgtcccattctgctattgatctcaaaatgcagagatagttctcttctagctccagagcaagtgagcgttgggccaagtaacactaggaaaagtgtgccagaaaactaaccaaatcaaaaaatcataccgtggccacaagctatacagctatagcctgaaaggctaccaaaaagaactatgactggactgaaacaagccaataatagggttgtgacaaaacagccaaaaaggctaccttgaacatttatccgaaacaaaacatcatttgttctagtaattctcaacttaatacatttagcagcaagattcgtcttctatccccgtctcatggaattccacccttgcaatggaaccttttagctatcaaacaactgataaaaacaatgaccattcaacatgcatcaaggtaaaggatctgcctatgtttgagcataaaacttcccgccctccaacgctaatgatgtgaacctcaactccactgataagaccatataggcccacaaggatttattcttaattcctcctagaactaaacgtgctatcggaaaaggagataaaaggacggcatccgaaccaagaacacaaatcaatatcaagaggacgatagttcacaagaagcatggcagctgtggacatgatcaaatgaaggttccgggatccgcacctcttctccaacagaagagagccggtacagcccatcttctggcccgctgaatccaccgccattgccatcaccgccgccatcctccaagcaactgagctcgagtccctccagtggctccttcccgaagaaggcgtactgcccagcatcaaaattacctgcatcgagaagcgtcagatggcacggattaatattaatcggcgtaaaaaaaccataacttctaaccaaattacaagcgagaaccgacaacaacggcaagaaccacacgaaacgccaatcaggccaacaaaagaacatcatttttttttctagttgagaactcaaagagcccgaattcgaacaattctccatcgatactcccaaagattcgcatcagagacgcaacagattaacagtaaggcgccgacttctgcaccaaatcagaccaaaacaacagcaactactggaaacaaccagctcagcggcaaaagccggagcggagaccagatcaaacagcgcgtgaaacccaccggaaggtgggttaccgaattgccaaattcagccgcgagaagcctcacctgcggcggcgggggaggaagaagacgcgccgccgcctccgccacccgactcgacaccccgcatctccgcaagaaccctagcagcagcggcggcggcggcagctgtagcagcaagcggcgtcgcgcatctaggcgagggattcgcgcgatttctccacggctttggatctgagagagctgtgtgcgaggaggaaaaggagaggaaggatagctcggcctcactgcggcttactacttcttccctcttttctctctcctgccttaaataaaaatgatttgggatatgcaaccagaggagaatttatgaatcccaaaaaataagaataagattaaagaaaaaacactggtcttttttttctctttctttaagcagaagacttgcagtagaaaatactagggtttcccttggaaggcacacaaatattaatccagcaagggcaaggtaagaggaggaagatgagaggaaatagaggggattagaagtggtagatgagagatgctaaagagttaggtggtgtttgaatctagtgacttaattgtccctttatttagacactaatttagagtattaaatatagactacttataaaactaattacgtaaataaaagctaattcgcgagacaaattttttaagtctaattaatccacaattagagaatgtttactgtagcatcacatatgctaattatggattaattaggttcaatagattcgtctcacgaattagtccaagattatgaatgggttttattaatagtttatgtttaatatttataattaatgtctaaacatccgatgtgatagtgacttaaaagttttagtctcatctaaacagggtcttaaggacgagaggagaagactttagcttggtttgtttgttactctaccaatatttatttcctttgtgtttgcctttttatctcctttctctctttctatgttgcttttttaggcctgatgatttaaaatttgttctggtgttacaattaatccttaccttgtttctctctcttctatgattatctgtcacaatgatgatggtttagggtggatttggcactcagttagcaattggttgtgatcaataggggaattattaactgccagtggtggtaggtttcaggtactctaggaaatttgagaggaggaccatatgtatgtaatctgttgtaactaagtttcaaatatttacatagataaaacatgaagcatcaagcatataaacctctaatacatttaaattttaatacatgtagatagcatgtgtaaaattcaacgatctttagtatagtctgttttagaaataatgtatcgtatcgtttcaatagaattaataaatcttaggaaactatagctattgttaaagctatatgtctgctaaaattttagcatatcattttattaaaaactaaaaaaatatttatgtgacaggtctaggctggcctgtcaggtagcatacatcacttgcataagtttaggattatgtgtcggagaagaacaatacatgctccgttcctggcaaaattaactttcagagatgaatttggatatatgcttccctagaaattaatttattttaaaactgagagatcagttaaaattatatgtatattaataaaattgtctaatattgttgcagattttttttgactagtcacgggggtggagagctttctcacctgaattttataaataaaagaggtgaagatacaatatcagtttgataccaactgcacagtttgcatgtaaattgcgagacgaatctgttgagcctaaattgcgccatgatttgacaatgtgatgctacaataaatatttgctaatgatagattaattaaacttaataatttcgtctcgtagtttacatacgaaatctataatttgttttgttattagtctatgtttaatacttcaaatgtacgtccgtatacttaaaaaaaattggccaagcccaaaggatatttttgcagatttataaaatgtgtagttaaaattgtagcaaatgcatgatttcatgcaatgtattcgtccgcgtatatagtgtcaaaatgcagctacaacaactgagcagaacatcgttttccacagaggacgcaattggcgcgcttcgttcactgtttcatcggtacactttcgcaacttgcaaccgatctgggctccacggtcccgtgtgggtttgacgttgtgtagtcgtgagcatctcgcaccaaacatcatacgctaccagcaaaccagtcgagcaagcagccaagcacagtgaccatttcacttgttcactgcttttttccccccttttcgtttccacttaaaataaacatgccactggccttccaattgtttagccttctcttcttcgtcttctttttgttaacctcaaaagcttccagctaaaacgacaactagaagaagctgtcgccaagtgaagagccggtaccaaacatgatccttcaaaaggagcacgcattttctttttttaataaaggatcaaagctaagatgtgcggatagaagtattcgatcctggtgctttcgttttggacggcactttgcaagagcacttttgttttttgttacgtttctttttcagcttccatgggagatgatagagttattggtgagcggaatattctttttcattgagatggttgggaggaatatgttccaaggagcttggttaatcatcagaggctctggattttagtagaatactcctacatgaaacctcgggctggccaggaatctgtgggatcaataagcgagtgtgatgtgagcttgagctactaacgagtcaacagttgccttctagcagtacactattaatgttgcctttctctagctacacaagtaggattacaaagtgatggtaaaagtgcatggtactgttactgtatctcgaagttacatcaatcatcagagaagatgatgcttagagtgtgtttagtttacgttaaaattgaaaatttaattgaaattggaacagtatgatggaaaagttaaaaatttatgtgtgtagaaaagtttggatgtgatggaaaagttgaaagtttgaaaaaacagtttggaactaaactcggccttacatttaatacgccaagaggattactactttcgctagtttgtcttaagatttatagcaacatgtaatgtactattagaagctagctagtaaggatcgtgctacacgtgacaattccctttgaagtgctaatctgaaatcccttcttcataaatttaattaatatttgacttcaagagaaaaaaaagtttagttaaacccccgaaaaatctcccccagaataataatggcgcgataccttttctacaagtatcgcaacgatttacgcagaattctgtaaatcttttgctacccgatacatacaccaaccaattattcagtgccagcttcagacaaaatatcagcggatgtaaccatattcttatcgggcttgacaccgaccggatcggaagatcaattctaaacccggatacgtcaacgtagaaacacacaagcaggacaccatttttgtgtgcgactctccaaagatttttttttaatcgccgctttcgcttttggacgggtcactactcacgcaccaacgacgacaccgctccacgtacagtcaaaagccggtggacacgtagcgctgcgctagcgacgccgctagctccttcccgcgtccgcgtgcagtgcaggacgatctgcttctgctgcagggtgatctgatctccccgcgtgcttatccgcgggcgtggccggcaaaaaaaacgccgagacgaacgcggctgacgagcgcacgcgcgggtggtggttgcggttccttctcgttttggatcaaaactccatcccccccgtctcgtcggtcctgtctctccgctgtctcggcggcgagagtagtacgatatccggcggttcagccgtgtcgttttcgacaaggctcggctctcatggttgcgtttccttctcattttggacaacacggtgccgcacgagctcgatggcaggcagccaggcaggcagttagtagacgataccccgtctctctctcgccggtggctctgctctgtagcaccgagccaccgacgatgatccggcggtcaggccatcgcgttttcggtgtctatatgtcagtttcatggtccagctgtgattaggaataactggacgaagccggtggatcaacggtgaaagtaagcacgaaaaagacggtcgaattgaactcagagtaaaaattacctgagtcaacgcacgggtgacacaaccgagaaaattctctatgacgagaagatagtactccacaggagtaccgcctgtaccagggctacttagatggccagctaacctgacggttacgtgcgaagtggctgtgatcacacgcgaattaactggagcagagtaggacatgtgtgattgggcggctaaagccggccaaagaccggtgctaactgctcattatagtcggtataatcgttggggttagttggatctcccgcggtgcacggcacacgcggcctattatactaatccaccgtcccaccaggtgtcgcttgacacataagcaaacgcggcggaaaaggagaccggccctcttcggttaggctagcggcggcctaattaacgtactccgcgtagtagtagcagtagcgctcgtcgcgtcacgcacggcacggcgtgcggcccccccatgccatgcgctgctccgcgggacgtgctggtgtttgacgtccagccagccaggtgctggatcggatcgagcgggacgtgccgtcggcgaagcgcgcggggcggcgcgtcccctggccagcgcacgtgaggcgtgcgagctcggcgcgggggagacggacggcaagacgatctcacagggggggacgcgtgcgcgctggccccgcccgcgcgcggaggcgaggcgccgggggcgtgggcacgtagtaggctgcacgcgtgggcactggccgaaacggaactcgcgcaccgtgcccaccacgggtagtacgcggccgccacaccgttcgggcgcgagcacgtgggcgggggtgggacggtcgctgaccggtgtttctctactcctggctcggcctctgggcggtttttcaatcggcaacaacggtgagtgattcggtgggtaggtaggttggtggtgagagcggcacgacgacatgggccaccctggtctgcgcgtatgttcggttcagggtgggccggcatggacgagtcgtcgtaggatgcgtggatgaccggtgatattggtagcagtagtaacctcgcgtcatgtaacccattaggctagtctgtcgatctcttgaatgtcgcggttcgccccgaaccacgcaattatacagccttccaaggagtgacgccgccgtcggcgatcgaggtctctcgcaggacactactgaaacaagctcgttacagaaaaagaaaaaaacaaccattctacttaattgaaatataattggcagttctcctgccggtttagttaaaaaaaaacaagctcgttactcaacttgacaagttcctttgtgtattgtctacaaaaggatggcttatacttactccgtccttaaaaaacaactcagaacagaatgtaacgttttctattacaataaatctaaacatgtgtactataaaacgttacatcgatagagtattttatactactactttgtaaatctcctcgccaaaggaaaaaggaaagtaagacgctcatttggctgtaggagtgtaggtgaaccgatcaaagtatcacacagttcgagaaatgatgggagcaccttcaaattgtcttatcctaaagaaatcgatgcaaatatattgttttatgaatcattgatcgagatccgaacacaatacaaagcaacggattgttgttatagtaatatgggctgttgagactcaaatttgtaaagatgttgccgttaaaatcacttgccttcataacttgggagtttttttagcctataaattgtgagttacatgacaagttacacgcccagcgcactgggcaaacacttctcttgattctttggtaaatctacctctacagtcggaaacaaaatgagaacgtacgaaggtgatgtcacaaaaatttgaaccaccttcctgcaaaaatcatttgcacagaaaacctcgcccaacccagcgaccacaggtccacaggtgtgaagtaaacccccgagtcagtgtacacttctcaaaaaacagtacgccatgcatgcatgctcttggttcaccaagcacattgatcttggtacaaccaagtttcacttgattggggctacttgaaagaatactcacctataataccagggcatatcagacactcgtggcaatcttagttcacgtgaagaccaaataagaatactcgactataataccagggcatatcagacactcatggcaatgttagttcacgtgaagaccaaataagtccggttaactgaatgactgacaatacttgaactccttgcttcgacacactctgatgttactcagcaatttgaaatccagctgtgtaaacatgatctttccagctgcccagttctgcttgtatatcagctgaaatggttgtgcaaggaacacaattctttccagcatttcacggttctgcatttgaatcttcacacatcaaatcaagaacattggcctcttctgcagaaacattccagcaacaggacatctagtctgcagaacaatccagtcttcaaagcaggtgagcattcaaagcgaatgagcattctcctctatatgggttatcttaagtgtgtcttgttatatcaagatcataccagcaaggaacacccagaaaaccactaggaatttcttcgccagtccataaaaggccaaatcaagaggtaactccaacacagtggttaaaactgactgcctgaattcaccaatatatatgaagtcaactaaagaacgaacaagctatagattgatgctccttgcttaactgacaaaaccattcagagatctgtcttccttgcaaaacatatagatctggtaattgcccagaatgtgcaactattttatcgaatgccaatgggaggaggctaagcaatgccccaatagcagaaagctgaacaggcatgttccttgagtttgaaacttttgttctcattagcactgataagtgattcctcaggtcactaactgctctttgctcataaccaacatcgtcaacaaagaacctataaaagacaaatgagttgtcaacaaagtttagatcatgtgtattaggagcaaattgaccaatagaaagtataatagttatactaggggacaggatacatatatcaaattagaacatcacattagaaccgcacgctcctgtgctagtaaaagagattattgagaacagagcgggtagaagagacgcaatagacaggaataatactggtaatgctaactaccaaattaccagcttagctcttgtgagttctcagaatatgtttttctattaaaaatccttgtgcacacaacaacccaaacagggtataacatatgcacctggagaattctagaatgaagaattgtgcggtaaaccatagcagaagaacaatgaaaaaagagaaaggaagaaatgcttcaatataaaaatgtaatacattaataattgttccttgaaagtatattgaagaaatgagtgacaagtcgggcaaaccttccaagttggctgagaagtattaagagagcagctgaatactcctcacatgtgcatgactccaaaatcttcaggaggcggacaacaacattattgtatgtccattcgcagctctgaaaatgaacacaacagaatcagccaacactggaatagagcatgcttaaaattgaacaataaattcttgaatgggaatagcagacaatgttaataacatgactacattttaggtaagtaatgtcaaataagaaaatttcatggccagaaggaacaatattaagttcttttctgattctggattgacaatagaacagaggcaagaattatgctaactttctattccaacatttcaaatctgttaaaagttaaaactaagggcttaataactgtaaatataaaccctgaaaatgtcttgtgtacatcaaattatgcctgctgatcaatatggctaacatattttgataatttgaaaagaaatatcaaggcaagctaaaccaatataagtatcacaaaaatgcacataccatgtaattcccgaacaactccaacaatgaagttatctccgcaaaatagcataagtcccttcctgcagtatggttatgaccatcctcagaaagttttacttgcttggagatatagcaaggttcaccacagttgacctccaatccacttgatcccaaatgtggactgcatcttgcaattattttatttgtgttagaacaactgttccattgctgagaacacaaatgcagctcatccaacagagaagagataaaaccgtcaactgaaactgaatccaccacatcaaataggcaatgtgcacaagttggaaaaacggctggcctgtttgactgaacatatgatgacaaaaggcacaaagaattgttttttgcctcaagaagcaggacaaccaaccgtatagttgtcatgagaaagttgctactctttgagagaaacttgtcaccacacatggaaccaatgatatgaatagccagcagagtccacgaaagattacttttacccatcagaagaactttgtatgaaacctctaaaacaatgtccattctctccactttaacacatatcgaagccaacaaagcgcaagcagagatgaattgatctatggtggcaggttcagtagacacttgtataccagtctcatcatccaagagactgtatctgtccacgtcagaaatcacatgccccgttttattacagaccacaacttctcttttcacaagaaaatcctcaattaaagagacaggaacatccagctgattgcttttcagaaacgcccatcttgtttccatgtaagatttcactgcaaggaagataatgccttgtaattataaatgaggagcgcaactatataagaatatattcctaaaaaaactatataagaatatgattgacaaatgagtatcccagttcaacaaagattgcacaactgagaacttatcagtaaaatgagtgaagcatacaagtagatttgatgtttaaaatgagaaatggaaaggtcctccaaagtccatttggcactcttgtatattatggtaattatgtttggtataactattttctgatgctttggtgtttggctagctaactttttctaaagcaagttcaagagatttgaaggaatagaatgtatccacagatttggctttggccaggggtgtgtgaacatcgatgatgactgatgaacatgcatgccataaccatgaggtatagacattattttggttagctggctcgatttgagtttcatcactagactctctagcctatcccaacttccttgggactaaagattgttgtcatgttttgattgcataattttctacttgcaatcgtaggggaatatcaattgtacaacaaaaggaagcagctacagcatatgtttttcccaatagaacaatttaaaagtgtaaacctgaattcgtttgtcagccaatctctactattataaaaattgaagatgtttttgccggtattttggtacgtcatccgtgtatgagtcggtttttaagttcgtttgcttttagaaatacatatccgtatttgagtcagtttttaagatcgttcacttttggtaatacagaaggaatcatataagaaatctgtttaaaaataactcgcatgctaacttgagccgatcggactcctaactgcagctcatgattttctaaaaatatatatatccaagcgaactcccacagtgaatttcatcttaactaaatcatataacaataataagatttaaatagacttcacccgttgcaacgcacgggcattttttctagtaaaagaaaaaggagacaagaaatgagccacgaatatatgggaaaaagtccgtcagttgtcttaccagtcaaggcgaaaactgatgaagcgaaatttccatctaaaacaggatctgcagtgatgactctacaaatatcccacaacagtaaggagatgatgagtgctaccttctccctgcaaaacaaaaacaattagatacgatcacaagtgctaatatgaacaaaatgctggaaactgctaatagagaacaggagttaaatgaaatgggaacaaacttactctaaaagtagcaatggttcagatgatattctttcaaataatggagtatcaacaaaagcttcctcagaagtttctctggcttcagcaatcagggtctcccaatatcgaaacattcttattatgttcctttttttcatgcttacaagaccaacaaaacacataggagatcttttgtctccatgacgaagcccaataatactatttaagttcaaatcggttaacccggctgcttttgttttacatccaccaacaatattctgctgtccagaatctgatatggatgagctatgtatctgatttgagctgttttcattagatgcctccttgtgcgaatgctgtaaatccaaagtagaatttggatggctattactagtattgctaggcacatcagtaggagaagctacaacattttgggcctgatcctcatgcaaaatgcagctcaaagagcgcttagttggcacattatccaacttggtgctacaagaaatattgactactgaattagatttatcattatcattcgcacgcagttgcttaacattatcatgacaatctattctattatgtccaagcttgccagtgctctgaatcaacttctgaattgcaggcccctcgactcctaacaaattgggcctcatctccaaatctgtggcattggctccagaggaaggacaatctctctcatattcaaaagcattgggcatcatatcagacaaatggtgggatttttcatgggtaggcgctttagttgcctgtggtagaattatgggcagatctggtgaaagagttctctgcattgcccttctgtatctttcctcatctgcatcattgtccaaatcgagtaatttcaagcagtcccccttgatcatttcctcaaaagagagtagcgaaggaaatttgctaactgcataagcatttcctgcttcagcaaaaggaactttagctggaacactcaagaaaggagttttaccagcaataacatagcatttcctcctacgagtttgcacgtcatcttcattcacaacgggcatgatgctgcttccttgctgcacacgagaacgatcatcactgcataaaatgccatttgaagtggaatcatgggccttcatttccagatgcaaccgcttatgtttagatgaaagacaatcagttgactttagagacattttggtcctttttctcttcttatctcctttgggcattttatctgtaacttctgtagcaccaaacatggatgattgcagtgccttctgttgaaagggatcaccagaaactacaggcaaagctctatcactgggtttccttgtatcattaccatctttactggttaactcgggaaccattgagctttgttttcttctgatatctgttgatgcagggactaacaacctatccttaccctgtgagtccattaactttttatcagatatggatgtgggacatgaagatctgtgtggactttttgacttcgttctgagagagctaccaaaaggaggctctagttcagaactagtacctgagattggtcttgtgcagctttctctgggtaactgatatgaagtgtagtctcttggtacagatgaactgaaaggaactattccagacggcaacccaaaatatggggctgaattatgtggaagtagattttgttcaaagttatgtatctccggatgtcgcttcaactgccaagatgataacattgaaacacattaatattaagatgcatatatagtagaataacaggcctaaattaacacatctaaagcatgtgtagtatagcaattagatttacacattacttaatattgttctggacacatcaattcgtgcacaattctctactactacctccgtcccaaaatgtagctatttctagcacagtactttgtcccaaaatgaagctatttttctacctaccttctcctctcaaccaatcacaaccattctttttcacctactttctcttttcaaccaatcacacaccttcttcaatcattctcacctactttcttaatacccgtgccaacctcaaaaatgcttacattttgggatggaggaagtacttaagaggagctggtaatgatgatggtatgtttgatgctcatcatctgtggatgaatctatgtagacatgggtgcgtcatttctgggatttttttaaagaaaaagtaaatgtattgtgtaacatgtcaatatctcaaattgacattcttttttttagttgcagatctgaaaataattatattgttatttttaggctataatatatttgaaaaccaatggaccaccccagcactgtgctagatagttgcctgggtaactaaactgaagcatatggtaaggagttaggagtgagtcagtgaatcctcttgtctaacaaaagtgtctgccgaatgctttatattttctaaacttcactatgactgttaaattgccaaactagtgaatggtataaaagaaaatgacataatacttgatggactcgatgtcataatcactagcataaaatgaaaacatataatgcgttaaaatgtcaatatagaatggcaaattaaacttgtagattgtgcagtgtctaaatgactgaagtttgtagacagagggtaatgcatttactctcagcactaaaaagtcccacttcttgccactccacttcgaataaatgaagattgagaaaggaatttcttaattttacatttttctgcgcatcctaaccaaacaaactctgtgatgcagacagatttgcaagatatacacaggtggcttaagataaatgatttgcctctactaatatgctaagattattgaccaagatagtttcgagcacattctagttcctactaaagttaccttcataagtacagttgatgatagtataagtagcagatacagacctcggttaagacatgaataccttcaacaccatcagcagcaagatgttcgtcaagcatattaaatcggctcagcagctggatccaatcctgtttaaggcgctgaagctctcttcttaccagcgcattttttgctttatctagctttgacacatttttcgcatgctttaattgttgtttcttcagcttaagtttctctttgagaagccttatatttgcaccttccgtaaccacatcaatgcgttgctgtccatgtttgccaaaagaagttgtatctttaactgcacataatttttcaagcttcctctgcaaattttcacttcgttctttctcttcttccagcttctgggatagatggtctatatggtttttctgatccactgcattctttctttcaacctcaattctaactcgtaaatcttcattcaacttcttctgctcctctaactttgcaaataaacactcagcacgactcttctcttctgtcaactttttcctctcggtttcaatcagatttttgttcttttccgctaacgacttctctgagttggcacatttcttttctctggcagctttctgcttctcttcttcagcccttttatttgcttcctctgttttcttcacctgagcaaccagcctttctctggcttcacttgcttcactcctcaatttttcacacgatgccctcagaccattggctgcttttctttctgtatcagaaagccgtttatactcttcagacttgtgtgtttccatattcagtaacctttgcagttctaaaaccttgcccttttcttcttcggcatttttcttctcggaattactcttcttcttttcttctactaaaacctgtttgagtcttctaatttcttcctccaactcagtgatgcgtataagttcattaccatctttgcaaacactttgtgattgttgcaaagcagagttctgtgccttcaattcaattatctctttctctagcatatctctggcatcagactcagagatcctagctgcttctgccgaatcacctcggagacgctcctcattgcacactgttcatcaacaaggtagagataagaaaacttattaatgcatgataaacataccagaagtttcaagacgcagatgtaaaatcatgaccaaaattccatatgcttcaatagtgacaggcttgcggcagtcttcaagttcttttagtcatgcatgaaatgtcacgataatatgcataagaagtgctacagagaaaataaacatactttcaaaggatcatcctctctgcgttaggcaccttctgttaaattcctgctagcatgctactaacatgctattaaattagaattcagagcattagatacttcagagaaaagtattttttttaataaggcaaatctacaatcctgaataagcataccatattatgctgtcgccaaaatattcatactgctgaattcatcccggcttaaatatgcaaaactgtgtttcaatatttgcgctgcccatttggtcgcagaccactccaggtgattttttttgttccaattagaatcacgatttcacaatgcaggagaaaccaacaaaagcagtgtggtagaaacaggtaggggaactctctagatgggagattaggtacctctgctgagctcggagcgctccttcagcagcttgtcattctcgccctgcaggagcttcaaaccctcgcgcagcgccgcgcggctcgcctccgacttctggtacttcctccagagctgcggggaaaagaaaaggcaatccaaatgcgcacgtcagatgccgtcccgccaaaaaggagacagtagagagattacaacgaattcgaggggctcgagcaggagggaccgggttaccttggcgcagcacgggttggggccacctatggcggcggccggggctgcagcgggcgcgggctcctgcgaggcgtcgggctccgacggctcggccgccatggcggcgagatttcggagggggagggggaggggaggaggggtttagggtttgtgtggtgcggtgtgatggggtgggctccgcctgccagtttccggagtgggggaaggcggtgcggtggtggtgactggtgggtgagaggagggaggaagcgagcagctgctttggctcgtgcgcggcacgtggccaccggggggggggggggggggggaaanncccnangcngttgagggcctgaaattttttattttttagatttttttaaaaatatttacagaaataatctatcggctaaaaaaaatttaaaaaaaactctgccgccccagtggtgggccgcaagctggcgaggcagacggcgggtcgaccgcgccgtctaccaccgtcggccaaaattgcatttagccccttgccgtaattttggcaaggggctaaatgcaattttggcagcccataaagagcttggggctcgtactttttgcatttgggccccttgccgccccactagagggtggcaagggacccagatgcaaaaagtaccgccaaatgatttttctatattatgttaataataattaaagaagtatttattagtaaaacttgttaatattgttataaaaatgtattgaagttggttgtttcgcaattttatatgttaagtaaggtattattttgtaacttattcgacgtattagtactcggagaattgatataggcctatcgcagtctcggtcgtagaaacattatatggacttaaacaaggagaattatgtaacatgaagaaataatagtacaatttgaacatgatacaactatttccattgcggttacatagatgatattagattcaaactaggagggaggtagtgcaatagttgaacataacgacgatgtagtaatgggacaaggaagcatgacagtagaaatttcaatatgccaagttgtccaataaaagctaacccctacgtgaggatccctcttctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtgaagcgagcaaagttagtaaatgttgtgagaaaataaggattcatgtaatcaaaatattcttaccatgaaatcgtcgtcaagaatatttggacaaacaaataaccttcgacccaatgttgtaggctttatggaacgaagaacctgacaacgatcaccacacttgcatcttagacgggcttcccatggagggagtgccatagttagcactcgccagtcgcactgttgttcacgacattgtcgttcgtaagccgcttttctctgcaagtattgcacaatacttttggatgcgaaataccatcgaccttcttgtaaacaagtggttaggttgagaacgggattttctgtatcgacccactcgatgtatgcgcaagccgtagtgcgggtctgccgaatagagtagtgttacgaagaataaaatgattgcccatacggaatgaataagcatatgcagataataaaatacctcacggtcatagttagggcacctaaaaaagcgccttcctcgaatatcaggattccttgaagccattagttggcatcgattaccgcataggcagagaggacgctgacactaaggtggtagtaggtatacataagaatcgctacgctagttcggattctcaacgcccaggcgtctagccattgacgaaagccggtaggatttgtaatgaagcaagtggggaagagagtactgaatgtgactgagttctgaaagattgtgaggcctcgctcgttaaggcaacttatataggcaccaaaaatcgagtgatatccctgacatttgaatgtggcggggcatggtgggtacgcctgattggcgccgaaagttacattggtcgtatgcggcaaatggcgggcaaatactcgtatcgcacgcgaataaaggaggctgcatcggtgcggcagaaagtagtcatgcatgcgccgaaaggtatcgtgcatgcgccgaaaggtgtcgtgcacatataacaacaacgtattcattacacaagcatacagtactagcatgtgaagcaaataaacaaagagaagtctgctctactggccctgccccgcgccgcgttcacgcttggtcctccgggcctgtgctcacacgtggtcctgggagtaggtgaaatgatccggtggcacagcacgggtagcacgagtgtctggcggtggagtggcctgcgcctggtcctgcgtctgcaccggcggtgcgcctcccagctgtgaggggccgatgacgtcctctgtcgagcctgaagcgaagtcgaagtcagtgatgtcgaagagtaaggcggaagccaccaagtggtccgacgaggtcccaacatggtccaatggtggaccctgactcgacgtgccggctgcctgtgacgaagtcccggtgtactgctcgacttgcaagcgttcgataaaatgttaggcaccttaccttacgactaaatatgtagtacgcttgtcatctcggtacaaaaacactcacggtgaactgaagcagccacctcttcgtaggtccggtgttgcggtggtgtgccaacggctggagcgggagatgtggtgcgcgctgtactggtgcgaaacatgctgttagatcgtccttccagtccacacccgtggtcactggcccaacagcgtctcccgcgagcggtagccccaacaagtacgatacgtcctgtaggataggggctacttcaccgcacggcaagtgaaaagtgtgcgtctctggcctccatcggtcgaccaaagctgctaggagggaccggtccacattccagcgtctggccgggtccgcgtggccggcgacaacctccaccaaccgacacattggtaggaggccggcctcacgcaacctgcaagaacaaattaatatgtcattataaaaattattacagcgcaactaatttatagtaatacaccgttcgtacctctcgacaaaggagtcgtgaaccgtaagtagcttaccgcacgtccgtgcccggaatgtcccaagctgagccccctgcaccgcaataaggtgagacaggtgtcggtgatctatcgccgggtccaacaactcaggtgtatcctgacgtgccatctctgaaaaatatagtgtttcatgttagaacaattcaaaaggtagtaatgtagaacaaaagataacttgtaaaattatgaaatagtaataaaatcataagaattattatgtacaacaagagtacaggctatttaaatatagcaaacgttactaagggtacataacgatgacgtgcaatttaacatatatgtagagttcgataatataacataacataacataacattacatgccaagtccgacattacatcagcatacctaaagacattaggtgcctaagtctgacgttacatcacgagacctaaagacatgacatgccgaagtctgacattacacgacgaaacataaacacatcgatgataagttcgaaacaaattacaagcaaagccacatgccaacatagaacacaagaactacaccacgtagccagatgtggcacgacgacgcctaggacgtggtcgagttgaggtagtgccttcacccgtagggcgagctccatctgctgcttatcctgatagtcctgcctccgccgcacttggtttctccttgtctttaggacacactacgtcagaactgacattctgtaacactattttgtaacacattcggagatgtgttactggggaatgctatagcaacgaaaccttatgtgttgaaaaaaaggttgtaacacatttccaatatgttacagttggtatacatatagtaacaccaattcattgttactaccacctatagtaactctgtgttgcgctatgtaattaaaacagatttagttttggataatatattggtgccttggtttattataggtttatttaacatagtgatgtaacattatctaatcacataaaaagtactagggttggataatatattggtgccatgggtttatttaacatagtgatttaacattatctaatcgcataaaaagtacttgggttgctttctaaaacaactaacgtgcctaacagaggagttgaactcctaacctcctgtgtaaatacacaagaatcgcaccagactagccaactgggcaagcaaacatttgtgtcattagttgtaaattattgtacttgtttttttttgcattaatcaaaatttaagaaatttaattttatacacacatgcgtacactttatttttaggaattgtggtttgatcaatgaaccaagcattcattgggttgaccaatgcccattttatatataaaaaaaggatggctggactcaagttataaaagtaccacaagcacagtgagaaagcatgcagaatttatagatgaggctgtgggcttggttcataactccttggatttattttttaatttagcgagtgagtctgatccatgacatgtgtataaaaatatttaatcacaaaattgctacaatgtagctgaggtatttgcacggaatctttttgtcttacatcatgaacttagaaaaaaaatggaagaataatcatttcggcaatatgaaagaataatcatttcagtaatatggtaaaaaacaagatgctagagagatcacataacccagacatgattacaggactaatcaatatagcaatagaaaaggaaaagctcacacgaacaaatttaaaataatctatacagatagactacattgggaattattattgactactgaagactggcctaaactcatgtttgcttggactagaactgccatatgttgcttagtgacagctgcttgttcactttcgcttgccgaaagaaacagtaacaccccgatgccacctggccatgtaggaaaagaaaccaagttcatcagcaaagacatgacatttcttttgttgttaaagaagacatggagatagcgagctgatcaatagaatctagaaagacagataccttgccaatgtaactgcgtctgcatcaaaataatggacctgaaactaaacaatatagagcaaagaatggacatgaacatgcatgaacatgttttaatcaatcagaaataaatataaacacaacgattattgctatcttttaatagaaagaatagccaaggtaaccacaaattattcatccactacgcttgtaatcatatttctcacaagaacataatgtaagatcatacttaaccagtggacctaatagttgtaccgtacaccaaaaaggcagaaaagttaaattaaaagaccataaatattgttggatttagatgcattcagttggatagagttttcgatagttctaaaactggaagcacctttgctaacaaaaataaatccatcaaaaggttttagatcaggtaattgcatataccttgaagtaatgaaataaatcatgaaagagtaactattttcctctgttatccttcattattcaaagcattattatcaacatctactgttgttccttcaacatctgttctaacccattgcttgtaattgtttgcattactggacattccaccaaggtgtgaaacatggaatggctcaatttctatgtcacctgcccattcatcctcaccaatgtcatatatatctctaggtttgttcttccttaccacagaccactcaggattcattggatcatcaacataataaacttgatctgcttgattggggaaaataaaaggctcatgctcaactttttctccagtatgtatgagatgtgagaagttaactagtgtgtaaccatacttatcttttttaactccttttccagaaacaacatcaacccattcacatttaaacagtactactgaaaattgtccagagtaatttagctcaataatatcgatgactctaccatagtatgttagatcacccaatattggatttgtgtcacttgatttagtataactggatgtttttgcacttaggacaactccgctattctgtgtcactccatccaaatgtttaggcctaaaccggaagccacgggtattgaaagcacgatatctttttgctggaccaatcggaccacgagccagccatctatgatcattcttgacactgcatatgccatttttcctctctagatccattatctgtgtacataggattacttagtcatgattttatttgttgatctaaatgataataacacgaaacttacatgagctctgaaccattcatggaatttttcattttggatacgctcgataatctttggggtgatgcggccttgccgatatgttcttctaatctcatcagcatgagttctgtaaaaggaaaaagtgtcatgaagtatgctttgaagaaaatgattagtgatgaagtgtatgatcttgagctaataccgaaggtatgggttgacatctggacagttgaagagcacatatctatgtgcttgcattttagtcaagcccctaataacataacttctcggcttgccaagtggttttccaacatgaggaaaaagatatggtgtgcattcatcatctgaacatgcaactgactcatcattatcatcatttcgtgtaggctggttatgctttgtctcaaaaccttcaagatatcttgaacaaaatgttatacactcatctgccaaatatgcttctgcaagacatccttcaggatgtgccttattacgcacatatgactttaatacactcaaatacctacataaataaagagaaagattaaaaatgttaaaaattctatactagataacaaatgaaattatatttgtgagagaaatgtacctttccacaaaatacatatatcggtaacacacaggacctcctaattttgcttcagtggctaaatgaacaaccaagtgcaccataatggtaaaaaaacctggtggaaatatcatctccaaacgacataatgtcattttaatttgttcctctaacttgtcaagcacatcaatgtacaggacttttgaactcagttctctaaaatatccacatagatcaaataagacaaaagtgacattgtaaggaagcacaccccgcaaagcaactgggagaagttcttgcattagaatatgacagtcatgacttttaagacctgaaattttcccttgactaacatttatacattttgagatgttttctgcatatccatctggaaccttaatatcatggagaactttgcaaaattgatgtttctcccgtttagacattgtataggaagcaggaggcaaataatacttattattagcttttcttatgggatgcaaatctggccttatattcatttcttgtaggtccaagcgtgcttgtaaattatcctttgatttgccttccagtcctaacaatgtcccatatatgttatcacaaacattcttctcaatatgcattacatcaagattatgatggagtacattcaagtcccagtaaggcaacgaaaataagccactacggcatttccatgtttttgacttctcaaaatcattaattttctctatcttttgtaaaactgatgtttcagaataagcaagaggttctactctatgttcttcagttccatcaaaagaattttcattatatcgtaattcatggtccagaggaagaaatcgacgatgtcccatgaaacaatacttgtgtccatgtttcaaacgtttagagcacgtttcttcacgacacataatacaagcaaattcaccattgacactatatcccgcaaagatcccaatcccaggatagtcactaatagtgaacagtactgtagcacgaagctgaaacatctcattttgagatgcatcatatgtaggagttccaacctcaaataaatcaaataactcttcataaactggttccataaataaatgaaaatcctttccagggtaagatggaccaggaattattagtgcaagcataatagaagatgctttcatgcataaccatggaggaaggttatatggaatcaagacaactggccaacaactataagttgaactcaatgtcccaaaaggattaaatccatcactagccattgcaaacctgatgtttcgagaatccgatgcaaactggggattcctagagtcaatggacttccaagcctctgagtcagctggatgacgcaacacaccatcctttgtacgaccctcatcatgccatcttaatgctatagctgtttccttgtgcataaataacctcttaagccttggcttaattgggaagtaccttaacactttccttggggttgcccttctcctttccttctttgttaaagtagttttatcttctttgtttttccaccttgaagtaccacattttgaacaaaagtcatcgtttgccttagctttcctataaagctggcagttatttggacaaacatgaattttgacataattaagtccaagctttcctattatcttcttagcttcagcaaatgttccaggtaaattcttaccatttggaattgcttgttgcaagattgctagcaaatcatttaatgatttattatttcacttgttaactgattttatgtgaaacaagagaactagaaatgacagccttgtaagttcacacccttcccacaaagggtcatgagcatctcggagcaagtcatagaatgcttttgtttcatggtctggcccactgtttaaagaattttgtacatcatattcattcactggagggtcattgtttgtgttcccaaaagcatcttgcactagttggcgcatgttaccatccattcctctactttgtgactctgttcccctactgttggcagagatgaatgatgtggtttcaccatgacaaccccaaggactataccgaagtaacattccatgacatactaaatgatcatacacttcatcccgcattaataaccacttgttgacacactccttacatggacatcggatcttatcttcaagactcttttccctatatgcaaacagaagaaaaccatctattccagcaaggtactcatcacttggtctagggaaaagcaataacttcttaatattattcaaatccatcaattttctgtgttaaaataagaaatatagttaatacatgagtgttcctaatttgacaacaaccactaaatatttttgattctataattatgccttcaagccaaaagaaatttgtctaccgaacatgtgtaggtgaggttaactgtacctggaagcttaggattaggatccagtagatacagcgtcgatgcagccctgatgcttgcttaattgaaccaaacgaaaacgaccatcttatctactggctagatcagaaaaatagcaaagcagtacatgagtggatcagacattgctgcagatgggattgacaaaagcaatcagaataaagaattaaggactttacatgataattgaggaattaaactgcactatgagccaatatttttggttgtacagattaaattatatggttaatataagagtttctgtgagctagattaaaaattgaaacaataagatgcagggtaaagttttaagatgccatctgcgtacaagaaaaatgacaaacacttggtgtgcatagaaaaacttagtgcttaacaatttgctaacctgccgtcatatgcacttgactgccttagggtcttgaccgtcttgatcaccaagcacagatccaccaacaccaagtgaaaatgtgatggtgaggtcgctattgctgatgtgtggcacgcacaagggacatgtaacggggacgcgcggaggatgctagccacgccgcgcgagtcggaactggacctggattcctagggataggccaccggggcggctagggcacgactgcaccggcgtggaggcgaccggtggccggcgctgcaggggctcgggcctgttttggtggctcccgtcaacgacggagtgctggggaacgagactagattggatgaagattggaagggagcgcacaggcctacacgtaggagatgagcgtgtttctcaatcggtatcacaactgcttctggataaggagaagtgaacccaggaaattgagaaagaaacgtgcaaaaagatgtttctagactcaattgatgagccctggaacttctttttttttcatgtttttcaggaacgatataaatagattagatgcaattcttttctttttaggaatgagagaaacagataagatgcaattctttttttttaggaacgagagaaataaatgattgccatttttttaggaacgagagattttcttttgtaggaacgagtgaaatagatgattatttttgtaggaatgggagataggtgagatgcaatatattagctaactcttctgaatgctagaacacgtgtacacattttaagtgctagaacacgtgtacactattttatctgtgccactgcaaatgtgtctttttagataaatactactccctccgtcccaaaatataaacatttttagcctaatgtaaagtcaaccatttttaactttgactattaatagaaaaaaataaaaatataatcatgtaaaattgaggttactagatttatcattaatcaaactatcttaatatgtaacttttttatttaaaatattttatttttataaatataatgtgaaaatagcatgcatctcgaagactgtgtcggagtacaaaaatacttatattttaggacatgagcattaaaattcgtctattatttgtaagggatgttgtgcgtgaagctccacaaggagatctatgccgctgccctccccggcggctgcaacgacaacaccaacagctgagagcccgagaacaacgcatcaccattagtctttgtgtagcgcccgttccgtcgtggcgcctagcgggaaaattatctcctaaaaaccctaattgcgaaatctgtttctttgcttgttgtctagtgtccgtgccatctcaagatctcaatccccgatctatcgtcgagttcaaatccgaatccaaatccttccaaatcaaattcctccgcaaaagtctattttgcctcccccgggtcgatgggccgaatctcgctcggcccatctccctctctccctctcccgggcgctccctctctctctctctctctctcgccctctcccctccccggcgcgctccgcttttccccccgttcagctccgctccgcctcgcccgcgcgccgcgcgcgcgtgcgcgagagccgcgccgagcgccccctttccttctcctcgctctgccg

SEQ ID NO: 80542 - DNA, 7379 bp, Oryza sativa
atgcctagccaccagtgaagcacgagccgacgccagcgcctagagaactcccctacaagccactaactgtgagggatgtcgctgctacgtctgaggccacgaccacctcctcatgtcgcgacggtgcctccggcgccacctcaggcccccctgctcctatggccgccggtcgccagctctaccaaccagttctggcgacgcccgccacagcccccgcggccccactgccaactctcttgcgcccccgccgcttgccacctcatcctccccttcctccaccttcgccagctctagatctgtcctcgccatcgccgctgctccacaccgccgcctatcttcccccttccccacctccacctctagctgccgccgtcatgcaagggtggctagaccagaaggggatgccaagtccggcaccgtcgccacccccgcgcccaatcgcctccgcgcccagccgttccgcacctagctgcctccgtgcgcccagcccaacgccctgagcccctaacacagagggaggaggaaggccccgctgctgccatccttgcagccgcgcggtttccggcgttccgctcgggcggcggcgaggcgtaggaggaaggcggtagtggtcgccgcccgtgtcgcccctacccttggagcgacacgggggcctcgtctaaccttctgaatcttttaggttcaggtggacttgttgatggcccaacatataaaaccaacccttcgcccatgggcagtacccattttgcaaatgggtgctatgggaaagcagcccgtatcagcaaccttcacttcatagatgcagcaggccatagcttcatatcccagacaacaaggccattgctggtacgaccaaagaaaaatgctacacggttgatagctttggtcaggatagtactgacatgcacgtctttggtggacctggtggttgtaacaaatagcttaattactagcttgttccattgtagggacatagtaaaaaaatcaagaaaattcgtgacatcaaataaaattgagaattctttctttaatttgccactcaaagttaccatgtttccttattttcccttattcgccatcaacatcaacacaccatgaaaactatcatcttagaggttaaatttagatagaaatgacaattttttcccctcagccaaatatgtgcatagttttcacatcccatttatgtttgcctaatttaaaatttcacattcgcttttattgtccaaagatattagcacgagtgtttttattttcgactaattatttttcagaggtaggtgacatacccaccaacaatgagacgcctgtagttatcccgtaaatcccaagacatgtcgatttagtctttgaaggtgctcataggggttgggtgtaagtttatagggtgagtgtgtgcataattatttaagcgcatgtttctgtattgtgtttaaaaaagtgtttaatttgaggaaataattaaatatttcttttattttttcatatgtttgttaattggagtttatgtgattttatttgccttctagaggtggaggcttttccctaaatgctgtaaattctagaaaaaaaattcaaaattacaaattcttgaattttatttcagaaaatctgttttcctctccattcctttctgccccttttcctcccacttccatcttatccaagccgacacgtacctcctatatttctctcacttccctcccattccaaagccactcgatcatcacccttatctcacattgcaattttgtaataactaatactcacctatatgatatgttatctatcttggttcggtgcagatatcattgtttcattttttttatgttattattttggataatgcttcaatgcaaatttacaattttgaacgtaaggtggcagcagattcatcgttgcaaacaacatttctaatacaaccagcaatcgcgtcaaatattaattatattagttggactcagatctaccaaaataccgatgggcattgaactcgaacattgatttatttgatacaacatgctagtacactacagatgtatcactttgtgcaattaccaggtccaccatataatagacgggctccatcatcgttgaacctgatatctccagcatcatagcagaatggtctagtactgcctgaaaatgtgttgtgtgtgcctggaatgaagtactggctgtctttgttgatgactttgatactcctcacataggcagctttcccaggtccagtggctgcccaatgtccactgcccagttctggaaggtgtaattgaactgttggtccatggacttgcccaccccaaaaacaagcacttgctttttcattcatgtaggtgaaaattgaaggaggccaatatccaagtggttttttatcacgcccatatgctagccaccaatttccggtcttcgggtcctacaatgtgtggtgatcggcgacatgattaaataaagtcttgcataaataaattgatatatatttcatccttcaaaattctttccgtcattcccatttcccaatttggcagtaatttcaacttgatagaatgtgtggttagtttcactaagtaaatatatacgttacaaactacttagaataaaaaaaatctcaaaagaaatctaccttattgatctgtactgatttgaaaaaagaaaatacaaacttcaatgacattcacacactttcaggtgtagtcgtgttcataaactcaaaatgccacttcaactaacagaggtatcctaaaattttctcttgtagtgtccttacaagtgatgactacttgcctaatcattatggacaaaagaacacaactaaatgtttatggcttatagttatgatataatcatgtgtccaagtattctaggagagcataagatgaacaatgttagcctatgaaatgacaagctgaaaacacaaaacaattgtgaaaacaacacctattttgcattgaaaatgttaacctaacacaatataataaaataataaatagcatttatccaattaaaatcagagagcatgcgaaaagaacaaatagtactgccttaaataagaaactaacaaatagtcttgtccccatactacattagcatgttaattgaagcttaacattcaaaatatcttatttgtactttatcaattagatgtttcatgaactgcaaagccacactaataattatatgcattggaactatttctatttaattaaggacacattggaatacatagaatggcttgatgacacaaatcctagatgattcattatatatatatgtgataccatatacagtttgactcgtaagatggatcaacgtgctcttaggaagcataaacccattaagttacaaagatatcgaatggacattctaatatccaataaatgcaacctcctctctttaattatcagttgaattttatattgttttctggtgagaattatattgtttgatataacatttagccatgttgataatctagtttagagaaattatgtttagtcccatggtacatcatgtaaagttgatgcatttaaccatctaaagtaatgcttgaacacaaggatttcacaaatcaaagatataggattccagaacaagtaaagacgattttcaataaaagtgaattcattcgagagttgttaagcaaaacatacctttgatattttcagtaaaaaaaaacatacctttgatatagtaacagtaatttcatactgatctccattataggtagaaactggttcaattctcccaccaataccaacactcgtactgacttgtacaaagccaggacacatatgatcaaagcatggcatgttcaccgtattaacttgctgccataaacaaaaagtaaatagaattcttaagcagtgcaatactgttcgactcaaaacaacaacaacatatatacagttcaaatgcatgactgtttacagaaattcttacccagtatatatgaaatctggcaaagttgtcaccatggtagtttggccatacctaaaagcattatatattgaaatatcgattagtgtacggcaaaaagggctttctattaaaaaaaaaggaaagtttaatgcaatgaagactttactatagactctgttatggcatttatgcattaggaggtggagcagcatagatggtcctacggagggcttgcggcgggcttgcggcccactaacgtcctaggaagcccaaacagacattttttttaaggaataagtccacattccctccctcaactcatggccgtgtatgaatatatagcatccttcaaccgcaaaaccgggtataactcatcccccaactctgaaaaccattgcaaatcaactccctgggcggttttggaggtggttttgtcctacgtggcatctttgaccctgttgacttgctgagtcagcaggtgggacccacctgtcagtgactaggataaaagaaaaacggtgggcccactgtcaaccacacttcatcttctacccttctctcgctcctccggccgatcccgacggctaggagctcgccgccatcatggtgcctagccaccgcgacgatgctgctgggggaggcttgccggggacagctgtggatgggtagaagcgcggcgagaccgaggccggcatggcggtcgttccgagaccccatggcaagcagcgagagtgcgctgagcgccacgaggaggagcagcgccgcccgtaccaccgtaatgtacgacaacttctccccgccgctctttcccctcctcctcctgcagctatgtctgcacatcagtgcacatggattgccggcggcggcccgcggcatagcgtgattcgtgcggccggcctcgggggagacttggctagggcagcacgtgagacggcagtggcaagaccaattacatctacaaacggctccaggaagcaagcagtcggatataaaacaatgcaagatcaatggttatccatcaaaaaaggtgcagatagccaggtaccccaacaatagtatcaatcagaaaattgccgggtggcataccatgctgaccaaatttactaagctatcgatcagcaatttggtcgactgtatcgtgatttttcaagcgtgtatgatactatgatgcttatgatcagcactaaatcactctgcccaagcacgcaaaacaccgtcaccagagaatccccgatccccaagcctaggggggaggccgtcgtgcacatggacgtggcggcgaagacgggctggtccacctgcagtgagaagccgctccacgtccaagggttgccggccagctccctcatctcgttcgccctcctccgctccggatctgaggagggggatggcggggtggggcggcacgtcaccgccgggatcggccggaggagcgacagaagggcgtagagaagaagaaaagtgtggttgacagtgggccccaccttttccttttatccttgtcactgacaggtgcgccccacctgctgactcagcaagtcaacagggtcaaaggtgccacgtaggacaaaaccacctccaaaaccgtccggggagttgatttgcaacggttttcggagttgggggatgggttatacccggttttgccgttgagggatgctattaatacacagccatgagttgagggagggaaaatggacttattcctttttttaacccttaagtactgctccctccgtccctaaatatttgacgccattgacttttttaaacatgtctatctgttcatcttatttaaaaacttttgtaaatattattcaaaaacttgagtagtagtagtatatttaacaatgaatcaaattataggaaaaaaattaataattacttaaattttttgaataagacgaacgatgaaacatgtttaaaaaagtcaacagcgtcaaatatttagagatggagggagtactccactaaagtttttttacccttaacactaatttagtgtttaaaacgtcatatattaacgacaggaaggtgtactccactaacgtttgtggtagtccaattaaaatcagacaattgcacagatgaaaaattgaggcagtttttttctaaggtgttttttcaatatttactagtgtattaagttgcactttcacgcaactataaccaccctctctgttaatatgtctattggttattcgtattaataataagcttaaatttgtaatgataataaatcataataacacgtttcgatgggtacataggtgataaccatattagtacatcacagatatatactatacatactcaaggctaattatatatactttgaatgatgtgaagattagtctgaaccaatgaatctttattaaaggatgggttttatttgaaaataatctttatttaacgtgcaagttataaaattatatgcactacctatatcttcctccttttttttttctttggctgttagatctttgtaaatataagtcaatgatttattagtaatttttttaaagaaacctgcacatttaatagaccgaaaagaccgataccgagaaattcggtcatcaattcggtccaaggtagtgaaagactgaattttgttcggtcaattcggttagtaccctcgggtaaccgaatagaccgaattatcaaaaaatatctaaatgcaacctacaatccactatgtttaataggattaaactctaattttcacatccctacttcttctaggcatgcaacctaataagagtctttactcataagtgcttacgaattttttttttgtgatttttgtgttaaaattttccattatttctttgcatatatgaaaatgttgttgaatttcggtcagaaccgagatcgagaccgaaaagaccgagaccgacttttgtcggtcctgacatttttgtgttcttcacttttcaaagaccgaaaagaccgaaagactgagaccgaaattttcggttagaccgaatgcccacccctacattgtaaaactatatccagaatcttactagccttttcttcttggctttggagatttcgagacaaagttaaattaataaaaaatgattactacgtcctctatccaacggctcatatttcttctatctatattttgttaccatgaatccaaaggtcattaatctgctgattacttggtgcatcctaaggtagtgtttggttgctgggatggaatgggataggatgggatgaacccatttttaggggtgtttggttcaggggtgagtgggatgggttggtccctacagaggaatattcctctcagatccgggaccaatcagtctggccaaaactggcggacgaactcgtcccacttgggacgagcgacggcgtgaaaccgccgctttgctcgcacgctcttcctcgggagacggcggcgggctcggcgacggcggcggtgggctcggcaacggcggcggtggggg

SEQ ID NO: 80543 - DNA, 683 bp, Oryza sativa
cacattcgctgcgaagtgtgtgtagtttaacttcttggaattaacacgggagttcggatttacgactatttatttagtggtagcatggtaggtggaatacccatacacaatgaaacactcacgatgacttcatcaattataaaactagaggatgccccgtgcgttgctgtgggacttggttaacatcaatttgttagataggaggtacaatctcaagaagaaacagaagaaacaaatagctttcttggagaaattctttttaacagctctatccaaaatttgtagataatttaggtagcacatgtcaactgaaggggcgttcagccataaagctcttttatacggattgacgggctggatacatgtagatgtgtgtggagatggaccaatttgttcatgtgggctacatttggcgctgaggaggtgaagagactcactcggtgactaatgggttgggctctatgctgcattccatccaacgtctgagaagcgatctaaaatgggggatgtattcataaaaaaaagccaacggttcacaatttgataataatgtggaagcatgaggtttgagcttttggccttaactttataaaaagaagggatatgtcagtctagtcatccgaaggtattaataggatgtgatgtgcatatgtgcattgatagggtgagcgcgcgcatagtga

SEQ ID NO: 80544 - DNA, 691 bp, Oryza sativa
  unsure (1)..(691): unsure at all n locations
gggagcagtgtgccagtgtcgctgtccaaaccatncatgcaagcagcaaantatgaggtgaggtggtgagtgccaaccacgcgagagcagagcactgcagccgcgtcacgncggctcgcgtggtggcggaacaatccatccatcgcctcccaaggggaataccccaaaaaacccccgcggtgttcccagttccaaaccnccgtgcaagtgccgtggccccacacnccgcccaatcccaggctcccagcgcctggcgcccacggataccgtcacccttcccgaggacctcagccgccgcgggcccanggggcatctnnnnnnnnnanncttcccacggacnccgcccaggtgggcccccagctgcaggagcccccctttcagccgggcccacgtgaacaccagcccgcttgtcggccagcgcgagccctgacgccgagacgacgccgagaccgcgggggtcccacggggcgcgtgcgaggtggcaggtcgtgcgcctgacgccactggcgacgccagctcgccgcggtccgatccaatcatgcggcctcgtagccgcggccgtcttctttatcgggagcctataccgtatagcgctgatgctggccttccgatcggcatctgacggatagaactgtttttttccggttacagtgaacgattcgcctggattgggaatatacggccgggatta

SEQ ID NO: 80545 - DNA, 18236 bp, Oryza sativa
gcccccttgccgccctccgatagggccactctccgctgtgcgggggggccgcctgcaaatgggcggcgagggggcatggaattttgcaggcggcccccttgccgccctgggggagggcgatttttgcctcccccctataaagcccagcccctcccctgtgaaatttcattatattcactaaaaatccaaaaaaacgaaagagagagagaggggagggcagcagaagggaagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttgagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagaacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagaatgtccgtgacgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggctttcgcatttgtagagagtgagaacactgaaagctggtactggttcctagagagagtgcacattgcagtggtgcgtatgaggcccaacgtttgccttatacatgatcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattattcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccagtcttggatattttaatcttgtatagttttcaatataaaaagatttgataactattgatatttatataaaaaaaatatagagcacagtacaaaatcgccctcccccagggcggcaagggggccgcctgcaaaattccatgccccctcgccgcctatttgcaggcggccccccgcacagtgcaaaatcgccctagcggagggcggcaagggggccgcctgcaaatttcgttgacggctgtcgccagagagagaacggccgtttgccacgtcattttcgccgccctgtgggagggcgatttttaaaaatcgccctcccagagggctgtaggcgactatttccgtcaattttcaaaatggaaaattatttttgtaaaacttttaataaaaaaaattataaataaaaaaaattcgaatttgaagtccaccggataaaccccgtgttcctcttcgaaaacctctccttgttatcctgtccccttccgaagaccaaaccggctacctgaacttcggtgcgcgtccatggagctcaacccatccgcttccctcccctagctctctctcgtccacctcgggttccaaccgcagcatcggaggcggagccatggcgtcgtgctcccgcacttggctcctcccaggtgacctctcgcccctcatttccaaccgccaattcgcacggctcaagcgaactcacctccctccaatactccgcaggcatggcgccgcaggccaccgcccagactgttcctcgccccctccagtccttggtaactcctcccccatcggaatgcccgagaaaattgctgaaattttaccgcgttcccgtgctcccagttgtcatgggtgctgagtatttttttattttgatttgtgtttggtgcgtgcgcagaaggtgtttgctggattgcctcaccggagaagggtgctgttttctggtgtgtcgagcagaacgcgaagaggcaggatcaggagcgtcaaggacgactcgctccattttgatccatctaagatcgaggcgccaccgtactccagttacttcgactccacgtcgggccagctcgagccggcgtcgggtgctcgggcaagcatacctgggcaggagtactggccggagggcactgcatcccgcgtacgcgctgcccgtgcacctgcaccggtcggggaatcagctgggacaccgtcgtttggtaagaagcccgggagtagaaggaaagggtacaaggagcaggtagcatcagcgacggcagggagaggcacggagaccagtggagatgagggagagtcggttgtggccattgaggcctcatcagatgagacactggaggagacaaaggattcattggatgagtacgtcgtttatgagatgcccaaggaagaaaatttgagtgaatatgagatggacaagatgatgggacggccacacccgttcgttgacccgcagaaggcaatgtctgtaggggaaccaaaatctagtgaagagctgtggtggaactggaggaggaagtctgaggaaaatgaaatgtggtcaagatggcagaggaggcgtccagatgttgacacggttagttcttgattggtttgaacttaataaatgacttataagtcttttttacttaagtttttctgcctattgtcacttgttaacataacctagtagcgaatatgatgtacacagtatggttcttattctccactcctcctgctgcatgtccacaccacaattttgagggtttcaattgtttgtatgctagtcttcgtataccctattttgatagcacaaggcacaaacactaaggtagtactccctctgtcccaaaatataagaacctagtattggatgggacgcaggatactatatactttggttggacacatcccattcggtactaggttcttatatttttgggacggagggagtacatgtagttttgtgtgtgccaaaatatccaaccaaagtatagtgtttgtagtgctaatatttccagaagccacacaatgtcgtcatgatcatcgtatgcatcttctagtgtataaaagatgcaagcagagtagtgtacacagtgatgagctggtatttttattctgggagttcaaaatgagatgaaatacttaaccatatatcttgggttcagacagaattaggttcttcattagcctagactggtaacatttataaggatcttctggggtcatctctattccacgaatcctaaaagctgtgtggctcagttgaacgcctattcccccatactaaatccaccacctggtagatacacgtgcacagcttgcagatgtggcatttcctatacatggcttatcaatttaatctatattgttggttgatgtttttaacctttttcattattcagattagtgtttcttctaacttacagctctgtgtcttgtcagttataatttaaattgtaacactcatttcattattgtaggtctttgcaaaagcaatggcagaaactgggcagatcaaaatatttggggaccaccctaccagaacagaagctgctcttgccaaggcaagaagacatttattcaaagaggaaaggttggctgaatactagaaattattttctcaaaatttagtgattttgcttttcgtgggtcttcaccatatgtgaaaaccgtgcttttaattttaatatcttcaccatatgtgcaatgatactctttaagcttatgtagactctttaactgacctttggtatcccctcgttgatttataacaaatatttgatggatgttattatgtctagttgcctacctgctggtttgtacttcaatgttacttgttatgacagcagaaaaaaatattgacacaacgtcctttcaacatgatattttcacagtattcttaaggtatatagttctatcttgccttccgtccattcttatattggatatacaatgaaaacacaggttagaagcagaacaaaggagactagaagaaatagggccaatagcatactattcggaatgggttgaagcgtataaaaacaaagacacttcacgagaagctgtacagaaacactttgaggagactggcgaagatgagaatactcaacttataacaatgtttcaacaccaaactgctggggaattccgtatcatgatgggcactgatgttcgcatacaacgagatcctttggcaatgaggatgcgggaagaccagatcaaacagagtatatcttcttttctcaatcctgatcattttatattattgacatctacaagccgcttttgctgaatttatacatggtccatcctacaatagcttctttctttaatcgtatttattctgttaaaatatattgtatgataaatcctggaaattgagcacatattatgatcttaacttagcacagaagtagtgttggcatttacctgagaatatatttggaacatccaaactacttgttaacttctatggtttgtttttgaaataaatatgacaaaccaaactttgtttcctgtcctgcttatagactggcatgatcctggaacggaagtcactgggtttgaacacaacatgacatgttttctccagtttcacgtggcactgttgtgactgtttgtatttttatgatatctacattgtttctgtataaatgcacctaaaatggtctattagaaatgtttacaactagtatattcaaacaagtatttcaggtataccctggtgcagtttacatgggaataatctttccatattaaaatatgcagtttggggtggtgatcctgtttacccaaccattaactacgttcatgatcctgacgaagtagcggactacaggggtccagaatttcatgagcctacacctgaagttgtaccttacttgatggaggtatgtcgtagtgcttccacacaacttatagtatttcacaatgtgctgcctaaaatttactggattcatgacgatgtatggttattgatttggaaagccatggctgcataagtatatgttacctgttgttatttataacagtacaatagtatagcacagtactaacaatgccagtcatgcgacaactggcgctaagctgctaataggactgatgaagctctaacatgatatatcgcctttccccttttaagcatggtataatgataacaaaggaagagctatatgcccgtttaaatgaagagatggaagacatcaatcaggacattacggtatacgtttaactgtaactctggtttggtattaattgaatgttgagaataggcatcacaaatacctcttttacttatcctgtcttaccttcttgacagtatcttcctgaagtcagagatcccatggctactgctgttgatattggggagcattctgtgagtatccatcctaaatgcttctattttttaccaaaacctctcagtacaggagaaataaaaaaaatgtaaattctgtttctttgggttcataactgcaaagtaatgctagattatataaaagcttctccatacaaacttacgcgcatttcactgtgatgttttctacttttcaaatagtacaacgaagatagtgatgacgatgaggaggatgctgacaaagttgttgcgcagcctgagtcactagaggtataatactgtactgtttacttgatggaaatgcatgcaatctgcgattctcaatgtagccttgcgaatttcttcttattactggcaatgacaacagatctttcagttcatatacatgcttattggaagctgaatgcctctcttgctgtgcatggaaatagttgatttattgatgagatagttatcgatacttgtcctacttgaaagcttgtcattcctttgtattatactgctttaccaataggatgatgaagatgatggtgatgatgctgaggatgctgaagggaaggtcagtcgtaattggagtgttctaaaaactaccggacaggctgaaaatccaaaggtaccttttcattattatcagttctgttctaatggaaaaagttcagccttttggcattaataaatgctgagcgagtagcattcttgccagtccagcagtcctattcactatcttgcctaattatgtgcatatggtttaattttgtgtaaattcatggaagtgtctaatgcatgcatagagtttgtaactgtatcaactcccactccaagcacgtaacgtaccctgtcgtaaaggatacattcgtcagtgatcacaactcagtaactcacggatgactgcttatttctttccgtttttctaggaaaagtcgaagaaagatcaactgtcgctaaaagaagctattgcagattctgagaacttgactgattttcttatggacttcgaagaagatgagtaatatctgggcatttactttactatgctgcacgttacacatggtaagcaaagtaaagcatagcagactaccatttattcttaatttttcagagaatatttaaccaaaagccagagcttgttctctggaaacttctgatcataaagcatctgatggtttttatctagtcatttgactttaggtttagttgctacagtgcatacaaatagataccacttgccagtagtatttgatatttggatggtacaatcattcttacgaatacatgcctgtgtgcaatgattaaatagtgccttaagccttcgtgtgatgctttcctaggctcaaagctgcatcctttatctgcctgagggattcggaaaaatcatccaaaagctcatgacaatctggaaattgtgcctcgtccacggcaagatttaccatcatggtgttaacgtaactttgaaaattcacggttaaggcctgcacaagcaaaccaaacatttagatgtaaactacgtcttgctaatcgcatctgtaccgagattccatgacaaagtgaaaaaaatactttcaccatctacaacgctgaaggattattcatcactatgcacttgttatccttgttataaaagtgtcatacaagggcttaattacttcttttttcaacggatcaaagcaattagtttcagtcagattaccttattttcgcgatgacttaatgatatatggtagacagctaccaggctatatttcatgggaattttttgggtttttttttttcatactgtttttgccactaagccaaggatcatcgcatgttctgacgttcgtcattcatttgttttttagccctagcgacaaaagtgagatgctcatagcaaaaacaaggtatcatcattgcttagtggcaaaaaaaacccttccctgtcatagatttgaggatctgacatactaacaagttaatgcaattatttaattctatggcaaatatgcatttcagggaacttacttctggaggtccatagccgctaggggcaatgaagacaactggatgcccacaaaactccacctgttcaactgggccgatcatgttggagaatgatatggtagtatgagagatcatacgatggaagatagcagctgctgcctgtttgattcacaagttgcaatgatattgggaacaaagaaatccacaggggatgttttttggcgcatggctcaaaatttggcgctgtaatgctctttctaggaaacaaggaagttaaccactgccaacaactgggactgtacacaatttctagtgaatatcacaatcttgtacacctacgattgtattttcttgataactaaattagcatggttagacagcaaatactaaatcaggtattcagttatacttggagtatcctgaaatctattgttttgtgaactaaaccagtgcttgtcaatagaaacaaagtgattatcgcattgcctgccaagataataatataaggatcaagttgctgatgaggcgatagtacaataaaggacaaatttaccttgagcccaaaaagtttgaggatcacttctgcagctaaatgagtgaataccacttctaatgagctcttcttcctatcaacaaccttctttgctttccgaacgtagtctagtggatctttgtgcacgcctatgaagaacgggaggattatgaaaccaagtgcatttccccatttcacttcatcctctctgccagaattgatcatatctacgtatgcctggccattgaaatgggaaagaaatcacaatagattttaccagtccaaaattgctaccactacaagtatagcaacaacaatgttcggtcctgtgagcttaaattgccaatcttgaatccaagtataattattacatgcaggcttgtggttggcctcaaattgacaaggaggatcgatctcaaacgtatatcctcgtcagtgtccatgtcacctgcaaaggagaacaagcagcgtgggagtaaagaactactgtatcagccaggccgcaatttaagagctactgtatcagccaggcagcagctgctggagcatgattttattggacgcaattggtcacctgacttccggtagtaatagcgcgacagtgcagagtacgtgatcccaaccagcacatcattgaccgtctgcgagagtgcaggcaaacataaagagaggaaataaatctccccagaacttttgctgagggttctgtcctttgctacattcaatttgcaagcaggtgaagtatagaaatggagggaaaatgatagacagaaaaaaattcgtgtttaatgattatgtatactaatattttatccattttaaaataaaaaatctgataatcgatatggcataatctaggaatacgaatctaaaaaaatctattatagagacggagagagtaggtcctatgtggaagatattattacttctacagaccgacagtttataagacagcaacactagaccaaactaacgaaaaaccattagtcttaaaaattttatactctcttttttcttttttcacttgttagcaggatactttgactacatgacttctaaaagagtatatgtaaaaaaatttgtattatcaaagcattttgcatgctaaatataactatactatttaagttcataaaaacatcgtaattttatttaaaaagatactggtcaaagataatatcatactagtcaatatagtggagtacttctaatcttagatcaaggctagaaagtgacaaaaaacgaaattccgtaaatcaattctaaaattttaattttaaagttttctgcaatttatatgccgctatatactcaaacaaacaggctctctaagaactaaagaaaacatcgcttacgcagttcatggcgttcttgacgagcttgacgtcatcaaggctaagcccccggtgcacgatgcgcttccgctggaactccccgtgcttcacccgcttgaacagcgtgtgcggatccttgaggaacatggtcgtggcgaagaagctcgcgacgtccaccacggtgtgccacgccagcgcgacgaacgaccagagccacgcggcgaacgccagcgcgcccgccgacgccggcggcctgggccgcgcgtagatcgcgccggcgcgcgtcggcagcggcggcatggcgggcagcctcgccgggtcggcggcgctgcgcgtgcacgccatgaggagcgtgagcagcgacatgccgtccccgagggagtggtgcacgcggatcgccgtggtggccgccgcctccgacgtcgggaagtccagcacgtggaactcccacagcggccgcgactcgtccatgggcttggtggacagcgacgccacgtagtcctccaccgccttgtccgggtcggccgccaccgcgtccatgtccaactccgggtagatgatgtggtcgtccaggttcaccgtcgtccgcacccaccgcgggttgccgccgtcctcatccgtcacctgcacacgcacacacacgtacgtaccgttcgtcagatcagcccaagcaccagtggcgagctcctgggcgcgccgcccgcggtacggcaggtgtacggaccgacctggatgctgcggaagcgtgggtagcgcgcgagctgggcggcgatgccggcgcgggcgacggggtcgttcaccggcgtggcgatgccgatcaccacgacgatgaagaagtcctccacgagccgcgcggaggggctgacgggctccggcggcgtcgccgccgcagcccccttgctgccgccgccgccgccgtcgccgacccggaacccattgccgccgttgctgctcgtcgtgcggacggtgagttgccgcttccgaagggcggtggctgcgcctgcacccgcgtccatctcgtgtgggccgcggcttaactgcgtcgcgctagctagagaaagtgtagtgtagtgagctggttttgcatgggcaatgcgcgcgtccaccgcctagctagaccgagaaacctgttccgatatataggccagaaatgagacgagcgttgtgttggtggtagtgcagggtattcatgtggggactgggcgcgcgtcatccgtccgtgaccagggccgacgattcaaccaggggaaaaaaaaacagggctcccgtgaggaagcggcatcttgtctccgccggaaatagagctctttgttgttgtagagtagagatatacaatatacattgcgtgatccagtctgtgtttagttcacaccaaaattgaaagtttggttgaaattagaacgatgtgacagaaaagttgaaagtttgtgtgtgtaggaaagttttgatgtgattgaaaagttggaaggttgaaaaaaatatttgtaactaaacaccggcccaattgatttcttttatgcatcaaattgtgaatatgtaatatttagttgttcgaattatatgctctataatgatagactatgggcatattccgattactgctaaaatataaatattttttagaatttgccgatgttaaaattagcaagttgactatattgctaaagtttaataggataagctaaatatattgttatcaaaattctttaggcgttattaatgtttggtaacaaacttcatcatccacgtgtttgtgttttttttaaatgatatggttcaatgtcacaaatctgaataggctctagaacttcattgaaataaggatggaaatatttttctcggcgagaaataaattttattatcttattaaagcaaaaccgtagtttcatcaccgatcgaaccgatggactggtgacagagggttgactaggagaactgtgtcatgagtcgtgaccgtacagccgccaactgccaacggaatgtgttaatgctactagctttcacgacaaatcgacgtgattaattatgcacgatgagctcgccggatgcgagcttgcgggtcggattcctaaatgtgatagcgatcttacattcaggcgatggtgtccaatggcagttggtcaaaacttgcctagatggttcgagatttcttattaatgacgtgatatatactcctcaggtttcattttaattgaagttttagacaataacacggtttacaaaatatatttttgaccttattttcctattataatatacacaataaataaatacatgtttacttttattatattgctttgaaagacaatctatacgttgttctagtttctttaaactaaatatttttaaagttattgatggtcaaatttataaaagtttgatcttccaaaacatcttattatagaaccagagggagtatagaaatgacttgaatgatgtaccactgtgccgtgtgccaggtgtactcgtatttgtgaacgtactaatgttaattaacgcgtacatcgtccatatatgctcaagtctctcagactgatctatactgctaccaatcacctacatgatttaatatgtacacagttcatgccatggcaaacggagattttattatggccctctttatttaggcttaggtttattggcctagacttttaagttaacttattggcttatatgatttataagacaatggatttaatgtcctaagtttagtggttgagtcatacatctacctcacataagccaaaaaagcttctccaacctagcttttggcttaatagtgttaaagtggcttgtggcttcaaacaagccaaacggaaaagctgcttgtttgtttaggtttagacttttcgacttataaattggcttataaatctaaactaaagggcttatgtagctccgcaggcgtgaggcttcttgtgtttccttaattaattgctagtgcatctttggagtgcaaatatctgccagcttcattgtgggacacgaaaaatccatgaacggcccaacgatatataattaattcgcaggcaaacacccgtgtgcctgcggtgtgattgtgttcctttcaactagaatcaacgacaattcgtgttactacgcgcaaacgaaatacggagttactaggtactccatctggttataaatattgaatattttaattttaaattctagccatctacaatttctcaattacagcttttaaaaatagggtataagaaaatcgacaaattttgctacaagacatcagaaatatgtataatttactgatagatattgtaaaaacgtgtcatggctaaaagacatcctagaaaattagtgatttgctgaaaatgacacttctgactcgattggagagagaagttcttcaaatagacaataatatatccccctagggtcacttgcttcaaacatggtgttggagtaaaaatttagaatttatggaactctaaatctgccactaccataaatacatcactagagcatatatcatatttcatcttcaattctttctcgggtaagatatctaccaacaaattacacaatttgaagtgtcctatagcaaaatttgtcataaaaaattgtcttgaaaaatactattctaatagcataaacctattattagtttttataaatttattctagtttaaaatttatgattagaatttttaaaaacttaatcaaatattgttctgaatattaaatatttgtgactagctagagtgagtacaaggagtacagtacaagagcaaatgtgttttacagagcatactatatgcttggcctccatgcatgcttatgtctcaacgtcctagaaggaggcctcgggatttgttggaaatttgtctcccgaaatctggagctctccaaaaccacttgagtttttttaattgaatttcaaatgaaatttatcaaaatttatgaaattcgtcatatcactggcctagcactagcatcttgacccttcaatgaaagtgtgaaccttaagagacttactccctccgtctcaaaaatactcaacctaggagaagatgcgaccctcatagtacaacgaatctagacaacttctctgtcacatcatctcctaggttaagttttttttgacagagggagtataaaataagcccaaaaaaagagtcaggggttaagaactctagtgaaaaagtttgtggaataaatagactttatttcctaaattttattaaaaatactatcctaaagtactactccctccggtttcaaaactgttagacattttgagatttacttggtcaccaaagacttattagcccttgcatgtatacatacattcccagggatggcaatgcttcgatccccacatgcacaaaattcaatggtggactcaatccactagactacattagagcaaggctaataggaacaagtttaagtttaatagtatagccaactactagctccaattcatttatagtcaatctaatagctcattcgagttcgtgctacagctgactataaatctgtagtccgctgctcttctctctccttatttatctccttaaaatatgtttatagctggcttatagcctgctattgtacctgctctaatacagccgaccttttggctataaggttttttgtggtcttctctcacccacccatataatagttagctctttacaattaatatagggctcacttgattctctcatagagtttcttggttcttatgtccaagtcggttgtaagtttacagcccacttcttctctcctcaacatcagcatttagtcggcttatagcctactattatacttgctcttagaatttcaagtataatatgcaaactaccgtatttaatatgggcataatagagaataggcacccaaataaatccctccttgtatatgagatcatgtctaaaacgttaagattatttttgaaactggagggagtacttctcactccaactactgtcaatttaaatttctccccatcttacttctcaaccaccctctctcttccaaagactgctttgtttaacgaggacgtatagatcatttaccttccttcccaatttgtcttataaatgctagaattgtttaacgagtctgtttctttgggttcataactgcaaagtaatgtagattacatacaagcttctccatacaaacttatgcgcatttcactgtgatgttctctacttttcaaataatacaacgaagatagtgatgatgaggatgctgacaaagttgttgcgcagcctgagtcactagaggtataatactgtactgtttacttgatggaaatgcatgcaatctgcggttctcaaattagccttgcaaatttcttcttattactggcagtgacaacagatctttcagttcatatacacatgcttattggaggctgaatgcctctcttgcagtacacatggaaatagttgatttattgatgagacagggaacttagccccgcaaacccaatctgaaattttcgctccataggagatttgaactcaagggtatttttttacccggcctctacatccaatggatatatacggccattgaaatagggaacttagccccgcaaacaacctaatctgaaattcgctccataggagatttgaactcaggactttggggtactactcaggtcactgtaaccactaggctatatgccctttcgtagttatcgatacttgtcctacttgaaagcttgtcattcctttgtattatactgctttaccaataggatgatgaagatgatggggatgatgctgaggatgctgaagggaaggtcagtcgtaattggagtgttctaaagactgccggacattctgaaaagccaaaggtaccttttcattattatcagttgtgttctaatggaaaaaagtgcagccttttggcactaacaaatgctgagcgtgtagcattcttgccagtcctattcatgagtcttgcctaatcatgtgcatatggtttagaaaattcatggaagtgtctaatgcatgcatagagtttgtaactgtatcaactcccactccaagcacgtaacgtaccctgtcgtaatggatacattcgtcagtgatcacaactcagtaactcacggaaaactcgaagaaagatcaactgtcactaaaagaagctattgcagattctgagaacttgactgattttcttatggactttgaagaagatgagtaatatctgggcatttactttactatgctacacgtacgttacacatggtaagcaaagtaaagcatagcagaccaccatttattcttattttttcagagaatatttaaccaaaagccagagcttgttctctggaaacttctgatcataaaacatctgatggtttcatttgactttagatttagttgctacagtgcatacaaatagataccacttaccagtagtattagatatttggatggtactccctccgtactcgtaaaggaagtcgtttaggacagcgacacggtctataaagcacaactttaacttcttgtttctataaaaatatttattgaaaagtgatatatgtatgcttttatgaaagtatttttcaagataattttattcaaactcaacaatttgagagttatttatatcacttttcaaactcaacaatttgagagttatttatgatttatattttcaaggtttgacttaaatattatcctaaacgacttcctttacgagtacggagggggtacaatcattcttacgaatacatgcatgtgtgcaatgattaagtagtgccttaagccttggtgtgatgctttcctaggctcaaagctgcatcctttatctgcctgagggattcggaaaaatcatccaaaagctcatgacaatctggaaattgtgcctcgtccacggcaagatttaccatcatggtgttaacgtaactttgaaaattcacggttaaggcctacacaagcaaaccaaacagttagatgtaaattaggtcttgctcatcacatctgtacccagattccatgacaaagtgaaaaaaatactttcaccatctacaacgctgaaggattattcatcactatgcacttgttatccttgttataaaagtgtcatacaagggcttaattacttcttttttcaacggatcaaagcaattagtttcagtcagattaccttattttcgcgatgacttaatgatatatggtagacagctaccaggctatatttcatgggaattttttgggtttttttttttcatactgtttttgccactaagccaaggatcatcgcatgttctgacgttcgtcattcatttgttttttagccctagtcacaacagtgagatgctcatagcaaaaacaaggtatcatcattccttagtggcaaaaaaacccttccctgtcgggctgcagga

SEQ ID NO: 80546 - DNA, 697 bp, Oryza sativa
  unsure (1)..(697): unsure at all n locations
aaaaccagtagcaaatttgcaaatgccctctgagacaaaagatactcaacatattccagggaatatacgctgaagctcgaaatcccgttaaggttttgaaccaaacactccatcctacagaaacgaaatttgcatgctcatgcggagcaaacaaataatgcatgattttttgcgtaagcctccaaaactcgtactgcagttctccaaataaatgggcaactcactgatcactactgacgatataaaagagcccgaaaatctgcgaatcggagaagagatcccgcacggacacggtgggccggagcaaaacacagaccgttggatacgaaatggacggcccgaacgagacccaggatgtaatacgcagcgcaaaaccctnnnnnaggngccaacgagcaaaaccccccaaatgggggagaaccgatttcagttcaaccaatgtttttgcccgcgcccggcgcggaggagagggttcctcggaagtgggctcgacgaacccattggtcaaaacccggggggggaaaagaagaagggacgtgtcgcgcgccctcccgttcgcctcgcgctcgccgcagctcggcgcggcgctgatacgctcggcgccgatgcgctgcccgcccctccccgacggggagcccaccgcctcgctgctctcctggcgcgggttcacgccctcctcagagccctcgcgctcggg

SEQ ID NO: 80547 - DNA, 698 bp, Oryza sativa
  unsure (1)..(698): unsure at all n locations
ataacttaagcaccttacatcggagataatttgtgctactcctattttaaacgtatcctcagctcggcgctggccgaccagcggtccagcagtactatactattgcaaattgtaatgccgaacttatcaggcgagctactagttcaaagcttcccgtctagaacatacgtttacgtagggcagcaacttgcgaagtccatcctcgcgcgttttggctctcctcaagggcgtttcagtggggagtacggctgacccgattgttgagacgagtggcggtttcaactctcaactgacggaaggggagacgcacgcatcgtcatctgaccggccgctcacccgatgagnnnnaaagaccagggggagggggggggagagggaggagtggggggagaagatcagtgtccncccctnnnncnnnnctgnnnccgcccccnnnnaagggaggaggggaggaggaggttgccgtgcccagcccttctttttaggatggatttggtagaatggcagccacgtatatggggagagaaggagagaaagaacccccgcctgtcagatgcatggagcggatagagtcgatttctcttgtacgagtagatcacggaaggaatgatgatatttttcgtacataggcctagagaatttttagggcgtttcgtactggatgggtcaatgtatggagcactgtgttttaataagac

SEQ ID NO: 80548 - DNA, 545 bp, Oryza sativa
cagatgttgaaacgggagatagattgtttgttgtcccacgatgagaagaagaaacctgcatcccgatacatttagcggtcactgattctctctagcacttaccgttttcctgttaaatttattcagataacgcagctgaagtcctgtaaatcctttaaccaacatttttcgtgacggtgcgggatgctatgttgaatgcacggacgccacattttcttttgcctattgcattatattattttgactttttaagctgttttctttgcttgtctgatctgtctagaagtgttgggttgatgagttatcgctaactcaatacacatagtgcttatatcatcttttcagattgataatgttaatacgatattttgagtttttttgggtaaggttcacctgaatgtttaaaacaactattttaatgtaactattatactgcaatttgattccaaagggaaagggtgatgtatgacagtataagttaagctgcaaagtttacttctcggagatttcttttcgcaatatgatcttgctagtttggtttttca

SEQ ID NO: 80549 - DNA, 1133 bp, Oryza sativa
  unsure (1)..(1133): unsure at all n locations
ccgcgcgagtaaagcactactatatgncgaattcgagctcggtacccaatagagcagagggaaagctcatgctttttggcgccaagaaatggatcaactgacagaagcagagcagagcagagcaaaatactacagcaaagcaagcttctgttatactaagaagctattcaaatacctgaacaatagtatatgtcttataaaatatttaagtatttatttgacaaaaatagcattgctgcactactactatgtcccagatagagtatttttcatccaaaaactagcagcgaaatgaagctactgctgaaatccttcataatacaactcacatccatctgataaaagattttgttgttctggttctgctgttcctgggtgaatagacatttggtgtcgatccatattcttggcgccaaaaagcaggagctttccctctgctctgcttttgttcccgcgcgctttgccgctgagattctatttgctgattttttgggaagagaaataagtgattctgttgattagtaatccctaattaatcacaaatggtgggatcactatatgcagctgttgacagaaggatgtgtggcagggatgaaggcaacggcaatgtttgccgtcagccaaaacggcagacgatgtgaacccatccaaagtatgtctggtacgctatggaatttgccacagggagcatgggctctaggccgaataccaacaacttcaggtcttggaaatttcatttgagatacccggcagcatcgaaagcctattgtagggctagatgatccaccataatcccatccggcaaggatcttgccaaaagcaggcgtaaaacctgcagactccataagcacatcggagaaagtctccatcaaactccatcgccaaggagggaggaaggaagctgtcacccagtcgcctgggcccaaattcggccccccaaaccaccccttataaccccccccccaaaaaaaaaaaaaacccccccccccccctttacatgatcatgaaatagtagatagatagaagggtgcgatctgtatacaagtacgaaagaactcagttaaaggtcanctccgagtaaaattttgaaagttatgtgtgccaaaggttccatttggttagcttgctatatg

SEQ ID NO: 80550 - DNA, 1247 bp, Oryza sativa
agattaggcctttttacgttcacaacctaaaacttgtccataatgatggtcctttgctgtcgatttgcaatgtactcagctttctaattgcactctcaaaatggacttgccaccctttttccctcccttatttcgtctaacattctctcaggtgtagctatcctgacaacttttggttagtactagcagttgccatgtcaatgatttatgtacaatgatatcatagtggtatggttattgaaaaacgtgtcaataaattggttggacaaaacgacggaagatttaaacttaccgtgagtactataccctaaactctaaaacctaaacccccttcgtactataatatagatttcgatattttgcttgcactgtttgacaactcgtcttattaaaaaaatttgtgcaaatataaaaaacgaaaagttgtgcttaaaatactttggataataaagtaagtaaaaaaaataattccataattttttgaataagatgaatggtcaaacagtgtaagcaaaatgtcaaaatcccttatactagaggacggagggagtatttctttaaaatagtatagtagtccagctgtacacacatacatactagactttgtcttgatatgtcgtttctcggtgtttatctagtctaacatcattgagaaaaaaaatagaataatgatgaaattttctccagtattaataattcttaacctctccacttatcaaccacaaaagggatcatgtttctttattttatcaaccgtgaaatcttcattctttgccacttcggtatgcaaaaacatgagttggttgttgagctccggttgagaagaatcagcatgacatcatgattcgtccctttgcaaatatcccatcctctccctccgtccctctttctctctctcattttaagggtatgtttggataatgaaaaatgagaggtaggattaggattggaaaataaatgaagcgttcattggtggagaaaccatctttggtcggttgaccaaaatccacaatagtcccggttgcaataaaaacagggactaaaaatcaaccgggactaaaaacacaacaaccgggactaaaaatcatctttactcccggttcatcacgtgtcagttggtgacaccaaccgggactaaagatcatctttatagtcccggttgataatactaaccgggactaaaaattatattgatctttagtcccggttaatattaccaaccgagactaaaatttaatacgtagtat

SEQ ID NO: 80551 - DNA, 50146 bp, Oryza sativa
ggtttaggcagctccacaactccactccagactcaactcctggagcaatatttaggagttagagctgtaccaaacaggcccttagtttacagttgtgccacttatatgtgggctccactttgttatgatccacatctcagtagtacaactacaaactgtacaaagttagaggagtcttttctctagtttgtgtatttgcggttcctcttacaagaaaaacacagccacagagaccatgtggtacattttccattcacaaaaaagaaagagaataaaccataaaaaaagaacgggctttttattacctgaaacaaatatgtgaaagatttccaatcatgtaatctctccgtctcaaaatataacaacttttagctcttatgatttgatgtgaccatggctactacggatacatccgttgctcacctcatggatggacaacaagatatcaagttcgagtcctccaagtctcaaaatccaattcggccacctactaccctgctgacttcaaacggccgccgaagctccatacgacctccgttttcggcccgtgagtacttgatggaaagctctcggagtcctctttccaatgcatcaagcctcattgccaaattccatctcagtcggcagcaactgaagaaacaaggtgctgcgacacctgtaatgggactatgggcttgtaacttcatttgggaccccggcccaggtggggcccatgtggggtgcgccccaagctagtggagcacgaccctaggcactcctaggtcatcctcccacccctatatatagctagttaccccttcagggtttctggggttttgttagaataaagtttagccattgctacttgcttgcagcgcgcgtgtcggctagaccgtccgtctgcttgttcttcggaaccccaacttatcatttgtattgaattcctatttgcaatatcagattgcttttatcttgttcttgcttgtttcttcgatttgcttgcaggaatagggttgatctgcaccggcaagatcaacaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaggtggtatcagagctttcgttgctcggtgaatttttatcttcctaaccagaaaatagccatacaaaaaaatcgtatcatttacctagccatattgtgccattgcattgttcttttcagtttttgctttgttgaattttgtgttgcattgtcacatcgtgttgctggtcttagcgtctagtttgtttagagtttcaagttctggtcacgttttgtaccacaatcgtcgctgccaccgtgtctctgttgttgtcgggacctacgaaaacggaatcggcccgctgccacggttttgtttttgtagttttcagaattttttatcggtcagttttggagttgcctttaggatttgcttgagtttctggtttgcccgtgaatagatcggcctgcgcttgttgccggtgtagagaggaggaagaagaatttccaaatctgtttttggaagtatgagagtttaatctggaaagaaatagtagatcagattgattgaaatcagtttccctttttctctcaccataaccggactcctaggtagtgccgcatccttcctttcctcacccaccaccaccccgggtccgcgaccaggccgagtccgagtgtctcctctcggtcacggtttcaatctataccgtgatcttgcatactgcttggtgaaaatttttcgagtatcggattgaaaatccttttgcaaaaacggaacctacaggacgagaggattccattattgtatagttctaattttgggttttaacttttacatttgagtccctataaattttgtatttatgtttgagtccctgtaatcttacattgaggtccttgaatctgtttttgtaaaataaaatcaaaaaaaaagaaagaaaaaaaaaaggcagaaaggtgcataaaaaaagaagaaaagaaaagccgcacccaaaaaaaaaagaaaaggaaacaaaaaaaaagaaagaagaaagaaagaaaagagaaaatattgttatgtttgagctgaacttcatatatcagagttgtgcatgagttgttcctagtgctatcttgtggtatcatttgtgtctaggctcgcgtctctagtacgttctagcctaggaccagcacggtgcttgactttgaacaattattcaattttgcattctctgatttgagcatttgctattcctttgctacatatttaagcctacccagagctccacagatttgattgcagccgtacaacaagtgttcgccaaggcatcgatacatccaacctccattggggtgcttggttgagtcggtgtatgtcaccattccgcttgcattggtaagatcttgtaagagcttggttaaaagcttgagtgtgtgtgatttttgagctgccactacctagtagttaataggaacgcgcatatttttgtgtatgtttcttgttttctactaacaatggcagggatacgcaagataattggggatagctgtgctcaccatcgacatcttcgtcgagacatgaggagtgatcaacatgacctttatgaggtaagtgacgatgttctaggtaagatcaaatctgcactgccttatttcgagggaaactataatcctcatgcttacattaattgggagctagcggttgatagtgaatttcaaaagcatgtcttgtctgagaaacaaaaggttatgtgtgcctctagtgttttagttaaacatgcttctaatgattggaaacatctttgtaggcataacaaaataccacaatcttggaaagacctgaaatgatattttagagatgtttatgttcccatgtattatgctgatattctgctcaacaaactgcaatgtttaaaacaagataccaaaagtgttacttcatattatcatgatatgcatgcttgtttattacgttgtggcttagatgaatgtgaagaagctacagaattgaggtttttatgtggacttaacaaagaaattcaggacatgcttgcttgtgaaaagtatagatctctttctcatttgttacaatttgcttgcaatgctgaaagtaaaatagaggaggatatgaaaaagaaacacgctatgtctttgcctccaattactaactatttgtaggaagtgcgtaatcacgaaaaggaggagagagacatgaaagagccaccaattccattgttcacactcaagtttgagacacctccatcatctaaagaggacatccaaggtaaagtaaatggtactgaaattaatcaaggtgagtgcattattaacgaagtaaatttgttcacttttcatgcaaaagtagagcaaccgttagtggaaccaaatgctggaattcctttgtcacaagttgatttactcgctgttccttgtgataaagaagagttgtgtgataatgcttcacttatatccatgccacaactagtgaatgagcatgctattcctagtgtttctttgtgtgctgattttaagcatgctgttcacattgctaatgaagttgaggaacgtaaattgctatcttctttaaatactttgggctatgttcagtttgatgatttttgtgagctcgataatttgaaggagaaattatttgctaagtctgatttgccacgtccaactaatgctatttttcatatctttggcaaatataatgatagaggaatatatttggtgcatagagttttcatttgttcggatttagagaaacatgttattgctaatcacactacttcgagtttctctagttttgattggatgaaacaggttattttgaatggactatgtgaagaacaccatatggaaaaaccgaggacggttttccgtgaagaaggggaggatgatgtgaccatgactactacggatacatccgttgctcacctcatggatggacaacaagatatcaagttcgagtcctccaagtgccaaaatccaattcggccacctgctacactgctaacttcaaacggccgccgaaactccatacgacctccgttttcggcccgtgagtacttgatggaaagctctcggagtcctctttccaatgcatcaagcctcattgccaaattccatctcagtcggcagcaactgaagaaacaaggtgctgcgacacctgtaatgggactatgggcttgtaacttcatttgggaccccggcccaggtggggcccatgtggggtgcaccccaagctagtggagcacgaccctaggcactcctaggtcgtcctcccacccctatatatagctagttaccccttcagggtttctagggttttgttagattaaagtttagccattgctacttgcttgcagcgcgcgtgtcggctagaccgtccgtctgcttgttcttcggaaccccaacttatcatttgtattgaattcctatttgcaatatcagattacttttatcttgttcttgcttgtttcttcgatttgcttgcaggaatagggttgatctgcaccggcaagatcaacaacccacggagaggtgtatcgatcgctaaggcgcaacacaacgtctcgtacggttgtagtcggatcgtcaacgtttctcccaaatcgtagttatcacaactcaccgaaagatcgggccaacaacagtcttgagtgtcgagaggaactcagggttcatcatgatttgtcctaaaatataacaacttctctaccaacattctctttccaaccaatcacaacccttaaccgttcacttttcacacatatcttcactactcatccaatcataactttccaccattcacctctacctactttcttaataaccgtacccaactctataacttcttatattctggaacggagggagtataagaagaatgtaagatgttactctctcgattctaaaatatagtaacgtagaacaatggttttattcataatactattatatatctaatctaatcttaaattactatatatttgggactgagggggtattacatttttatggctcttatatcacctagtaaaactaaaatgagcggataacaataaggtaagtatagtttaactgattaggttttttttttttaaatctgtttaccctagttcaagttttaaacttgatatgagtgttcatatatatttatgtctaattaaattatcctgtttcggaggtgattaactagaacccgtgtagagcacattatttttcctataaaaagggaacagaatagtatcaggtacatttttgctagagcgatgttcaaaatttccaacgtttatgttgaaagtgcacgttcgtcgaaagtgcgaaattgtcatttgcaaaccgcaaaattcttcgacacggtgcaaagaagtccatatggcttacataagattatgtgacgacgccgttttgcaagtatagatcatatcgcacgcttgcttaagtcaatgtacatccttccattttgatgaagagagacgatgcattaacagttccaaatatagttcagttagttatcccctcagctgagaagcaaaggtcaactctttcctaattaaaagatcttctctcgatcggttctcgccattcatcccagatcggagattccgtggctatcatcccactgtaccactggctgcttattaatcggcaagagaggctcgcagcggctcaatgcacctggtccacccagcctagccacaaccggtccaatccaaactctctaaacacaggagtagcggcgtgtacatgcgccaactgcccacgcggccgctgtcaagttgttggccgccaactcttcgcctcgctcccgtgtgtagtacggtaaacggtgtactaccacttgccctgacgtacgtactacacgcgccccggtgagccggtccaatatatacacgtcgtactcccgagaggccgagacgcgccggcagagagcaagcagatcaattgccaaatatctcgctatcagctatggacatgggagggcacgacatgggcggcatgtccccgccggcggccggggcggcggcgcagggcggcatgggcgccatgaagtcgatgaggtacacgcacatgaccttcttctggggcaagaactcggaggtgctcttcaccatgtggcccggcacgagggggggcatgtacgcgctggcgctcatcttcgtcttcgcgctggccgtcatcgtcgagttcctcggcagccgcagggcggacgcctgcctcgccgcactggcgcggcgcgccccggcggcgggcgggctcgcgcgcgcggccgtgcacacggtgcgcgtcggcgtggcgtacctgctcatgctcgcgctcatgtcgttcaacggcggggtgttcctcgtggccgttgccggccacgccgcggggttcctggcgttccgcgccggcctgtgcggcggccccgcgcaggtggaggaggaccgcaagaacgacccggcctgctgctagtagccgcctcgtcgacgttggtgtgtactgtgagcgatcgattcggttcggtggacgttggtttgatgcttgcatgtgtttgtgtaattgtgtatattgttcgcggtcggttggatgagttgtttggctggttttctttcgtctgtatcattgtatggctcaaaaacgtgacatgaaaaaggctcctgatggtccatctctcaagttgaaatctgaaaagttccggtgccgtgaaactgtaatcgtgcaatccgctatctatcacttgtttcattgatgattcaccctggctgtaatttcaattctaataaattgattatggtgcgcttatgtaaatgtccttgtctttaaaaagaaatgtaaatgtccttcaaacaattcttgttttgttttgcatctgtatgtgctagttggcacaaaactgttctgcattggtttgtttctaccttcctcttttgtgttgctgacccaaaattgctcctctgcatgcaccggagttcatgttgctgaatttctcatgccactgtattgtccattttttgctggtaaaaagcactgaactactgactggattggcaattccatgaatgatgattagctctaccgaaacagtatgctaccctgaaagtactgtcttactgcctctataagtttgctttgctccatcgatttgacgctctatgggttatccttcacgttctcccatcttctttcctgctgcaccatgggccaccgccagtggtaaattctctgagacgcaaaacagagcgcatatgcagcaaacatttcaaaaggttaccggtagatagattggtactccatccaaaagacagcacccttagtgctttaagtctttttgtttgctccgctcgcgtcaccacttttagtagtacaagaacacactttacttcctatgtagtactaccatctcctttttctccttttgaagatcttcatgtttctatggctgctgttgaaaagcacaggtgttcttccacatgtggaagaacaaaaatctctcaaagttgagctgctaaaaaaaaattaaatcaaaatatatcaaaccggagtctgtacaatactattacatactcgagtccagttgattcttaagctgcgtcagagattggctgtcaacctgctgctgtttaatttgttacattatccaccgctatattttagagataatgcactgctaaacaacccaaataatggttttttatgcacccaactgaacaaaagttaatcaatttcaccacataattgtactactaaatcgggctgaacacttcgcggaggggcaattataattggtcagttgtgtgtggttcagacttaaaatctggccacttgtaaattctacaatttcgtcttgacagtggaagcctccgaaggaaacctttttccgcccatgccgtacgatggattttcctcgttgacattctgcgcccaacgcacagcatggcatgtcgttctccataaacgtacacacaaaaaaaagcaccaaattggcttcaagataaggtcgtggaagcgtgctacgggggatgatttgtctggtggaatctaaggcctccataaatgatctgttaccagaatacctgccgtacataggatgattagagcaggtacaatagtagcctataagtcagctataaacatattttaaagtgataaagaaaaagagagaagagcagcgggctacatatctgtagccagctgcagcacgggctccaagatgtaatgcgtgtataacaggtgggaccaagtattaatagtatagtaagcaactattgtatgaattagctattatattggctatagatgatttagagctattagtgggctgctatattgaccttgctcttattccttcattcaattgatccatccataagaccatgattattatccatctcaagagggaaaatggccagtaagctgtaagcccaatcaagtccaagcccgatcatctgttgggcctaatttgatctcacttttttttttcatctctaatggtcctgtgacaatagccagattctgcaactcatgaaaacctcgaattgcgaggtcctcgatttgcgcacctgttcagttatactaatccatacttataaaggaaatcatttaggacaatgtttaagtcaaaccttagaaatataaatcatgaataactctcaaattgttgagtttgaaaatataaaaattatatatatagatttatcttgaaaaatactttcataaaagtttacatatagcacttttcaataaatatttttatagaaataagaagtcaaagttgtattttgtagaccgtgtcactgtcctaaacgacttccattacgaacatagagagagtactacgtaccagtacgtacctgtactacacgctcgccgccgcatatatctatacttgcacggcgtgtggatgacggatcaaaccaaacacacccgtgcacgcggagatcaggagcatctgcaatggcggacatgggaaggcacggcatggccatggccatggcgcctgcggcggctggcggcgcgggcaggaggaagcggtacatgcacatgacgttttactggggcaagaactcggagatcctcttcaccgggtggccgggcgccagcggcggcatgtacgcgctggcgctcgccgccgtcttcgctctggccgtgctcctcgagttcctcggctccccccgcgtgcaggagtcctcctccctcggcagcaggcggcggcgcgcgacggcggcggcggtgcacgcggtgcgcgtcgggctggcgtacctgctcatgctcgcgctcatgtcgttcaacgtcggcgtgctcctcgcggccgtcgccgggcacgcggcggggttcttggcgttcagggcgggcctgtgcggcggcgggtacaagaagggagagctcgcgcctgcggcgtgctgctagatgtggttgccatggcgcaagacaaaagcgaatatatttgttttcgaaaatttagataaggattttgagtgcggatctgctcttgaatctacgctaaaatctatatttgttatcctcacaatggaaaagaaaattcaatgttagggtagggatgtactcgatcacgtcgatcgtgaactgatagcccccgttgttggattcggtgtttgcatgtgtaccttcgatcctatttgaagaatccataaccctaactgttaaacccccaagcagtgcttctttcatatttcccattatctgcagaattaaaccacagtggtagcccaagaggccgagaggcccgagaaggcaaataagtggaggcccgtaataagtcgaatttctgatatgttgtcccgacgaactcatgacgacatgaaagctaactactggagtaattagttgcattgctgcaaggtactttggttagccaggcccacaatctgagtcacatgtcaccttcttttagctctttattaatacttttcatgcatttgtgtttgtacttttctttataatgaaatatataccggtcttagtttcaaagaaactatagctaattgttaatttgttatagaatttgtaagacgaatgacttcgcttgataaaatcgtagcttaactaaaaaaattacttattagaataccaccttaaagacataggttatctctatttatagatggtaagatctgcataaccattgttttcccaaacggtttactcaaaccaggaacataatctatgaaatcaatgatcgattattgtgtcgactgaatacctctaagaaggtcacaacaactacgatattgctatcgccattctaagcatctaaaactatatttttttactcggacagttcaccccaaggcattaaggtaacggagaggatgttagcaacattgcccatagacattgtcaatgttggtgctcccaatattgacggccttggtcccatatctacgacgatctgaactcaacctcctcccctacgtttagtggcatcatcaactttcctaagcacaatgacggcgatgatggtcgaacctgaattggaggggctagtgatgacgtgcatgggcaaatgttgtccagatccatatggtgccagtggcaaaggagacctgcagtggtagagatgatcacctagatgatgttggaagcctgacaggcaactcaggcgcaaaggagtcgcaacctcccccatctcctccctgccttcaacgcgctagacaaaaaggggtcgtgttgccttcggatcatcgatggccttatatatgtacatgtatttgtatgaattagaacttaaattttttaaaaccggtttacaattatcattatgttgaatgttgatccctttgtattttatatgttttaaacttttcggttttctcataattttggttcgtcatgataggaacatggcttttatatttattttaagctggtaccaagcatatgcaaaaccgtttgggtcacctaataccaatctccaacggtttcgttgataaatgttcatttggtactgcccaaaaccggtataattcagataagattttactgaaaatttggattttggtttgatgacatttaaacttggtttgtttatcgagcggttcttgaatctcgatttaagtcgagtactcgcgataactgagtaattacagcctcaaggctcacaggctcacagtcctcaccgtactagcactagtagatataagtttctcatatatctattatctatctatctatctatctatttctatctatctatctattatatactaaaagtccattaaacttcctacaaatactctcaagctgccacgtggcactactataaacgatcctagaccgccatgtggcaatgtctaatctcgccgtcgattccattagattagattagatgtattttatttaaaaagaaactaataccttactgttggcagggaaaaaaacataaatactccataagtacgtacgtactatatagaaaacaataaaacttaacttctcttcatcggttcgcttggaaaagagcggcttacttacgaatctacgatttgtgagggaggaaaaaaaacgtaccagcgtatttacgataaaataaataaagccaaaaaccacgtgacactgctacaaacgttcctagaccgccatgtggcaatatctaatctcgccgtcgattttcacttaaattggtggacccgataatttagaccattagattagattagatgtattttatttaaaaagaaactaatagcttactgttggcagggaaaaaacataaatactccatgagtacgtacgtactatgtagaaaacaataaagcttaacttctcttcatcggttcgcttggaaaagagcggcttacttacgaatctacgattcgtgagggaggaaaaaaacgtaccagcgtatttacgataaaaaaaataaagccaaaaaatatacgtatatagtaccatcgaaaaaatcaaaaatagaattttctacatataaaaataaaatatattattccacaaatatgcatcaactagacccgtcataaaaaatataaaatatcaaatctaaccgtcgattttcacttaaattggtggctcctataccgtcacatgccactctaataaatttataattctaaaataaatttaacaatcagttttcttttaatctggtggacccattattttttaccatttaatttataataaaaatagccaagccaatttatctcaaaaggcccacataacccacataggtgcatgtaagtacgtacgtacttcatgcatggtcccacgtccatcttatctcttttcttttctttttcgctcacaacaataaaaaccaaattaattattccaactcatagatattaactccagcctatatatatgcaaaaatatatgtacgtaccagtaatatattatattttttatatattatagatattatttagtacgttgggccacacatccctttttttcttttttcttttagactcacatgacataaaacccaaattaatattagtaattatatataaaagtctaatagactttctacaaacgctcctaaactgtcatggggcatcttcaaatgctcctaagccatcacgtggcactctaataaattaaaaaaaaatataaatcctgagaaaagaacatctaacatccactttcacttaaattgataggctaattattttaaccatcagatttaatctcatataaacaaagagatggaaagaaagaccacgtaccttccccacctctctcctcagtcgttacgttcgccctctccccacgtatgcccctctctctctccctcccctctatgtataattcatttttcctgtattagctaacggggggaatttgattaaaaattttttaacattcgtaacacctaaatcatatacctaaaaaataaacatctaaccttaaattttttttattaaaattagtggacataacacttcaagccattagattagatttaatttttctcatccttaaaaaaaagacgtccatcctcccctccgttttcttttaggaaatcctctacgtttttttccttccattctctctctatgaaagattttgcaacaataaattttaaataagtatacttctaaatacatattatttgcaacagtaaattttaaataatactaactttttaactttaaaattatacgttcaatttttgatctatttgtaccattgtgttatttatgattaaaatcacaattagaatttaagacacatgttgactatattttaacttgtaaaattatattcatttaagttttgttgagaccctttacatgttattcaaacatatatgaacaattattaaaagaaagtgacattatatattatttcatcatatatcacttcactggcatgcataactaaaacagatttatgaacttcaaaaagttctaaaaattctgaattatgagaaaaacaaaatatagattataccataatttgatgcatcacaaaacatgcataactaaataagatttacttaaaaaataatcagtcagatcctagctgtttgtccacctatatacattccgagcttaagatagaaatgacctattatgtaccaaattctacttgataaggaaatagaaattatatggaagtaaacataaagctaaattttctttctgtataacatgataatataacggtaatgttcaacttcggaacaagcaagcaaaagctgcatgtgtatttgtcctgtgtatctatatattatatatgaaaaatccattaaacttcctagaaaactctcaagccaccacgtgagactcctaccaatgctcctaagctgccacgtggcactataataaattagataaaaccttacaaattttgagaaaaaagaaaaaaaaatccaaccctcgattttcatttaattcggcagacccactatttttaaatcattagattagatttatttaaaatgcatctcattctcacatgtacaatacgtactactatccaccggattgagaaaaaaaatctcccgagcatgtacatactacgcatcgtccacccgtccctaataaacttatcaataactaataaacttatcaataatgttggattatttcttgagaaacaaagtgcgctcacaacgcacgcacactcacccctacgaacgcacacatgcacactctaccccctatgagtacctctgagagattgtgccgacatattttgagatgacaaagtcaccatgattgtctcgctgtcgatgggtacgttgtctaccactgaaagaatttatcaagtctgggatttgaagacaagtgggcaatttccaccacaaggaacctaaccagttaagctatgttcaattcaaaataatgttggatattaaaacaaccatgatttttaagctacacttttagaatactcctatgccttttaaaccagtgaaactattatttttaatcattagatctatcttatataagaaaaacaagcgtgtattcatggtacatcacatttcaaaaatattattgtgcaattgtattcacgttagattgcgtagaacctcttacccactctacatgaaatgtttatagatggattgtctctcaaactatatcaattatattaggctatataaaatttagtggagctttatgtcccaccaaattcatcctctaataaaccaggataatatatgtgcaataaaaaaaataaaaacacacttcttttgctttacacttacttttactttcgttgaaatattttcaaaagaaaataagtctaccttcttttcaaatgatgaagaagattataaataactaatattacttaaatatgatataatataaaactaataggttaaaaattataaaagtaactaatgctaacaaaaacaatttacggagaaattggggtagatgttctccggttaatatatcgcttttagtgtctcaaacttagcgtaagacgcatgcccatgcatttgcgcgggctaccttcctagttatctataaaaaaaaaggtagagaagtttctagcaagaatcctaatgctaaatcaaaatgagagaagaaatgaaacaagcatgacactactagtttataattaggtatactgacgtagtgacagagtaattctgatcaatgcgcatgcagatcacatacacaataccagttgcttatgatctattatttatatataaaaaaaacatatcaacggtttacgtaatgcgaagtcgagaacacgtttcttctggaccacgacttggagccactttgttcctcaggtaaactcagtgtccacgtgaaagtattgacaagttgtcaagcaggaacaaaagctgcagcgtacatacgagaacaacgaaccatttccccacttttcactatctccaagcgcatcagtcccgccggcccttttcgataaagttcaagtcgttttccatcgcattttgcacccatgaatgcgttaacccaacgaaaatatggctcgtggccgtacgtgagcgcatgacctgcgtgcgcacgcatgtcactgcccgatcgatcagtcacacactcacacggtcacaccgcgcgcggccccgggccacccgcgttgccatcgaccccgccgacctgcctgcgtgcggtctacctcgagggcgcgacgccaccccacccatccgtccgtctcgcttgccacgacgcgacgcgacacaacgatctaccgatgctgccggttgcctctcgctcggacgcgcgggcggagcggcgcgttggccatatatacaccgcgattggccgggcgggggggtcaccaacccacccattctcctgtacacatgcggtgcgcggcagcgaccgattaagcaggaaaagcggggtaccgcacgcgcgagcggcgcgacacaataattgagccgtgccgtggcgcgcgctggcgctggcgccgctgtgtctgtcgctggtgtgatgtgagcggtgggtgctcgtggcctcgtggggtttatccgggtccgcgcgctacaaaagctgtagcggagattgtgatgtagtacgatctacttcagtactatcacaaaaacattatcgccatgtgttagctcaaaaaagggagatcagaccgtatcatcttgtcgagagcatatgtggaaagacagagtgtacatgcatagaagatgcgaaattcgtgttttttaaacgtgggtagacgatcgatttggtcagtgcagggatttcaggcgaataatggagtgtccaagctggtcgtgcatcgtatcgactgacgtgaaaaaaaaggggtgcagaaaaaagaaattcgcgtgcacatttgcatgtgtgtataaactaatgaaagtgtgttccatatggttagtatatttgctgtattttagtgtattataggttcatcaatctgctataatggtcgttttttatgccaagattctccgcaatgcgctcccatgcatgcctgatttcagcgctacagtcgacaatgctctctgccattgtttttctttttgttgggatatggtcattgctattaaggagtaataacgtatttgttcgtcgcaacgtggctcacgaaattgagacatcatacgtgcagtctgcatcgtgcatttttcctaccgtgggatccatttggacctgctcgagcaatctctgccacgaaaaatattctctgtcggaaaaaatccatgtcatcctaaactttgaagagaagtttgtttagtatcttaaactgtaaaactaggtatatatgaccctttaaaccttacaatattaataatattgttcatatagccagacggtattattttgttttctaagtgtcatagatgttgtaaaatttttactatatgacttgcacattggacatatatgttaacaatttaaagggttatgtagatggtgtattgcataatatgtagggttgtctagtttgaaggtttggggtgatggatagactttcattcgagaaaagcacagggcacgtgcggaacttttccttcttcattccacaacttgcaggctgcagctcgcaaagggtgactggcttcagttcactgccacacaatgttttctaccatgttgacttcaacggaagccttatattcttgtgctctcagcaaagctgttgaggtggatcaccaaagtggccggtgaacacaaagtccaagctagtattgaaaatgaactgtgcccagattccagaatagaaaaacgaagcagggatgcataatctgatgaacaagaaagctcgaagaatccatcaaaccctcaatgaacatcccggtcgcgcaccatcgctccattttttgctttgcctctggggctgtggaatcacaggcataggtagttttcagaaatcaagacatctgtctccgtcgtctcctgcgccgatgtaacgatgatgcaaccctctgggtagaaacggctcaagcgatctgataggattgtcgctatagcttggaaatcccgccctttaaattccgataatatgtaatggcacgccgcttgctgtgcccgatcctctatgtatgaacctttaatttgctcactttcaatggaaaatttaggtggagaatctctctcctccggtgattactccaaaaaaaaaaaaaaggcttcaagaatccacacattcatctgccattctggcgattgctatgtatacaaactaaaaacttcgaaataagttgcataacacgtattgcacattgccgttttctccggagcaaaggcgtacacaccaacacgcacaaacaaaacaaaagaggaaaattgcgatcagcaagaacgcagcgctatacacaaaaagaccaagaagcgcacggttcgttccatcaccaaatcatggcgcggttggtttcctctccggcgttgccgtcggcctcgtcgccggcgatctgatcgagcacgaggacgatcgccatggcgaacgccgcgtcgaacccggcgcccacccgcaggacgaacacgtccctgcccatgaccacccgcgccccctcgtccaccttcctcctgatctctgccaccaccgccgcctccccgcctgactcggccttgggcgccaccacgcggcagcaccgccgcgggaaggagccatcgacgcggaggagctcggcggcagcagcgtgggtagacgagaaggaggcggggagcggggcgaggagctcgacgacagcgccggccgcggcgccgccgaggatggaggagcggcgagcagagaagagaggcttctggccgtcggcgcgggcgccgaggtagccctcccagcgttggtgcagggacgggcggcggcggcgcacggtgatgagcgcctctccggcggggccgaggagcgcgagctcgccggcggaggcggctccccctccgtggccgcggccgtaggtgtcggcgcggaaggcgaggccgccggtgcggtggtcgtaggccgcgaagccgtcgccgggggagaagtgggaggtcttgcgcaccgtgagcacccgctcctccgcggagcagtactcctcgcccacgatcgccattgccgctgcgctagctagctgcttgcttgcttgcttgcgttgctctggctcgctcgcgtcgcgtgcttgtctgcgcggcgaggtttgcaggcttaagtagagagatggagtgaggagctcctgtatcgcttgatactgtaaattcgtatggaagccacttacgaaagtagtgtttcacgtgaaaacgtgaaatatccaatatatatatattaattagccctgattactttcacttcgaatgctttccaacagaaaaaaaaaaccggtgttgtctcatgcccatgcatacgtgaatgacgtgtatgcataatgcaggctagtttctccgtgccagctgttggcttggcttgagctttgagcgacgactcgctcgcgcgcttgccaagatatccaactaggcgtggccgtagagtatgggacacagagcacggaacggaacagcggcgaggtacgaggtgcatgccgtgcgtagcgatgcggtacagtgtacgtatgtacgtgcgccctgcggagaccatacccttcctccaccgactcgatcccataccgtcgagtgctcgcgacgaggtcgatcggctgccgctgactttagttttagacgaacggcaaggtcgatcaatacgttaacgggtgcgcgggggtgcatgcatcagcatcattgtgcgcgcgagcttagagatagtatagccaactactggctctaaaccatctatagctaatctaatagcctatttatataatagttagatataaaaatatactataccattaatactcggttccacatctcatatacacataatgtcttgaagtccgtattgcagccggctataaatttgtagcccgctttcttctctttcttctctttttttctcgatatgtggttatagcttactattgtacctgcttttagagcaagtttaatagtatagcccaccgctagctctaattcatttatagcctatctaataggcaattcatacaatagttgcttactatactattaacatatgatcccacctgttatacacacattgtgtcttatagttcgtgttgcagctagctacagatctgtagcccgctgctattttctcttatcttttatcttattaaaatatgtttatagctggttaatagtcttttattgtacctgctatagctccacaccgagtcaactatcaacgacatggacgtgattttatagctagcctggcctggtagaggtaggctcgatcgggtcgcccgtagcgggagtgagtgtgagttgcattgggtatggagtacagtactgtacttgtgcagtgtgtggtggtgcgtatatttaggtgatctagtggatgaagaacgaccgaaattgacgtgagtttttggcttatgtgtatggagattgaacttttgcgcgtcgaaagatgttgataggtggaatcgatgataagacgatgatgcgtatgctttgaacaaactcgatcgttctccttcggtagtagtgtcgcgctcgaattttataagagttccctagccagtttcccatagtactcataattctactctcctacaaaaaggaggtactagaattcaaggcaaaaactgattacacttcatagtaataatccaatccaatccaatatcgatgaaagcataagcatactccgtatatgacacgtgatgaatctcccaacgaagacgtgtactccctccgttttataatgtaagtcattctagcatttctcacattcatattgatgttaatgagaaatactagaatgacttagattgtgaaacggaggaaatgaatctagctagatatctcgctagattcattaacatcaatatgaatgtgagaaatgctagaatgacttaagattgtgaaacggaggaagtataaaagtcgtctcctgcatgaatgtctccagaagtcttctgcatggccaccggatacgtgtatcgtcgatccagatacacagtatggttccctgcttcggtgacactgacgcgcctatatcacgccaaagatctccgttttcaccctcacgcgcggtcccacgtcccaatcggtggctgaatcagcaacacccgatcacgtcacgtcacgtcctcatcaccggccggccgaggcttggctccctcccagccccatatcccaggggtccccatgccccccgcgcaagctcggaaatatcgcggcgaaaagccaccaaactctcggatccgtccgtcctggcgcgggcgtctctctccttcgggcaggttagattcgagctgacgcgagcgcgatacatcccccgcaccgcacgcacgcacgcagctcccccgcaccgcacgcacgcacgcagctcccccgcaccgcacgcacgcacgccctcttcggctacgcgccacgttcccgcgcgagcggtgagcgagacgctgccacgaggatacggctacgcgaagcaggcgtggtgcgatactgcgatcccctagggggcccgatgccgttctagttgcccggacattggggggcagttaggaatttagggcctacaactacaagtaaaacgaaggaaaaatctcgatttcaattgtcaaacgtgcctgtggcagctgattacgtggtggcatggaaagcaacacttatttgaaccttttctcgaactcatctgcaactctgcaaggctgttcctggtcactgtaacctcttctcattgtttcgttcatcaagacatcaacgttcaccagtgagcaaatcctagagacgggcggatctaccagagtagactacagcatggcatatgtacgggccgaagttttggattgtgtgggctgccgggctgggtcgagaggtcgaggtaagccaggagattgccctcttttatatggcccacgctccaagaaatccaggcatccaaccaagcttcagcacggcaggttacggcttaccaaccaatcgacctccatctcctgccgtggattttgttgtttctgcctgcaaagacccagcatgatacggttcattccttctctacaccacgagtatcatcggtgcaattggaaatagtatcatcatcagtgtaattggaaatggaaccgaaaggagtcatattcatctgtaatcttgtacagttctctatacccccaactccccaagtgattgtgttgtaatcatctaatgatggcctttctataaaagttggggatgtgctctcttacaaaaattaccaatagtttccggctccttcaggctaattttgtaaccctatagccatgattataggaaggatgcataaattgttcaagtgcatggttatatcgtaatgcacaactaatggtagagcatccaatcacaggaatattgaaaactcacgctagtaatcctacacatcaagccctccagtgacgatctactccccaggggcttagttaaactaaacagaacgaagaaacccccactaatgcaatatcgtgtgccgcatttgctttattgtagcatagctccaaatcttctgggttttctcaaacaggcaagaaacattcctagtatcgcctccccgatgtgatcttcagcaagatgttattaacatctgaaaagtataaaattggagtcagatcttcacaccacatgatgcaacagtaacgactaagtttatattgagacaactatttgtttaacagaagtgctacttttcttttgtgaaaatacagataaaattccataacagcctaatatagcatatgctgtacaatcaactgcagctttccctatcgataagaaacttgtacaaagcaaaaaaacacacaagattcaacagataatgtgacgaccttactcagactttggctcactgatcagtgtacccacactcttgaaccagcgtatgagattgcggtgatccttcacatacagccaagcttgtaggaaagggaagagtttctcatttataccacgggcctcgatgtaatgatggaatgcatcacgcacattctcatccaattctctgtcaatcaaagagaagataattattcatgatcagtaaaaagcagtacatcaacatccagggctaacatatgtgtttgtactgtatcgtccaggacaagcaccatacacagcggacttagtcttatacatgtaataaacatcaaatgaattattgatacccatccatgagagaaacaaacgaccacaatccaaatagctaagcaaactttcagttattgcaagatagtaaaaggcttttaaagatgtgcttggatcactggacttatattcggggttttaatattacttttagtactttttgtgcattgtgcactgcacaactgagccaaactgtgaggcatgtgcatacatatttaaggcacatgatatcagtaacttaaccaattatgcaacatgtaagattcatattactgggtaaatgtagccactgttacatagatcaaaacattttttggtcatggtacctaagcatctatgacgtatcactagccatttgataagtgttttaaaaggatttgttttatttagctctctcaacatgtaaacatctctgtaaattatggtgatcattatttgtatgcatatatggtaaccggtgtagtgactgagaaaattgatttaactgataggagaaactaaatacccataggagtacagagttttgagcatgctagtacatctgaaattttacatgtttcaaactcaattagcactagtaaggacaacgaaaatattcttcctttatacacattaaacaataggtaatccacagcttgagataaaatatttacgaacaccacctgaaaggctgaaagactactgttatacttcatagaccttaaaagttagtacacatcataaactcccacacctcaagtgaaagtattacagaacataaaacactgggcacctgaactgccaccatccttcatgattaggctaacgcaactatttttacaaaactatggtatgcaacagctaacaaaatatgccctaaagccccattctaaccactaaattagtattaagatcgcacctgctaggcattcactcattctagatcaattgctttctgatcaggttatactagcgccaccagtcagattacccaaagccccaaaaatttactaaaatgcttgcttacaaactgaaccaaacaagtaattcacagaatgagaacgaatttcgctgatttggaagaaaaactcactggaagatacggccctggtacccgtcaccgcccttcccagccaaacccgccgtcccagactcggcagtcttcggccggaggcagacggaatggatccccacggcgtcggggtacagcccgcacaggaactgcagcgacttgctgctccctggcctggagatgtcgacgtggaggaaaagctggctaatcgactcgctcaccccacccccgccgccgtcgtcgtcgtccgagtcgtagtcggcgccggggggcatgatgttggcgagcctggcgacggagattgagatctcctcgccggcatccccgtacccgcggcggagcacggggccggatgcctggtccagggcgcccttgacgatcgtgtagggcttgggcgggctgatcttgggcgggggcgtcatcttggagacctcgaggaagtgctccttgagggagcggaggatgatggagttcacggcggaggaggaggcggccgcggcggcggcggcggcggaggaggagtatggtgaggtggagagggcatggcgaaagaaggtagacgcggcggcgcggcggaacatcgtgagaagggaggagccgaagggtttaggaggaacgggaaacggtatggaagctgaggtttttaggttacccggggtttcagatcagtttttttttcctcttgaacctactctctccccgtccaaaaaaaatcaaactcgcacaagtatctggacatccctcctaggttatttttttctttaacggagatagtacagtataaacaccagatgcagagacaagcacttaccttaaaaacgtatatatacacatcctatccttacaagcatcttaaaagaccacgggcatatttgagattaacaaagtcaccgcgggcagatctctcactgaaacacacacgagagcatccccgaaagattgggtcggcatcgcttgagagttgagattgtcgaagtcaccacggtcccctcgttgaaatgtacatgcgcacaccttaaccttatgaggtgctccggaaaactgggtcgatatattttgagatcgacgaagttatcacaggccccttgctagagcacacacgatcacccccagaagactggaccgatatatgtattgatgaagtcatcatggatcaacattgttgatgggtacgttacctaccgctgaaagaataattagctgtaaatatgatcacacatgtcaagtatagtacttaacccaggtaagttagtcccaccataagaaactaacgagttaagttcgtattttatcatatcagttcattttggtaatatcaattgcagttgttgcacgaaaattagtactacttttgtcacggttaaaatttgcaggttacactacaatgaattcggaaaaatttaactagaacaaatacttcatatgaaaaataggtcaatttctttaaaattcccatgaaattcgtccaaatcgaataggctctaaaattatatagtgcgtttcagacggtgaactcaccacacacaacatgtcatttgttctacatggatttatagccgaccgtatgctttctagagttaacaaatacttcctccgtttcacaatgtaagactttctagcattccccacatttatatagatgttactgaatctaaacatatatacgtttctaggtttattaacgtatatatgaatatgagtaatgctagaaagtcttacaatataaaacggagggaatacaatataaaatgttcgccgattttatttagacggtacgaactagtcaatgtcacactaaaataagattttatgtgtagccattgcctatttacaaattgtaatatcagatagaaacccttcggtgtgttcagcaaatgggttatgacttatgattggtgggattgagaagaaaaatagataaatgtttaggattaaatgtgttgtaaagaatagatgactaagatacagtaatattacctttagagtgtctgatattattctcctgtcctatttaccaaacaatccctttgagtgtggttttcagtaaccctacctttttttggttaaagaaaaaaaaaatgaaaactaaggctgtgtttttaactggatccaaagtttggattttgattgaaattgaagatgatgtgactgaaaagttgtgtatgtatgacaagttgatgtgatggaaaaggactgaagtttggattcaaattttggatctagacacagcctaagtagtaggagaaacgtggttggtcacgatgtgcatacgcctccggccttccacatccttccagaaacgagccggccggattgctctccaagccaaacacggcccagagaggcgagagcccccacaccgccaaacccgacccggaaatcaactgcacacgctccgatcccctctctccagatcgattcggaccccatgggttggcgttggcacgacgacggcgatgacggcggccgcggcctgggcgacatccccgacctcgccggcggcggcggaggcggagatggggagcgctgcgccacgcgccgggtggtgcagtctcggtgccacacggaggaggtggagcccggccgcttcgtccgcaagtgcgagaagaccgagcagctcctccgcgactgcgtcggcaggtatatacatatactccatggcctcgcgcttttccctgatctgttccttcttttcctgcgaggatcccctctttgcatattactgttcgttgttttagtgatgaattggtgataacatgtcatgcgcagttgtgttactattagtcccgtgtatgattgtgagctgtgtatagccgcctctctgtggacgattttcgtgagtctgtcctcgctgatttgatacaaacacgaattcattaagaatggggaatgtgccgtgatgatcgagacgtttgagttctgtggtgaatagtatgatcaaatgtgtgtaataacttgggcttttgaattttggtagctaattagatatggaatttctatccagttttaggtgcccgtgccatcgacatgggttaaaagttattgtgggctattttgcgctcaacttgttaatcaacaaattttggacggaggcagtactttgtaggcatggggtaaatttgtatgatacacttgttgcttgaagatgttcgtgaactcatgggatttctagacacctacaaccaattacattacagtgttattatattctaacgatatgtaaagagcagctgtgttcgtgttgtctacactaaagattcaacaactagtggtcatcatcaaaccgatagcatatcctcattttgcaggattttgaaaactcacatctcgttagcatccttccttttatttcttcacatgcctcatgttaaacttttaagtgcatgaaacccaaatttctgtatttcgtagctccttgtaaccaatgtacaacactatgattagtattctggatagattttgtacttcccaaagtattttggttgttgacaagctattacaataatctgatggataacctaccatacattatttctcctaaccgatcacaataatcttcttctaggccctctgaactggtggaatcaaaaactgaaaatactgaagaagacgtcacagatgaaatgaaaagcgggtcactatctcttggttttccgaccaatgagccctttgcatttcctggacttcgcagtgacatagaagctcttgagaaaggccttttcgggagcattggtagctttctggatgatgctgagaggatgaccaatgatttcttgaagtcttttggtgtcccttccatcaatgaaagggagtcgagctcatttgatggacaacctacaggcaggcacattggtggacaacctgcaggcaggcacattgaggaaggtactgcaaaggacactaaacagaacgactacgcagaattcagcagcaagattacagatgtgtaaggatctacagttagctgacgcacctttgggagcagcttgccaattttgtattttgaacatctccatggttgtaattggaaggggaaggatcagtttgactgttttataagcagagtcgtctgaagtctgaagtgttgcgcttataagaacaattgtgtatattactgttttagataagcctgtttgtgttcctcaacaatgagatcaattatggatggtttttttctctgcttaagtttggtcatggataatgcaatgcattgttgtttctgcgttctgctgctcttggcttcaactgaaatatttgggggccaaaggggcagagactctggcaccctgatgcgcgattgcccatgcccatcctagctaatccatttgtgcgttctttcaaaggagattggggagattgtgactcgttttccacgcgcacgcttcccaaactactaaacggtgtgtattttgcaaaaaatttctatatgaaagttgctttaaaaaatcatattagtctatttttaaaatttaaaatagttaatacttaattaattatgcgctaatgacatataagtctcttcaggatgggctggggcctggggataggaaattctccgatcccctgtttttctcaactttaccttcacgtggtcttcgaagcaatttcaagttgctatgatgcttctagatatctgaaatatggacctgcacagtgtcacggtgaacgctcctctgatatttcggtaaaactacgaaagctcgtagctacttcctctctcctaaaacaaatccactcttagcatcctatcccaagacaactttagttgtaaggataaaataaacaaagtgtcccttatttataggaaaataatattaatagatggataaagggtattaaaatatggtgagataatcccttatttctctatggtatatgagctgcagatgctagatgcctggtgaggtatgtacgctttcttattatgaaacatgtatatcatctcgatttttcgatgtttctatgccaataattcgaaacagaagatttctcctccgttcatttgaaagtctggtttcagacgtaagctaccaaaaggatgaaattttttaagataataccaaaaggatgaaatgcttggtaactcgggctaggtgcttagagtaaccagaacctgcacactactttatcctacgctttctatataagtacaaccactaactagtgaggataagacatcatcaaaataaacctaacctgggaatatagggtaggtttggtttgctacctatcaaagatttggtagtaccaaatgtttggcaaattttggtattatcattcttttttggtatccttggttgggtaaatatgtttggattactaccaatatgaagtcaaaactagaaattgagcacgcctattggcgcacttgttttaaaccccatgaatttgttttcgtgttattaaaaaatattatgtttgttgaaaaagcaacgtcctcaaattttgacatcttaaattattaaattgtaaatatcatattaatagatttttgatgaaaactcttctatatagttgtgttttaatttttatagtctagaaaacaatgataaaatatgtgtaatagagtctgttgatttttaaaatgatattattttaaatacacaggtaatataaattttgcaaagttttataagaattagttaaattttattgaaacttgagaaaaaaaaagtacattcgaataaaatttcaatcaacttttaatttaaaatttaggggcaattgtatttttaccctgttttaatgtctaacttccaatttgaccctgttattttaagtttgcttatttgaccctctttttaaaaaataaagatcaaacttgaccctattctgtgaaagcaacttaacggtgttaactcatgacaaaagtaccatttatacccttgcttgtttgacccttctttattgaaagtttttgtttatttatccaggtttaacaaattttgacctaggtttgataaatttaacataggtttcacaatttgtcttaaatttgatgaattttgacatatatttgatagctttttgaaaattttgacttagatatgatatatttttttacaaaattgacatacacttcacagatttgataaaattttgacaacataaatctcaaactatatattccaagaaaaacacaaacgccatgaggctaaccagatgtgtctcgagtccaagctgctcaatctaccgcagctgctacgcgccgccgtgagaatactcaccgtgttgccgttgcggccgcacctgcgcgtcgtcgtggccgcacctacgcgctgctgcagctcccacatgccgctttcgctccctccgtgcgccgtcgccgctaaagttcccactacgtgctgcctccgccgctgctgcactcgcgtgtagccgccgcagctcctgcgcaccatcgccgtcgaactcttctccgcgcgtcgcctccgcagctcctgctgccgccgccgccggtgaagaccactccgcgcgccgccgccacagcccccaccgagtgccgcctccgcatctctgtctccacagctcctgccggctgccgccgccgccgccgaagtcctctctgcgtgccgccaccgcagcccccaccgagcgccgccttcgtagctcctatcgcgcgccgccgccacagccccgccgcgcagcgcctctgtagcccccacgcgcgccgccgagaaggcccggccggctggggtgaagtagactggtgagaaatttggggatataattgatttggtagtcaggggcattttagtcagttcagattataaaataatttttttcggtgcactaagtaaaccctaactgtacagtgaaaatagggccaaacggcagttccgatttctaaaagtagggtcaaataagtaaagttgaaaaagtacggtcatattagtagttagactttaaaatagggtcaaatgagcaattgtccttaaaaaaagtagcaaatcacattattacggaaatccttaaatttctgttttttctaaccacattatttagggtttctttctttttgtaaaattatagttgagttttctattaaatgataaaattgatcattgatattttttgtaaaggtgttctaaaggagctaccgtactcatcattttttctagtaccacatgaaaagttacaatcgtatagattttgtgccataaacacttactccctctgttccagaatataataagttttagagttgggcccggttattaagaaagtaggtagaagtgattggtggagggttgtgattggatgaataatggaggtaggtgggaaaagtgaatggtggaggattgtgatttgttgggaagaaaatgtcggttgagaagttattatattttgaaacaaatcctaagggttaaaagttgttatattttaggacggatgaagtatttaccatcacgcacacgggagggttacctttcatcttctttaaaagccaggtaatctctcaaatgaccaggcaatgtattgagttttctagagatttattataggtatatgtgcacaggagacatactttccaacacacatatactgcacctctttacctttaaatgaacacatggcagttttctaaagaagcctttactaaatactagccagtaaagtcgtgcgttcgcatgactatgccttcccacctattaaatgcaatatattgattataattatattgtaaataagttcttaaagaacatattttgtaggaactaggaagtttatctattataaacaatatttgtgatcataaataattaacatgcctagcatgtaaaatttgtcgtaaatattaatattagcatatgttctcaactttgtatattattagcaggtattatattttaattattagtccaagtaatttttaaacatttatattaaagcattaatttctgaacattcgaagaaccgtgttctgtattgttggaagggaacacaccacgcttggaaaaagcattagtttttttttctaacattctttttcgagcttaactccagatgctccccttttctgatcaaagtaaaatgactatgcttttattattcccatgttttcttccgatccttccattggaagtgtcatgaatcttctcctgccctctatatttctaaccaatcctttccaaatccaacggcacatcttaaaagcatacctggctcaaatcaaaatgcgaataaacattttacgttcattgtatgatgacgacgacgacgacgacgacgacgatgatttagtgtgcacgtggctcaataggaggctagatatttggcccttaaatcggttatagagatttaatattacagaggagaaaatttagattagtgccaaatttacttgaggcattaccgatttgtttgctacaatccaaacacctaacattactattcaagctgccaataaattggttggacacattttggtagtaatccaaaatagctaaattcaattgtcgctatatagttctgtattttcacccatctttacgtgacgctagacaagtcggcagcaacatcacacgagttattgtcaccacattcattcttacggttttatatgaattcctgtagtaaagcgtgaagtatcatcgggtttacttttattctgaagtgagaaaaaattgcccaaaaaagatagcaaccaagcaactcgacttagcaaaggggggggggggcatgtttggggcacgcattgcgcttgcaacaaaactttggctgctgctatgtctgctgctatgtctgggataatcagttggcacaaattgatgaattcgaaaaggaggccccatgagctgctaggatactatgttagattgtaggaaagagatcctatgagattttttcagtttaatttaatagttgtataaattatatgtagctattctataagaaaacatgataataataatagagtaaattgtaccagcggtccttaaacttgtaagcagatttcacctaggtacacgaacctgcaaagcgtgcatcgagatccctaaatgtagtttattgtatcatctcggtccaaagtcctgtttgaccgtggttttaccagtgttcacctagtcgctaaacgctagtcggacggccacctactgactagcgactaggctgattaggcggcgactagacggattaggcgaattagacatttttttctatttctttcacgcaaaaatactgattctagatattcggtactcggtaaatataggcatttaggcaaatagcataaatcatagttaagttcagaaatcatcaagtccatacaacgcactgacactgcacacgaagcattgggtttagtacaaatctatagggatagcgaacacatcagtatagccactgtacatgcacatcataattcataaatcataactttatagatctgaggggctggagctaggagagaggaagaaaaatttatctagaactggaagaacagagaaggtgaggtggtggaggggagcctgatcccctgatggcctgatctagggttggcgtaggctgcttgagtggttccgtgcttgactgcttcaatcggtgtgtttgccaccttccattgacagcaaggatgaaggatgagatggagagcaggagcagcagaggagggggaagaacgtggagcagcagaggaggagagggaagaacatagcggcgcggtggaagatcgatgggcacggcgacggagccgtcgctcgtggcggtgtgaaaaaagggggtaggcagggattgcgctctctctccaggctctcaaataaggcaacctaaatccccttctataccgagtcggtcccgcgtggcgcttctaaattttatcacgcccaaattttgatttctatcgcctagtcgccgcctagacgcactgtccctttgtctaattgcgctcaggcaccgtcctgtccaggccgcctagaaccgtctaggcggtaaatcgactaattcactgcctaaggtgtaaactggacaaattgtcgccgactagcgattaatcaccgtttagacaggctaggcggccgtttaggcgaacattgggttttacttacgtggcatgctacatggatggtgatgacatggcgaaattttccctcctttttttacctgctctgccttcactatgcatgtcgagtcgccggtcggctttgcccgtaggccaacgacggatggattcggcaggacaacggattctgcagcggcagtgttcggcatgagtggatccggcgtcagccagtcaacacgttgcgcggaccaagccgaaggcgctaaggcatgggggctcggttccaaatggaggtgctcctatctcctatcgtccctagtggatttgtagcctccgtccctcaaggagggaggatccgacgcaggtgacacaaggaaatgacatatcctatgttgttgttccgctaacatgaagggatgacagatatggcagcaccagggtcggacgggaccgacgttgctgtcagccacaagcgctccgatgtgaggctccacattgctctgcgtcgtgtcctcatccgtgccatccatgccgccacctaaaccgaatcgaagggaaagagatcttagccaagttggagcggcaacgctcgcagaggagggagtagaagcagcatcccaagaagaagtaacatgctagtagcatcaccatgatgcccgccagtgcaggcatccgccgacacccatctctccggtcgcgagctcctccattagctcaagcccgtcactcctcccagcttaaatcatgtcggatcaagccacaacctatccgaagtcatcatccccagccaccgctctgccgttgggccaaccccgttgctagcgcatctaccttcggtggtcggcgtcgtctctctcgctgcctccctctccctttgctgttgtcgtcaatgcggtcgttgctcatcatcacagccgccgttggtacatccagcagtgaaggaagaagagaagaagaatgggagaataagaacaggaaaaggaaaatttgttcgtgtcatcgttcacataggatgccacgtaggcaagccacagtcaaacgagactctggaccagaattaatacaataaaccaagtttatagatcttgatgccatggattagccctgcacaaaaattgcaatggtaactcatgtatactcttattttgcagtcgtcgctaaaacctatcttatgcaggcaaatgaagcccaacaacacttaatttaggaataacagcacttcataatcaattcgtagctagcacgcaaatgaagcccaacaacacttaatttaggaataacagcacttcataatcaattcgtagctagcactaccaagataggtgaaatgtggaaagacagcctactctgaataccgtactctaccacaacgttttctacttcattttgccatcagcaaaacacacactgcctacaagggcaaaacaaaatattgcttgcaaactatgcacgcacacggcgtttctgaattgtgtagactaatcacatgtgtgtttttagggtaacacatcaaactattcaccgactcttacaatcgtctactaataaaaaaaaataaaaccaagggaaccgaaaccaagatcgagatacaatttttttgaaacgctttctttcacaagtctgtgtgctaccatattcgcgacgaacccacctcagtttcacctcagtttcaaaccctagaaataaagccaggggaaccgaaacttgacccctggtcaagatacaattttttgaaacacctttttttcgcatgtctgtgtgctactatattcgccaaacccacctcagcttcaaaccctagaagtcatcaaaatggctgagatcttggatgatcaccccatggaccgaccttttaagctcactttgtttcaccatattggcaccctcccaaggagacaattttctcaaaatgtgtagtttaacgttacaaacgaaaacagattcccctttcgatttaaacctgaaatagatttcgatcatattatgtgggcatcaacagttatcccacaaaaccccatggtgaaacaaaaaccactgggatgatcagcccatgcccaatatacagctttcagaatctacctaaaaacaactaagaattccaacattaaagaaccctgtacacccaaccagatggaaaatttctttcaaccgaccacaccagactgtgcaacgccttcttgcgcagaccaaaataatgactatatgtctagaagaagacaatgaactttgccgggtgaggaataaattaaggtgctcttgatgatctcattagcttgtactacggcaggtgagagctctggatacatcacataaatgtgataatttaaccacctctagttgaaaatcttcacagccttatcgaaagaattgcggttctgtaatttattcaaattgttgtcagaaaatgcccactgttcacatgtcagttagtaggagtcataagcgtatacctgattggacaagcatgacctttttggggtgacgtctgagtgctcaagtcctaggcattgttcccatggtccataaacatctttctatattaaataaacaaggcagaaaaaaattatttgagaataatccgactcaactcttaaaagagaatttaacccacctggaatcggctcaatacgatatctgaatcttgaaagtattcaccagccaggcgattgtgagcaatataagcaaatttccactgatcaaagtagctcacgtcagatagtatccaatatatgatacagcagaaaaggtaattgaaaagatcactaaaggtttacactgtagcaccagcctcaccaacagtaaacaagcagtaataaagtaatacaaaatcgatcgtgtatgagatgaaaggttgaaataattaccttcgcaaactgctcatcagaaaccagaagtttcttctgaatacgcactttgatatctgataatgtctcaccatcacggataagaaagaagaaaggttctccgtagtaatcaatgtgctggaaagattgagacaaatgattcaataagagaaatcccaggtcgccgttgcttctctcaaatggcacgcaagaaaacaaacgtcacaaaaaacaaagaattggagcgagaatcagagatgcactctgaagaaaatacagaacatgctcaggcaaatggaacgatgcttcataatagaaccataaaccagcataggaattgagaggcactgatcattgaggtcagcttagtaagtgacgttacacctttaggcagcattcagttgtgtccattggaggactatatagtggcccattattacagataaaatgcaacgacctggttgtttacaatgaaatgaaatgacacaataaatgcttcagtcatctcttgacgagacaatgcctaagaaagtaccaaacagtttgagcttatccaggaagacagttaaaacgtggatagatatttccaacattgactgagcatgttcacgctcaacccttccaaggccaaagccatatttcccattacacgtttcccatgtaaacaagctaaagtacaacgactagtcagtccaccatgtaaagtagcaaacctcaataatttctactatgttcttaatcactgtgacaagtgggacagctaatactttagagatgactgtttcatcacgcttagatcaaagaaggctgaaatgggatttactctgaactatatccagaatcatgatgtcgtgaacattgacatgttcctcaaaactggtcttaaatatatgacaccattgactctaattcatttgattatccatcttttctagaaatatctgtgcaaatagataaacattcgaggcacacttaaattactttgatgacagatcaagcggtactcttcacatgacttaactaagtaattgaataaatattgctggacatagtttgaggacgaagtcaattgtgttgtatattaaaaaccagagggagtaccaaatgactacaagcagtattgaaacattaggttctaaatatataaatacctgtttttctatgatgaagtgacagacatgaaccaaacggtctcgcacaccagcatttttctcttcttcaggaacctgaccaacagaaaaggaatatgtggagaaaaggtagctaattatgtacactaattaacaacatgttcagtttgagtgggttattccatggatgatttattccaacatgagatgaccacattttattgtgtcatcttattacaggggatgacgtgttgatgagcccactcattttaacaaagcatgcccaactgtaggtcatttgctttgtagcctgaacttcagattgcttaaaggacagaacatctcaataaagtttccgtataagcaaatgcttacctcttcaacacataacagtccattgaattcattaactgaaattttctccgaaggttgatacacctgaaaaattaacgaggcaagtgattgatcatgcataaaagaggtattttcaaccactattaagtatacgtgtaccttgatgaaagaatagaaaatattgttttctacgatgaaagcagggatgaaactttacatggtaaaatgaaatcatgacgtgagcattatgtgtttttcttaaagagcatatgacgtgatttttggtaaaacttggaagagtcaggcaaaacctgccaggttgactacctttcgtaatcaaagtgaaagaaaaaatctatcaactcaaacagagagatctttgttattttacagcaggaactgattttctacaacaatacaaccctccagtttcagaaacgagctttgcagtattttttttttgtgtgtaatggtctctaccctaagaataagcctttaagaattacagaagaactgttgaaataccttgcgtatcttgtttttgtagacctcaaataaccggaattcagcatcactataagataactcaacctgaaaaaaaatcattaaattgccatgcacacacaacacttgaaagaaaactagcagttgattcaccttggatttcatgtcctcaatcaaatcagacatagtgctaccttttggcaaccgtataaagtgagatgacacctgataagtaagcattagcacaggacatgatcagaaatatagaagtggttacaagcacaaaacgagttcaaacaaacctcattgtttgtagcatgataaaaggcaactctcaatgttatcagatcttgcagtactggcaaagggatgtccagtatctcataatacaatatgtcagacatctgccaaaccaaaggaagcgcaagtaatttcatgtaaaaggcacaaaagaagttgctcagaatactccataaagctgccaaacctgattgccattccttagcatgtccgaaagatgatcaagacctctatacttaatgtagtgagatttgggcatctgtgaatacgggaggtgttgtgtaaggcggagtttggaaggatcatcgagtccaagttgattagcaactttttcaacaacatcatcatacgtgaaacgctttgaacttcacaaatatgaaaataggaggggaaaaaaacagtgagtcatatcacagacaaaggaggtatgtcagttattatatgtatgttcaaatattcctggcacatacagctccaaagtgaagtcatcatcttttggattctcaagtaatctgaagtggacaacctgtagataacaacaataaattccacttgtgggaaataataaatgaaatatacagaaaattcagacaggaatctgtttttttgcgaaaaggaattatttgaaagggtagttgttccatgtttcactacagataccataaaccttaatgaagcagcgcccaacaccctacagacacacatatttcttccattgcacaatgtcattgacttttcaggaagaccacatatatatttaaaatcatacagccttgccaacataattcagctttccagaaagggaaaaataactacatggttctgatattctttactctcttcttacagctccaatctagagctctacgctcaaacatgttaaacttagggatgaagtgtgactgagaatagagatccgacaggagctatcggatgtgaatacataaaacatatctatttttaagagagtattttgtaatggatggagcactggagcatgacacaagaaaactgtttgctccatataccagtatgcttacatagtgaacaaaatagacattacagtggctagtggcacaaaccacaacaaatgaattgcataaaaaaaaaggaggaataaaaaaaatcaaaggagctaaaagaaatatagcagtgtatcaagacagagaatgtattagcagaaaagagctaaaaaagagaagctatagatattagaatttgatcacatttaggaggcttgcactgaaatatggtcacaacaattctctttgttcaagtgataaagttaacataattatttgtgtgattacacatatttcattccttaaaattagctggcggttatggtgtaaagtgcctttctttctcggtttctccaagcaggccatattggttatattggcaaatggcaatgtacacaccccaaaccatgtcacccacaagcacacccaacatgcaaacaggacagcaccataccaccaacttgggcaaaggtatgttccctatggaaaaacatacaagacaaacaaagccagactactctactggtaatattctaatccatgaagaagtaaggaattccatgttcaaacgtatcaatccaaacaaagattatgctaacaatttaacagggcatagaaaaaaaatgataatacgactacccgagctaaccggctgttctgcactgttctttacttctttttctttccttttggctcggtgggtcagagtggctaggctttgccagaaggatcatcgttttggtaagcttgcctcaccaactagctaatcagaccgaggtcttactcctcaccagctgagccgttattttccttttagcaatcctaatattagaagtagcttgactttactctttttttttcaattctgaaatagccttcagcccactggtaccagtggtgccttgatcacttgaaagtgaggctgttggaaagtttgtctctagtctatcccattatcccattcgcgagttattcgacttctttttcttaattagcagattttagttattggcatccataaggataatggggaaaacagaacaagcaaaggtctgttgcaactgttactgactgaaggacaaaaaaagaagataagataacagtccacagaaaaatgaaaaagcatcaattcatccccaggacagatatatttacctgtctattttggatatattcaaagaaagatggcacatcggcacagcgatagtggtccaacttttctggagaacaacgtttttggtagcatataatgtcaccatcttcaagcttaaatcaacaccagacagtcaaacaggataagtaaaatgacaactaaaactcttggaaagctaaactaaatctgttagaaaaaaacaaaatattaatagaacaaacctggcttgaaaggaaggaatcattaatgttaataggttcacacattacacttggctcgaacattacttcctacaaaaaattagggaaataaattgcagttttacaactcctcaaatggtgcctaactaaaatagtcaagtagaaccagtaactaaaaactaacctcatacagttcaatatcttcatctgactgaaaccctgccatctcttgcaatttttgcactatatcagctggcttccctgatgctttcacaagaagttttccaacatatctatttcataataacagggataatatccatgcagcttggtcaggtaacccatagaagtaaattaaataaataaatagctatatgcatatacaagagataggaacaaccttagctcttccttttcaggatcatacagcttgaagaatattaatatgtcatcctttgtctttggaggcacagaaataggatgattttcctgtacacatgtcataatctgggttaaattgtccacaagtaaaccaagatcaatgaactttggctaaacaagtagcacaacacaattgagtagatgacttagcaaataaaaagcactttagtaagtagttaacctgtcccaatgcaacctccaagaacagtttcaactcagaattgagtgatttatttgatggatctgtaaggtgtccaatctgcagaaacaaaatttattaattgcgagtcaagagagctgatagatgaaataaatggaagctaaagacaaacacaaaaacaaagtagatctctaaattgaatcaagtaatgttaataggtagataagcttaatcaaagtgcaatatccacacgcctggttggttggttgcactattaactcataaatctaaccaagatataataatatacctgaatcctcgcatatagaaactgtctgtgtattctgtatacataactactagttccacaaaatgagtgcaaggtaccaatctctgtttcagtacactcaaaccatgtatttcacaagagttctttacttgaacagtttaaaagaacagaaaatgcccgctgctcctaggggcatcccctcaactccaacgttggagaattgggaaaactggataagttccctaaaaagcaactttatggtgcaaattatgttatgtgcgcataccaagtttcacaggcaaattcaaccatactatgaataaactggactatgaagttatgcatatgtggaacacttgatgacctacagccaagaaacttttggggttaggaacagtgcacatccattatccacaaactggactatggtgcctcccatatgaaatcatatttgatctcttatatcctcttacccagtttatcactcccaccactgacaccttacttaaccaaacttcatctattctatactcatttaaaaagaccatgggtctttaaatggtaatgaagtgccacatacatccctaaacttgaagatataagttggcaagcattgtgatctggctcacttcagtcatcactttggacatggctaaaagtgttgatgtggggatgaaatagtgttgtgaagtcaacaaagtactcccttgttgcacaacactttaattgtggtttcgcatagttttagtttgaccactcccattttataaatactagtaccaatatgcccttccattgtaaggggcgaggctcatataattaaggatgggttaggagggcaattgaactcggagcgtgcggtgggagtagaatgaaaggagtggagaacaactccacttttaaagtggtagagaaaactatactccctctgtttcatattataagaggctttgacttttttcctagtcaaacttttttagttcgactaaatttgtagaaaaatatcataacattcccaatacaaaacaaacatattatcaaaatatattcaatgttatatttaatggaactaatttggtgttgtagatgttgctaaatttttataaacttagtcaaacataaagaagtttgactaggaaaaaagtcaaaacaacttattataatatgaaatggagggagtaggtattaaaaagtacaccatattgctaaagtgtgttacatggtaaatatataaaaaaaaaataagcccactcatcacaatcagacgatttaaaagatcatactccctccgacccaaaataagttagatctccagagttcaaactttgtgacagaatgagttcatttctactctgtaacctaccctcggtccacaaatacagaagttttactccttcaataccccttgcctacccaatcaccaataccctaaagttgcatcgcaatgcgaggaatgcttttattttgggacacagggagtaagttcatacataatggaagaaatcaaggctgatgatttcatgtaggtagcatggacagttactgtcaagcaaggtaatatgatgttaattaatgccaatattgcacttacactagatgcttcctcctggagagtcaacgggcgtacgggtctaaatgtgtggttctgtcgcttagcccataaccaaaatcgttgggattgtacaggaataccaaattcttttgataaatcgacctgtcaagaaagcatatttcaatcagaacaccacattttttgctatcatgataaaattccagtatgaacaaaatgttcagattttgatgcaacaaacaccaagcagatccccaacaaagcaactgaagtcaaacaacagcgcaatataatttgttccagttttctacttgcaataaagaaataataataacagcatacacatattcaatcaagtagacattatgttttcagtaaataatatattccaaacatgggacttcaaacaatttctccgagagactggttataactgaaaagaaaatgagctagtctgtttcttatactattttgatttcaacactgtatcagatcaataatggagattacatgtattccagagagccagcaaagataggcaaccaaagaaagaaatctttgaccatgttattaggcttatgaatataagaatctgatctaacccagtatgaactctcttcataactcattatttgttagaaaatcatatttgaggcgtatatttgtgtgtatgaaaaatctaaagcacagctgtttgcttcacctatggatagtcaaaccagcgaaactcaacatgcaattagacttaacttgtttgtttattgtcttttggggtttgtgtttgtactgtttccagttttctttcttctttaatgaaatgatatgcagttctcctgcgtatttgagaaaaaaaaatcattgtattgatatattcaagttatctttggtgaatggtgttgaatagcatttccatgcaacaaacatatacatgtaggttcgacaatgtgttgctctcacagaatatccatagactatgtttgttgtactcttagttggtctatttttacagagtcaacaagatcgatcaaagctaaacacctgtgaaagattcaccaaactacacaatcgggcttataagctaataatgaaataatgttactcactttaaatttaagaatggaaaactaaaataccagaattcaagaaagtactggaaaataaaataaaataaattgtagcgtagttatggggcatcatcaatgcaatacaattctgtgcatatcgtatattcattagatatacacattttgatatatcatggatgacaaatgaggctcagcaaaaagttaccttggcctggtttattgtcaaatgtttaggtgcccgaaggctttggatgttgtcataatccacaagatcaaaatatatatgttttccaatttgctctgcaaaatcagaatctcgggcaacctagaaaatgaagcactaagtgaggagcaactagaatgatagcattttcagataatgtaacgtatcaaataaagaggtaaacctttaatgcagtgaacatgtgggcctctgctttctcctttttcttatactctctttcttcattttcttttctcaacctaatctggtaaaggttttcatgacatcagaacaagttctgtgatacccaagaaaagaaaagggaagaagtattaccttaaggtgttctggtatgtcgttttcatctaaattgcaaataattttttctctgtcactttcacgaatgtacacaagcatgtaagcatttgaatgcttagtaaacctaagcggggtggtattcaatccaggattggtatgtgggagctgtaacagaaaaaaaagacattaataaaactaatagaagtaaaaggccgacttggggcttccagtgttcatgtgtgtatatacctcttcctcgccaccgtattgctcctctaatgcccgcttcatgtcttcttttgtcactcgttcatcatcaaacttgtacctaaattgtgaaagtacaaaacattacataaattcatcaaatgactgtccaatggaatgctaaaaaattgaagatagaaaggcagggcattattagcaacaaagcaatcgtctaacaagcttatcttcaaactaatgttaacaaaaatggaatgatcctttacaaagtcattaaggatattcatgcaaatcacatcaatccataaaaagaactcctgcaagcacaacaaaaataagatatctctttttaagcctagtaatgtaggtcttgccctctaatgcgaatcagatgttcaacaaaaaatattagccatagaactgattcagcaacaagtcactgacttgccaaaacagtacctgatgtgcattgtgtattcttgcttcattggaacaaattaattataatattgatgtacgagtaatatttttttgtttctgaaaaagttactacccaatacaagacgacagcagtcatgtcaacaggggaaaaagaaaataggaaagcgtatacctattttctagtaatacgttcatgctaattattgaccatttatgtatacctattaatgcaaaaggatcagattttgtattcttatgttttttatgaagaaataaacaagaaattatttgctaggagaatcaaaaaatatacctattcaaaaagtttaacatctaaagctacagaacataccgttgtgattcacaatgtcattaaagcataagtccttttctaaataaataacatttgactatgactaaaatgaagtaatgaactgctgtgaatgataaaacacagcatactgtattactgtttcacaacgagaaagagaggatatcattaaaataggatatcattgcagccatgtttaaaaaaatgaaaagcagggagtaggtttttatatcatatttcatggatcaacttatccgttgatgattagccaactaggatgaaaataagacgattaactataaaggaatatctcaagtatgttataaagttcatagagcttccactatttaaacttagatgtaccatatatctgaaagtgccgggcgtataaaggcgtagtagtgtccaccatgaccaccaccactatgaacaagtacgctgcattcaaaacaagttgttaagactagtgtaagggtccaaagcacttgtcgataacaacagaaactccaatgtatgctcagccaggacaagctaaactgagaaatgcttcctatacacaatccaaaaacttcacaagtaaagggtgtagaagaaattgtctaagttctctgcctgaaaatagcatgtgacatgactgaccactgacatttgtaacagctatgtaacacaaattgcgtgtcaatgcacaaacaagacatacaagggaccatatcagtatatacacactggccacaacttcaaactggaacgagtgagaccaaagtaattactaaagaaaacaaggtggtcattcctaacattggttgcagagtttaagcgcagcaggctggctgtgggccataggatacaggagaaaaacagcagtgcagctgaagcctcagctagctgatgcatgcactgcaacagtcttgaacacatgtctttgatagtcttttttttttcctaataatatgttggtgtaaaaatatggtgatatcatggtactttaattgtcaaaaatatatttctctgtgacaacttctacatgtgccagtaatcaaaattttagaacatcaacagcaagcaagtacaggataactgacagagtataacatactacaaagcaaaacagaaaacataaatcacatggagagcttggaactacctgtgtagagtatagaggttacgcaccctcctgtcagcttctggagagaggtattttccatcatccttgtcaagatctaattgtaatgggaactcatagcggtcatttatctacattgtccaaattagtttagtttaaccagtgcaggaaaaaattgtgtgtataaagtattttgcatgtttccctcaaaagtaaaagatacagttgagcctccaaactttagcaagcctacttttaagcaactaaataaggaattttcaagccagtgagaagatattaatccgagatattgcaagcgaactccctcgttttcaacatttgaagcaccaggttctatctaatttttagccttaaaaaaaggaacttcctgaggatcacccaagtaaataaacaaaataaggtgtcaatggcatgtgcagcactgtagcaaatttattttctgcttgttttgttgctcacactttcatcaagaaatatagaaagtactcctagcctacagcgcatctagaaggtttttcgtgtggagatgggatattcaggagacaaattaaaatatgttctggtgcatgtaagccattgaccattatgttgaaatgaggacacacacataaaaaaaatacaagaagcggaaaccataattgcattaagaaagatcttctgttacaaaaggacattgcaaatgcgacatcattatttgtcctctcatggctgcccatgttatatttcagaattttaaaagcaagtcaaggaaatgaagctaaatttcaagggggaattctccatatcttgacagctaaggctcttatcatgcaaaacacaatttggaaaatctagttttccatgtccttgatatgtgagactacattatgaaaagttcgtttgtagcctatgttaaatattagcaagcgccacaatgaaaaggataaatcatagatgaaatctagaaacaagccagagaaaatatagagtgaatttcagaccttaaccatggtatcccgcacaaaatcatattcaaaccgctttaattgaacttgcaggactggagggaagtcaataaaaagcatccctttcttggcatcctgaaaagagaggacgaaaatgttctgaagcacacaatctaaaaagtcacttcattaccaagtaatttgtatgtgtcaaagcacattttccttatcaagaatctagcattaaagtatacttaaaaaaattatagatcaaccagaggtggaaaataatattgatgtgctatgtcactggcatggtcacattcaaatatgatgacactttttcaattgatacatccgtgcacgctggggatagtgaataataatactacccaaccactcaacatagattcaacaatgtgcaactcagtgggtgagccatgagcatatgatatttacataagttacccttaggatgggaaaaccaacatcctagcttgtccttgtggatgtgccagaatttaactaaaagccaggcctacccacatggatgggctgggaccaaatcaaaccttagataatatatgaataggtttaacacagctcatgtgaaagatcaatatggaattgtgcataacaacataggaaaagtgttgcctaaaatgaattcagctgcaaagaaatatttaaatccaaacattggtaaatgtggcatttgaaggttctagatctcaaatgtcagtgggaccaacctgcaaaccatgtttctcagactggtatttattatcaccttccaatctctctacttcaacatacttatcaaatgatgcataaacatctgaacagcccttgacatcaagtgcaagatctagaaaagagttacgaaaatacatgataaatctacaatcatgatgaatagataaaaacaataaagaaacaaggtccagatttcaccttgtcacctaccatagaatgattctttccttgtagatttgtagtcaacattaatgcactcaatataattcatatgatgaccttcaaatagctgttgaattgtcccttccacagtagttccctgaatcgagagagtagttgtacattgatgaaacactatttattatcttacatataacaaaaataaatgtccaaccttcattttgttttccagtttttcgcagagaacacgattcagttcttgaacatcatgctgcaggaaagaatcaacggtatcccatccaaaagatttggtaagctcttttgtagaaacactattgtcactatgctgaagtttgcagaaaagactttgcaaagccaaagggatgctcccgcaaggtgtatcattctctgtagttggcatatggtatacagcctaaaatatcattctctgtatcagcctcgcatcataggattcatttaagagaatttacaaatttagcctcacctttcggaagtacggaatatggtaaagcgtctgaagaagagaattcatgtagcatgtagccccttgattcttaaggccaacatagccagtctcctttttggaatcataattccagaaatcaactattttacgcacagcaacctcagcctcaataatgcatttatcattcacaatataacctttagtcggatcatatagatctcctaaatgcataaaagaagtgaagccccaatcactttcccgagtactgaaatgatgtgctgcttctgtggaggggaaggaaactcatgaataacgactggtgaaattcataaagtattgtgcttaa

SEQ ID NO: 80552 - DNA, 591 bp, Oryza sativa
tgctccctcagctacaacaataaccatgtgggtgatctctttcaacctcttctctatgtactcaaacaggccaccctccccttccaaataaaatggggactcaggaattaagcagcagtcctatagaagacagagaaacccaatgaataggaggtaccattcggggagaaaaagaatgctaggtggtccaatgcattactgcacccagaacatgaatacacagaatatttgactcgaagaaactaaagaacgacatagatataaagcattaacttaccacgtctctgcttgcaagagtagcatacattgcaataaaccctgcaagggaccatagaaaaggaataaggacagtataatgaaataactaaaacaaaaaagttagaaattcatcatggattcacatgaggaatatgtgaattccattctgtaggcagaaaataaacatttcatgaacagtgctcttgaattagagtatataagcaaaatataggcctcttagttttacgtgcatatttatccaattaaagcattaaagaaacaagggagcagagaaatgttagaatgcagctgcagcaaagacgtatatggggg

SEQ ID NO: 80553 - DNA, 11893 bp, Oryza sativa
ggatttgcccatcttccctccccccgcgtacgttggccccagcccgtcccatcccacggttcgattcttccatcgctccgcgcctcgcctcttccgccatgcgcccctctctcctctcccctttacctagccatgattgatgtacccatcggtgagcgctgcgtgcgagaggatcacccgctcctcatgtgtagacggactgtcgggcgagaaagcgtacggttccaataagaaggcccttaaactggccagaaaaattacaacccgtgatggcgttgtcctttccctttcttagggcgagatataagctggtttgcatgcgaccatgtcagcgtaggacaaaacactaggggcactgttcagctgctccaggacgtcgacaacatggcgtgcgccgtgcaaagctctaactaggctagagcagccgctagcggtggtacaccatgagagtatttgggaccatttttctttgatgaaaacggccttgttaggattaattttcacactgctatttggacaccattcgacgtgacttttagccggagaaagaaagtgtggacaaacatatagatgcgtgtgggttactgtacacgaattaattaaaacatgtcaaatggtttagagaacattcttttcgtggtatattggatcttacaccgaatcgatttattttttttcaaatcttgttttaggagtgcaattggacatcatcacacacacatttctttacatatatatgcttgcgatattgtcatagacatcaaatatctcctgagcatgagcacacacatacccactaatgcacatgtgtgcgcatatacccttaaaattgataggcactagcactgaatctactcactttgtccaaaaaaaaaatcaattcctttcttcggtttgcagaccgataaattttagcctctcaaaaccctttacttacacactatttcaatactattctgttattaacgagggacatttatatttttttcctctcccttaaatcttttttggatgttagaagtagatgagtagtccattttttcagttgacggagggattagtatttaagcttcagtgagctaagtgcacaaccatatcacccacccatctggtaatatataggccatcctagtgactgtgaatactttaaccttgcccctctccatatttagtgttcaacctccaccaatgtctagttaatgtatctatcgaatctccaatactggctgtcatgcctttaatttttctcacctctcatatttggtggtgctttttatggatgatctgccattgtcccttcctccacacagggaggtggatacaaccctaaattttctgaagatatagttgtttcaatcacggataacacagtcaagctactatgtcagtaataataaaatttgtttacgtatagcagtttctatgcatgttaattatctagtgcatacagtacaacaggaggggcaggtagacgaaactttctctttctaatagtagagatatgctcagtcgctaatagatgataagttcataaaccaaggaatcgatagattatttatctaggggtttaacatctcccattgtaatgtcttcttttgtttctgtaatggtggatctaggaaatgaatggggagggaggcttatctccttcctcctccttcaggcccccctactcttcctcttctccctttctttcctctctcatctcccattttctcaatggtgattcagtggggtagggggacctaagtctccccagtacgtattacgctcaatccgatcttgaatttagatacctttctaaccggaacaaatactaatcggattagccaacggaccctctctcgcatgaaaacaaccctacacatcctcaagcatgaaattaaactaccctccacatcctcaagatttccacccaaatataaccagcactaatcaaacttctcgaatctctatctcctaaaaccaatcaagcaaaagaaacacgtaatcacccgtaataatcaatcagaccaatgaatgtaattaagtgcgtaataaaccccagccgctttcagcccatgcaagagagtccatattgccgtgtcacaaaggtttttgggagggtggacggaaggcaatgatgggatgatgatggtcgcggagatgagccgtggatgtggggcctccgcccgcgggggggataggtgcgcgcgtgccggctcaaagcgggacacgatgatttgggcctgggggaaaggccatgcgaacgcatgaatggacacttgaactggcctttccctgtggcgcctagctagtactgtagctaagcttggcatgccctaccaatgcgagcagagcacgccctctgcaatcatgccgtccatccccaggtccggcagcagccttgccttgccccggcgttggtttttgctggttggtaccagcaactcgatcgaaaagccaatcatttcttcatgcactgctcctacgtgccgcgatcattgcttattatccccaaagctagcatggctctcccctaatctagtactcctgcacctagcatttcaatgtgcggtacagtttctcgtctcctgcttctactgtgtgaaaatgtgcaaacaaatgagcattgagctagctatagctagcaaccttaaaacatcgaaagcttgcactctatctctagctacttgttgactggattggaggatggacggtagtcggttgagattactgaaactggttgtctctctgtttttttttaaaaaaatgttctgatttggcaaaaatacttccgtggaatgatcgccgaaatgtactaattgtacgcgacgacgactagtttattttgcaccacgtacgcacacttgttcacgggccataaatcaaagcgcatgttggtttgctagatactccactccattcggtggaccagattataaaacattcgtcaaagcggaaatgcatgcccctccttatatatatttttttctcctaaaacaaatgctactttgagtggagaatagctgaagttagctaagatagcaattttaagcctttaaggtgaaggaggtggggaagttatgattgcaccaattaaggagctcgccccacaagttaatcattgctgtcccaagaaccgagtgagatccaacattccttcccaccctctctttaaaaccctcactctcccccacttctttatcacttccaagttccaactctcagctagctgcaaactctactcagtttgcatcgagatatacagagatcgagtagtcagagctgagagctagtggagagaaagcaccagggaagaacgcagagagaggttacagggagcgatgatggagagggccgaggacctgcgcctgagcctcagtctcagctcgccgcttattgctcctcgtactcaccatgtcgccatgctgttccacgctcctccaggtacctgtcactagctcgatcgcgcttttctgcggaaacttcagttgtgagactagatcgatttgtgagtagttgctgatgattaacctttgagtacgcgcgttgtgtctgtggattagagaaaagattcctggagatgccgctgctccctgctgcgaagcggagcgaggtcgtcgcggcagaagaggagcgcgcgggcctgcgcggcggcggcggcagcgacgaggaggacggtggctgcggcatcgacggctcacgcaagaagctccggctttccaaggaccagtccgccgtgctcgaggacagcttccgggagcaccccaccctcaaccccgtgcgtaaacacctccgtcctcttcctcttcctcttcctctcctgattaattgcttagtttaactattttcggagacctaatttaacacagatgtatagttcgcgtgcattttctctactactgctgctgctgcatctctaaaccctgcgtgttacatgcgtgcagaggcagaaggcaactttggcgcagcagctcgggcttcggcctcggcaggtcgaggtgtggtttcagaacagacgcgcaaggtacgtaataagcacatgcaataccgtactgtacatcttggggattaatggactgttagtttagtggtttaagcttggatcgacatgagtctcgctctcaattaatcaatcgatcgggattatattctgaaaccattgttctttgcggcctgtgtaactaactcaggacgaagctgaagcagacggaggtggactgcgagttcctgaagcgctgctgcgagacgctcacggaggagaaccggaggctgcagaaggaggtgcaggagctgcgagcgctcaagctcgtctcgccgcacctctacatgaacatgtccccgcccaccacgctcaccatgtgcccctcctgcgagcgcgtctccaacaccaataacaactccagcgccgccgccgccgccgaccgccgcggcatcaggactactactgccgcaggcggcggcagcgtcgtcgacaccgccgccgacgggggcatcctctgccaccgcccgatcgccgtccggccgcagcagtcatgacaagctagctagctttttacttcctagctagacagactacacccgtacactgtccccatgtgtcaacgaggcagcaagcagtgtacgtgcacattatattcgcgcaagctgtgtgtgttgcgctcaccgatcgatcgctcagttgttgtttttttcctttttgttggaagcagctagctggctagctattagcatggtgttcatgcgtcaggtggagtagtagctataggcggcgctgggatagaacaggagtgtctcggcagcttctggccggcggtggtggtgttcgcgggcgggccggctgggagctgggcgtagcgaatatttagctggtccaggggaaagttggatatggtgggatacgggtgtaggggaagtggggcgcagcgggatggcacggtggtttgttctgtcccggctgacgatgacggcgatgatgatgagagggtcagtttgtttgttggacagtcgtttctcttaagcttgattctagcgattaatttaacacgggtaggcatgtgcatttggtctctgctgagcttaatttaggtgattagtagtgtgttctttaattggccggccgggaaagccatagcttgcatgcatgcatgaaagtttccttgtgttttgatgggatattatccgctaactgaaagcgttcgatcggtttgttcgcttaatcatgtgaacggctaaatataaatatgtactactactggatatcgagtaacgaatcatctggatataatcgaattgaattgcccggtcgaggaatatgcaccattcgatcggaggtggtatatatatgtcagttcttatctatgctgattgaatggtgcttataccgctataccaggtgtttgttcttagttgctctcatgatcataacggcacaaattcatcgtacgcgcgagcgtatagctgcaggaagagtgcctaggaagctacaccgaaatgaggcccaaaatcatgtacgtacgcgtgacaccatggcacaatataatcgccaagttcacgtcaaagtagaaatattttccatcactccatttattctcttgttgtacaagtcaaactgttataaagcacaagtgtatcgctcagactctcagagtcactcgatacgtggagagacttgcctataggtggataggaattctcaggctggttcacaaattaatcacaccaaaatttggtaacgccaaattttgatatatttcgacgttaccaaatttggtagtgttgactttatttgttttgatgcttttactatattttggtagagttttaaagagaggaagcttataggtagtaacggctgaagtatgcatgtttagtttgttgttttactaaaatttgataaggtttaaagtggcagccaactgaatagcccatcaatttgaatccgaaaggatatactatatgataccgttgacttggttggatttttttaaaattttaatcatttttttagaccaagtagggggggcgcaaaaacatcaaatttaaagtttgaagtgaggagctaaaaccttcttccaagggtaattttaccgctatattttctagtgtaaaaagttaatacctctaggtactaagtattttaaggtataaaaaattttagtataaaatttagatacctcaagatactttctaaagaactgtaaaatccctcttcttccaaacagagcttgcgtccctatcttgactttttaagtctgacagtccaaaagtttgtttcctacaaacaccttcttgaagccgaagcaaccgagggcgccatgtttcgaagaccacatcgtgtctatgattccatagaacctaggaatacaggaaatagaagaggcaaaattgccttgtaggattcaaataatatcctacatgcattcaaatatggagggagtggagtttgtcattgagaaaaccagatcaattgaatattgtgggacgttgatcctctgctgtactagaatgcagtggtactgtagcaaacttacctcgacaaaatattattattcctcttctgtgttcgagatcactgtagaatttgttttcggccgtttgatgaagatccgacggcaaaaacaacgcctaatgtcagtgtactgtagatcatctgcaatttcttcttcccaatgcagagtatactcgacgcaatgtatcgccagcatccacttcagctgcacggtgtgcgtgcgtgcaatgcctaagagtacgtggacacaaacacgtatgcatgcagctgtagtaccatctcagccagtactacccactgtagctatagcagctacagcggccaaacctttggagtttggaggtcacgcgacccacgcggccgcgcaccataacttggggagcaaaagctggggctttttcccggccgtgttgcatgcaatgttttagtataagcggcatgcattaatccgtgccgtgtgttaccactcattggctcccacaccggcccccgccttttacgagattggctagcacaatgattcccatgggagagcgtactcacatggctggtcgtactgcctgtttgcttgctgctggagcccaaaaaatcaacgggtaatcaagctgaaaggactaaataaagaggccctgtcgtgattaactgagagatttatggtgcttatattagagcatgtcgcgtatgagaccgtctgcagtagtaggctgtaagccactaattaccctatcgtgtttccccagcttttgtcagtgcgctcggcttctaatttgaccacacatgatgtacgctaacgtgctgtcctgtactcctgtgcctgtccaggctagtcagtttaggctgagtttagttccaaagtttttttttcaaacttccaattttttcatcacatcaaaacttttctacacataaaatttcaactttttcatcacaccatttcaattttaaccaaactttcaattttaacgtaaactaaacacaccctcagacaaatcatgtagaaatcagaaagaccagatcgtccaatactgtccagctttcggcccatgggctttagaccatagcctattagctcatactaatcacaacgttgggcttcttttcttcttttcctggattcctaacgtataactggcatatatccgaaaagaaggcactatgtaagggggatcttaatgggcgatcgatcgtccggagacgggggtagcgatcgatcccctcccccctccacccctccacctggtttcctttgttggcaccgcattactttcctattttagtaaatttatacacctaaagtttatacacctcaagtttacacatctaaagtttagagaccaaaagtttataagtcgaaagtttatatatccgattcaaaattgaatttgaattcaaatattttttatatatatagtatttctatacatctaaagtttatagacctaaagtttataagtcaaaagtttacatacccgtttcaaatttaaatttgaattcaaatattttctatatatagtatttctatacatctaaagtttatagacccaaagtttataagtcaaaagtttacatacccgattaaaatttgaatttgaattcaaattcaaatttgaattgaaatattttctatatatagtatttctatacatctaaagtttatacacctagggtgtgtttggataatgggttaggagaggtgggattgtgaaatggaaatgaataaaaggataggatgaaatggaatgagaagaatggatggctaggattgaaacttaccctttgaggggtgggaaatcatatcccaaacccattatccaagggggctgctatacaacggaatcccgttttcgaacgggatgagttctgatacctaacatgtatcatacgtttctaccacatatcaggtgatacttgcgaggtatcagataatatctatcatgtatcatgcgattcttaccacgtagagggtgatacttgtgaggtatcaggtcctaatacctaaccggtatcaagtgatacctatcaggtatcatgcgattctaccacgtatcaggtgatacttgtgaggtatcagatggtacttatcaggtatcatgcgattcttaccacgtagagggtgatacttgcgaggtatcaagtcctgatacctaaccggtatcaggtgatacctatcaggtatcatgcgattctaccacgtatcaggtgatacttgtgaggtatcagatgatacctatcagatatcatgcgattcttaccacgtagaaggtgatatttgcaaggtatcagatgatacctaccatatatcagaggtcgagcaccaaagacgtgcatagccgagtggtcccaccatccaacgtaccatgccggagcttgtcgccgagcggccacatctatccaccatgccgacaccacgtcagagttcgttgccgaccggaccgtgtcctccgccatccatgccccacgccggagctcgtcgccgacggccgcatcctccaccgtccacgccatgtcggagcttgtcgccgatggccgtgtccttcgtcatccactcccaggccggagctcatcaccaatagccgcatcctccaccgtccacgccacgtcggagcttgtcgccggcggccacatcctctgctgcctcgacgagctagccaggtacgtgctcgtcgtgctcgcgccgatgacggcagcgagggcagcaccttcgtgctctacttcctcatctgccgccgtgtccgtgttgggatcctcctctcctacgccggcgccggtgccgccggcgagaggctcgcggtcgtggcgcagtgcgtcgatggtgcgggcgtgggtgccacagccggcgccaccggcgaggagctcgcggttgcgggatagtgcgtcaacggtgtgggcgtgggcgccacagcgccgccacccatgtcggccatgcatgcgtgcatgttggagcggcaccgtgtcctgcacaggcagctgctgctgctgctcgggacgtccatggtcaggtatcgctcctctttgaataagcaagagtcccgtccggacgggattccggtatgtagcattcccgttatccaaacatggccctaaagtttatagacccaaagtttataagtcaaaagtttacatacccgattcaaattcgaatttgaatttaaattttttatatatagtatttctatacataaatttttttaaccttttgtttgtgaactgtctcttctcccaaggaaactactttctgggtatcgaccgtaataggtagagggcgtggtataggaaaggagtagatcaaaagtatctgcgcagaaggaagaggaacaaaggaaggcgacaagaaggccaagcatgcccgacgagtcaactctttaaaaagctaaaatagatgccaaccgcacatgaattgcaagaatgcggttagtgattgattgtgaaaggttttttttaaaaaaattgtgtggtgtactgtaaatgaagagaagaaggggagaaggaaggagggagaggagggaggagtgtatcgtataggggaggggccgggcgggtgatcgctgggcggacgggggagcgatcacccacccagggtaccattctcgctatgtaagagtagagaaggtattagtatctgccaagaacagaatattattggcctcttcacaaatctagcggtaggtaattaggtggtaacttagatttttttttttaatcttccctaccgcaaagaggtaacctgaagaaggcaagaaacggagtgggaaacacacgggatctctttccgatggtggtaaagaatagccgtcgaactaagcaacggataacctgctgcgcgaaagagagcctgacgcgaccgtcttttccctgaaatttgctcccactcttcaaagaaagttggcgtgcgcatctcaaaagaagaatcgcagcgacaaatcaggtcacctcttgcttcctggaataatggggaggcatgcacacggccgggaggccggcggcgatggataatacggcgcacggcgggctatctggccgaggcggcaccctccagatttgggccttctttgtttttgattcttcggggccaaaagctcggttgctttgctgctactgttgttatcgtggaaacgtcctttacagagtccgagacagactttgcaagggaagctagccagctaggcatctgccaacactggagagtttttacccgcgaactagtccagtatcaggcatgcatgcaaccgtcaacctgaagaaaagtcactactacaaaacactctttgggtttcgattggaaattttatgttggtgtcggatttctcaaccgatatcctactagcgacatcgataaaaattaattatattgatttaggaattaacacctttgagaattaggaataataataataataataataataataataataataataataataataataataataataataataataataataataataatacctttgagaattaggaataataataataataataataagattggccctaatgtatcggctcaaatcgagccgatacttcaagcgaccccacatcacctctgagatcgatcaacatcaagaatcgactagcatgctaaagaatcaagatcacacaaaacttacacacatcaagaatcaactacacattacagaatcaagaatcctaaccttatcaaatttcatataaaatcacaattttttttctcaaactccatccttagattcagcacaaaagaaggcaataaagcaatagcctgtcgtcgcgctgagaaagcgagggaaccaccgccgagcctagggagaatgagggagttgccgccgtcggtggtgcagcaggcacatagttaatttttttttggggggggggggcactgtcgatgtagggggaatgagtcgccgccaagccaagggagtggaagggagttactactgtcgagctggccgtcccaagctcatggcaaccggatttggtggtcctcaacttatggccgccactgttgtctacccatcaaaacaccaccgagctctaggctaccagatccgccacttcccactcacgcgccatccttccactgtgaagaagagaaggagagagccgagaaggaggatatgttgcgggctaggagaaggatatgaggtgtgctgtgagcgaggaggaggcacattggtgatggtggacagaaggcgactatgtgggtgaggaggaagcgccgacaatgcgagaaggcaacgctgctggcgaggaggagcggtggcgacagagagaacaagggtgaggagagacagaggacttaaaaaggcgagaggataggattggtggactagaggtagtattctctccttttttttatcttaatttcgaactaaccaacgtcatacgttaaagtgtaattaa

SEQ ID NO: 80554 - DNA, 7068 bp, Oryza sativa
gcattacacatcgaaatattacaaatacttcgttttacaacccaacctagttctagttaactataatcaatttatataatgcaaccaaaattttctcaccttcatataattaatggttaaaagtttaacctatagactatagcatcaagtccatcaaattaaaattactttcatgcctcaaccataatttttcatccatccatccaaccaaaccatccaaaaattaacattaccacatatatggttaaaaaaatagtgacaccaatgagtacattgcaaacatgtagcactacaacaagccaatcctaagaacaaatgctaaaaatcacaaatttgggtaaaaaaggggttctagggttacccaccgatctacaaattcaaccaataaaaacgaaaaaaaaagaggggtgaatgaaggagtctacctttctcttcgatttccacaaaaaatcccgcgaaaaacgagttcaaatggagtggatttgaggtggggaggtgaggaggagagagagggggagagctgctgctgctcagctcgggctggtgcttgggcgaaaatgggagtggggaggagataggtggtggggcccacggggtttaaggggtcggcccacagaggaagggtggcgcagccatgctggcgccgtggtataaggggcggcgccagtgtggctggcgcccccttcggcctagtcagcacctccacgacagccctactgccacggtggcacgggcacggcgccagtgtggctggccccgccatgttggggtacggcgccagccactctggcgtcctaaaaaggaccatttccggtttaagtttttttaggggtctatttgtaaaataagtttttaaaaaggatcaaaatgtaaaaaattttagtgccggcggctggtcacactggtcgccaggctgcagcagttggaggagtgcctcgcgcggccggggccgctgctgtcgccggagacatggagccgcgtctcgacggtgcacaccatgagcatcatggtgtgatgaagggggcggggcgcccgcggcccgcggtgcgcgccggccttctgctgcacgcagttctgcttctgtactgtgggaggctcactaaggtgaaaattctgtagtttcttacttctcgcgagagctcctttgggatggggaaaatctggctcacatctgcgaccttgttcgtgcctgttttccttgttgctgcatgcggttctttgcttccttagacctcagagctcagacgtaagcaacttattcatgctttgtaaattgacccacttggtgcatttgtttccaaggacaaaatcttcgtacagacgctcttatgtattcacacagtcaaagtgtttgcggtacatgcacttgccgtagagatctactccctccgtcctatagaaaatcaatagtactataaatatctggttgtaggttgagttttttttacggagtgagtagtgacattaggttgatcagcacctctagcctggcagcgcgctaagccatgtcgtgaccaatcgtatctgaatacccgcgccatatactgtaccatgacgcaatctccctgttccggtctggaggccggcgcaagtacagtacagatctattgggtgggtcagggtggctcgtgcttggtttttccacttttgggatgtactatctgactatatctggcccacggcaccccggcagaggcccatgggttttcgctgaacatgacaaaggctagcgccgcaaccatctgcgcgggccgtgcggctccggttgttctttcgatatgggctattgcgttctccttcgggaataagatcactttgactccctcaactgaccccgaatctaaatcgtatccctcaaccgcaatactagaaatcttaacccccgaacttacaaaaccggtgcaatttgactccctcggtggttttggagggtggtttcgctgacgtggcgcacacgtggcagtgttgacctagtctttgtacaacgtggcattgacgtggcgctgatgtggaattaaaataaaaaaatatatgcgggcccatttgttattcacaaaaaaaaatttgtgggacccattggtcccacatgtcatcctcccttatcccttcttcctcctccctctcctctcttctctatctgtccctctttctcttcatgcgagagcggtgtccggaacggcggcggcgacggcgggcgatggacgaagcagcgacggcggacagagcggcgacggcgtatagtgggggtcaaaccaccccacaagctttggcgagattcgaaacacggcggaggagtttgccgtcgccgagatgccgcagccgccgccgtcggtgtgcacaaggagcgtcacctccgtcgcgctcccgacgcatggagatggcggtggctgctgccgcgtgccgctctccccattcgacgcatactgggtcgcgctgctgttcgtccgccaccaccaccgttcggagacgtcgtccacgcactcagggactccctcaaggcgttgctcccagcgttctaccgcttcgccagtgcgctggtctactcgccggaggaggaagaggaggaggggtcgctgtccatcgtcgtggaggccggaggcggcgtggcattcgtggaggccgaggcgttcgtggcatcggtggtgcgctcgccgcgggggatgatggtggcggggctagggccgcgctttgccatgcagcagcagccgacggtcttcgcgttgcctccgccaccgccgccgcagtagcaaggatttggcttcggcgggtccgggactggagcggtgctagcgccacgggagatggggaacgctgccgccccagcggccatcgagccccctgctcctgccgccaacttcccaagtctctgcgaggctgccacgggcgcggccggcagcaagtccaagaggaaaaaggggcggtctcgcggcggacgtggtcggggagggggcccgtgtcgaaggaggaggaggagctccagtcgctgcttcgcatcatggccaggtcgacgccggagcgctcgaggccagtccaccgccacgcgttggggcgcgcgagctattgctccctttccaccgcggccaccgcccaccttgccgtcgatgccgcggccgccgcccacctcactgcccacgacacagagtggggacaaggagcggcggctgggagcgtgctcccatctcccccgacgcattttgtcgcacgtcgcccgaggtccaccgcccatttcaaggagtagctgctcccgcgcttgtcgcccgaggtccaccgcccatcgcagccaccactccggcacccgctcgccgatgccgccaccgagcccctgccgccggctcatgtcaaggggagagagagagaaataagggagagaggaggaagaagggtagtgagagagaagatgacatgtgggacccacatgttagtgggtcccacatttttttttgtgaatgataaatgggtcccgcatatatttttttattttaatgccacataagcaccacgtcagtgccacgtggaataaagaccaggtcaacactgccacgtgtgcaccacgtcagcgaaaccgccatccaaaaccaccaagggagtcaaattgcatcggttttgcaagttcgggaggtcaagagttctggtattgcagttgagtgatacgatttagattcggtggtcaattgagagagtcaaagtgatcttattcctctccttcgagggaggacaaatatgttccacgataaggccgtaactcgggcctagtatatgcagcccacgacacgcacgaacagcatgccgggagcgcacgcggcacgccaacgccattgatccgccggccggcacccgacgccgcgccgcatacccaccaccactgccgcgacacgctcacgtcaacaagccttttccactgccgcggcgcatttatccggcgagtgaccatgagcccatgatgactcctcccccccggcctcaggccctggcgctgctgcatggcaggcaggcttgcaacagcatcatgcgattcatgccagtgaaacttccgcccgccgcgcctttacacatcagagtcaggagggtgactcagctgcagcctgcagatagctctgtacagtacagggcaatccgtgagagcccggcccgggaacgcgcggtcaacatacgggcacccaccaccgcgcgcggcgcggggcggcgcctcctgtccgagacattcggcgggggctcgcgcgcgcgggcaatgatcattcacaccgtgccatgataagcagtggcacatggatgatggcagtcaggagcaatggctgatatggtcacacatgtccggacgatatggctctcttcctccacacctcccgttcaggattttatcaactgatcgacctcggttcctttcacttatggcgagacaggtgctatctagcagcttattgcctgcgaggccaggccatcatccggttccttgcaaatcaagccactctacccagctttcggatgccatggtttttagccaacagggtacgagtatgaatgcttcaagtgatcataaaatctatagcttcccttcacaatctactcagttcagacttcagtgtatccttgagtgcgaaatttatggcgctaggggaagccatgatcgagcctgtagcattattcaccctgcgtgtgtagtcactaatcaggcacacatgactggttatccaccagctggtcgcatgtgaatggctactagctcgcgatatgattctgacggtgaaggggggcatcatctcggcaggcgttccatcacggctagcagcttcctgcttgccaataagggcgcgagcacgtatagtagtttcagctttctttgtattttcgaaagaaagtttcagtatatatatatatatatatatatatatagtttgtgcttgtgttgcagagcatcatatggcaatccttgcactacagttccgttcgtgccgggcgcgacgcctacttcgcttctacgtcactgaatcgaaggagtgggctgcagttactctccgcgcgcagacaccgcatttacctttgtctcgtcacgcggtgaaagtgcctgtctgggaagtaactttcccgtctcaggcctggcgaatgaattccctgcgcagtgcaggtttgccgtccgggccctagcagtcaaccatgctcgcatcaccatcaggatcagattgcatgtacatgtaacgtgctacctaacaatcctaacaaaaaaaaacacaatcctaacaatcctaaaaaaaacacaatcctaacaacaaggagatattagagaaaaataaaaataatcaaaataccccctattattgaaaaaaataataatgttgataggtaggtaaaggatatttaagagagaaaacttctcgttttatgtgtcgagattacgtaggatggtagaagttggatttttgttacgataaaattcaaatttcagaagttgatttttttttacggagggagtacgccactgccaagttcattcaaagtgagaattacccaaagatcacatcacactcgttggtagatgtacatctactccaaacagcttctccggcatctcaaaatttaacaagggatcttgggactgaaataatagtcttatccacaaatacaagagatttcagtgcttaaaatttatccacggatataaatggattttagatagaaaaaccattactattttgccttcccatctaacattcactgttcgctgttagttgcatcgctatacgtgaattttcataatcaagtatatatagtctcaggaacatgaagatagtaattcacctaaacattaaactttgctaaataatttagaatcaattatatttatggaggaagaaagtagtaggcgctctagtactactcctacttcatttacttttgatatatttccatctgaacaccacaaagctgaaattgacaggatgtggctaaattaaagatcacacaaattaacaaagcaagacggaacctttcttatatcggtcgtaatatgaaaacagaaaaaccgttcttgccgaacctggtaaaatgagctgatcgataagacctggaaaagaatgagctgatcgataagacctggaaaagaatcacgcaagactaaggtaacggtattactactcccactcctacaaactaaggccatgtttagttcccacgtaaaaattttacaccctatcacatcgaacgtttgaacatatgtataaagtattaaatatagaaaaaaactaattgcacagattgtgactaatttacgagacgaatcttttaatcctaattgctccattatttaataatatggtgctactgtaaatatttgctaatgacggattagttagacttaataaattcgtctcgctgttttctgacggattctgtaaatagttttttttattagtgcccaaacaccccatgcgattcctatataatatccgatgtgacacgcaaaaactttacacccctgaatctaaacaccgcctaagtaatttcaccctttgtggcttttatgtctggagatggggacagatgggagcagttggtatggggctaaaaaattttagtcctatcacatcggatgtttggacactaattagaagtattaaatgtagactaatgacaaaacctattttataaccctggactaattcgcgagacgaatctattaagcctaattaatctataattagcctatgtgatgctacagcaaacattatctaattatgtattaattaggcttaaaagatttatctcgcatattagctcttatatttatacaattaattttataagtagtccatatttaatactttaaattaatatccaaacatttaatatgataagtaataaagtttagtcaccgaatgcaagcacccagcagagagagagatatcagctcggctgcgtaggtatggaattatggatgatgcgggctcggcgagaggtcgatccatcgatgaggacgacaatgattggcggcggtggatggtcgaggacgacaggacgacacgcgtgagagcggattgttggtggtggcggtggcggtggggggtggggggtgat

SEQ ID NO: 80555 - DNA, 43488 bp, Oryza sativa
  unsure (1)..(43488): unsure at all n locations
ctctcgggagtacgacgtgtatatattggaccggctcaccggggcgcgtgtagtacgtacgtcagggcaagtggtagtacaccgtttaccgtactacacacgggagcgaggcgaagagttggcggccaacaacttgacagcggccgcgtgggcagttggcgcatgtacacgccgctactcctgtgtttagagagtttggattggaccggttgtggctaggctgggtggaccaggtgcattgagccgctgcgagcctctcttgccgattaataagcagccagtggtacagtgggatgatagccacggaatctccgatctgggatgaatggcgagaaccgatcgagagaagatcttttaattaggaaagagttgacctttgcttctcagctgaggggataactaactgaactatatttggaactgttaatgcatcgtctctcttcatcaaaatggaaggatgtacattgacttaagcaagcgtgcgatatgatctatacttgcaaaacggcgtcgtcacataatcttatgtaagccatatggacttctttgcaccgtgtcgaagaattttgcggtttgcaaatgacaatttcgcactttcgacgaacgtgcactttcaacataaacgttggaaattttgaacatcgctctagcaaaaatgtacctgatactattctgttccctttttataggaaaaataatgtgctctacacgggttctagttaatcacctccgaaacaggataatttaattagacataaatatatatgaacactcatatcaagtttaaaacttgaactagggtaaacagatttaaaaaaaaaaaacctaatcagttaaactatacttaccttattgttatccgctcattttagttttactaggtgatataagagccataaaaatgtaataccccctcagtcccaaatatatagtaatttaagattagattagatatataatagtattatgaataaaaccattgttctacgttactatattttagaatcgagagagtaacatcttacattcttcttatactccctccgttccagaatataagaagttatagagttgggtacggttattaagaaagtaggtagaggtgaatggtggaaagttatgattggatgagtagtgaagatatgtgtgaaaagtgaacggttaagggttgtgattggttggaaagagaatgttggtagagaagttgttatattttaggacaaatcatgatgaaccctgagttcctctcgacactcaagactgttgttggcccgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagataaaagtaatctgatattgcaaataggaattcaatacaaatgataagttggggttccgaagaacaagcagacggacggtctagccgacacgcgcgctgcaagcaagtagcaatggctaaactttattctaacaaaaccccagaaaccctgaaggggtaactagctatatataggggtgggaggatgacctaggggtgcctagggtcgtgctccaccagcttggggcgcaccccacatgggccccacctgggccggggtcccaaatgaagttacaagcccatagtcccattacaggtgtcgcagcaccttgtttcttcagttgctgccgactgagatggaatttggcaatgaggcttgatgcattggaaagaggactccgagagctttccatcaagtactcacgggccgaaaacggaggtcgtatggagcttcggcggccgtttgaagtcagcagggtagtaggtggccgaattggattttgagacttggaggactcgaacttgatatcttgttgtccatccatgaggtgagcaacggatgtatccgtagtagccatggtcacatcaaatcataagagctaaaagttgttatattttgagacggagagattacatgattggaaatctttcacatatttgtttcaggtaataaaaagcccgttctttttttatggtttattctctttcttttttgtgaatggaaaatgtaccacatggtctctgtggctgtgtttttcttgtaagaggaaccgcaaatacacaaactagagaaaagactcctctaactttgtacagtttgtagttgtactactgagatgtggatcataacaaagtggagcccacatataagtggcacaactgtaaactaagggcctgtttggtacagctctaactcctaaatattgctccaggagttgagtctggagtggagttngaaaaacccttccctggcatagatttgaggatctgatatactaacaagccaatgcaattatttaattctatggcaaatatgcatttcagggaacttacttctggaggtccatagccgctaggggcaatgaagacaactggatgcccacaaaactccacctgttcaactgggccgatcatgttggagaatgatatggtagtatgagagatcatacgatggaagatagcagctgctgcctgtttgattcacaagttgcaatgatattgggaacaaagaaatccacaggggatgttttttggcgcatggctcaaaatttggcgctgtaatgctctttctaggaaacaaggaagttaaccactgccaacaactgggactgtacacaatttctagtgaatatcacaatcttgtacacctacgattgtattttcttgataactaaattagcatggttagacagcaaatactaaatcaggtattcagttatacttggagtatcctgaaatctattgttttgtgaactaaaccagtgcttgtcaatagaaacaaagtgattatcgcattgcctgccaagataataatataaggatcaagttgctgatgaggcgatagtacaataaaggacaaatttaccttgagcccaaaaagtttgaggatcacttctgcagctaaatgagtgaataccacttctaatgagctcttcttcctatcaacaaccttctttgctttccgaacgtagtctagtggatctttgtgcacgcctatgaagaacgggaggattatgaaaccaagtgcatttccccatttcacttcatcctctctgccagaattgatcatatctacgtatgcctggccattgaaatgggaaagaaatcacaatagattttaccagtccaaaattgctaccactacaagtatagcaacaacaatgttcggtcctgtgagcttaaattgccaatcttgaatccaagtataattattacatgcaggcttgtggttggcctcaaattgacaaggaggatcgatctcaaacgtatatcctcgtcagtgtccatgtcacctgcaaaggagaacaagcagcgtgggagtaaagaactactgtatcagccaggccgcaatttaagagctactgtatcagccaggcagcagctgctggagcatgattttattggacgcaattggtcacctgacttccggtagtaatagcgcgacagtgcagagtacgtgatcccaaccagcacatcattgaccgtctgcgagagtgcaggcaaacataaagagaggaaataaatctccccagaacttttgctgagggttctgtcctttgctacattcaatttgcaagcaggtgaagtatagaaatggagggaaaatgatagacagaaaaaaattcgtgtttaatgattatgtatactaatattttatccattttaaaataaaaaatctgataatcgatatggcataatctaggaatacgaatctaaaaaaatctattatagagacggagagagtaggtcctatgtggaagatattattacttctacagaccgacagtttataagacagcaacactagaccaaactaacgaaaaaccattagtcttaaaaattttatactctcttttttcttttttcacttgttagcaggatactttgactacatgacttctaaaagagtatatgtaaaaaaatttgtattatcaaagcattttgcatgctaaatataactatactatttaagttcataaaaacatcgtaattttatttaaaaagatactggtcaaagataatatcatactagtcaatatagtggagtacttctaatcttagatcaaggctagaaagtgacaaaaaacgaaattccgtaaatcaattctaaaattttaattttaaagttttctgcaatttatatgccgctatatactcaaacaaacaggctctctaagaactaaagaaaacatcgcttacgcagttcatggcgttcttgacgagcttgacgtcatcaaggctaagcccccggtgcacgatgcgcttccgctggaactccccgtgcttcacccgcttgaacagcgtgtgcggatccttgaggaacatggtcgtggcgaagaagctcgcgacgtccaccacggtgtgccacgccagcgcgacgaacgaccagagccacgcagggaacgccagcgcgcccgccgacgccggcggcctgggccgcgcgtagatcgcgccggtgcgcgtcggctgcggcggcatggcgggcagcctcgccgggtcggcggcgctgcgcgtgcatgccatgaggagcgtgagcagcgacatgccgtccccgagggagtggtgcacgcggatcgccgtggtggccgccgcctccgacgtcgggaagtccagcacgtggaactcccacagcggccgcgactcgtccatgggcttggtggacagcgacgccacgtagtcctccaccgccttgtccgggtcggccgccacggcgtccatgtccaactccgggtagatgatgtggtcgtccaggttcaccgtcgtccgcacccaccgcgggttgccgccgtcctcatccgtcacctgcacacgcacacacacgtacgtaccgttcgtcagatcagcccaagcaccagtggcgagctcctgggcgcgccgcccgcggtacggcaggtgtacggaccgacctggatgctgcggaagcgtgggtagcgcgcgagctgggcggcgatgccggcgcgggcgacggggtcgttcaccggcgtggcgatgccgatcaccacgacgatgaagaagtcctccacgagccgcgcggaggggctgacgggctccggcggcgtcgccgccgcagcccccttgctgccgccgccgccgccgtcgccgacccggaacccattgccgccgttgctgctcgtcgtgcggacggtgagttgccgcttccgaagggcggtggctgcgcctgcacccgcgtccatctcgtgtgggccgcggcttaactgcgtcgcgctagctagagaaagtgtagtgtagtgagctggttttgcatgggcaatgcgcgcgtccaccgcctagctagaccgagaaacctgttccgatatataggccagaaatgagacgagcgttgtgttggtggtagtgcagggtattcatgtggggactgggcgcgcgtcatccgtccgtgaccagggccgacgattcaaccaggggaaaaaaaaacagggctcccgtgaggaagcggcatcttgtctccgccggaaatagagctctttgttgttgtagagtagagatatacaatatacattgcgtgatccagtctgtgtttagttcacaccaaaattgaaagtttagttgaaattagaacgatgtgacagaaaagttgaaagtttgtgtgtgtaggaaagttttgatgtgattgaaaagttggaaggttgaaaaaaatatttgtaactaaacaccggcccaattgatttcttttatgcatcaaattgtgaatatgtaatatttagttgttcgaattatatgctctataatgatagactatgggcatattccgattactgctaaaatataaatattttttagaatttgccgatgttaaaattagcaagttgactatattgctaaagtttaataggataagctaaatatattgttatcaaaattctttaggcgttattaatgtttggtaacaaacttcatcatccacgtgtttgtgttttttttaaatgatatggttcaatgtcacaaatctgaataggctctagaacttcattgaaataaggatggaaatatttttctcggcgagaaataaattttattatcttattaaagcaaaaccgtagtttcatcaccgatcgaaccgatggactggtgacagagggttgactaggagaactgtgtcatgagtcgtgaccgtacagccgccaactgccaacggaatgtgttaatgctactagctttcacgacaaatcgacgtgattaattatgcacgatgagctcgccggatgcgagcttgcgggtcggattcctaaatgtgatagcgatcttacattcaggcgatggtgtccaatggcagttggtcaaaacttgcctagatggttcgagatttcttattaatgacgtgatatatactcctcaggtttcattttaattgaagttttagacaataacacggtttacaaaatatatttttgaccttattttcctattataatatacacaataaataaatacatgtttacttttattatattgctttgaaagacaatctatacgttgttctagtttctttaaactaaatatttttaaagttattgatggtcaaatttataaaagtttgatcttccaaaacatcttattatagaaccagagggagtatagaaatgacttgaatgatgtaccactgtgccgtgtgccaggtgtactcgtatttgtgaacgtactaatgttaattaacgcgtacatcgtccatatatgctcaagtctctcagactgatctatactgctaccaatcacctacatgatttaatatgtacacagttcatgccatggcaaacggagattttattatggccctctttatttaggcttaggtttattggcctagacttttaagttaacttattggcttatatgatttataagacaatggatttaatgtcctaagtttagtggttgagtcatacatctacctcacgtaagccaaaaaagcttctccaacctagcttttggcttaatagtgttaaagtggcttgtggcttcaaacaagccaaacggaaaagctgcttgtttgtttaggtttagacttttcgacttataaattggcttataaatctaaactaaagggcttatgtagctccgcaggcgtgaggcttcttgtgtttccttaattaattgctagtgcatctttggagtgcaaatatctgccagcttcattgtgggacacgaaaaatccatgaacggcccaacgatatataattaattcgcaggcaaacacccgtgtgcctgcggtgtgattgtgttcctttcaactagaatcaacgacaattcgtgttactacgcgcaaacgaaatacggagttactaggtactccatctggttataaatattgaatattttaattttaaattctagccatctacaatttctcaattacagcttttaaaaatagggtataagaaaatcgacaaattttgctacaagacatcagaaatatgtataatttactgatagatattgtaaaaacgtgtcatggctaaaagacatcctagaaaattagtgatttgctgaaaatgacacttctgactcgattggagagagaagttcttcaaatagacaataatatatccccctagggtcacttgcttcaaacatggtgttggagtaaaaatttagaatttatggaactctaaatctgccactaccataaatacatcactagagcatatatcatatttcatcttcaattctttctcgggtaagatatctaccaacaaattacacaatttgaagtgtcctatagcaaaatttgtcataaaaaattgtcttgaaaaatactattctaatagcataaacctattattagtttttataaatttattctagtttaaaatttatgattagaatttttaaaaacttaatcaaatattgttctgaatattaaatatttgtgactagctagagtgagtacaaggagtacagtacaagagcaaatgtgttttacagagcatactatatgcttggcctccatgcatgcttatgtctcaacgtcctagaaggaggcctcgggatttgttggaaatttgtctcccgaaatctggagctctccaaaaccacttgagtttttttaattgaatttcaaatgaaatttatcaaaatttatgaaattcgtcatatcactggcctagcactagcatcttgacccttcaatgaaagtgtgaaccttaagagacttactccctccgtctcaaaaatactcaacctaggagaagatgcgaccctcatagtacaacgaatctagacaacttctctgtcacatcatctcctaggttaagttttttttgacagagggagtataaaataagcccaaaaaaagagtcaggggttaagaactctagtgaaaaagtttgtggaataaatagactttatttcctaaattttattaaaaatactatcctaaagtactactccctccggtttcaaaactgttagacattttgagatttacttggtcaccaaagacttattagcccttgcatgtatacatacattcccagggatggcaatgcttcgatccccacatgcacaaaattcaatggtggactcaatccactagactacattagagcaaggctaataggaacaagtttaagtttaatagtatagccaactactagctccaattcatttatagtcaatctaatagctcattcgagttcgtgctacagctgactataaatctgtagtccgctgctcttctctctccttatttatctccttaaaatatgtttatagctggcttatagcctgctattgtacctgctctaatacagccgaccttttggctataaggttttttgtggtcttctctcacccacccatataatagttagctctttacaattaatatagggctcacttgattctctcatagagtttcttggttcttatgtccaagtcggttgtaagtttacagcccacttcttctctcctcaacatcagcatttagtcggcttatagcctactattatacttgctcttagaatttcaagtataatatgcaaactaccgtatttaatatgggcataatagagaataggcacccaaataaatccctccttgtatatgagatcatgtctaaaacgttaagattatttttgaaactggagggagtacttctcactccaactactgtcaatttaaatttctccccatcttacttctcaaccaccctctctcttccaaagactgctttgtttaacgaggacgtatagatcatttaccttccttcccaatttgtcttataaatgctagaattgtttaacgagtctgtttctttgggttcataactgcaaagtaatgtagattacatacaagcttctccatacaaacttatgcgcatttcactgtgatgttctctacttttcaaataatacaacgaagatagtgatgatgaggatgctgacaaagttgttgcgcagcctgagtcactagaggtataatactgtactgtttacttgatggaaatgcatgcaatctgcggttctcaaattagccttgcaaatttcttcttattactggcagtgacaacagatctttcagttcatatacacatgcttattggaggctgaatgcctctcttgcagtacacatggaaatagttgatttattgatgagacagggaacttagccccgcaaacccaatctgaaattttcgctccataggagatttgaactcaagggtatttttttacccggcctctacatccaatggatatatacggccattgaaatagagaacttagccccgcaaacaacctaatctgaaattcgctccataggagatttgaactcaggactttggggtactactcaggtcactgtaaccactaggctatatgccctttcgtagttatcgatacttgtcctacttgaaagcttgtcattcctttgtattatactgctttaccaataggatgatgaagatgatggggatgatgctgaggatgctgaagggaaggtcagtcgtaattggagtgttctaaagactgccggacattctgaaaagccaaaggtaccttttcattattatcagttgtgttctaatggaaaaaagtgcagccttttggcactaacaaatgctgagcgtgtagcattcttgccagtcctattcatgagtcttgcctaatcatgtgcatatggtttagaaaattcatggaagtgtctaatgcatgcatagagtttgtaactgtatcaactcccactccaagcacgtaacgtaccctgtcgtaatggatacattcgtcagtgatcacaactcagtaactcacggaaaactcgaagaaagatcaactgtcactaaaagaagctattgcagattctgagaacttgactgattttcttatggactttgaagaagatgagtaatatctgggcatttactttactatgctacacgtacgttacacatggtaagcaaagtaaagcatagcagaccaccatttattcttattttttcagagaatatttaaccaaaagccagagcttgttctctggaaacttctgatcataaaacatctgatggtttcatttgactttagatttagttgctacagtgcatacaaatagataccacttaccagtagtattagatatttggatggtactccctccgtactcgtaaaggaagtcgtttaggacagcgacacggtctataaagcacaactttaacttcttgtttctataaaaatatttattgaaaagtgatatatgtatgcttttatgaaagtatttttcaagataattttattcaaactcaacaatttgagagttatttatatcacttttcaaactcaacaatttgagagttatttatgatttatattttcaaggtttgacttaaatattatcctaaacgacttcctttacgagtacggagggggtacaatcattcttacgaatacatgcatgtgtgcaatgattaagtagtgccttaagccttggtgtgatgctttcctaggctcaaagctgcatcctttatctgcctgagggattcggaaaaatcatccaaaagctcatgacaatctggaaattgtgcctcgtccacggcaagatttaccatcatggtgttaacgtaactttgaaaattcacggttaaggcctacacaagcaaaccaaacagttagatgtaaattaggtcttgctcatcacatctgtacccagattccatgacaaagtgaaaaaaatactttcaccatctacaacgctgaaggattattcatcactatgcacttgttatccttgttataaaagtgtcatacaagggcttaattacttcttttttcaacggatcaaagcaattagtttcagtcagattaccttattttcgcgatgacttaatgatatatggtagacagctaccaggctatatttcatgggaattttttgggtttttttttttcatactgtttttgccactaagccaaggatcatcgcatgttctgacgttcgtcattcatttgttttttagccctagtgacaaaagtgagatgctcatagcaaaaacaaggtatcatcattccttagtggcaaaaaaacccttccctgtcatagatttgaggatctgacatactaacaagttaatgcaattatttaattctagggcaaatatacatttcaggaacttacttctggaggtccatagccgctaggggcaatgaagacaactggatgcccacaaaactccacctgttcaactgggccgatcatgttggagaatgatatggtagtatgagagatcatacgatggaagatagcagctgctgcctgtttgattcacaagttgcaatgatattaggaacaaagaaatccacaggggatgtttttttggcgcatgactcaaaatttggcggtgtaatgctctttctaggaaacaaggaagttagccactgccaacaactgggactgtacacaatttctagtgaatatcacaatcttgtacacctacgaattgtattttcttgataactaaattagcatggttaggcagcaaatactaaatcaggtattcagttatacttggagtatcctgaattctcgattgttttttgaattaaaccagtgcttgtcaatagaaacaaagtgattatcgcattgcctgccaagttaataatataaggatcaagttcctgatgaggcgatggtacgataaaggacaaatttaccttgagcccaaaaagtttgaggatcacttctgcagctaaatgagtgaataccacttctaacgagctcttcttcctatcaacaaccttcttggctttacgaacgtagtctagtggatccttgtgcatgcctatgaagaacgggaggattatgaaaccaagtgcgtttccccatttcacttcatcctctctgccagaattgatcatatctacgtatgcctgtggccatagaaatgggaaagaaatcataatagattctaccagtccaaaattgctaccactacaaatatactagcaacaacaatgtttggtcctgtgagcttaaatggccaatcttgagcccaagtgtaattattacatgcaggcttgtggttggcctcaaattgacaaggaggatcgttctcaaacgtatatcctcgtcagtgtccgtgtcacctgcaaaggagaacaagcaacgtggtgcaaaggagaacaagcaacatgggagtaaagaactagtactactgtatcagccaggccgcaatttaaggtggtgtttgatccagagatttaaatttagtctctgtatttagacactaatttagagtattaaatatagactacttacaaaactaattacaaaaatgaaagctaattcgcgagacaaaatttttaagcctaattaatctataattagagaatatttactgtaacatcatataggttaatcatggattaattaggctcaatagattcgtctcgcgaattagtccaagattatggatgggttttattaatagtctacatttaatatttataattagtgttcaaacatccgatgtgatagggacttaaaaagttatcagccaatcagcagctgctgtatcagccaaaattggtcacctgacttccgttagtaatatcgtgacagtgcagagtacgtgatcccaaccagcacatcattgactgtctgcgagagtgcaggcaaacataaagagaatgaaataagggcagctaaaattgaaagtttaattgaaattagaatgatgtgatgaaaaagttgaaagtttgtgtgtagaaaaattttgatgtgatgaaaaaattagaaatttgaaaaattattttggaactaaacacaacgtaaatctattattttggaactaaacacaacgtaaatctccccagagcttttgctgagggctctgtcctttgctacagtcaacttgcaaacaggtgaagtatagaaatggagcgaaaatgatagacagaaaaaaaattcgtgtttaatgatatttgtatactaatattttatccattttaaaataaaaaatctaataaacaatatgacatacatattctaataatacaaatataaacaaatctatttcagagacggagagagcaggtcctatgtggaagatatttttactgctaaagacctacggagtacagtttataagacagcgacactcgaccaaactaacgaaaaaacattagtctcaaatttttacattccctttgttcttttttcacttgttagcaggatactttgaccacatgacttctaaaagagtatatgtaaaaagatttgtattaccaaagcattttagatgctaaatataactatactatttacgttcatcaaaacaacgtaattttctttaaaaagatactggtcaaagataatatcatactcctagtcaatatagtggagtacctaatcttagatcaaggctacactactagaaaaatagtttttacacaggcggccaaaaaggttttcgcaggcgggggagtcatccgcggctatcccatcgcctgtgaaaataggttattttcgcatgcgggtccatggcccgcctgcgaaaataaagcgagggaacaaaaaaaatccggcgctacccgccggcgccggcatcctcctccggccgatggctctccacctccgtccggtgccgttacccgagggcgaggggagcgccgcctttgccgccgctgctggccggctcccctcttccgtccagatctgggaggggagtggccggtgctgtctgcgccgccgccgccgtcggcgtctggggggaaggaagttggtgcccagagccgccgccgctcctcttggccgccgcctcctccttgcgcgcatcgaggcgccgacggccgccggctgctcctctccttgcgcgcgccgaccaggccatcggttcctctgacgtcgtcgcggcccccttcctctcgccgccgccaacctcccgccaccgccgccgccgcactcgtggccaccgccctcaccccgccctccggccgctggccaccgccctccgccgccgcctccaatggtagacgccgcgcgccctacaccgccgtcagcgccagggagaggaggagaggtgaggggtggggagaggtgcgggagagagctgagaggtgagggaaagaggacatagaaaaaatctagggtatgtagcctctatttgtattcgctatgtattttcgcaggcggaccatatttttgcaggcggaccacttatatggtccgcctgtgaaaggcgggcagtgggtttcaccccgatttgtatttttgtaggcatctatttggctccaatggtcatacccgtctggaaaaataaaagaccaatgttgctaaaaattactccctccatttcataatataaagcacaattacttttttttaaatgttccataatataaggtatgcatacatgtaggcaattaactatggccccttctccattaaattattattttttaaaatcatgcactctcatgttccctaattctattagattcatgcattgtatttattaggatgatccaaactacaagatgataataattatttcttggtcttttagttaggggtggttatgccttatattttggaatggatggaatatttttctagtagtgctagaaagtgaccaaaaacgaaattcttaaattttaattttaaagttttctgcaatttatatgccgctatactcaaacaaacaggctcgctaagaactaaagaaaacattgcttacgcagttcatggcgttcttgacgagcttgacgtcatcaaagctaagcccccggtgcacgatgcgcttccgctggaactccccgtgcttcacccgcttgaacagcgtgtgcgggtccttgaggaacatggtcgtggcgaagaagctcgcgacgtccaccacggtgtgccacgccagcgcgacgaacgaccagagccacgcagcgaacgccagcgcgcccgccgacgccggcggcctgggccgcgcgtagatcgcgccggtgcgcgtcggctgcggcggcatggcgggcagcctcgccgggtcggcggcgctgcgggtgcatgccatgaggagcgtgagcagcgacatgccgtccccgagggagtggtgcacgcggatcgccgtggtggccgccgcctccgacgtcgggaagtccagcacgtggaactcccacagcggccgcgactcgtccatgggcttggtggacagcgacgccacgtagtcctccaccgccttgtccgggtcggccgccaccgcgtccatgtccagctccgggtagatgatgtggtcgtccacgttcagcgtcgtccgcacccaccgcgggttgccgccgtcctcatccgtcacctgcacacgcgcgcacacacacactcgtgccgttcgtcagctcaagcaccagcggcgagctcatgggcgcgccgcgcgcggcaaggcaggtgcacggaccgacctggatgctgcggaagcgtgggtagcgcgcgaactgggcggcgatgccggcgcgggcgacggggtcgttcaccggcgtggcaatgccgatcaccacgacgatgaaaaagtcctccaggagccgcgcggaggggctgacgggctccggcggcgtcgccgccgccgcccccttgccgccgccgacccggaacccattgccgccgttgctgctcgtcgtgcggacggtgagttgccgcttccgcaggacggtgtcggtgtctgcacccgccgcgttcatctcgtgtgggccgcggcttaactgcgtcgcccgtcgcgcgctagctagctagagaaagtgtagtgtagtgagctgagctggttttgcatgggcatgcgcgcgtccaccgcctagctagaccgaaacacatgttccgatatataggccagaaatgagacgagtggtgtgttggtggtagtgcagggtattcatgtgggggactgggcgttatcggtccgtctcatttctggtggtagtgcagggtattcatgtgggtactgggtgttgaaaatactggacctggccgacggttcaaccagggggaaaaaaacagggctcccatgaggaagcggcatcttgtctccgccggaaatagagctctttgttattgtagagtagaaatatacaatataccttgcgtgctccaattgatttcttttatgcatcaaattgtgaatatgtaatatttagttgtttgaattataggctttataatgatagactatgggcatattcagattactgctaaaatataaatattttttagaatttgccaatgttaaaattagcaagtcgactatacactgctaaagtttgataggataagctaaatatgttgtaccaaaattcgttaggtattattaatatttggtaacaaacatcatgcatccacgtgtttgtgattttttttttaaaaaaaatgatatggttcaatgtcacaaatctgaataggctttagaacttcattaaaataaagatggaaatatctttttaggcgagaaataaattttcggagtattatctttaagcaaaaccgtagtttgatcgccgatcgaaccgacggactggtgaacagagggtttgactaggagtactgtgtcatgagtcgtgaccgtacagccgccaactgccaacagaatgtgttaatgctactagctttcacaacaaatcgacgtgattaattatgcacgatgagctcgccgtatgagagcttgcgggtcggattcctaaatgtgatagcgatcttacgtactccactactcaaagaaagtcctatagcacaattttcaagtcaaaccttgaaaaatataaattataaataactcttaagttgttgagtaaatagatttgtcttgaaaaatactttcataaaaatatacatatattactttttaataaatgtttttttatagaagcaagaagtcaaaagttatatctttttaataaatatttttttatagaatcaagaagtcaaagttatattttgaagaccgtgtcgctgttctaagggcaagtgctatggtagatgtgactatcacctctaaatttatctattttattcactcatgaattaagaggcaacacatacaatgtatcacctctaacacacaaataccaatatctctaatactctcacacacttcttgaaatttgtgtggaggttatctcttgatttaggggtggctcatcttctctctctccacttctctcctctacctcatcacccaatctaatgtggcatttttaggggcaacatatgagatattatagtacttgctctaaacgatttcctttaaaaaacggagaggagtacaggcttggcagttggtaaagcttgcgtggttcaagatttcttattaatgacgtgatatagagatgacttgaatgatgtaccactgtgccgtgtgccatgaacgtactaatgttaattaacgcgtacatcatccataaatgctcgagtctctcagactgatcttatactgctaccaatcacctacatgatttaatatgtacacagttcatgccatgtagctccgcaggcgtgaggcttattgtgtttccttaattaattgctagtgcatcttcggagtgcaaatagacttttatttcctaaactttattaaaaattggtatagtggcccgcgcagattgcgcggctagtatcgttacattcttttatacaatatcatatatatttttatattttattattaaaatatattaaaattatagcataacttttaattttgtaccaacttgaccaaactaaggctgtgttcgctacctccagatcccaaccggaatagtaacacacggaaaacggaacagtccattagcacgtgattaattaagtattagctatttttttaaaatgaattaatttgatttttttaaacaactttcgtatagaaactttttgcaaaacacacaccttttagcagtttgaaaagcgtgcgcgtggaaaacgaggaagaggggttgggaaaggagacatccgaacacaccttaacagatgtgtaatattcatattgtattttatatacatgatatttattaattatttaatattctaattttagttaattataaattgtattcctatataaactataaactcatattctaatatttcttatttttcaattccgaagtcatgttatttacaaattttattccaatatggactctaaaccgttatttcaatattccttagtttaaaatctctaatttcatttatttctaaattgtatttctatataaactctagactcctctttcaatatttcttattttttaattttaaattttagttatttccaaatctatctgttatatttttaaaacagctttgaaaggaggcaccacgttcgctgtgggggctagaaattcccacattaatcggagaaaaagaaaaggagagtccaagtagaaataaaaatttaaaaatagctgaaattcggaattaaaaataagaaatagtgaaagaagagtccatataagaaccgaatatgagattaatcaaaatttggaataaaaataaaataaaatctaaaattagaaaagaaaaggagagtccaagtaggtatacaatttaaaaataactgaaattcggaattaaaaataaggaatattgaaagaacagtccacataggaacccaatacgagattaattaaaattaagaataaaaataaaaataaaatccaaaattagcaaaaaataaaaaatagtttaagtatgaatacaatttaaaattagctgaaattcggaattaaaaataggcaatattgaaagaagaatccatataagaacccaatataagattaattaaaattcagaataaaaaaataaaatattatccaaaattagaaaaattaaaagagagttcaagtaggaatacaattttgaaacaactgaaattgacaataaaaatttgaaaaaaaaaattagaagaacagaatacgatattaattaaaatttggaaaaaaattctgaaattagaaaaacaaaaacaagatttcagttaggaatacaattcataaatactcactctgtcccataacataagggattttgagtttttgtttacactgtttgaccactcgtcttattcaaaaaaaatttggaatcattattttttttgaattactttattatccaaagtactttcagcacaactttttatttttttatatttgcacaattttttttgaataagacgagtggtcaaacagtacacaactttttatttttttatatttgcacaattttttttgaataagacgagtggtcaaacagtacaagcacaatttatgtgacggatggagtaactaaaattggttaaaaagactattgaaagaaaagaccatctaaaacacatgacgaaaccatctaaaagtagggtggtggcggttgatacgacatataaaaactgttaataaaacaccaaatagaatcctaatgacgattaaaaggagggacgacaggcaagccgtgaagcaacaggcaaggccgtttccgggacttctagaaagtaaaaaatataaaccccattgataatcatatttaatttttaaaatctcaatgacaataaaaaggagaagcagcgggcggggtgtagaggagtatagttgcagagccaccaacgtttggtgggacgtctagaaaatataaaatgaattccaacaatagttatgttcgattattagaatcccaatgacaagaaagagtaggcgacggacgggccgtagaggagcgtagtggcatcgtttgatgggacttctaaaaaaatataaaaaatgaaactcaacaagacagtaaactctaaaaactacaaggtccaatttttaaatgttcggaacttctaaaaagtaaaagaaaaaacaatgataatcatgttcgattttaaaatctcaatgacaataaagaagggaggcaacggacgagccgtagaggagtataatggcaaagctgctgacggtttggcgggacttatagaaagtaaaaatgaacccaaaggataattatgttcgatttttaaaatcccaatgacaataaagagaagagacagtggatgggccgtagaggagtataatggcaacatttgactgcgcatctagaaattataaaaatgaaacccaacgtgacaataaattctaaaaactataagatccaatttttaaaggttaccaggagaatgaatagaaatagtggtagattgagcaagcaaataaagaaggagatgacagaagtaaagggtagcaactggtgtgactgttaaaaactatataatagaaacacggggatgataaggtttggtctttcaaagtcttaagacaacgagatagctatttaataaattttaagtgaaatcataaaaaaatatatgattttgtttaggtgctagccacgcaattgcgcgggccacccagctagttgtgttcatatatggactttagactctttttctagtatttcttttttttttcaattttgaactttagcttcatctaagttgtatttcatatggactctagattctttttctaatatttttttatttttaaatttctagttttagttttttctaagctgtatttctatatggactctaaattatacttttaatttttcttatttttaatttcgaaattcaattagatctaaattttatatgtttttctatatggactctaaacttatctttcaatattctttttttattttcgaatttcagttatttctaaattgtattcatatatggactctagactattttttttcaatattccttaattatttctaagctctatatggtctctctaacctcatcttttaatttttcttattttttgattccggattttagttagctccaaattgtattcgtatatggactctagtctcttcttccgatattccttattttctaattccgaatttaaactatttttaaattgtatttctatatagactttatttttctttttctctgattaatgtgagaatttctaggccgtgagagtgaacgtgaaggcccatttttctattcctttaataagttaataagttaatagatactatcctaaagtactgctccctccggtttcacaactgttgacattttgagatttacttggtcaccacagaattacttacccttgtatgtatacattccaaggatggcaatgcttcgaacccaacatgcacaaaattcaatggtggactcaatccactagactacattagaattaagtataatgtgcaaactaccgtatttaatatggcataatagagaataggcacccaaataaatcaatccttgtaaatgagatcatatctaaaacgctaagggcttattcggatcggagggtaaactcaggaaaaacataggatctgcattcctatggattcgggtactgtagcagcattcggatcaaaggaatcccctgtaggaaaatcagaggaaattcgaaggaaaatttccttggccatccattccacaggaaaacaaacaatccactccaacctctttttatttttcctgtgcatgggaacgaggcaatcaacaaactaatcttcacaagcttcactcctctgacacatgatgattttagttagtgggtaggttctttaaaaattcctatgtttttcctacgctctatccgaacgcatgtttatatagtattcctatgtttttcaattctctgttttacacgtgcattcctatcatattcctatgattttcctattcctgtgttttttcaatcctccattccgaataagccctaagatttttgaaactggagagtacttctcactccaactactgccaatttaaatctcttctccttactacttctcaaccaccctctctcttccaaacactgcttgtttaacgaggacgtacttccttcccaatttgtcttatacttttttttagataagggtatttttacccggcctctacatctaaccggatatatacggccattgaaatagggaacttagccccgcaaacaacccaatctaaaatttactccataggagatttgaactcaggaccttggggtactactcaggtcactataaccactaggctacatgccctttcgtatttgtcttataaatgttagaattgtttttataacagaggcagagcaagtatcaaccaaagatacttcagggtgagatatcagtttgagtatattttaagggcattaattgggatgaaacaagggcgcatttaggttgtgtttagttcacaccagaattggaagtttgattgaaattggaacgatgtgacggaaaagttgaaagtttatgtgtgtaggaaagttttgatgtgatggaaaagttggaagtttgaaaaaaagtttggaactaaacacggtgtcaaatgacagaatttttctgtgcatgtgagagattagactattatcgcacgtcgttaaaaacatggcaggaccgcacaagaaccatacaagtacccttttttttttaagataaagagagttttattgatcttaaacaattacatcaagatgatacaatttctctaagaccactctcggcctctgcatagttaggatgtacacagcctatcaatattataaaagaaaaggaaaaaaaagcgacacaactgctacaaccgtgccgcagcgacttacatctacgagtaatcttcatctcttatctccaccaaaacaacacttagactatcaaacggactccctttaaaacaacgcctccaatgaggaaatgacgtgcgcacgcgtcatcattgtaatgttccaatcaactaagatcagaccataggttttcacctagggaaattctgtgaactctagacaatgtcttcaagaaggaagaacatccattgccaagtacaaccaactaaggacagacttagggatttaaccccggagttaaagaattagtaacaagtaccgcctgaatgaagcccactagtattgttgcccccttattccgagacagaacctccataccccaaacttaacataatcacaaaaggccacgaacataattacctgcatccttctatagatatccttcgaagataatgtcgcgagaagccaaaaaggcacacacccaaaatccataggccatagctaaataccctacgaagataatgtcgtgagaagccaaaaaggcacacgcccaaaatccattgggtagatctaaaggatgagatatagataagcgatacctttaatcgaagtcaagctgacgatggtctatggtagatctgaacgccactgccttatgatgatgaaaacatcatcgcgagaagtagccactaaaatgatgagaagaaagttggcatccgcctccttcaattgtagcctgccatattaccttatcggtcccaaaatagatccctccaccaccatccacaacgaacagctagagggtcataggaacgaaagaatctacgaatcaggctgccgggttgtggcgacgagtgtactcttcacctcgaaaccccagaacacctttagcgatctgggaagcaagatgaagaaccacaaagagaagcgtttggggagacgaggcttgccgtcgacgagtcttggtggaaccacgcgacgaggtgaaggttgccatggagtctgaacccctaccggcaccaagcgcatggtgaggagagcttggcgatgtccacctccgcactcgatcttgagcacgacgtgcctgtcgccctgttcctgatgccgccaccgacaaattcttccagaatcgctgatcagcgcatgtctgcatgatgccccaccgccgccttcactgcgccccgcacggcagcgcgctcgggcggcggcgagacggcttcacttaggtggtgtttagatccagggacttaactttagtccctgtctttagacactaatttagagtattaaatataaactacttacaaaactaattacataaataaaagctaattcacgagacaaattttttaagcctaattaatctataattagagaatgtttactgtagcatcacataggctaatcatagattaattaggctcattagattcgtctcgcaaattagtccaagattatggatgggttttattaatagtctacgtttaatatttataattaattttcaaacatccgatgtgatagggacttaaaagttttcccatctaaacaggccttagccggatcgccgatccacgctctaatcacggatcggtgcgctcgcttctgaaacggctacctgaccgaataatgacaggccccgctgtaccatacaagtacagtacagcatggagtcagtcagaccgccatcctcccttgcgcctagttcggacgattgtaatgaacgaggatatcatttgaattttgactttactgaaaccggataaggcctttgaacataatcattggggctagcaatttaggtctacgtttctgattgaccgcctgatcccggcggtttcaccgtctttgacaaattttgaaaaaaaattcctgttttcgaaatccttcccgaaaattgatttcgagccatatagtagaccctgtttagttctaaagttttttttttaaacttctaactttccatcaaaacaaacattttatacacacataacttttcagtcacatcgtttcaatttcaatcaaacttccaaacttcagtctaaactaaacacagccgtaataccaaaagatcgtgaaaatcaatcagtttttgtcggtaaagtaaaccctcagcttttcttcgtcgttttgacgttttgactaggagctgtcaagtcttttttattttttgagaactaggagctgtcaagtctactccgtccatctcaaaacaagacaaaccatgggtttccgtatccaacgtttagccgtccatcttatttaaaaaaatatgaaaaaaattaaaaagacaagtcacgcataaagtattaatcatgttttatcatctaacaacaatgaaaataataattataaaaaaaattcatataagacaaacagtcaaacgttggatacggaaacctagggtttgttttttttaagacagtgggagtactcggcaagtcggcagtagccagtagtacgactagcaagtcatgagggtgtggttagatcaagggtctaaagtttaaacgtgtcacatcggctattatataggatatcgtatagggtgttcggacactaataaaaaactaattacagactccgtcagtaaaccatgaaacaaatttattaagtctaattaatccgtctgtttactatagcatcacattatcaaatcatggagcaattaggcttaaaagatttgtttcgtaaattagtcgcaatctatgtaattagttattttttagcctatatttaatactttatgcaggtgttcaaacattcgatgtgacagggtaaaaaattttggggtgagatctaaacaaggctagttaataaataaaaaagaaaactataaagcgaccatgaagggggtgtaggatcgtaaaagtaaacaattctatgcacgtcaaccatatcggcatgttcattagatctggctgcggctgcagcttctctgcagcaacagtagctatttactgacaaagcgaacatggatatacatcgatagaacaacttgatatatgaggattaattaatttcatagtgaagaatgttttggtgtcataggtgttgatggcctttgcctatattaggggatgctcttttttttttccgagaggggatgatcaagttagaatggagaaagttcatcttttagatttgttgataatttttttaacaaatatgtgaagctgacttgatgcttgatagaatcatcctactaaaagaataattagtgatgaatatgagcatccatgttaattctaatacttaaatccagtgaacatattccaccacaagaaatctaaccaaccagttaaattacacatacttttcttatttgagccaatttcatccgtaaaaatattacagtatatttttagtgagcttatacggaaagatgggaacagttgcgattttaattcatttactaaaaaaataaaatataccgatggtattacaacttaaaaaggatgtaatttagtagtttattcttacaggttgttcaacacgaatgttacaaaacatatagcgcatggcctgtactcattgctaagctggtagattgccctaacattatacgctcgtgagcaacaggggcatgacaaatttatgtgtcgagaccagcaatgaaaatgcaaatcaactcctatattctcagtgtgttgctgctggtgtgtttttcaatcaacacatctgcatagtggttagcactaaaaagaaggttcatcttatatcagatttactatcaatagtgctagtagtaattattgcacgtaccgttggtttatttgtagcttatgcgtgtatgaccgtgttagcgaagtgatcaacgtgacgcatgtacatggaacatgttttacgttattcgcatattcggaaaagatcatttacttgtttgagtattttgctagacaagtgacaaaaatataccccttccgtcccaaaatatttaacgccgttgacttttttaaacatgttttactgttcgtcttgattatttttttaaataagtaaaactatatatatacataaaaatatatttagtaatgaatcaaatgatatgaaaataattaataattacttaaatttttttgaataagacaaacgatcaaacatattaaaaaaatcaacggcgttaaatatttaaaaaagtcaccttgtaaaattgtgatacaatcggtatattttacttatttataaattattctataattctttttttaaataatgcaacacaattaatctctctactaatttagtcaagagattaagtgaagaatataatacgcagcaggattattttgccgtgtcaatccgaaaagcatagtttatcaatctgcttggagaaaaccatgcttaatttggatcaaacctaccgagatgttttagccacgtttacgaaggattgacgtggcccgctcctggacaaccttccacgcttcgcggacatggcgctcctcggtgagcgtgctcccgatggcgcacctgagcatgtacacgccacccaccatggcggagctcatgtacggccccgagctcgccgcgttcacctcctccaggagcctcctgttgagctcgtttgccgccttctcgcctccgacgccgacgccgacgccgagtctctccggcggcgaccggaggcggaagcacaccagcgcgaaccgcctcggcgccaccacctcgaacctcgcgtcgcccctcaccatggcctcgaacgccgcggccatggcgacgtgggagcggacgtgggagcggaggccctccacgccgtagcagcggagcacgagccacaccttgagcgcgcggaaccgccgcgtcagcgtggtgccccagtccttgtagtcgacgacgtcgtggccctccgccgccgcgtccctgaggatgtactcctgctccgtgcccagcgccgccaccagcgccgacggcgccgccacccacaccgcgcagcagtcgttgttggcgaggagccacttgtgggcgttcatgctgagcgagtcgacggcctcggcgccggcgatcacgtcgcggaactccgggcacaccagcgccgacccggcgtacgccgcgtccacgtgcacccacacgccgccgtggcgcgccgcgacggcgcagagctcgcggacggggtccacggcggtcgtctgggtggtgcccaccgtggcgcacaggaacaaggggaccagcccggcgtcgacgtcggcctgcatggcggcatgcagcgcggtcggcgagagcgcgaacacgtcgtcgcggcacgtcggtatctcgcggcagtgctcccgcggtatcccggcgatgcgcgcggccttgcggaacgcgaagtgggtctgatcggagcagtagacgacgaggtcgccgatcctcctcgcgccgatctccgccagcttccggtccctcgcggcgacgagcgcgcagaggacggcctcgcacgacgtgcccaggatcgtgccgccgcctccgccggcgaacagaaggctctccggcaggtgcagcgccctgccgagccagtccacgaccaccatctcgagctcggtggcggccggcgaggccgcccacgtgaaaggcacgacgttgatgccggccgcgagcgcctcgccgagggcgccgacggtgctgctcgacgccgggaagtgcgcgaagtggcgagggctctgccagtgcgtcacgccaggcaggatgaggtcgcggacatcccgcagcgccgccgcaaacgcctcgggctccgggcgggacggcgcgtcggcggggagctggcggcgcaggaagccgggagtgacgcttgggtggacggggtagtcgcccaggccggcgtagtagtcggcgatgaagtcgacgacctggtggccgagccgccggaactcgtcagcgtcgagcagtagcgcggtatctgacgccgccggcgtcgacgtcgtcgtctccacctccgggatggcaccattccgtggggcaccgccattgatggtgtggcagtgcgagggtggtgccatctgcgggaacgggcgtcggtacgtggcggaataggcggtattagctaccaaatttattgggctcgctagctaatgctctggtcaataatgttagcaatagctacaccagcgtcgatctacccgtataactgtatctctctatctatctctatacttaatgagcaatgtgtgccacattaattgggaaaaaaagtcagattatcgatttaggtcctattttttatccctctctcaaatagccaaatagccaaaaaaaaaatctaaaaggtgagctatttgagaactatttgaaaataacccatctaaaaaaatatcccacccaaggagtgctaatttaaactattttgggtggggcccactaaaaaaatgccttttatctctatctcttttcatgggaaggtatattaaaagccaaatagctctcaaaataaccctttgatccgaacaacttagggctattttttttggatggctattttcttgtgctaaaaaatagctctcaaaataactcgtgactagttctccaaacatgatcttagttgggtcacatacattgtattgccataaatgcacgttaattacttccttcgtcctagagtaccataatagaagatgcggtatctataacttagaacggtatctaaaattcattttttaattttttattatatttatactttgtagcaataaaattataaccattcttgataaaaaaaaaaagatcataaccatgtggaaatcaaatgccaattatgcgatgctatttttttttatcaaatgtgtctccaattatagcaatcagctgaaaaatatgtcaaaaaattatagcaaaaccgttaaaaaaaatgagattaaaagaagcttaggtataagtgtgacctactactacctccgtccagggttcacaattccgatgaaaaccgacgaatttgcggaaaaccgaggttttgacgtggctcaaaagtagaagccatttggaatttcgatgggtttcatccaaattaaaatttaaattgataaaaaaggaaaaaaatcaaatcaattcctataaatgatatgatattcatagaacctatatgggtataaattttccaaaaaaattagtgtattccgtgtattcttgaactttactgtagaaaagagaataataacaatatttttaaaaaaatgaatacactttcttggaccgaattccatgtattaggcctacttagtacatagcccagataatgatgtataatagagagaggatgtggtcttgcacctgatttcgctcggaatttcgcccaagccaaccggttttcgtgagcatatcgataaactcagggaatttgtattcaaattttggtttatgaaatttgttcgaaatctaccggcttttcaccggatttcgcgaaaaacgtcatactaccagagcccggaacggaatgtcatctcggaattgtaaaccctgcctctatcccagcaagtcacaaacaaaataaataattattcgataactttttttaataagacgaatgatcaaaggttacaaacaaaaactcaaggcggcaagtattttgggatggaggtagtaactaatagttcccattttttactattaatcatgaaaaatataatggctctaaaccgggtaaaacattgtcgacgttttaggtctcgactacggtatttgtatggtatgagaatcgtcggtaccaaggtatatgcgagattgaggtaaaagagacagagataaggattttatataggttcgggccccgtatgtgataggtaatagccctactcctgttggccgaagccggtgttgctctttattcatctgaatcacacaagtacaatatgtgagataacctatctatccaccgtcaacttggtggtatggataaccaacatgtagtcgacgacagggtaatcttcctcctcgagtattagcccatcgtaatcaaagatggcgctagatccctcttgttggcctccgcaggcaccataaggggtctgtttaggtttatccctgatgttaatgtctagtgacgtgtgttggcttgtgtattgtgtgtctatctattgttgtgtactctctccccctatggggtcttgtatttatacccatagatgtccctttgtccaagtagaactaggcagaccaatatggatacaatctgagttgtccttatcatttccatatagaactctacttatccttccttatccggaactccttctatatacgaggtatgatttcatataggacttagtatatggtgggcgtcgccgtgtttactcaactactattagatatgcggtatctataaccgtcacaaacatgatgtttgctaattcaaaattttgggataattaaatgtttgggaaaagtactactccactctaaaactcagaccccaaaaggagaacaataattggtagtactaattaattctcgagttttgaaatataactaaatcacgaagcatattaaggtagtttttcaaaagattattcaccagattattactgcagatattacacttgtttgttagattaacttaaatattttgagaaataaactttataaatagcatagaacaagtggcataataagcattaaggtggaagaatgtttttttagaagtcatatgtttagaaacatggagtaaataaatcaggacaatagtccggtcaaaaagctggaaacaacgagtccaacacaaatacaaccagagacttattagttgcaaattttataaatattaattaaaaattataatggagggcgcagtatagtgaactttttttccagagaaaggtattttttttacccggcctctatatccaaccggatatatgcagccattttaatttagtaacttagtctatcaaatagggaacttagccctcaaataacccaatctaaaattcgctcctaggaagatttgaactcataaccttacggtatagtgatctgtttgggggaagttattatctatagttagtttttatggtagaacccgttggacaggcttgagaggtagtggttttattttgtggaggatatcataacaccaaaatttgcaaatttgaagtctacgtgtaattttgtactctgtcactgaaaaatataaggcatgcatgtatttgaaaagttggtagttttaaatttgaaagttccttaatatgatgttaacttaatagtcattgattattacaaaagaaattaacaaccaaagtttaaagttgggactattttacacactaatatgtcttatatttctcgttggagagtaatcattaaatttataattattgataaaataaaattgtgcctagcacttcaagaaagtagatacatatacaactttcaatataacttagataaaaagtggaagaaaataactgtacgaatgcacagagtacctacccgccaggtgatggtagtagtaattcaatagaagtgtttgtttttccgtacgtacacccatttaatatatgcaaagttcacgacaaagatctgaaacattttactagtaagataaatcaacatatatatgacatatcaatttacaaatatgtaaattcaaattcaacttatagaaatagataataaaaataacaaatatcaattgccaatagtatgcactttttatagttgtatttattattttgcggagtaatatattatattttttagtaatatattatatattaatttatgttattacttttttaaaaaataatgactttttgggtggcacatataaccgagtgtacgctttgtcggctgaaaaaaataagtttcattcattggttatttccatatatgagcatgcattgtaccaccgcgactggtatgagacatgatcaactctgaaaacccatttttttatacatatggagtgccactagagtctggaccatgcaccgatgcacaggaccggaagcgggtagtggttatctgcctaggcatcgagcatgaattatactctctccatctaaatattactttttggttttttctttcaaaagtttaagatctatttgtaatatttatgagctaaattaaatcaaaatccaagaagttattttagtacttattggtttttatcacatggtaaatgagttaattatattttagttttggtgacaaaagaataaatagattttagacatttggatggagtaataaataaatgttctcctcctaactagacgatgaaaagcggtcgagtggagtggcattgagttgcatgcgcagagagccagatcaggagatcgagctagctacttcctctatcttataaggaatttaggtgaaattgacacatcataatactacgaatatggacatcaagcctctttcagtggcccgaaaggtctcgagaatagtatgtaaagtactccaataaaattacgggtgccatgcagtgtctccagcaggtgcaagtgcacaagataaaagagagaagtgaatagggtggcgcacgatcttgctagaatagcaatgagtactaggtctaatgctgagtggaggctatgtgccccagcacaaatcctaaacttattaaaccaagaatgcaaccctttattccgtcattaataaagctctctctttaatgtaaaaaaaaatgtaaagtactccaatggaatgcccagtccccgatcgaaatgtagttatcgcgtggttgtgcctgtgtcccgccggcagagcacgagcgacaccggaacgaaacgagaggcagcgcgtgtgaacagttgttcgtacgtgccgtcatgcgcaggtcatacctggcgtgatcacttcaacgttactttgggaggtttttgctaattaaccatcgttcggcgcccaaaaaggtttttaccaaagataatcgaattttactgagttatactgcggctacctagctacgcctcgttcggagtagaagtaaaacgcatggcccgcaggccatagccaggttgggcaaattatctatcgccaggtcaagtgcccaggtcatcactcctcaggtggtgcactggtgctcgatgcctcgatccaatgccagtacgggtatactgctcagtgcttgcctgtagttgagcatgcagccggccgctctgccaggctcattcaattgggtccggccggcgtgtcggctgacaagtctgcagcactgtacatctgggccagcttcaattcggtcaagagttgctgaactagatccgtcctgcgtttcggcctttaggcctgtcttgcacagacagaaaacccgtcccgatggcacaggatttatttggttatctccgactagatggcacagaacggcaacaacgatgtcagattagttttcgcacgacccgtttcacgagtgctggatctgttgcaagagtgaacgctataaatgtgctattgacgtactagaactagaagaactgcgtagtagcatactcataccattaccagtgacattctgggtcacccggagctaccccactcatcatttcatcaacaaatccgtaaatcttgatacggcacttgctcgattcaagaaatcaggagttcagcgcacaaggcacgtaggtttctatactgtagtcacgcactcccttttatccaataaaagaaaaagtcagtcgggaagtaactttgtagtctgatacacaaaaggttacaaggtcacatgaggcagcacggctcaaacttttctggaaagcagagcatgttttgtccataatttgatacagagctaacagcacagtgcgggcaactaaaagcaaaaaatgacactattaaatctaataatcgatggggcctcctcgtagaagagacaatcaacagatgcgttgtctgcatgaccgggcactccaacctcatgtgtagatgtatttcatggcatttcttcagggtgcttttgctgcagataacacattccattccaactctatgccaaacagcccaacataaacaggtgtatatacttacagatgcctgatgtccaccatgactcctagatacgtctcaatagcatcccatcatatcctggaagtaatggtgaaaatgagttcagtaaaacattccaatggagcaaactaacaatcacaaaattttgcactagcagaatataacaaggcctgtaaaaaataatgtatcgtcttcaccaagaaacaccccagtcgttctataatctggtaaaggacaccctgacacgcataagcatgaaatgcagtaggaaacgaaattatcaattgcaaacgtgcaccggcaatatctaggaacagatccttgcttgatgtcaataatgatgaagaaccttagtctgactggcatactaacaagatgaaggcattgctagccatgttcaaaatgaaggattttagaatagtcataatgaaggacttcagaatatcgaggcacaacagattagggttctgattttaggatatcgacccacaacatagttggcttctgacttcaagtcaccaagcactatctcgctaccccaatgagaacacaacctcctagcactcacaagtaatccccagtttagtcctacaaggtaacaattcaaaaatcttcgaatacttggtaaaagtgtcctgctcatgatatcaaggaaaatgaaagtaaaatggcatatcagaatatctggagaccacatgaacaatcctccatatgataaccctcctatatcttgttacttttttttctttttggcatcaaccatgccaagttgccaacagggttacagggcaacgtcaagcacatggtgtttactgcaaattaattaggaccagctcagtacataatccaggcaagcctgccttaacagaagtaaagctctgccctattgtgctgttctaacataagtatgtactagactactttacgaaaatgttttccatcctggtcaatccaaattgcctcatctcttatatcacaaactactgaaactactctgttcataaaccaaatagagtcaaaacaccagaaaacaattaaacttgacaagttaaatatagggaaccggtcagttggcctcaatgcctgaaaacagaataggagaattcataattagctattttgttggcacatttcatttgtagaatattaaatccccaatgttgtttccgttgatcaagaattcatgcatgttgcagttacatcatcgaggactggttaggctatacccatggatcaacaagccactactcatggttatatctataagacttcattgattaaaactaattggttatagtcatcattgatcatgtataataggacctcacaatacttttcacatcaaaaactgaatactggatatctttttgcaaaatttagtgccaactagaatataggttttcaagaattagagtatgattcaaagtaattggtcagaatgagcacaaaaaattaatacaacatgttgtttgatcagtcaaaggaatttaacagaatcacttgtatagcttgtaaaacagaattatgatcctttatctctgaaactaatccagaaacccataaatagagacataaacttaatataatgacaactgactctcacttcaaaattttctttagataaataaagtagccaactagtcatgcattagataaaacagagtagtttctggaatattgcgcatcacctatatgttggtagcaattctattccataatcacatcaagtggtttaagtggtaatttacctccccaaagtgtagagctctctgaagctgcctctctgatggtcagaatgagttcatttcaagactatatgtccgccgcttgagaagcacctgtgccgctgttcgatatggctcctcaaaggcatctaaaatccagctagctcctgtcgggccagcaacctcaattcctcccccttcccttagaacatcctcgcttggtctgattgctaccagtgtagcacccttaagcagttggcccccaggaagctcaatatgcggagcgtaccatagccgcatactaagtgctggcatgagtgtgcggtgcgagttcccagaagctgacacaggccgcacacgcagctcctgcagctgcctcttgtccatagtgaggacgccctgcccatcagcatccgtcaggtccaagctctcgagtgttgagtgatctgcgatgattggctgcagcaagtaatgccgtgccgaagcagcgatgagtgagctgatcgtccagacaacacggagcttaagccctccattcgtatagagtgactctgggatgttccctaattcatcgggctctctgctggaatcgggagaggcagccgagctgtctgcagcagttgggggcggcgcggccggtggtgggggtggcttcgacgttacagatgacgcgccgagtatgacacagctgccgagggtggaaccaaagtcagccttccacttgaggagcacgccgtcctcgatgccgagctcgccggtgggcagctcgatgtggaggcggcgcagctccttgaaggagcggaggacctcagacggcgaatggtgggagacgtccgcggcggcaggagccggtgcggcgggcggggcagcggagcgacgggagacggtcgccgcggccggggagaggatctgcccgagtgcctggatgggcctgacgatgccgccgagcaccaggcgcgcgagatgcgcgagcgcgccgcgcccccgcgcggcgggaggtcccccctccgccgccgcagcggcctgcgcggagcccgccgacgaggggggcgggtcgtcggatatgacgcagtcgacgcggacgaacaccgagtcgacgagggggacgagcgcgtggaaccgccgcgagacgagcgcgcatcgccccagcgccttcacgtcgccgatgcggccgaacacgtcgaggagcacctcgtcgggcagccgctcgaactggtcccccaacccctcctcctccccaccctcgtgcccttccatcctaaacaccggcaacagcagcagcggcggcggcagctcgcagatcgggatccggaggcttcggcgctgggcttgggggggggggggggggggcgtggcgagtgtgtgagcctgagccagtcgcgagagagctggagaggggaatttttttggtggaatcgagcgagggtgaggaggagttagccacgcacgcacaccacacgcacggcacaccaccggcccaccgcacggcacggcggctgagcgtgaggcgaggtgggggtttggctttggctcgtgtggtgtggtgtggtgggcgtgggcgacgtgtccgcctcacccgctgtgggctcacggccttttttcccccccggtgcgcgcgtactacgggagcacggcacacggtgacacagggcaccgcgtctcgtgggacgatgcgaggtttccaccgggaggaaagatctactagtggctacgtcacgtcgccttcggccgaaaattccgacggcaactgctccgtccgtccgacccaccgcgaccaattggggttgggtgttggatccgtagccggtgttccgtcgtgggctgtgcgcgcttcacatcgtcgacgtcgagccgcgcgaggggagcaagcaacgggtgatctcgcttctgtcgctcgctgtgtgtgttgttttgtggtggcgtgcaaggaagtacaactcgcggcaaacctgataaagcgatggagaccggactggacggggtgtggtcggtagatccccacggagccgtctgatctccacaccgacggggcggatgtacctctctctctgtgagaaaacaatttgtctgatgcatctcatcctcaggtgcttggactttcttcgcctggattggtgggaggagggattcttactcttaacagcgaagacctgattaaattaatccatgttgttgtcggaaggaaccatcagcttaatcatcggaagcgactagtggccagcttgcgagcatctccacagttgacgctgcagctcatcgctcgagtcgacctggcaacgtgctgccgatctctgcatccgtgcaaagccgattcatgcgagggaacagccgtcaaaaatgcttaccgctgcggggtaccggattaggcatgatttgggcgcacgagatgtgtaatcatgcgtaaatgtaatcgatggaggcttcggcgtcaagcgacctatagtaaaatggagtggatcttctttcttttcccttgtttttttttcttttttggcttcaggggtcaatcgtgtgcgtcagctcgagtgtgattggagcatgcgtccagagaatgaatgaatgagtgaatacttgattagatttgcctttggctgtgttgtgtcatctgtgtgacgcaacgcaatggcgaccacgccagataacttcccggacttatcacacacgtctctagtaccctactacagtatttctcaattttgcgaaagaaaaaaggtagaataggtgccagctttaattttgccaaacaaaaaggtagcaccttccaagcctctagcttatttctcaattttgccaaccaaaaaggtagaacaacttctcaattttgccaaagaaaaaggttggccaatttctcaattttgccaatgaaaaaggtagaacaggtggtagcttcttagtttggccaccgtgctacgtgagcagctattgtgccggtcctcatttgtaattgtaccttgggttggatctctcagccgggaagaacaaaattggctcaggtattctgctgcttcagtgtgaagtgaagtggcacgtcaacatgacacacaccacctcactggggtcatgtatgtaacacaggaaaactgctgcttaggcaattcccaaattttccaggcttaacatactcaaacgtgaattgtgaaacccagagctgtggcagaatttgaacatctaggccctacatgacaactcaaaatgcccaaatcgacattgctataagtaaagagcaagagagtagaatacagcttggaattgaggtaagaaatttgcggggaaatagcctaaaaaaataaactgattttcaacaatatgatgtgtacaggagtaggcaaatttccccatagcttcatattcattccaagtatcaaagctcaaagtgaccgaagtagcgggcttgctttttctttatatatttggatattgtagacacatcaccttgaataattgtctggccatcttccatataaatagcaccatcagcatatctgagttcttccagtcgatgggtcacccacaatgctgaaacctccccaccagcacctacagatttccttaccgccttgataacacccatctacaatttgatgaaagaaagagtagaacgctcattttagtcacagtgtcattaccagagcggagtaatacatgctactaaagagtacatattagaaacagaaaaatatgaatcgagatttcaacaaggggtaaagttgtgtttagccatagcttttgaggtatgatggccactcaacaaatgtgaataaagaaaagaaaattgcatttgtagaagcaaagctacacaattgtttagttgtttaaataataaatcgatctggggtttttcagtgatgtggttaatcattgttctcctcagcataatatttagttacctcgtgatcaattactacctctgttttttaatatatgacgttgttgactttttgacaagcgtttgatcattagttttattgaaaatttttgtgcaaatatataacaaattaagtcattcttaaagaacatttgacgataaatcaagtcataataaaatataattacataattttttgaataagatgaatgttcaaacgtttctcaaaaaatcaacaacgtcgtatattaaaaagtggagggagtatttgagtacaactgattagaaacaagaacatgcattatatttatacctggtcgtattcatccaagaatgtggtcagctcatccagtagtagtactttggatgcttcagctaaagcaccggcaattgcaactctctgcttctgcccgccactcagagtttggattggcctctgtgttggatgaaggatgtttgtgaaccttgtgcagacaatagattataatccaaaaggagcatgtcagctgcctacttgagagtagcttaacattcccacagcatccagtgattgtgatactcttgacctaacctcatccaacgaaaggttgagcttaccaagaccaaatgcaacatctgattccactgtcggcatcacaacctgcattcaaagaacgtaacttaatatgtaccagaaagcttgatctaatttgacatgaatgtgtcattaagcaatcttcctccaatgcatcaagagtcaaaaaaataacattctatagttgctagtaatatgatgcaaatacagtctagcaatatcttaatgaacatttatatgttcaaatttagttcaggggaaactcagcaaacagcacaactgtatagttttcaaaggaactaaaatatcaacaccttatgtatccaattagctataaaattcttagtccaaagagtttactaagttctgagttaggaattactttcacacccaagtttgtgaatgaagattaatgaggaacacagaactagattcattaagacaatcatgtagcacaaaatttcttgcttggtgaaactaaatctattatgggcaacagttaagagtgaactcatcagattacagtacaatttacgaattagtatgtctatgtatgtcgtttcttttcaaagacttatataatgttgtcgaacttagtaggatagttaactaagctctcaaatactccctccatcccaatataagtgcaacctagtacagatgtgacatatcctagtacaaatgtctgtccagatttgtagtcgtgggatatatcacatttgtactaggttacacttatattgggatggagggagtatgagtattaccttaaaatacataaagctggatgagttatattggtcggtgaagtaaagcctaaatattgcagaagtacttataaagaaaaactggaccttggtactttaaccgatgaatagttattcaacagggttactaagactatggccaacatgcttatacagtccaaaacgaatatgcaagcaaggaacattggaaccgagacacttcaatttgctgcagagtatcaataaataccagatagaaaagaacaaagattttcatgaattccattttctaactagcataatacacgttatgtgaatgcaattttaacattgttgtattccatttgagaacggagtgaaatttcagataaacactaaagcagaatataagtgacaacctggtgatcgggattttggaagacatagctgcatggcctgttaatatacactgtaccagaagaaggatttaaaaatcctgccaaaacctagagaaaacattcggttaacatcccattaaggagctgtactaagaaattcagaccaattttgatagtccggtagcctaattaggcaagtaaatattgtacagcattataataaaatttatagaacttctcctctgtcttttttactttctcatccagtcatcctatatcattctattctgggtgagcatatcacaaaaagttgctaatctgattgtgccatctggtccattcatccaaatagtcaaatgtgcttgatgctccactcctgagattctatacaatgctcactcactggttagcccaagatacatactagtggttctcgaattaaaacatccatcggctcctgacggtatacgaaaatttcctggagcaagatatcaaagaatgtggtccatgggcacaatctaatactacaactaaacttttgcctactccatgagcaaaaacgctcagggcacgaacaaaatacacatgaaaagcacaaggacgacgccctcttcagttcaggggggtaaagaagatgaagaaccttgagaagggtggacttgccgcagccgttggggccgaggagcatccagagctgacccggagggacgcggagggagcagtccttgagcaccggcagcacccgcccccgccgagtcgtcaccgacaactcgacgccctggccctcgatggccggcgtgggtagggacgacgcgaggacacggaggcggtggcgagggcgggatacgagggcggctcggccggggtcgtgggggcagcggcagatggcggaggtgccgccggcgaaggcgtgcgccatctctgcgagagaagtgagagcggtagatggaggcttgtggccttgggggcccggttctccagaagaccagaaggctataaggccagatgcccacaagtccattggttgatgggccgatttggggctttgggggcagagagtgcggataccatcctgtgctcct

SEQ ID NO: 80556 - DNA, 675 bp, Oryza sativa
cagagtaccacgtctcgagaaaagtttccagtccacaagacgacaggaagcgggctgttgatctatcaatcgcactacgacgtcttttacttgcctcgtctatcaatccaggactacccgaaattataacagctccacttatctgtcttaacgggactgcgttagaatcataaaaataaagaaattgacacacaaggtgcaatgtcgagagattgaccttggggctatgatctaacgccatgtgtagggcaatgcttgcacccattgagtagccaacaacaaccaccgctccatgggttatatttcttatcaacttcagtaacaaatctgcaactgattgaactgcaaaggagatttggttggagctttcaacatcatgctgtagaatttcagactcgccatggccaggaagaacgacagctataacccgtgcactacgagagagagcttttatgattggaacccaggcttcactcgtactctgaaatgcatgaagaaagagaatagccttttgctacattggctgaagcatgacaatagatactgtgacagcaccatgttactacatacggagaaactaccagtatctcaagtatacagtgcaagggaaacgtaggataatgaacatatgcctgcatctggagcttaagcggataactggacaaccgaaatcaa

SEQ ID NO: 80557 - DNA, 725 bp, Oryza sativa
attcctgcgccccggttcacgtcctctgtaacaatgatattacacatgtgtgtaaaataataagaaaaagtgatttcatcccttgaagggataacccctcatttagtgcatgtcacctaaatggtcataaaaaatataaaaaaatagcagcatagattaatataaaatatatcacttcacaaacatgcaagtttaaattcaactgttataagttgtaacaaagataaaaaaaatatagttgcgaatgtgcaataactatttttagtctaacttgttatttttgttgcaacatgtataggttaaatttgattttatatgtttgtggagtgatatatttcgtattaatatatttactattttttttaaaaaaatttgataactatttagatgacatgcagacaacgaggtaatattcctcgagagatgaaaatccacatcctgataataacatttatgatagaggactctcatcccgtcgtgtcacctaacgcatgcaggttgtacttcaagtgcacgttcagccgcgagcggagttgcgcggcgaagaagcaagtgcagcagcgggacgccggcgagccgcccatgttccttgtcacctacctcaacgagcacacgtgccagcagccgcaagctgttcccggcacgcccaacactgcaggtagctcgccgacgacgacgagccggcaacgacagtcgtcctcctcccgccggcggaaatgttggac

SEQ ID NO: 80558 - DNA, 993 bp, Oryza sativa
aagcagcatcttcgtcgaatagtacggggagaaacagtaatagtaaccaggacatggcaaggacactgccaatccgcaagccagaaaattcagagaaaaatacagcaaaacaaggccaaaaaaagagagagtaacaacaagcttaagagaaggcaacaaacgacaatcgaagaatttgatacggacagggaagaagagattctagccatttatagtggcaccgatcacatagtcatcaattggcataaaacggcaagcgcggtgctcaaataaccaaacaacttcataagaatcagcaaaggcaaggtgaccaaaaaattgcattgagctacgggaagagctttgcactaagaaacccacaaattcgcatcaaacaacaaaacaggcacgaagtcaaccctccagcgcgtgaaaaaaaaagaggagagagagctgaatcagacctcgattcaaatatactccaaagtacaaatcgaacatctacgagggagacagattttgatcattacccagcgatccaagctaaaagacaaccgtgaggctagtggcgcgagagcgacatagactcagagagagagagagagagagaggggggggggggggcttacagcgcctggacccagcgcggcgggacatcgagggaggcgatcacgacgcggtcggcgtccgacccgagcctccgagggatcgcatcatgacgcgcgtggccacgtagaactcgtaatcccggggagtgcccatgtacatcatcgccgcgtacgcgtgccgccgaggagccaccgccaccggcaccgctgccttctcacgcgccccctacggcgccggcgccggcgccaccaccaccaaagccacggcgacccaccaccagcggccgcagccccgccccatccccgacggagcaaggtcctcctcctcccccaccacctacgcccagatctggctacgctcggggggtcgccggagccgaaccgagaagcatgagccggcgggggg

SEQ ID NO: 80559 - DNA, 502 bp, Oryza sativa
tattttatgtgaccggtctgaccgggctgtgtatgccggtcagaccatcggtgatcgagcggtcagaccggccggcccccggtctgaccggccgacgctgtgtcggtttcggtttcgggttgtttctttggatatccgtgattgtttcatggatatggcttctagatggatactatacgtatgtaatactgttgtttgctaacaatgagtcaagttggtgataacttggtctcagaatatggtttctttatttgtttcatgtgtaggtgactcgatgcctcgggagaatatttgcggtgatggaccgggagtcggcttggtggtaagacgatgtccgtggtggtcagatatcatgcgggatactaaagctagagttgatgcacgtggttggtgaagattccatatggcatacgatggaggtattgtgtgcgtatgggatgcggagtcgaatttcgaaggagtcccaaattggtacaattggttatgtaaagcctgtgtcttg

SEQ ID NO: 80560 - DNA, 833 bp, Oryza sativa
actgtttttggtaggtgattatcttatctgtcatctcatctttaaagtgtaatccctcttgtttcttacaaggtgctagttttgcgtctagaatttctgaaacaaagataagcatcagttggtgttcccaacttcccaatgttcccatcagtccgctatcaaggcagcgtacacgcaagtggattttacataaaatctttgaccaattaacggcgaatagtctcagcataacctctatgtgatggttgcatccgtatactcaaaacatagccaaatgccaaaatttacatgtacaaaaatggggttgctcacactggttcaccctacagagaattgtaagacagaaaactgtctgaaccgagcaaccaaaaatggatacaacgctgcaaacaatgtaaaatgactattcacccattctacaaaaagaaaaaccatcgggatttttacagggctactcgataaagttcgtttactcagcagttcgctgaataatatgatctgctggatatggtgtacgacctagcctttgctcagcctaactcgcaggtcctattacttatccactttgtacagatagtacatctcgagccatcgattcattatgctaacacgaacagaaaatgatctttaagctagtaatgatttaccaaaataaatgctttttgctcatgactgaagaagcccgtcaccttcccaaccaagacgtaacatctgatccactaccttcaagctcaactgcaacattaccagctctattagaacgaaggttaagtggcaacgtaagtactttatggacaagcaagtgctaaatggattttgatacatcaggaatt

SEQ ID NO: 80561 - DNA, 26708 bp, Oryza sativa
  unsure (1)..(26708): unsure at all n locations
atcgatcagctgcaagttcttcgaacttataatagcgggaatctggtcattgatccaaagctcacaaagagataacaaaccaaacaattcataggagtcccccactagtgccggtttgacatccactccagcagcgcgccaagagaatcaagtcagtggtagttatataagtcatctccgacgaaacaatcatccactacttcaatactggcttttcgccccaggcctccctctttgggagcagttcgtgtcgtaagatgtcaggttgagtccgccaacgaacgcaatccctagaatctgttttgatcttattatttgctttcaacaagaagcgggagataagccttcatgactgcaatttccagccgggaaagaagatcaaggccactgcttttgagccggtacccaccaaaaatcatatagagtgtagtttgtcaactcaaactttcctggcttcatttcccattgtcatttctttttccaaaaactcatttgctaagtagaatagttaaaattcatgctctgctagagcaaacacacttctcgggattgatgtcgtctccgtctactttttctcttaactcactcagagagagaggccgccaaggataaaaattattaaagagagtaccagacaagaggtagttgtgtggttctattattcgttcagtgtattattcgggaattggtttggaaagccttggtagtagtgcactcaaatcgacattgagattgggacatagccgcccaacgattagaccgactgggggattggaagatctggaactttcctttggccaactacaagcagttgatcaatttcaccatttctttcattcccttttcttcttttcttgagtttattcacgagttgatgtcattgctttatttaatgggtctcagaagttttttcaataagcttatctgagataggcatttcttgagactaggctagtgcattggtatagagagtaacagtagggtaagtaagacagtagtgggagtacttaggattggtattttttcttgggaattcagtaaagtttgttgtagcacttttcaacgaatggatgtcctcttttcttcttgtacggccctgggagaggtctttttttgtaactaggtcagctactcaactcatatagccgtgttttttcctctatttcaactccccttgtaccgagctcccaaagctttccttctgtttttccgcgggcgggtctgactcttcgatacaacctatgatttgtgaagctttccgctctaaggcattttgaagatatgattgcgagagctttctttcggctaaccctatctatctccttaccctgtaagaaaagcaaggcgccctccagtctcgttcgctgggtggtcagagtacagcttcgccttctcctcgggcggcaacttgaaaaactccattccaatccccaacactttcctcagcatctcctctgttatccccttacgatctatgcacattagaaaaaaaagttggaaaaaaagcatgttatctctcatttttcgtcggtaagatacttgtacataacagactagcagtaccataagcagcaggcttttggacacagtattttgagtaaaatagggtaataccccataccagcatgaagccatttacacaaagcccataatttggtatcatgccggtaccagagtcatacataaaggtctgtcttctccttctgctcgaaagagtctaatgctacatcctttcactcatgtagattgtccagcatttcatttgacaaaactccttctgatctgaggacgacgaagtttatgaagctgccaagcaagatattgatggaatctcgacaacgggttcttatgtatgatgtgtccattaggtctcaaattatcaacacggagtgtacacagagttatgtacgagatagtagtccttccacacagccgtcagttaataccatcaatgattctgatgagagtttcctaggtaggaaggattctgactttcacagccatcatttgaattgggtttgaggaaggtgaacaggggtggtcgggtcatctttatttacgccatgcgtaccagttgactaggatagagacaaaagatgtacaaatatgtcctaaaagtgagtcaatggcatgccacatggtgggaagtgtatgtaaacaccgtagggagacaaaagcaagcagagaaggcgccagtggcgcatgacatatttttacaagtgtataaagtctagaagagggcgggggaacatactctcacgttctccgagtgggtactgcaccgagtaaaaagggtactggtcgacacgggtagcccatttcttgcataaagaagttctcgaacgagacgataaaatcttgtcccaggttcgaacttctctcataagctttaccggttaaaccttataagctttgggtaccatcttccagttcagttttggaagtctccgaatgtggccatagcgaccgtcaatggtggtggacgccggcctatcatgcaatattaggacgaggaaggctgaatgcaatcgaagctgtagtttccacctctcacttgatgatgaagtttcccacgggtttaaaaaggacagcaacaggtagcgagggattgttacctagttgcgttaaagggaaaaggggccatgtggttatcgaataaaccatcacccttatcatagagatagccacgaagaggtctgactttatatccaaatatatcagcatatttaagtttctctgaatagtaaactccgataaaccggggaaaataagcaatccagtcttttttatgatcgatatggaaggaatggcttattcattgtttcaggacagtccacatatgcctcgagaaagccatacagttcctctccctgtaaattaccatcccatttagctgcacctatcggcattggggatgatttcattataaacggatacagagagcgaacgtcataatagaaaaaattctcacagcttatacacatccgcatgacctccatagtctcccctacgaagaaactcatcagcagtcctatgaggaattgctataggtgtactcatctcatcataataatccttcctaaagatggttagcgctagagaagacaaggtcatcatccttgtagtaatataaagctcgtaaagactccaatagatattttgatcagcataataccacccaatatgtcttgcttctctaccaattccctcttcctagacgcgaaattatccataactacagacgtatgatctacttcacctttactgccgagctctgggcagagactttgacctaaagaacttaaagaatctgggagtagcttcaatgaatcacgaaacaccatcctcctgagtagtccctttggcgactaaacgcgctttgtaccgctcaatcgtaccgtcggacttgcgtttggttttgtaaacccacaacctaccaattatattgtagttaggactaggtggtaccagtacccaagtgccattatttgcaagagctgaaatctctgaagccatagcagagcgccactgtggatgtttaacagcccctgaataacatgttggtttagtctcttgattggaaggaggcaatggatgcagggtagatgagtaggcaatgaaatcagggaatttctgaggtttcatagtgcgatctgtggttcgagtggtcatagagtgtgtcggttgttgagagtgttaaggacatggggaaggaggaggtggacgagaggaattaagaggagaagcagagactgaggagatgactggaagagttgtatgagaagatgttgaagtggagtaagtagtgggtgtagtttaaggcacagattgaaaaggaaatgtagattcgtcgcagagaacatgccgactgatgtaaatggtattgttggccagattgagacatttgcttcctttcttagtatcacaatatcccactcactcgctttggttagttatagtcaatccataccgccttcctaaggttagatcagatggttctgaataaagaggaggctcgggagagtaactcgtgtcgttcagttggattcctggtcggctttgtccaaacaaatcactccttacagaggcgaggggaaagaaggcagagcgatagggataggcagagcaagagctcttaaagtctacccgggctagcttcttcattcttcgatcaggggcgggcttcttcccttattatatacgatgacatagatagagcctccttctttgatccattcattgataaagtcttcgggggcagtttaccttttgaatcgacagtagagtaggtttgctcttgctttctcaatctttccctatgtagtagatccggctttattcggctaaaaagaggccgtcgtatctgctcgcccccttcttcattcatccaattaggtcagaatggatccagggaacccggctcgggaactgccctgagaaaaacacagtaagagagtccaatctctgaaatatagcattttctctcctaagtacctaagtagtagtagaaggcttagtatctgacttgatccaatagagtcagaacacactgtagatccagattccacaccttgctgtggactggggagagagcagctctgcgaagctgggcgttctgtgtgattatggaggaactgtagtactcgccccaaaatgcaagccgggatagatgcttaaagaaagggggagcggtgggccttcaaaaaggagcgagggagtgatgggcaaccgtagtctatatgttgctcgtgagcccccaagtaccagtctcgcaacagtactggcgttaaaggatcggtccttcacttgcgggtcgttcgcgagtcgaactcgctctcttgccacgcctttgactcacgaactcgagtcggactcattcactgctgactgaggatcgttcgttcttcactctcttgctattacccgcagggagcgcagcaaccgacggtgcatattatcatatagaaagaaaaagaagcgaagcgtagcgattcgtactaccggaaaagtgtcgctaaccgctaggcaatagagtcagcttacggggtggagcgcaagcaagcgtagcgaatcacatagaattgcccctacctgccagcgcgcagatagatagggcgggcgagcgcagggatggatgtctgagcggttgaaagagtcggtcttgaaaaccgaagtattgataggaataccgggggttcgaatccctctccatccgcgaggtcataagttctctcttgccttatctatagataagaacgaatctcctcgactcgactgatatgatggatggtagaaggttgaggttattgtgtgttgatttagttaggactttgtctccctttcgttatcttccgccccgggacctgtgggagctaagtcgaagatctcggtgtcgtcgtgagtggttgataaacagcgattgcagtttgatttagggagtcccaaccctgtgaagcttaacagacaaagaaaacgatagagacttccgggtattgggtgacgaccttaatgaatcaagtattcaggtggcagagttattagctacataagcgctcaaattcctgaatacttattgccctggcttctatgatcaacccctggcacatttaggttttgatctgaggctatcctggtctgcgggacccaacacaagtattcatcctttccaatctgaaaaaggtgttgccgaaagcttaccctcttccacacggatgctacagccgctatcacttttgctgggggggaattacagagttcgcctctcgacatcttgtttggtaaacggaatttggacccaggcgccctagtgttgcctaaccgttcggccggggatgtcggatgcgagatctttagctacttgtatcaatttgccgcagtgtgcttagatacaatgcgctggcagctgaggcttggcaggatgggagttaattagggtcgagggagcaggaaagagtttgttattcgctattggcttagtacggcctatacataatagggccatgacggttttggcaaggccttgaacttcatatatcccttttttactcaatccagaataccgataaagtcagattgaatcattttttcgagcaagaaaacggatgcgcgtgctaacgctttcgcgctagtgcgctcaatccgttgcttgtttggggacagaaaaagttccgtaatcgtcctattttttcgttgcatttccttgtttttaacggaagtgagaaatgcgtaattaatatatagatgtgatgattccatgaatctctgaaaaggtaggggtcaaggaccttatgggactgcaatcgtgcctgccaattggggaaggacgcgggcctggcaaccgctcggctctagtaagggaaacaggtatgtctcacatcattgctcgaagactggaaaaactgcaagttagctcagttggtttaaaacggcatatgtgagtgacgcgaactagcattttgaattgagaaagccagtggccggggtggtctatgttgttatggtatctctctttaaaatcgagattgtgtgggtgttcagtctaccgctcatgttcgacgctattatggaccgagaagaggaatcaacgaaaaacccaggaaagagctgcgaaagaaaagcgtgacgagcaaagtcaagtctccacgactcgacatgttagaaggagctaaatcaataggtgccggagctgctacaattgctttagcgggagctgctgtcggtattggaaacgtcctcagttcttcgattcattccgtggcgcgaaatccttcattggctaaacaattatttggttatgccattttgggctttgctctcaccgaagctattgcattgtttgccccaatgatggcctttctgatttcattcgttttccgatcacatatttcttggtgtagatatctctctttgcaaatagagataccgaggccccccaacctactagttgttggtgggggaaagaagagtgggaacgtgggcttctttcacagtgcgtacctctctttctcttctttctcgctctgttctggaaactaactacttctccagaagcaacgtcaacaacttatgcaagactcctttcgtaactacttttcggtagaaatacggacttcttcctatcaaactgcttttgcccagcaataataggcaagacttgattcaggtcaatacaatactcttcttcgaacttgtaagcttgggacacaagcgtaaactttttcaaaagtaagaccaggtacactgctaaacataagtataaagaggtggaaggccggctgtgcttgtgctcacctacaggtctgtcctagcatacagtatagaaaaagactgtctcttatttgtgatttgtctgaatcagcgtatattaactaatactactttatccagtcaataattaattgaaaggtcgtctttaattaaaaagtgcataagcaagcaaggaacggaaggcatgctaactacactactagagtcaatacactacaaaccaaactacttgagtaagaatctattctttttgcttattcgtaagcgcatgaagaaacttatttcactctagcaatgagcataaatagttgacaacatagttgtattaattcttattttcctcttcctactacatacacggctataatcgttatatattctcttcttttctttagactcttctttctgcatctcttttctttccattgtgagtaaaaggggacagcagtgggtcaagtatgttgattggtatcatactgtggcagtagatcctggtgtctttctctcagctttcagaagcacctttcgtgctctcgtagctgtaaggaaggcaaggagaagatccgcatattgtctttatgggtcctctttatgatgaggttgctaataagggtgggtaaagtagtcccaatgctttttccctcggtaaggaagacttatggcatctaaggtaggcaatttcttgtgttcgcgtttagctccttgaacaactttgtatcattcgataccactaagcagcggttaatcggacattccagagagttccttcgggaaagaagaagcctagcctaacattgaaataaaagtgccgtagagagagatcatttagtgatttgatcgtctaagatgaaatcacatagtatacggcctataatcttgcttcttttgcattcaacaagaaagagaattggtagtccaccatcatagtacctaagtttgattgaatagctctatttgtagtcttcttgtttttgagaaagtgctctagacatcggttcatcccgagcaccacatagtttccagatgcaagctggcggggaagagtttatggttctgagaggacattcttttgttattgaatttaggattgggaaattgatgtatgtcagtgaagaatgcaagttgaccaatagcagctatgaagaacagcacctgtgcagtatgtcatttataacggattgaccttgaataagccattgaaatgctatcaaaagatagctctgttgataagttatttgagttctagatgtctacaacttaccacactcgttttccctttgtcggacaaccggcactagcttgataaacgacaataactcgtatagccgtgcttgtaactaagctgtgaatggaactttccaaaaatagagatttttctgaaatgcagactattcacatcgcccttatgtgctcagaaaacactttattctcaatcgacgggacggatagagtaaagaacgatatagtgtgtgactatctatactcaaaacgcaagagcctgtacagcaaatcgttcagaaggcagcttttttcgaacttacaggggcgctgcgacagctaaataaagcgagcactcggcaacttcaatctcacctctaccccgcactgaggtcaaaaccatctctcgatcggggctatactactgagtcgaccaattcctctccgcccttctctgtctttacccgccgggagaagagtttgaggagcattgtcaccgaacttcactatactatttggtttggcatgacatcttcttctaactgagttcaaaagagtattgaaaagaatgaatccgggttttagcgctccttgaatctggcctatacgtagtgtaagccgcctgcggctgctaaaggcaaggtatgagggtgaaagtaagcgaagcccatcttgatatagtcaattgagtgagcctatcttatttagttctgtttatgcgtctagtgagcattgaactcctttgacaagcgcaatgcttctttatcgatcagttagacgctttatacctggttaaagctgaagtgacgataccagtgcctgccgaacttccaagccctcaaatatcgaggatatggtgtgccccgttaccttatttcaaggtgtaataaaggctctcccccgactagaaggatccagggacaacggctatttcctccaaaaatattggcagtagccgaaacgactggaaacccaggtagcggtccggaaagggcaaaagggcaaggtgagtagtgaaagcaagaacgttctttcgcatatagagcgacagcccagattcagggttacttgtccacaccaactgatcaggtatcggaaaatagggcatatttgtttcagccgggagaccccctgggggtctagttttaaggcgagtaggcctattgagatgcacataactaccttttttcatcttatcaccccgcctagcgactttgcaagcattacaggctaggcacctaacaacggttattcctccaacaggttattctgggttacgctaaaccttcaagccttctaccagcagatgaatacttaatctatcccctctgcgcacggaaagggaaagctactcttcacttcaagagtatatgccgaaaatcctatgtttggagatgaccatgaacacacagcttgagacccttctttcgtgagacagatgtgattccgctttcatgttttggattgagctttgtcactctttctatgcctctttctttttcttggaggaccttcccaacaacacacacgcggcgctaaggttacccgtggcaactgaactaggattcgaagccagaatgagcggatctaccgctccaggtcctttcctattcttatactaatatatgtaagttccttgcgtttagaactagaacgtgaggcatagtaatggcgcatgtgtgatattactattgatacctgtttagactgactttaggaaagcagtcaagcaggaatggaaaaaatgtcttctgctgctatcttatctgctaaaatggacaaaatcttctcttcttctctatgtcactaatcacagtcggagagacccatgagactttcttttctcccggcaggctctagcgctacggcaatgcttatggctgcaatccaaacagcaatggtcctcgcggatttagtgcacccaatccattaggggttcctgatagtgagattcctctagtcaagtctaaggattgagtatgagggatttcatccagtccattgcggaatgtatggtcacagaatagactcatcccccggcttatagtatgcagcttggaaggccttggattcacacgtctggtgctgccccgtcttctccgcatcaaagagtaaagtatgctgttgaggtggtaaaaaatcgactttgtttgtcactaaacctgcagcattcccgtatattgaagccgctgaagaagctattgagacttccttccagtcactcgaaatttggaatgctaattctgtttctgagggcggagctatgcccaaagatgtctgaagcttcgaagatggtagcaagatttatgctgaacagcccatatcagaaaggcaagggattgggcaagaactagcaaggaatattcgccccagtggaactcccttctgctgatgagagattttggataagagttcataaaaggcgctagccagtttcaaggtcaggaagggaaaggaaagagctgggtttctaacaaacacagaaacgtttcctttttcgtttttcgctttgatttcgatagtaaattgtttgtattcatcgcattgatttgaaaagtttgaactttgatttcaggatggttacgggaaatttcactctcttggctaattgtaccgtcctttcctctaggtattgagatccttcgacaagttgttcttcccccgaagaatcgtcaccaaagacattcttccatggtttttttacatgggggggggctcggttttgtaaaagattatgggtttgtgtcgaattattttattcttcttacccagtccttcggtggaatgatgaacatacaaagctcatgaataggattgacttccctagggcaaattgctttttaatgtttttcgggaattctttcaatcattaggttttatacctgtcggtatcggattcataatcttcgcgtggttcaaactgctcttcttcaaagggatagttcaagggcttgttcattatttcgtcgtctgatgaagaaccttcagtgcttgaagtctcctcatccgtttataatccaaagactggaatgggtttaatcatagccacctgtttttggggtgtgttagcagctaggttttttcggaggaggaaccctggtataatcaggagtattgggtttcttggcgttggatgaagtttcagccacctgtgaggaagagggttcagcttttccactccaaccatttttcaaggttgtcatttcttcctttgaaaagaagtattgggcgtctttatggcttatctcgtgtattccaaagggtctcagacccctagctattcttctttgtttaccattctttacatatttgaagcacgggagaaggaaaaagactttccactgtcctaaactaaggacgggaaggaagaaggcgagcatatcctctaaattgattatcctcaaatcagctcttcctggggtggggtattgtctgtcccgataaatagataattccaggagtaataaataggagtaaagtattgatataattggaattgcagaagcaaataccaatttactaaaaaaagaaaaaagtatctaatctaaagggctcattttcttttttaggatttaacaaaagggtttgcaaataaaagcgctagtgccacaactagtccataaattgttaaagcttccataaaagctagactaagcaataaagtacctcgtattttaccttcagcttctggctgtctcgcaataccttctacagcttgtcctgcagcagtaccttgaccaactccaggcccaatagaagcaagccctacggccaatccagcagcaattagtggaatgcctagtttgactagttggttcagtagcagaaacaacttatttccccgaaaaagacctagcttcttggacagctcaatccggtgcggcaggaacgaatgaaacgactagtggtcctcggaaccctacccgagcttatattccttgcttcaacgcccgcgccttccgtggaaaagtactagtgcttcttatggagcaagaaaacggatgcgcgtgctaacgctttcgcgctagtgcgctcaacccgttgcttgttgggcactgaacacttttcaagatccggttttggtaggacgaagatttttcactttcgtgaaggtcgttctgaggtggaatcgaaccactctgttaggatttagagtccaacgcgcaaagctaaagaggatttcaagtcccccgcccgccagaacctaaagattgctttatttttatacgatttattgagttaactaaaaagctggttcgttccatagagatcagacttagaaaaggaagctctgctaaaagctaaatcgctaataagttcaaacatcaaaggtacctgtctacatctacctacccgaagctactaaaacatcatcaacaacaacatcggaaactagatgaataattgaaacaatcgggttgaatggaattatctcgaggctattatgcgcaagcttggtttccaccaggtggaaaaggtgatgaaatgtgtgacgtcgatctctttttcggtgcttttcaatggtggccaactggagaagtttaagccaacgagaggcatccgtcaaggtgaccctatctccccatagtaagccagccaatagtaccctaacttaagaagttctcttagctagcgcatgtccattaatgtgaccaccgcatgctcctgcatgagtttcatgaatggtttgttttcgaatccattcttttttaggtatactatcttgcctcgagaaaggagctcgcaacaaaacgagagctttttgatagcccgttcactcgactaccacgcttagtaagtctgtctgcagggatgggaatggcgtagtctgtctgcccttcttcgtaagcaactggaactatcaaaagtcaatgtcaattggccttctaaaggctatagccctgtttcttttgaaaaaacgaatttcgagtttcgaagaagactggcttccaagaaagccactccgcctaaagagtcctaattcctatccggtctacattcactattcttcataggcactgcgctgggtcggtaggttgctgttttgacttttttcttcttgctttaatccagtcgctcgataggacttcccgtaacccgaaaaggttggttcttcccctacaacccctacccctccaaggcagtactcttcatcggcaaatccgaatgtctcgatccgagttgagacccacctacagaaattgatccatcaacggcttttttctatagtggcaggaagtctccaactcttcgatatgcgctagctaggtaatccctttacttaatctgatatgggatctcttgctaccagaaaggaactgaactggcttgcccggaaagaatggattgctacccttggagagctaatggtactggactgatagcgcactgattgaaccgaccccggacgtaccactggggaacctgtggctggagagaatctctcgcgatggaaagaaataaatcgaatctagaaagacgcgttctacctatgactgccatttgttcgcttttatctatcgtattggatagaattcaagtcccttaccgtattcatctattccctctcctttcagtcgagttgacctcggattctaaagcaacccacgggcataagcaaagaagttatcaagcttttgggatagcaagttatttctagggtaaaggcaaacaagctaacagtctaaggctaagtccctagagttccagttttaatagtcccattcctcctgccttccgccgacctgcggccttatcatagtagcccttctttcttgccagcgagatagttactacgaagtctgcatcgggagaatgggaataacgatcttttatatgatacggaaagcgaagagaatagactgctacatactaagttggttattcgtagatttttaccttcttggaaaataggaatggggattggcagggcatctactatcaactagttacttgggcaccggtgatacaccccaggataccttacctatttagacatttacgcctcgctgcgcgccttcccaacgagccaaaactatgcctaggcctcgggcttaggaactatactacaactagttttgtatagaaaacccagaaatacccatattcctttaaccttcacgaagaagttcgttagctccccctatgtcatactcctaaagaagttgtaataaaatgtgctgatccagatagatcaaatcctgattacgacttcttcattcggtttgtagccataccgtatagagttccaaatgcctttttttggaagtaactagattcaagcaagcatcctagcaaaacgatcttttgacaatgggctctgcccaacactgggactgactgactttatacagagatagaaaaggcagcaatccaagctctttttgaatcggatattggataggctaagctaggtgtagcccgctttctctacggttttgctgaacttgtcaagcccggggggcctttagggaattttggagaatgatagattctaggataacactttctaaggttgaaagggatggcatgggttaagcatctgactttggaccttcgagctaagttatttaataaggtcctactaattaattggaaatcctttttacaaatctcctcctcagagcgccctgtaaccttactttttctgaatggtacaccttatttaagacattcagaatagaagaagagcagtcgtcgattgattgaaagtggattgacggcattcatcagttgattgaaaatggacttttcttttatgatcgagcgaggtcccttttgggcttaaaagtcctttgagccgtggaatcccttttgtcttgatttaggagaataggcgcattgattaggttacgtggtttgagcaatctgcaggaagtttatttttttctttattatatataccattcatatttattattctatataccattcatattaaagtaagacggatagggcatatttgactaggaagcaagcaaagctagtccctccataccagctagcagtcttgtttagggagtctccttctttactgagtaaggttcccgggtgcctatgcgattattaaggcagggtgctactgtaccagtagtagagtggcttgaatcaaatcgtttgtctagagagggtgtagcgataaccaaagctgactgtactagaaactttagatcctgtataggcaactggccttagaatagtgtcttgaactacaggacaggaacgacccataatcattgacgaagaaggcttggaaaaggataaaacatattgaagagaagctttcacaaaggccaatagccgatagctgatgtcactagccttaacttctttatctacttgaaagctgatgagagtacggctttcttaaaggaagtgtccgtccctatgatattatatcatagtaaagagcccttggattcgcctttttccgtaagcctaaaggcaagggaagctcttcgtcgagcttcttatccattgaaaaagacagacttcaactttaagactaaaacctgcccctttattattattagtaagtaagataggttgcttgagccaatccttaaatcgtgggaggaaaaggcaaaaaagtgagcccacccgactaaaggaacggagaaattctgaacttcaataatcgaagagtggtcgtaggtgagcccaccccaggcaaatccacttatcgttatcttgctcctggtcaagctcccgtacccgctcctttccgtgggctttctttctgctttgacttgttccttttcttgctttcaggaagtcgtccttgacgagggccccttgatagccggtcttcgttgccaatgagaaagaaaggctcctgcttgtgtgcttagtctagccttgcaagcaacctcttcctaccagaggactaccatataccgatccttgctgttaccgcaaatcgatcaattcgttacttttcatcggaagaagtagcacgcaactcggaaagaaaaaacctctgatgctccttttttcttaatgatgcaactaatgtaatgcctagaactgatctattgcaagcccagatattcgattcctaacagaacaactcatgtgtgaagtagatagataagtagagttgctttcgctttgttaacttacgtaaggttgcgtaagatatgtgaatgtagttacgtgagcttgcttgcctcactttcctaatatattgttgacaacgcttgcaatagggcgtagtgttgcgctgggtcgtcttgttcggaagttgattgagaaaatatgcaggcgcaaattggatgcgtaaaccttggactcatcatagctatgctatggctatgtactagttgacgagcttgcctccagtacttgatagaagcccatgactctctatctgaaagtggtcttggccgtaagccgataggcgtagttgtagcgaagcggcgtatatcgtagttgttcggatagcaagctacctgacgtgataaggctactagtgccctccactcgtgcctactttcactaacctatagctattgcatgcaagctcaatcttctatctcgcattgctacgtgctcgaaacagccaattcgctcgtatagctaacgcaacctatagagtttggggagtgctgctattctttccaaatggtctctgagtgcggtctgtcaattcctgttgtagacatctgaggagagggggaagaagagtagacttactacttttgcaaatcaaagaaagaatttaaacagacatcaatcatctaatctgaattctttgacaattaatagatacctatcatagaaaaacctttctccaaggaagcttgcttcttgttccagatttgatctgatcctaaaataggttactttgctttccgctctatcggaaaacgttctaacgtattgattccgtaattctatttcaaaaaagagtgagactcaatctccttatgccatcccacgctaccgaagcagactcgctccgtctatgcgtcctgaacccgaagatagagaccccagctagacctatttagtttagttgcctcgggtgagctgaactaccagaactagttctttacaactcgtgccccggagccctctatctagaatagctctctctagatttcccagaaatgttaccagaataagttacaactgactatatcttcttttcccagcgacgcgccctcccactaagctctcaaccaatccaaggttaagaaaagaaagaaccaatggaatagttgcgaatagatcagtcaaacctcatcaagtccaggttttgtaggcaggtatccggataggtttatggttggaagagatagacacgaacggatagccttgtatgtatcggtatgaacaggtgttcaggtttaggaagagtaatttgaacagaagggctagctgcgcttattccgacaaggctgaacatgagttgctctcaaaggacttgacttctgaaatctctattctacgtttttcaactaatccacacgagaaaatcctatctttcaagctttctctcactaacttcgccaattgtccttcgctccagatggtcaatgtcttcagactagccatcagcccttggcttctgtacccttctttctaatcaatttagaccttaaatgaatagaactacccatttttttttctatgccttgtcaacttgcttggaaaacaacatgctcttcctttccaaaaatgtttttagactaaaaaggttcctttttatcttgtgcactctgatgtgcggggaccagcacctactacacctacaatgggtggcaatatttcatcttatttttttatgatttttctactttgattttacttggattatcttttcaaacatcgctcagagctcacgaaactttactttgatttgatttgaaaaaaaaaaagtttttttgctactagaatgctgctgagtacacagattcctctttcctttcaaggaacagcgagcgttttagggaaggatataggggcgaagcggctgctaaggtcctcttagactaaatagctttttatcaagctattatgatgctcgcttctcttcggtcctcgtcattaaaggaaattgtgcttcttcagttctacattaaaattgtgagtagattcttcagttttaagctgagaaatcttggatcaagacatacaaggcagcattggtcaaacataggactacctaggctaggtcattcattgcttggtccgctatattcgttttgtcttctagttctccacagggacttcctactactccgccgaatctctcatctgagaaagtaggtcacctgagtcgggtttacctgtggaatctaatgcattagggacagaatcccaagacgacgttggcgcagaagcaatctctgggtctctacctttagattacctggccatagaaacacgttctggcgaagatgaacaaacatcctcgggtaagtaaacttagagcaaagagaaagcgacaacgagatcatacttttattgcttttgaagttccttctactggtgtaccgggcacaggggatgttgcctcacctaactcctttatctccggcggattcgcatctatgtctctttgagaagactgccttgacaagtcaataatcaatcactagatttaggatcacaagccgatgcttcacgtcgaaatgggttagtctgcatctgagagaccccgcctagctctaaaatggtttcaacctttcctcgaccggaagcattatgatagttttcttcggctagaaaaggaagactcatagtcgcactgggagtgaacgatacaaacgatgaagctcccgaattggcataattgatgtataagaagaaataggatctgttgtccttggaaccgggcgcggccctctttccgctattatgagcgggttttgggttagccagagcgggccaatagggataaacaaagtatggaagtagttgtgaggtaatcagattgaacaaagcgtgctctcgatgctcccgcagttgactcatttcccgacgttcttgttgctcgaagcaagctccaaaagctgtgcttaaggctgttgttgttcctgggctggattcgactggcgagatagactacttgtttgcgactttccgtgctttactttcaaccgcgatgaggtcagcgtttcttagcggataacnnnnnnnnnnnnnnnnnnnnnnagtcgtaagatgaagtagcagatcctgaaccagctttggacatagttctttctttttttgattagaggaaagacggaggatgcttgccttgcgaatttgcaaaggactaacgagattgtttctatcgccaagatgagccgcttcgggctcaggagactatggtggtctatgatcaaataactggtggtgagactgcggctcaagtccacgtcgtgagaaagactgagctattctgtacttttctaaccctttgaaggatgaagatggcgaaggcgcgggcccatgataaggattcccaagcctacttggtcgatttggttgataacttttagtatgcctagggcggagactttgcatttccatgggtagagcactactagaatgttagccattcctattaggttactgagctcaagtagggattgtagcttcgaggacgttgaaacccgtcaagaacagctagtaaagtgaatggatcatgagccaaatgagtgaaacaatccttcaacaagagaagacaaaaagtatgaccttacactcctgtgcattgaatgaatagaaataaccaggattcgccgccagacgaaaggaatgaaacatgttgtgtctgtttcagatcgagattgtgatgtgtgatgaacgcagctcggttcttccaataagccaggtaggcgggtaattctctccgtatggctggaagtgcatgctctcacttcgagtttcaattcaatcttatcgcaaacgctctacgcctcgtcgaataagagtgtttctggatcatatctattcttctcgggtactctttcttaatgagaaaatcataacttgatctgatctttatgtcgcacagtggtgtcccaggctagggctgcaggtccagcataagaatctaaactaaaaaagtatgtttacgtggtccataaataatagtgacagaaatccctcctactgcgcctcaacttggactggagctttcgggtctctaggtattgaattaaagaacgggtttagctttgctttggggggagtcctggtggggagatatgctagcaggtaatggctcagcttctacttaaaaagcgttttaagcgggtttccttatttatttgcgggtctctcgtacaagattctatcagttacagcggattcaagggatggagccagatctactatccgcttgctgtccctaagctgataattgcccgagcctatttgtttttttccggggaggggcacatagcgatagatactttataaacctatcactaagaagcgggctcactgaaaaccaaactgttcgtatttctttaaaacgctgctgccctagccgggggtctgtctatagaagaagggaatccagaggaagaagcagctccccgaaggaatccttctaactaccacctatctacctcccgcttttgttcggacaaggcgagtttcctaagattcacccaccgcggatacactaagcgttcttcccgttggtaaatctgattcttgcaaatcaacatcagacttagaagcttcatggggtctggtctcgccatttggcaatttaagccaaacaaaatacagtacagaggttataaccaatacacaagcaggcgtgaaccagtcagaaattagaatggagaagtagacacagaagaggaggttgttgggacagtatcgatagccgccttttcacttattgctaggagtgattgtgagagaatacataacataggtgaaagccaaaaggcatatatgaccccccaatggaagtgatttgaaactgacgtttctttagaattcgattaagaataagaacatagaccggcttctagaaaaagagacgtgccctcttctctatctgtagattcaggagcaacatgctggttccttttgtcataatacctaacggctgtgggcagaatgaatgaaaaagcagatgaaagacactatacataccgatagaatgataaatttagaataaagctaggtgacatcacggcatttgagaaccaattgcttcttttgcttttcaccaaccttcatgtacaatcttatttcgtattggagtacagcctatcgtaggcccagcaaaggcaagacggaaagcaagcattaagtgaagaagcaaggtccaaacaaagtagtgaaagattgacattgaaaagcttctccatgtctatatctgtccgatggaccaagttcaaaggaaacggcttctctactgcatcaaaaaaccaatccaagcctgaaaaggagagttgcggttaacgattcctataaattgagaaagaagcatgttcttcatgcccaaaagcggataaagtagatggaacctgttctctaaccttctttttgtagcagatactgcataaagtttacctgccttgtaaggcttttgtaggattaatcaaatttgctttttctcgttctatctcagagtatccattcattcgatcttgctatccgctctcaattgaatcccttctctgttgtcgacaggtgtgtccgcatcaggaccagaatcacggtctagtacctccgtactcgaatacctcctactttattaattaggaagtgaagtagggaacggtttcctattcaaagtacagtgcctttggtacattggtgcattggggatttccaggtagcaggtcggttgagtgagggctccatccataacagatatagctagcgcacaggatctcccttctgcgaacaaaaggacaaaagagccgggtcgggcgttgattcgccgttgctatcagtcggtctactcgtgcctgctgcttactttctcgatcgatggaatcggtgattcgaaaaacctaacatccataaggagtctcaatcgtagctcactcgttgccttactctcccacaagatcacactaaatacaataggtgcgtgatctactagattcttatataatcaatttctcaccttagttgatagacaggaaccaccatcccataacaaaaaaggggggcgaaggttattttgtaccaatgaagacggatttctctctcgagctgctcaaagatctttaagtggcttacgaggtagacttgatcatgatccatatccaaccttctcccatctgcttctgcctaagtatttgttttcatttctttgattgaacattccaagcttcctttctattatacctaatgcccatagctagttttattttatatttgtctattctttttgaaaaagctttatccgccccgtgcgagagagttgaacaaatagcatagcctctgggatgttggccctagtgaaggggagctcttcgcagctgtcagtggaaagatggaaattggttctaaaagagccgagctagggataagagatacggttggttggctgaatggaaggaatgctattctaatgggaaccgggaaaagaatggttcccaatacagggcccgaagaagagagacgaaagaaagtagtgaaagaagaaataaagtacgcggataaaagtgaaaaatcacatagctactaagtcaaaacgtccaatgagaatggagatcaagaaggacatgaaatccattagcagctctatcagttatttcattattggcattccttaaccaatagaaaaagaaagagatcacaagcgttatcagtctccagacgcatctatctataaaaaggagtagggcacctgatatgagatacatactggagtcaaggattgagaccactagtgagaaggcaaagaaatcgtttttatgtatcggaagggaaagaaggaccatccattggcaagcacttaaggacaatggctggattaatgaactccgacaactgctttcccttgcagcacgttgccaactaagctctcttacgtaccaactgagccacttatttacaacggaaaggtaagtccgttaggcacaactgcaaatggagtttattaccttagcattcccaactgtaagggattaccttaggacaactggaaatgggacgggggaggcttgagcaacaaatctttcagcttcatatgccgccgatccttgacaggcaaaagaaaacctctattccgaggctagctttcttccttgtttggtggggctctccgcctttacctgcccgttctttccttgccaccattgtggtgccggtctcaccccctctgctgaggaatcaaagatcctcttcttcctgtgtacctctagtgactcgactcgtgtcttggaggtccaaatgttcctatttgcctttgcgtttttgcgcctctagaagcctcatcgctttttcacggtcaaagttcaagaaatagggtttctgatcagcagaaagaatgaactgtagacccgctaaacagctgcaccaagaaaaatggctctttcggcaccctcaagaatagcttgtgcgttggcccaaagaagccctgggtaaagctcgattagtacataaaaaaaggaccctccccggggcggaggaaacggcaaccctactgcattggaacatcgtctcctcaccatctccctccccatcgtctccttcttcacttccccggaactgcacatcaggattcttcaatccttctatctggcctccgtacccgtagtggagtaccttgctactttcaatattcaagtcattttcattgtttgtttttagttttgttgtggagaaagagggctacttaggaagcaaggtaactctatcaccttccgtccgtcttttcttgaacatttgacttcgcgaatcctagcttttataagggaaaaccaacatcacgtaagatgaggcctatccttcccgaaagcgtcggctagttctattctattctaacttgactgacttcctctaaaagaagagttaacacggtcgaaggtcaaagcagaaagggtttgagcttctttggcaacttagctattctttggcaacagagctattgcaatagagaaatcgagggaaataggcttaacctacagagaaagagtgtaaggaaagaatgcagaaaaagatagaaaaagtgagtgaaacaaatgaaatcagagtaagaaatctcacaaatagtaggttttaccggactagaacaaacgaattagcttgttttaactaaaaagcacagttgagcaggaacgaagtgtgaacataggcacaaaaacaacgttttggtgatcctgtgtagttgcttgctttccgcttgagctactttcactgtgaagaagaggacttcatctcttcacttacccaaggaacttggaaataacgcgtctggcttggaaagctagttagggatattcgatagaggaaggacccgtttcgagtagtgaacgcaccaagaaaagccttttattttaagccatgcttggtaacgcacatgtcctactctacctgcatcgggactggtgagagccggcgatgcacggaattttggaaacgctctacttcactaaggaagatacgtttcacttttccgatcggaattttaactctggctggttcaggttacagtcagaggaaataagaagtatggtaagatgaatgaaaggcaaaaatataggacatacgctttatcgcagaacatctatttgctttctattcgacaagaaggacaaggaaaagataatggatatggaacacaggtcctggcactattggaaaatgaagctctctcagttcaaacatatgagattacttaccccggtttctaagggcggaagaggaaagtaccaaggtgcactaggtgagaagaacttttttcgcttttttatcggaatttgactcattttagtatagaaaaacaccattctatccgacctagtaggaaaagttactattttgcattccttagggaaagtggcattttcaagggtcatttttgaaaagcatttgtcccaaccatgtgcaaaagtaaagaaaattgcttctccctcgtaaatggctccaaaatctgctccatttttgaaaacttgatagccagcatggggcaatttggtagttttttcattttgcttgtaaatcggctctttttggcatcccagttctgaactttttcatctcgcctagtggaacttgagactttttccagtatctttatccagcagcaggactttcactactttcccaagtaaagctagtgttaagagactggattgtagaagtgttgactgacttgactggaaatataatatggaaagactgatggactgactgaagtggctatttcctgattccgatatggcgtcctgaatccgatattgcttgattgtctgttgatgcccagccgaagaagtgacttgcttaacgcagcaatttctgttttcttgtgctctccacctccgcttgacactctcgtagtagatcataagagaagtattctttcaagaaattcgtatagaaagatggactagctcgagaacaagcaacggattgagcgcactagcgcgaaagcgttagcacgcgcatccgttttcttgctccttggcttcaaacaatcgattgaatctggattcctttgcttatccttcctggctatagtctctcttgtgccttcggcagttcagttaaagatttctgtatcagcagtttgtttccccatttgctcaaagaacgcataaaacctgttccctcaccgtatcaaaagatcaagcggaagagtcctcttcttcaagaagagtttttcatttcactcttccgcagcaatgcccgggcaagaaaacaatatgagcaaatccgcaaaacaatatcatagcaaacggtatgtgctggttggatagagcaatcagtagttgacgttcgaaccaatcttctctctagtagactttagattcagtcgtccgtttgttttgttttcaattgacatagagaaatcttcccactacgtaattaaggaataggtggcgaaggcccttggcggactatatataaaggaaaggggttatttttcctttacggcaataagagctgattcccttgcttgtagtttttgatcgatggagtgtatttaacatatttaagagtggttaggagagagaatcaatgtttagtagtaggcccggttcaccaggttctaccactgttcggcccaatcatagtcaaaatct

SEQ ID NO: 80562 - DNA, 3488 bp, Oryza sativa
ctttgggcaactaagtgatttttaaatgcggtttactgcaaaacttaatccctatattattattcccttgtacttcccttgcattaatcatgcacctccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtgtggtgtaccccggcttttcctgggatggggattaatacactagcgttcgggaaaaggcaattttcccggtcgcgacaagctggtatcagagccaggttgactgtaggataagccaagtggataaaacctaaggacatattttatgaataaaactatttgcgaaagttcctttttctccttcccctaatgctatttgcaaaaggtttactccgttcttccttcttcggattttcaactagtactagatggtcaggtcagtgaagaagaggacatcgtcagttgtttgccgaagctccagaagactgcaggatctgctagtgaagtggaggaagcagtgaagccagctgtgaagcaggagtgaagatcttggagaacccgtcgcagaacctaagccaccctctagtgtttcgtttgtagtgtgtttccttgcttgtgtgtgtagcgcatggtttgcatcggtgggttgtgatgtgaccatgctaggttgtttgtttaatcaacttgcagaataagcctaacatacatcataacagcaaaagacttagatctgttaaggtcctatccttagtttctaatctgtctctccccttcgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaacaaattgcttatagagatactacagcagcatcggatgccaattttgaacccgagtcagatgcaacctcaagtgcagttggaggcagtccaagcactcacaccacaagtcagcgcaccgccaacatcccagaaggcccctcatgccatgccgcatgttgacccaaaagaagcaagtatcatctgttttatgtgtgatgagcaagggcactacgcaaggaactgtcctcagcagaaaagaaaagcaccaatgcgaatcgaagatgaagtccgtaagatgatcattaccagcacagaatggcctccaccaggaatgacaaaacatcagagaagaaattccttccgaggtgcacaacagttgacagagcatcttttagctaatggaggtagagtgtctgatagcgaagattccgatcaagtctcctcagatgatgaagatgagaagtctccccaaggttttaaccagaataaaatggaacgtaaggcatgctctcgttgtggagaaatcggtcatgttgccagctcgtgtgccactacctgctttcattgtgaggaagaccgtccacccggtgaatgccccatgagcaggatcacttgtttcttttgtgaaggaactgatcatgtaccaaaagattgtcaattcagttttctgctgacgaagaagatggccaaccaacccaccagttccaacggagagaagcatcaaggcaacacaaatccccgccaagattaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccagcacgtcagtccacgcaactccctgcaatcagaagcttgctcctcagcgaattgtcatccatgcatcccaaagcagtcctatagcccgcgttgcaacagctccaactccagcgagtgcattaccacaaggtgtcaatgctcaatttcagccccagccatcagttgacaagacagaggccagtatcggcattgtacctttggatgttccagcacagcagccaagaaatcaagtacaggatgaagaacccaagcgtaagaaagttatttacaacggtagtacctgttaaggaagcagacgtgccaatcgccaagtggtcactggagcaaatgcagtacctgttaagcctagcgctagtcagaagcaaccataatactcttatatcagtaatcatatacttatgttttatagttgttccccgtcaatcatgtaataacagagaaacatgagataatgaatgagcttgataagtttattgagggatccatgttagggttgcaagtgctgtgagttgtgtacattttgttgctgattagggagacctagggtctcatttccgtaagctcataatcttttatgaatcaaataacctagcgattgatggcgaagcaaatcaagtgattaacccaagagacatttgtttggactaagagtttcagatgtgtctttttcggatcaaaggcaatgacagtcagtatagcttttggcgaaacacttcaaggtttcactgaaaggtagcagaccaaaggacctcatcgccaccagaagcatccacaactctcggagtgaagagtacttagtgaccaaagtcaaaggatgactgatagaagatatcgaaaaagatgtttattaccaggcaaagaagtaggtcgaaaggtgattgataagagaaatcgggaaagaacacatcaagggcaaaggtgtaaaggaatacgttgaatgctaaatgatgacaagcatggtatcctagtaatgacgagctgatctcgacgcatgacatgaagtgggtaacttgtatgaggttgactccaaagatatgaactatgcaaagttctggaactgaagccccatcttcaagtgccgcaacccagtcgaagtcagctaaaggttcaaccagggacaagtcaggtgaagagaagattccatttgcaacaggagatcgagccaagcagttcggagtggagaagttgtcctaggcaagtttgttacaaaagacggagcggaagaagtcagacaagaagagaggaccgccaacctatcttcttgctagcctcttcgaatctcggggacgagattcttgtaaggggggtggatttgtcacgtcctgataaattcatcccgaaataaaaatcattcgctaaaaggaataatagaattaattaaaattcgaaaagaaattggccaaccctaaaatacgtacaagaaaaatttgaatgtgggccggaggatttttggttaattttccttggtttaaaaggagccttcaaatttaacttgaattttcagagcaccggaa

SEQ ID NO: 80563 - DNA, 647 bp, Oryza sativa
atatatgtctagattcattgacatatatgtgaatgtgggcaatgctagaaagtcttataatatgaaatggaggaagtataattttaaggtctcaacttacctatcatccttccagaatgagtggtgatctaactcaggtacaacaagtgtggcattcaatattcgggcgacaacaacagcatctgttatctggaaactgaagatcgtaatggtaatacaatggataatacaaagcaacgcaataaaaagttgaaatacagttgtacccctatgcgctgctgatttagtcccccgctagtaccaatcagcaagtaaccagtagaactgttctccggcacagcagctgaaagatgaacatatggaatcactgtgttaaatattcttccactcatctagttataattgtccaaaagggaggatgatttaataagcaaactaacatctgaaatttacgctcctcctgctgcagcgttatgggcggggccgtttcgacgttcccgtgtcactgtgatactcgtcgcgtgctcgcgctcgcagcagtccaacagaatgcggactcgcccaatcatggtacggcaacagtgtaggaatatatgtactgtttgacgattatgcaacctgcagtatgtggtggttgtaacttgtag

SEQ ID NO: 80564 - DNA, 2079 bp, Oryza sativa
ctcagcgcatgcccttaacctgaaaacatgctgatgttcctaggattacaaactgatatagacgtgtgattgtacaggaactgacaagacaagaaggcttgatgctatgaatagagtaatttatgaagttttcccagaaccaaaccgacaacttttgcagaggtatctaccttggatgttttttttttttttttgaaattacacactttgtgtatgtctgaggttttcatttgtgaagaaccagttctcattttttgtagttctcaatcattttattatgaatgtatgagttagctttagattagactgtagtacaataatactccctccgtttcatattataagtcgtttgattttttttcttagtcaaacttcattaagtttgaccaagtttgtagaaaaatgtagtattattttcaatataaaagaaacatattattaaaatatatttaatgttaaatttaatgaaactaatttagtgttgtagatgttgctagttttttctataaacttagtcaaacctaaaaaactttgactaagaaaaaaaacaaacgacttataatgtgaaacggatggagtagcttcatgttccacctatggattccaaaactcactagttttcttttaggactcttaagatgatgcagattgttgaatcacacaaagctgtgaataggatgtctcaatctgctttggcggcttgcatggaccactccttctccgacctcttcttctcggtgaatgtgaaattgatagcgactttagtatggctggggatggttcattccagctgcttcaagctgcagctgctgccaaccatgctcaagcaatcgtcatcattatgctcgaagaatacgatcagatatttgatgtatcctctttttcctttacatgttcctttctacacagtcaagttccatttgaagttatactgcattgactcttgatggattctaatttagcagttacctgtataggacttggaagacggttcctactcttcagatgcatatactgagtccgaagacggtgattttgacaaggaatattccacagacaacgatggccctgaagaggatgactcttatgattctggtgaagataacattgaagaagacatggatgatgatactgagcactcatctggtggcagtgaatgtgacaacaacattaagaccagtgtctctgatgacaaggtacttcaactagtcatcgtttttccaatcttaattacattgaatgacctccttcggtcattctggcaaaaaactagtcatcgttttgatttcaagcattacagatgtgttgtgtctaaaggtccagtaacgagggagcttcccttgtgttgccttttatgatccggcgatgcgtttttttgttgatttcagtggttaactgctgaatttgtgttgtaattgtccttctaaatggttagcatacttggattaacttcttatatactatctccactcctaaatagaagtttttacgagtttgatcatttttccacttttgataacgtaatataacattgatagtagaacatgttagtttataattttaaaccaataataggcttaaatgtttgaccatgctaatggtgaacctgaaatgtatgcaaactagaatatactgaaagccagcacgagactgttatgctgctgcaattgtacaaagaactgcagtagctgctaccccactgtctgctacagttttttatgcttttagatcaccgatatgagcaattcttaggttacctctgaaaaagtatgcccaaagttgaatcagtatttcaagctatatgcccaaagttgaatcagtatttcaagctaacttagaattgaagtgcaaatctttcatagggatgcttgtaactttgttctgacatgaaaagaacgatctgttcacagtagctcaatgatgtgagatgtgaaaatgaacacgaccatcgactacatctccacaactttgtagaagccttgaataagtaactgacgtggttaagtatactgattacccagaattacatctttgtgtctctgacttaatgcaaatgcaatttctacgccacccttacaa

SEQ ID NO: 80565 - DNA, 2364 bp, Oryza sativa
gtatgcgagttgcttgtgtgagctgatgaggaagtctgcgttgaggggcaaagattttgtagggtcattctgcttctattttggggagtctaatttttgtgctcgttgcttcacttcggtgtacatgaactgctgaactcctttcttgcatatggaaaatggggggtgggcatcacgtgcggcattcctagataatgacaatgagcaaagcatgcacaatgctatgagaaaactgcaagccaaacgtgcaaaaaatttcaccagagataaacacgaagaacatgcattacccagggaaaacacgatgcctgatattggaggatgcagaacttgtgctggatgagaacgatttttgagatggcatagcgaagacgaacgcagtcatgctgtcatgcatgctcacaacctcggctgctaaacggcgggcttagtatccagctcttggcaaataagcaagccattgtagtcttcgggagctcagacaagtgcattcttcttagcgattaaccagggttgttaagtattttatgcccatcatggaggccctcatgtaaggaggccgacacaactgcggagtccaggcgacgccctacacttcctcggcgctctcatcgaacacgacacccatctccccttgtgtaaccaaagccgggtagagctttttttagcaacttgctactttccttgcaagggggctagaatagatcgtgtatgtactatatactaagtgcaacttttggaaataaaaaccccttgacattactctagcatggggaattgtctaggagctgaagaaagatcccctgagatagtagtattttgttgagaaaaactccgaattaattaccttgttgaattattgcgacggttcaatttacacctctaaactataaaaccaaaaattctacccactcaactcttcaaatcggacctataaccccctatcccaatccaaaatggatttgatcttatgtggcatcagacgcggcgattaattttttttttaatctacatgacagttggcccacttgacatcgatttttttttattttttttgaacatttttattttttaattttaaaataaacccttcaaaatattattttcaaaatctgaatcttttggccatgccagcccgcttagagtggcaaaacaacactgacatgccacacgcaacaagcgtgacagttttgtaccgtcgtgaccaaataacactgccacgccatctagaccggcatgacaatgttgttttaccacgccagtctggctggcttggctgaaaggttcatatcttataaataagttttgaaagggtttatttttaaaattaaaaagttcaaaaaaaattccttgatagctctatcttctctatttttttcttcacagcccaagagagaaaatgggagggcagggaggtagtgggtcatgggtgtccacggcgaagtcccgcgagtgacgacgctagcgagcagcggcgcggtagcaggagtctaacaccgaggctcgaggaggggcgcctagcggacagagctagagaagggggcgccgtcgtgctcactggccaggaaggcaggtacacaactagatctgaccacgggtcgtcagtgccttctggttgcagatgtgcaggtacatcgttcccgtcattgtgctgccgcacgtgtagctgcatccagcattgccatctagtgagctagctaagctcaaatactcaatcgtgaaggaggaagaagcttattaattagttggctcaccggagaggcagagacgatgttggccgtagctgcaagtgacatggttgcacccgctgcttatatacttgttgccaaggccttctactcctgccttgttggctttgttgccttgctcttgctgcttctgtttcaggacaccaggcggtgtcctccttgccgttttcagatacgaagaagaggaattggctccgcggaaaccaaaagattggttgacatgctagtacattgctactgcttcttgctctttgttgacatgctagtacattgcaaaagatagtgaattgggcgattttgccgcagcggcgcttggactcaacgcatggaagcggcgctggtgaggtttagatcgaaaagttgtcgtcgagttacttcccttccttcatcgctacatctgaggtcgagagagagatagagggagagatatgacatgtgggcccactgttgctttctttattttttcagttggaatgccacgtgtgtactagtttgtgcagaaaacaactcaaaatagtttttagtatttgtccggtttgaagaatcccgtacacaaaatgtctggtttgtagttcgcgggtgtaaatcggaccgatgcaataatttaggggtgtaa

SEQ ID NO: 80566 - DNA, 1786 bp, Oryza sativa
acgatgtttcgccgaagttattgatcgagccgactaacgactgcacgcacgagtggacaatgtctttgatcattcatcactgggtcagtttgctcctttttttataaaaaaaaaatcactgggtcagttagttagtcagaccttctttgtttaggcttagacttattggcctagattttttaagtcaacttattgacttatatgatttataagccagtggatttaatgtcctaagtttagtggtggagttatacatctatctcatataagaaaaaaaagcttctctaacctaacttttggcttaatagtattagagtggcttatggctttaaaaaagtcaaataaaaaactgcttgtttgttttggcttagacttttcgacttataaattggcttataagcctaagcaaaagagggcctcaaaacaatcgccgtcgaccaaccaaacaggaaacaagatttgagaaatagtacgagttagtagttcatatgctacggcgcctacaccaggttgtgcacaatgcaccgctaggctaattctgaatgtagacgtgcctgctgagcttggacgacctacacgaaacgcgatccgaagaaacatccattgttcatgggacgcgcgttaatgcattatacctggggctaaaaccaaatggcgatgggaacacctatatatttatcgataaattttctcctaaaaatttgacagatgtaattatagtataatcgtagtgtaattacactgtaatttgtatgtaattacactgtaatttgcatataactacagtgtaacttgtatataagtttcacgtaattttgaatcgttagatctattacaagatttgttttggtgaggaagaaaaaacaatcacagcacacatatatgtgaaagaatttgttcccacaacctccattttaccgaaataacatgttacggagagatttttgaaagttacatacaagttacattatagttacagtgtaattacactacgattgtgtaattacatgcaagttacagtgtaattacactacgattgtactgtaattacatctgtcaaatttttcggggaaatttgtcaacaaatatatagcaaaattgaatggggattcaccccctccatccggccatcccatgagatcggtgcacacacgcgtcggtgacaggcgccgcgcgcaatggggaaatgggaaacgggaggcaggcggcagtgacaaggttgcgccacacgcgcggcggggagcggttgcgtacgtcgattgttgcgtacgcctactcgcgctggcggggttttatggccgcgcgcgtcgggcgaatcgaaggcttcgcgatctcgcaaacacatgaaccgtggcccttgcgcgctcgacgtcatgcacgtaatctgggcagttatacacaccaaccgcccggcgtctggctcgtcgtcacgtcgtcccccgctatcctctccacgcgcgcatatctatctatctatctccgcttttgcgtggcgtggctgcgcgtgacggcgtgaggctgtgagatgcggacttgtggcacgtgcctaggcaagcgcggtgagcctctctgttttcaaacgcccggggcaggttgtaacgctccgcttttcgtgagtcgttaaaaaaaaactaactcggcaaaatcctaattgcgaaaattttcgttctttgtgtagagtctaagttgtgccaaggatctcaatttaatcccgttgttccctctcatcgaaatcagaatcctccacctcgaaaattcctcttccgattcgagtctccaaaatcaa

SEQ ID NO: 80567 - DNA, 10123 bp, Oryza sativa
tacagtagctcatcatatgattgcttagtagtgattagctcatggctacgcctgtcactaatctcaatgtcacaggaggaaactatgatatggtaagcaataatgggctatacatgctaatatatgcttataacgggctataatatatgcttaaaatagcctgctgcatgcatcctctgattgaaatatccatactgttggaaaaactgagattttctgaagttggtatagttatggtagatacatagtgcaatcagaattggcaatggtgatagcttttcagaacttttctctggtatggtagtatttgcttcacttctaattatttccatgatctatggttgtatattgtttctaacagaaaagggattgtagttcaaggaacagaaaagggattgtagttgaaggaatctagtattctttgtttgtaacttagaaggatttcttcagcattcaagttcagaggttcaggtaaaccgaaaaaaagtagaaaattttatcttcatgcaaatttatgcaaatgtgatatatagaaaaatatgcatcaactttgagttgtatctttatatactaatcattggaaagtttttatttgatttttttcatacattattggactagatcagtatatatattgtgttgaaatttctcatatagaaaaaatagtatgctttattagttcattgtggataaacaattggtgattcttattccaagataaatactggtcttgttgctgaaatcacataatagtattcttatccaatgcaagttttcattgtattatctgtgttagattcattttccttatgcgcagaactgtatgcaccgtccttttatccattggactgcatgctttaattttttcaaagcaacaatagcatttctcatccatcacaatatttgtgctgccaaatttttagaaataaaagcattgaactccaattctgtgtgattatttaggagatctcacaaggcactgttctattcatttacttccgcagtctcaaaatttgtgaattgccggacatgtcaaacttaattgcttatccatgtaagattcaataaaagtagaataacatgaagttttaagtttgtcaaacatatttcagatattgatgttaatatggcatctatccaaattatctgtcacagttacaaacaggtttacttcttattacttaataatgattagcttgattggcaactgttatgtcttagatacttccgttctcgcttaactcattttgtggcgtaatccgtgtttgatctttcatatgtacaattcaatgtaaattttatgggcttaacagggatattttcatcatgatcaactgcaggtacagtttattgtacacattacacatacaagttgatactcagttggaacttaagagcaaagatgcacgttcaggtgcaacaatggatcaagcagcaaataattttatgaagaatatagaaatagacacactttgtaaaatcgtttagaaattgtacttattgttgatatgtggattgatgaaaataacatttgcttcgtatgcaattcaaattgccatgttgatttgtgttatttgagatatgtgatgcctataaaggatattttgaaatattttggcacattcctgaaaattaaaaggcaacaatgtaaaaaaaaagctaattagagcattattggtaatcaaatcattattgttttgctgtactgtgcatttgatgtgttactagtggccaagatatgtgttaccgggacctatagcaaggtgttccaaagtgcaacctgaggttaaaaaatggtgttactgttggtatttcttaacgacattactagaaatataattcccagcaatggcgcataaatacttttggtatattatagttacagagtttatccgcaagcgcacggatataccattatagcatttcacccgagagtattccaagggtattgtatttattttatcccgtgggaagatcatgtagagaggacttgactaataatttatatgttgcttgtaataatcatattctaagtaggagttaagataatccaagggtagagtgacacacaagcattaactactcattttcataatatattatctaagctaagtggaaagaaaagaggaagataatctattcctatacttctaatatacatagtatacatacatcttagttaactgatatactagctaataccctctttccgatgcccttctggtacttcgagaagccacccctgactgctgagttccttacgacagcccatcataaccacacaaccgggctaaatacggaggaataccctccccaggaaattaacttaggattatatataggcgcggaggaatacctgtactgagctgtcaccatcagcggcccacctctcatccgcaatatataaccccaaataatgatatcccgtaatctagacaccacgtctaaactaccagatactactctaatatcatcgtcatgacatagagtaattgcataagcaaacattatacccgcaccaaagcatctcctagataagctagccgtatattcagtataacaagaacataatataaagtaggtactcatatactcggaaagtatttcaataccataaatgtatttagaagagtattctaataaaagtacaaggcttacaaaagagaagagaaaagctgctagagtcatacccgaactcttccgaagactttcggactcctgatttctactctattcctattccactagctagatactactaaactaagcttgagagaaatgagagagctattgcttgaggtgtgtgttgaagtgaagagagtgagctccttatatagaggtagttatgacggttgtggaaggggaattgtccgaagtgccatccaactgtcattgggatgcaatcctggacgtccacgccaaaacctggatccaacggcgcaaggattggttcggccgaaccaccaggttgggccgaacctggggctggcccaatctagcccaatttcggctggtggcctcctctattgctccactttgcagacttgtgaattttgtcccaattcatcgtgtcaattctgagttcttggcccattcatacataagtctgattgtcgacatcgtgcgattgatttatcgtctgtgttgatgtcgattctccttcactttattgtcattctctgcaaaatgttagtatacctaatactagtggaatattattattctaacgtaattatgcattgcaagcatcactagttctcctctattttggcaatattgatggtcgaaactgatcgataacaaccgtcaacagttactagtatatgccttgtaacatctaatatgtgcgactacgatatggttgtaacacctttttctactttgttggaacacttagttatgtgctactaggctttgttgtaacacccttttttataggttggaacactaaatatgtgctactagactatatgcccgtaacataggcagttgcatcacttatattttgtgttactgcggacctcagtaacacctttttgggtatgtagtagcacatagctgtgttacaacagccatgtcctgtagtagtgttaatgccgctgtaaactatctatacgcccttaaaataatcacactagtgcaaaaatgatttttctggacaaatactctaataggtttccataaatgtttgtgtctgtaaaaatcaactcccattttcacatacggctcagagacccgcacacaaaattcaatttttgccaaacagaccacttaaagcgtccgtacgcgaaaataagggtgtatttttgcatgcggggctcttaactcaccagcatgcaaaaatacccctcctcttcccactcttcttgtattctcccctcccctcccctctctctttctctctctcccggcctcacccacttctactctcctctctcccactcctctcctctgtcccggcctcacccactcctcttcctctcccagctcctcttcccgcttctcctccctctcgatggtgagcactagcggcggcggcgacaggcaagggtgcctgcgggtgtgggcgacagtgcacgacagtctcctccttgctcccccacgcgcggcgggtggtggtgggtgcagaatccggcaggcggcggccaacccccgcacagattcagtggcggcaccttcaggagtgcctgctgcgaaggagggcggcgactgcggtgaccgtgagggcggcagatccggcgattgcggcgatggcgggcgtgagcgacagctacaatggtagccccttgggcctcccccacgtggatccggcaataggctcgagtgggaggccaacggcggctctccctagcctcccattccaacgcggatccggcagcaggcagcatgatggcggtaggcacgggctccgcaacatgcgcggacgtcagcgacagtgtggattcggcctccacgcgcgcggattcgcggctggcgatgatggttggtacggaaccgccgacagtggagacgggagaggcagatccgccagcgacgatggtggcggcaaccggctagggttaggtctttgtgttttggaatttttttttgcgattttccattttcacgtgcgcgaaaatccgattttcgtatacgggtgtgccacccgtatgcaaaaatagcaattttcacagaccatttcactactactcatcaaataggtgtctgcattataggtgccggaagtgctaaaaccggcacctataggcctttgctacctccatggtccgaaaataataaaaaccggcacatttaagtgataataggtgtcggttctgtaaaagaaaacaacaccatgttagtttttcagtaaaaactgacaactttataggtgccggttttttaaaaaaccgacacatttattatcgagccgagccgagccggaggagatatttcttctcccggcggggcccacactcagaggagataaggccagctttctccatttctctcgatcttttctccactgctcctctctcgctttccctccctctctatgtggagccgcagcccggcgacgacggcggtaccggcccggcagaggcgggaggtatggcggcgccctcccctccgccaaatccggcaggggcgggaggggaggcgtggtggcggcggatggcatggaggtgcaacagcggcagatggcgggagggtaggaggcggtggcagacggtgggagcgccctccctctgccaactctggaggcctgacggtgggaggagaggcggtggtggcctggtggtggcccggtggcggcggatccttggggcgacggtggcagcggtggcgccctcccctccgccagatccggcgggaggggaggcagcagcggtggcggcggtggcggcgatgttggggggcttcggatccggcggcatctctgtccgcctcccctcgcctacggtgcccgatggtgtcctgttgcttccacctccggtgagaacctgtgctgacttgctgttgattgtctgaacatttatgatgtttgattcaatgatgtgaaaatttgatgaacatttgatgcatgaacttgttgttgagtgtctgatgtgaaaattacatgaacatttgacccatgaacttaattgttgattgtctgattgtggattattttctcttttttttggatttatttttggtgctttgaagcatcggctcggcgagccggattttttttttgtaaatcgtatacctcaaaggtgccggttcctaacggggtttgccaaccggcaccgaaagccctttctgtggtagtgttttgtgcatgcagctagccataccgcacgcaaaaaccccttttggacagtccgcaagaaacatttttgtaccagtgtcatttgcaaaacgttgtaaatggtatacaactttacagatgcttcttcgttgtatctccagtacacttataagttacttatatactctctccgctcttatttttttgaaaatgtatctattgactaataagtacactaataatatctacgccaagtattatataggttatatcattagatttgtgttttaaaatactttcatgtgatactgattttgtagttgttgatgatataatatacatgaaatagtttgatactacgccggaccaggtcatctctgacgggcccaaaccctcacctttgatgggtttggccttggtcagtgattagtggtcactgatgacaaaatcacctgtgacgggtgaaacacccgtcacagataactcatctctgaccggtatataagtcatctctgacgggttaaaacttgtcacccgtcacagataagtcatcagtgacgtgtcataactacctgaccatcactgacgactaatctctgacgggttgaaacttacgacccgtcactgatgacaaagcaagaaatacaatttttaaattttaaacgcaacaaaaaaaacctcaaaaaaatattttgaattttactagccatcctatacatagttacacatcactacctacaaattcacaatttttcacgcaatataacttgcatgctaaacgtgagattcaaacttaagacctcaaccaccatagagagcttccttaccaactcacctactcagcacatattgattactcacccaatgttattattttgtctatgtttgtctgaatcatttaacatatatttaacaccctaaatgacttcaaatgaaaatattatcaactaaatagttatagatctcatcgtgttttataacttttacatagaaaatatcttcatccgatgttgtttgaagaattcaaaatttcatttttcaaaatagatctcactttataacatgtattttgaacatgtaaactttgtcaaatgaaaatattttcaattattaatgttgtagatctggttgagttctatgactttgatatggggcatgtatccatccatgtcatttgaaaaaaaactcaaaattttgtttttaaaagtagatctcatcacttgtaatgcatcttcggggatgtaaacgatctctaatagaaatgttattagttataaagttgtggatatcatcgagagctacaactttacttttatataggacatgtctcaatccgaggttttttgcaaaatttaaaaatttgaattttcactcatcactgacgggtcataactaccacccgtcagacataacgttacctgtgacgtgtgttagttaatgacccatcagagatgagtggtctctttttagttaaagagccatctgtgacgggttacaagtgcaagtcgtcacagatgacctcacatctgtgacgggtcctccctagtagccatatattgaagaggatattttttcggcccgtcagagatgactcatctttgacgagttgcgttggcccgtcacagatgacccgtcactgaagcctggatctgtagtagtaagttaaaatatgttattaaagcttggatcttagagtttgttagagataagagtcgtgtccgacaaggacatattttgtaatctcgggtataaatagaccccgaaccccatgtaattagataacacgtgttcaaatacaatctcggcgcatcgccacccttttactttcgttttgtttcgacgaattcttgctttcgggttgagttgcatcggtctcgatcttcaactagaggtatgacttgttatggcggcttgcgttctcgggattagtgcttccatcattatgatactctaatcttgtctacgtaagttgtcgagctatcatatatcttatataatctctgataatattgctatctaacctccaatcggctaatatctatcactagggagtagtcgattaggttagatatcgatgttggcatagattatataggatatctacccctctatgaagctttcaatagcttgattgtctagatattgtctttcttttcatacttatggctgcattagttgagtttgatctcataagtcgtgcttagaactataatctctagcctgcttcttggttgtcgattagagtagtatcggggtttcagccgatcttacctgatttagctttatattccatgtgcttagttgatatgctagatctgccctttatgttaagatcttattgcttttaggtgtattagactttacgtttgatatattttacttgctttaatatcttaatgtagagtagtatcggagtattagccgatacacactagatctatctgattgactatgctatgaatggttatagtttccttgttaacatatatttcgatctaagtgatttatactgtctcggcatggcgaccgatctatcccaatcacttgatttaagtatatgtcgacatgaaaattatatatcattgatatctacagccgatcgaatagatctagtttctttattattgcctcgcacagccgatcgatacagagatgacatcagctcgagtataaatgatacgtcatcggcggctggccgatcggctataatttatggattaactacggtttatttgtctttgtttcttgttgattgcaggatcaaatcaactggcatgctcatgaacctaaaaggcaagattttggacctgcactggagttaagcagatctctcaggcctcgtgtttttacatcaacacgcttttggcatgcccggtgggacccgagttttcgacgacctcatcccgatggctaaaaaaccaccaccatcacagggaacagggttcaaacctcctgtgaacaaaacaggtgccaaaaatccatcagctgaagtcgactcaaccaatattgtcccaatcacattagataggctgacagctaagcaaagggatgaacttgaacagatgatgagcaacgtgaagggcaagtttatggattcttttcaagagacccgtagagggaccatcgtacaaaagtacaaactgaaggtggttgcagccgatgaggtcggctcgagttcatcttagggtaactaagatactgcaactggctcaggtgacaagggtgacattccccaagatggtacagtggaagaccttggtgcagatggcaaccaagtgcctttgcaattcaataatttccaagataggatcgactatgctgtgcaacatgctttgatcaatcaatttggagtgctagttaatatcttaaccaacatggtgaagactgttgtcgatagctcgatagccgagcaccaagcctcaggaccagtttatctaccaggaggtgtttttccgaattataggcctttggttatagcaaattagcagaatacatctaatgctttgccggcttggccgacggctccagttttagctactgcgcaagttacatcatcagcaccaaggcagatagttaatcccagattattgactagagagtagccacaacatgctgggcaaaatgtcaatcggctgacccaggatcaagttgctgcaatgtttctgccgaatccaacaatagtcgacccaacacagccgttgccgactcagcaagcacagccgaggcagtagacggttcagccaactcagcaccaaaacttgtagcatgtgttggaaggttaaggacacctgacaatcagccaatacagcatcctgtgaaccaagttattcctgaacacttggtccatcacgtacaggccgatcaatcaattatgccctcaaggttattccctaaacatttggtgcataatattcagacgaatctccagaactatcaaagaaggaaatctgaattatcaatatcagcctctgtcacatcatgttcagtatcagcagacaggatcgccaacgtcagtacgctcctcaattcaatcagtttgagccaatgcagcaacaaatacaaggagtaccttagcaaacatcatggactgatatgattgcagatgtaatgagggaacagtttgggctcaagccaaaagatactggaaatttgtatcggcatccttattctgagtggtttgagagggttccattgcctagctgatacaaagtaccagacttctcaaaattctcagggcaggataatatttcaacttatgaacatgtcagccgattcttggatcaatgtggtgaggcatcggctacagaagcttgagtattctatagtatccccgggtaccgagctcgaatt

SEQ ID NO: 80568 - DNA, 1131 bp, Oryza sativa
ggccgtgtatttggccacctttccggccagagccaactcggcctgctgtttgttgccccagaggaggacaacatggagacgatcgtcgcgcaagatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggta

SEQ ID NO: 80569 - DNA, 12813 bp, Oryza sativa
aaaaagaatattcatgcccatcgcatctgctataccttgatccaacccgtgtgcaattcggataacacaagcagctacaaaatcacaccgttttggtttttggaaccagtcgtgggtagtctgtaactctgacttaagcattttggctagaaagtgagagcgcttggcaatggctagagacggggcactgggagcaaccaagcttcaccttgctgcagagtgtttctcctagttccatcattgtttggttgaagtctcctggccttgaaaggttaacaggttgaccagtgagtcccttgtgatcaggaaaacaatgttcaaaagccatgtggaagttttcagatcagtataaagtttccaattcaaaaatatttgtatgaaccgtttcaaaaaaaaaaagctgtatgagaaaaatgacatgattagggcttgcacttggatggggatcagggaactgcaaattgagcttgtaaattgtattgcaaattggctatatgaacatgtgcattttgactgaagttgtatacaggtagttcagtacaatgccaatgatgtgcaaaataatgataatgtaatacaatgtatcaccaaactcagtgctattttagtacaagtcacagcagtaggacggaagaccttggcctggcagactggtggatgcaggtcagactgttttcggaagtgctacaggaccaacttcgaccgcacttgcttgctgatttgctggcaaatatggaaggaacacaatgcacgggtatttgatcaacaatccagaagccctgaccagctagtggaagctataaaagaagagattgtggtgtggaaagaagctggctgtttcacggtatataactcttaattttccagctgcggtgttgtagttgttcctagcttgtgggggctgcggctttgccacagcaccaattcgacagcctactgtcgttataagcaagaaactctttgtaactctattttttctcctatcttaataaaatttggtcgccggttcctttggtcgacccggcaaaaaaagtcaagtcacagcacatagggatatgtatctgcacagatttatcagtgatcaacaaagatagttgcttaccaaatctcttcactgttgagccttggattcttttgggttatcgggaataacgtatagcctgctgataacttgaacaatatttccatccccaacagggacaacctacattagcaagaagttgcgtaatcatgtgaggatgtaaactcttcactgctgagattcttttgggttatcgggaataacgtgtagcctgctgataacttgaacaatatttccatccccaacagggacaacctacattagcaagaagttgcgtaatcatgtgaggatgtaaagtatcttagccatggtgatttgaataggatataaattgtgcttctgctgtgcaagggaactcgcattttcaacaatttgctttgctccctactttgcaacaaaaaaggtaaatcttattaagctacaaagatattcatcccaatatgcatgccgaaaatattgctttgctccctaccaacatttctattagctgtctctcaattcatctttcttgtgcattgattctgtgtccacttcactaaaatacgagcctaactttttttgctgctgccacaataacaacagattctggggatgcaaatcaattgctacatgcccatagacaaacttgataagtccaatgagctaaagaaaacacaccatctgatgagcacgtaagaatgtaatatccaatgttagcaacaagaaccaatatggccccaactacaacacaaacagtaatactatactactgccaatattcccaaaataccatactactgccaatggtaacaaagtgcactgaagagtagagcttacaacactccagccttccaggtaaggtaggtctcccaaagaggttggcaatgcaccagtcaattgattgattgtctcaaggtgactgcagttcagaggaaagcatcctaaggagtaaacaagaagaataaaatttccaaagtatacaaaataatgggagcacacatatactgtaaatcacagcagtaccgcacccagtgaaatcaggattttgaccagataatgagctaccatcagtacttctgaatttgaaaaaaaacaattatgtagatcagataaaatccaactattagcagaggagaggaaataattaacattctgagcttaaattttacaagccccgatagcctcattaatttcctttaatgttcttccctaataatatgctggaaaaaataatccttagatttcaaatacttcaaatgttgaccagaaaaccacattaagagaaggcagatgacatgaccattatacattgaaagtatctggggtcttgcctctgaactgcattcacccaagaccatcatgctcgtaagcaaaggtcaccaccctctttcacccaacccgattcagagtaccgtgagaccaagatggacatggtgcttgctgttaatatttaccacaaaacagaattagaagagagcaggtgaattttcttttcatctattctaaaacacacagacatacaattgccttaccatcttgtattggtagatctccatggaattcaagatagagataggtcgatcagacgaatcatttgtcctcttgaatccaaaccaaaaaaagatggaagtggacatggaacattcgttcattaagcaagaccttccctgagcattctcctgtacatcaacagttggtttactgaattttgtcttgcctgaaatggctagacattcaatatttgcaaaatatgaaactgcccatgcatttcctgggaaatcttccaaataaatatggtaggtagagcacccattttaccaactacagcagtttgcatgaccgaccttttcagatgctactttgtagacactgcaaataggaattttgtagttgatattcattgtccctagagcaacatcgagaaggtaatttgctcgtgacactaaatcaggcttttatattccatcaaatggagtattggatacctgagcaataataaaggaacagaggaggcacaacccttcagctagttgtttacatcaaatgttcttttcttaaaaagtgctatgtgtgttgcagcatgtaataccaattgaagtggatacaaagatcaagcttgttaagcacacattactgtagttcagctacctctctaagacgaccttttcatcacagtagcatgtgcagtcaggtattcctttaacgcaaaattatatatattattgatgttaagttttacaaatgaacaacattttgtaatctactaatattatgggtttctaaacaacttatttcatccaaatgttttgaacccatttaaagctattgacaacgaaagtactaacacaatgctatgcagtagtgcatacctgactgacacattgctttatgcaccaaactttgtgactggacggtccaaaagcccctcctcctcaacaacaccctcaggtaggccagcggagcatcttcttctgtttaatattcaaaatcaactacttttcaaggaaaatatacatactaatgtgaaattttaacacgtattttatgtgcattgtgctcacaagcagttgtattactaatccaaatgagaacattggaagtttgaaatgcctatgatagtatgaatgtatgatgtcaagtaaactgacctctccaaaagcctccatttttaaaataatctttactgattcagtatttatccctgatctacccactgaaatgacttattccttctgcagaaatttagaatgacacactatcaacacaatatgtaattgaagacgattaagttcacacattcggattttcattgcagacatactctatgtaagatgcaccctctaaagacgacaacttgctagtgtcaaactcaattatgtcttcagtatttggttctaaaggaaagcaggggagtcctccacaggctcaatggttgaggtggaaacagcacctcaataggttcaatctcttcgatagtaccccataccccgttcctcagacaaatcatagaactcatttggtataccatttctagcaccatcacaacttttagtacgaactgctgtgtagtagctctgatttccagccaacagaaaaacaacacctggcatttcttgattacttctattttcagattttttttttgagtacgttataacactttctgaaaaggattgcttcagaaacaaacattagcacctcaataccaggaaatgaagagaccaaaatgttgagagtgccattccacaggaagattggaagcagcaaagaaattggttggcggctgctttgttagatgggatctaccatttagatcctcaagctggttagatctgggaggttttacaactgatcaaatatttccacaaaagcaccttgctggatttctttgagcagtatcaacatgtaatgcaggagcctttcccttaaagttagtcaaacaatgaggtatttaggccttcaaaaaggaacattctcatgaaaaatgagaaactcacagaaagaagggaagaatcaaacaagaaatacaaagttgacatattgaaaaagttcataactagaagtgttaaaagctaaattttctccaagcatgagaaataaaatatttacaaactcacatacatttttaccctctaataatttccccatcacctcaggttccacatatgcaattacacatgattattaccttataagttagtgactagcatcttccatatgaatcaggtgccacaattttttccatgcatttttagttaataatttgcaaagattgcttagatgtaaataagaacttaacatggaacagaaatatattaatacttcaaagtatttgaaaaataacatcttatttttcatgctatacgtaaacaagaaacagcatcaatgactatgtacaaaagagcataacagattacctgagcgaaaattccaactggaggtgaagggattccaagtgatggtgacttagcagacattggtgtagggacaacaacagaactgaaggtatggccaagattgttacgccctgcttgcagtcaaaggattcaccgtcgagccgccagaacagtggggatgaattcttttcattatcccgacaacgtttcattagttactgtaactgtctatttaaacagatcaatatcctcacaaaaactgtccccgcacagcatacacatgacattcacatcactagacgatgccttcttcaggatatgcatttccatttcccaccttcccatcgtctcctacctctagctccaggccttgattcttccacctgtaacacaccctgtggtgtgacattgccacccccttgaggcgatgacaaaaaacaagcttacatatcatggtaatcttccaagtagcacaagccgatggcatttctccccattgcaccaacacttgagtgtgaacagtgttaccctttttaacaagacagcaattcagaattgcagatggttccagttctctaatgtgctgttgaaatggagagggcaattgagaaaagatcggaacatgagctggcacaaactgcttgagctgagagacatgaaagacagggtggataaatgaatctccaggaagcctgcaatttgtatgccacttccccaatgcgaaacaagatggaaaaggaccaaaatacttaaaagctaatttgggtaaagctgaagcaactgatttctgatcataggttagaacttcaaatacacttgatctcccacttgaaacaccagcataatgtttcattctatttttggccttagacagctgctgctgaagcatgtcagaaaataattgatgatcttgcaacaaagtggatgcctcgtcatcaccagcacctccagtaaccagctcagaaggaaggaaatggcatacaggatcagtaccgtacagagccttgtgaggagtacagaacaatgaagtatgatagcaggtgttataccagaactgaaccaatgataaccaagaacaccactgagaaggagaagctaatgtcgcatagcagattcgcaacttcaaggtagcctgaaccccagaacatcccacaaaagcagaagaatgataagctgtgatttgactcagtctgcaatgcagaattttcaacaacgcatactttgaccttatgtttgatgagcccatccaccaaagtaaacccttgagaattagtgcctgatgctgccaattcggtgagaagcttctgagcagaaggatcaacaaccctcctactgctccttcctgaccccccccccccccctctccctttttttctcttttcccttaatcctctgcctcttccctgttcgcttgttcattgttctcacgtcgaatgtcttcaagctggccaaactttactagggaagttggtgcaggtgttcgtatggcgttctttacagtgatgccaaatgagactagatgagaaaccaagtgatcacattcttgtttctgcatctgcaaaatgagcgatagaaaaacacctataatttcaatacaccatccatgatgcatgcatgccgttcgaatgatgagagaaaacggagatcttacttgatctcccccttgcacatatcgaacaaaaaaatctggtgctgttgggggtcctccaagcccacctcctaagagaccccgtgctcgctttgaacacatctctgcagttgcagcagaagtacgcttgtgtccacgtccatgtaatgctggctcctgaggtaatcttatgtttgcatcacccaccccggggtcaactggagaccatttcatctctctcggagggggtgcgagactctcatgctcaaacaatcctccattccaagcatcaacatgaaggtaataaaatacctgaatcagatcatccaatgtaaccaatacatcaatgccacagtcatgtggatggtgtgttaaattcgtcaaggaccccatcacttgagcactaattgaactccagttcttgataaaactattgacatagtctctacccaactccggtgtgatcacctcaaggattgcatggcaatgacgcctatggatttcacgagatttggattccataatcagcacaacaaaaagaccaatccacactggcaagtcctttgggtcctgacacttgcttggaacaaatgtacacaatccgtggaagcattttctaatgaattgcaaattaacagtagtgtttcctgtcccattgggcgatatggtatggtgatttcctttgaatctgagaaggtggctgtggacactatccatataaaggcccatcaaatcttcaaattccatttggaaaaatccatttgtagtacaaaaaccaattagccatgccatcctggctaatactacgagtatgacatagcgaccttcatgttgcaggacatagtaaaatgtcccatccaaaggggtagtgtatataacttggtccccaaaacgtatgcggaagggtgaattcatgagaagccaatattgaaaatgagcctggcatctgttgaaattttccaagaactcttcctcagtaccttcaagacgtaatgtcactgtgttctgtgagcaaaaagaagaaagtttaaattaatgccatagaaactataaagagaaacataaattagtgaataaatccaaaatataggaaaacctcatattaatgagacaaaagaaaaaaactgtccaatctaatttcattctagaggtataacagaccaaagaggcaaagaacacttgggactacatgatccaaagaactctcctatacagtaaatcataaaaaaccaattcttgataaaacttactcaaatgaacatactaattgaaagtttagaggctcccaaaagctcacactgccggaccacaaacactggcaacagcggcatcctatcttacccccagtggcagacatcgcacaccccatgaccgctcctagtaccaatactgcacactgcctacaaggggtcgatgagacaagtccccttcccgttgttatgacccaagctcgtgagagatcaaatcacatgaactggtgacagtgttatgggtagaatttgggagaatttgggggagaaaacaaagtaggtcaaggggaacaggggaacacaggagagaagagaacacaggaattgtactcctgaactcctcactggaatcaaaaactttcacatcaccataatatccttgtaattatcaaagccaagagtatgcaattattcaagccattaaatctcatcaagtgttcctctgcatctagtttatgtgcattgccatccacaagcacacacgatatttcttaaaacacttgatctgctgcctctgcaaacaatgaaactccaccgacatgagtgagcacgatgtcctttctcctcagcatggaggatgcaactgatcttcaactacacttattggacttgaggtatagctaataagtgaagtgtctgtaggactgtagctgcagagcctgtcgaggtggcaagtccaatgtccaggattcaacatcaaacacatgggggaatcgctagcttctggttgctggagcacgggctgcacatacttgacatctaacaagcaacaccatctaaccctggagttcatgttgagctcatgctgcgtcttggcatggcgtacttgagtgagacgacagcctccacataagtaaccgcctcaattgcactcatcacccgctctgacaatacggaacaaatacttcgtgaagcacctctgtggtcactggacagagcacatggctcacggtgacgcgaacaacacttgctgtggttagctccttgtttcttggcatttcatcaaacatcttctgggcatcaacactggaggtcacctctggatttgaaacttgaacacgaggaatccgcgcgaggtagaaggccccgcgagaaaggtggtagatcacccagagccatggtcccaagcttggcccccaaactcatcaagcttcgcccagaatcaaaatgccaccacacatggcttccttcctctgttcccctgctgctccagtgagtccaatggcgatggtctccgtcaaccgccgccttcccggcttcccgctggttgcgctcgcgccgccgccgccgccctcagcgccaccgtgtggtgctctctctcgctcgccgcccgcgcgccactgccatgcccctgcggccatgcgcaaccttagattcctcgtcagctgggctgggctgggccgggagctatcggctgacgcccaagaacaaataacccacgccttcccgcccttgatgccgcctcgcccgccattggtgctcctccccggctgcgcgccgcggcgccggtggcggccgccggcgaccaaacgacgacgggcagcggcggtcgatcccaatgcacgcaaagatgatcggggaattcccgcaacggcgcgacatttgcttataccgcttccgatccatctcaacaacaacaaatcgatcatgaaagaaaccctagcaaaaccccccatccgacaaggcaaaggaagaagaagaagaagaagaagaagagcaaatccaacaaggcaagaacaagaaaaaatccaagaagaacaaatctcttctcagaaaaaaagaaaaaaaaaacaagaagaagaacgaatccaagaaggcaagaagaagggaagaaccgatcgatcgagcaagcgatcgatactcacccgggggcgtgggggaggatgaaccgccgctagattcttcttcttcttctccctcttcggcgccattgccggccaagaagctttggctctctcctctgcctccggcggccggcgggttagttaggtggattaattaattatttgccacttttacggatggtgataaatgatttgccattggacccacatgtcatagacacatgagggcccacatgtcatagacagcgagtggcaaataattaattgccacatcttaaaagtggcctagagttaaatgtcccttattaggtgaccgttatgctgagctggcagaaatgctgactcaaatatctaatttcttgtttttttccctaagtgcaaataatatgattggtttccaacctgccaacacatattaatatggagtattttgttacccttgtggaaaatagagacgtgtaaaaaaaatagctcgtaccaagcacaggcaattatcaatttaattcattgacgcatcatgttttactttttttttcggctgaatttttactcctatttggtttgcaaatgattgtggctgcccctcaatttcatattgataaaaaggcagacactctaaatatgcaaattaaatgggctgagaaatggagtaaataaattagatgatgagcttgccgcaatgctgcagtatatctgtatatacacagaatatacagtgctctgctatgtgaacccgccacctgaactcctgaagtactgagcattttttatcaaaactccaatcaatttcttttacaaaaagaaaaggttatatctcccaactttccgaattcctggtgctatgaggttcaaaatcattagctcaacaacacatatcgtcaggtgaattccattgcccattgtttatgaacaacaaacagcagcaaaaacacaccatggtttggcttttggaaccactaagtgcgtaacattgactaaagcattaattttggctggaaataacaagcggctgcattatgttgctcctagtttcaccattgctgtggttgagatctcctggccttcaagagtcgaaccaattgaccagtggatctccctgtgatcaaggaaacaatgttcaaatgccatgtcataaacggacaaagctgaaatttcagagttttccacagattctctggggacaacaccagctttgccagacagggaacagggccaaaacaccggccaccaaccaacttaactgctgcaactctaacagggatctcaggaagagaaacaaaaacaaaacgagtttaggttctggcaaagaacagcaaggctccaaaaccctgctcagcctaaaccagggtaacttctaggatcttcaccgccatcgactccgcttgagcttcttctcctttgcgcatcgacctactccactgccaaaggaagaaaatcacacgaaaaacaagggttagaggtgtggacaagattttgttcgctgcacccagcagctgagcagcataagacccttttcattcattttctggccaggcatcttctatctcagaacaaagaatgcatctctcagatccttcccaattcttcttaaccagataggaggtggattgaatcttatctttccaagcaagccatacaaagtgctttaccttctggggcattggctcttgccaaatatctagtcctctcatatctttcaccccatgaaagtttagcattttgtagcaagactttgtagaaaagcatttgttcttctcaaaaggccaaagcatcatgtcttcctcatcagtaagagatttcagccattcgttgcccaaggttttcccactccacctccaccgggccaaaagaccttttgaaagaaatcccctcaggccaagaggccagagcatcaggcaccagaatctcttgttggttacagatttgttttcaaaggacaggacccagtccaaacatctgaccagaaagagatatgagttccttatcccaatttccattcagagttgttttggacccagaatttaattgagtgcaagcttctacaaaattgtgaccctccctccttttcagattggaaaaaccccttgatctgtagatattttcttcttaacagctctatacaggggctcatgtcccctgattccagcttccaaatccatttggataacagagcgtgttatacttcattgtttctgtgaaccccatgcccccaaactctttatgactgcataaatggtcccatttcatcatgtattttttttcttggagccattacctgcccattaaaacctgctcctaactgtgttgatcttgcgatgaatgcattctggcaaaagatagaaacccattgtataggagggaatggatgataggcaagaattgataaggatatctctccccccagatgagaaatttgacttccatgtacccaacctcttttctaacttttttttgacgagaacatcttttctaacttatgtggtaggaattttaactcagagatccctaccttttgtggactgatgggtaaaactagatacttcattgggaagaacctgcagggcagttgagcatgttagcaactctgttcaactcattttactccaaccccacagcaaacaccttgcctttatcatagttaatctttagaccagacatgtcctcaaagcagtaaagaaggaacttggtcacagcaaggtatgggataaaaatcactgtatcatctgcatttgtaggtgagtcaatcccccagggaagaggtgtgggaccagccctgttaggatattggcgcttttggctgcatcaaatagctggatcaacgcatcactcacataattgaagagcagcggagagataggatcctcctgcctgaggcctctgtaagtgctgaaaaaaattagatctctacccatttatgttgatacagacttttccaccttctatacagcttttcacccagtgaatccatttttcatgaaaatgctctgtccaacaccccataacgaatccccatctcactctgtcaagccttctcaaaatctagtttcagaatcactgtcaaacaccccataaacgaatccccatctcactctgtcataagccttctcaaaatctagtttcagaatcacgcctcttt

SEQ ID NO: 80570 - DNA, 647 bp, Oryza sativa
tgcatttatgtgtcccccaagccaaatcatgagacaatcgacagaaagatcttgaagggggagcatggaggactaaaacatccacctcctcaaccttcaataaaatgtggtgtaaggaactccactacacgtaatatcacgtacatatttctatatatatttaagttcatctgaatctaggtgaattttcgcatccacaggtctatgccaactatttgtcatatttttgggcaaacaacaactttacacgaagaactctaggaatcaagaaggtaatttcggggcaccttttcatttctaggaatcactcctttgcatttgccatacgagcacatttttcaaattatctaaatgccaaatatccagggcaccataaatgaatgggttaggtgccacgaacatgatctaccatacaacatcgacatcaggagcagcataaagtatcatcgaaatgttacactaaaaggttaccgtgctttggtatattggtaataaatgttattggcaagttctcagtagtacctgtacaagctattatttagaacatttcaatagaatatccaaactagatgagatggctatgacaaatatatatatatataccttagacaagtacatgccatggctatcacaggaaaagggagtat

SEQ ID NO: 80571 - DNA, 726 bp, Oryza sativa
gggcctgttcaacgtggtgtagcattgatcagtggagatttaatgtcaccttaattactcaacagttttactgttttgctaataaaatgttttacaaccgcctttatgcaaatagccgcaagccatccttgtatccccttgcacgtctgtatcattggtgtggcttgttgagtacggtggttgtactcagccttactattattccccctttttcagaagtatagtgtttctgagctaaagacgaagttggaggatcaaggctcagaccccagttgagttttgcctgtggagtgaagctgaagccccgctaggatcgccttttccgctgctgctgctttcgcttcggtgcgaggactaagtgcctcttctgtaagtattttatgctttatttacgtttggaactatatattacttgttgttttgtgtaccctggctggtcttggacagggatttaatacacaaaatagtctggaaatttgggttaaatttctgggcgtgacacgcttcgactcgttcgtctcgcctgtatcctcctccgccgcccttccctccccttctccctctagcacctgcagcctccccttcgctcccctctcccagccggccggctggccgcttccctccccctgcgtccccctctcctagctggccagccagccgcttccctccccttgcgtccccctctcccggacggccaaactgtgagcaagcggcacctgtgaccgg

SEQ ID NO: 80572 - DNA, 983 bp, Oryza sativa
tggttatacgttagagggtctataacgttataagccgagaaatgagctgagaaatccttcccaacagttggaccttttaatctactactattggtgcttctgtctgtattagcggaagcaccaataataagagatcggttcttaattattaattgttgttaagagacatgcacataatctctaggcgtttcataatcataaaacttttgagatgtgaacatacaagaacttggttacctgtataccaagacacgatagcctctagatgtaagattttgatggtacttaatactgctctctatgtcctgagaataaggtagtccatcgtcatggcacctcacccactcatccacagttccctatatatgttatgaacatcaggagaaacaagaaaagtgtgatgtaaactgcaaaagtgaaacactaccagtcgatatggaaaaataatattaatttaaataccttttttattccaagattttcccgtgtgttgttgctgttagcccagaaatatgacaaatagttgggataggtctgttgatagaagaagtaatgtattgattcagcaaaagttttgatggcgtagcaagatcttatatatgccacatcatccttcactaataattattacatttaaacatcatgcaagcatgctatattatctataattttataattattgaattttagttctttaaaatgcaagaatgttaaatcatcatcccgcataattcttatcttactataaagctataacccactaaattctaaaactctacatgcaatgatgacacatcatctttcactaataattattacatataaacatcgtacaagcatgctatattatctataattttattttataattattgaactttagagcttaaaatgaacgaatgttaaatcatcatcccatacacctatatagttcatcctcacttagttaatattatttctctcctctcatttagctatatcat

SEQ ID NO: 80573 - DNA, 1916 bp, Oryza sativa
atatatatatatatatatatatatatatatatatatatatatacatgcatgtatagtacaattcatttgctcgctagctatagctacgacttcgacgctggcgttacgtcagaagaggaaggaccgacgttatgaattgtcgatccgtcgtagtagaattcaccatcgggattaaggacttcttcgttgatgaaccccatcagttgttcttgaacagccgtgataaaatccttgtgtgggagattttccctcatgtgaatacgctatcattcgaaaaataatgacatatcaatatatgaaattaataaacaacttaacaaatcgatacgcaatgaaattttgaatggtttatgtatacgtacatcgagctctcgtgtggtgtatatttggtttgataggcagtggtcatactcgcatacgtagtagccgcataagttagtaccctggtcctgcttcgcacactacatgagaaacgatgagagatttaatatactctttatattaactgtaattagagattcaattcaatataattttggatcatgcatgtactcactggaaaataaaacctccgtccaagtttttctttccaagtcccgtggaccaattgacggaaccgatcccaagccctacatgtgcagttgctagctatgattaattaattattacccgagatcaacataatagcaacagagtcccgtgactttggaatagatggcattatattacctgtctatcagttggaagaccttgtcaaaaaccttctcctctttattcattgagtcgtacacagtgacttgcatgcgtccaagtcgaaaaagaacaggaccaagtggaatctggaatatgcgtgagatgagataaatatcagaatgtacatgttatatgtatgggaatgaaatttgttcgaacgacaataaaaactcactctgtgttgtacggcaatagtatgaatgtcttgaaatgctgctgcgttaggagatggacgagattgtcctctgtatctttctcgtacttgtcaatcattttagtgttaatttttcgagggtcgatgaacccagtatcgtaaaccccccgccgtcgggccctttgaatctccattctacaacaataaaaggaaattattattgcttacatatatgccaggagctaattattgaacgaaacaaatcgaactcaaagatacttacaaaatccatgcgcccagaagagagacgtcgagggcgtccagatggtacagatcgaagacatccttgaaatggatccatagaacatcttctccttgcaagaagtcggggtttctgatcctcgctccgaacatctctctacccttggcgctcatttccatgtaccgttcatggaatttgtatatttgtgtcggtagggactgcagctgctcaggcctgacaagtggtttaccgagttcaaacttgtatgccacttccgccttcgggattggtgcgcctccaaccaactgagccacagttaaaccggtgtccgaaataaaatccgttatgccaaagtcttcgccggtcaccaatggctcgaccacttggtttggttgttctccaagctgaggaactggtttggacttcttgtaataggctttcctaagtgttcggtcatagtccgatagctttaaggcctccttgtttgtggtggatattcccttgaagaaattcttcatgctcgggtcaataggtatcttcttttcaggactccgaggcttgagttgcctcttcacttctcctgccacataagcatcaagctcctcttgactgcaatcgtacggcggctccttgtttttggtggtgtcaactttggccttcttcgctgcccttgtgctggcaggaggtggagcttggcgagaccttgtcttgagaggtgcaggcggacacggtggaggtggaggtgga

SEQ ID NO: 80574 - DNA, 2505 bp, Oryza sativa
ggactgtagtggtaagtccctgaaatgtccgttggaatggccattcccgacgccaccttcacgtgatgagaggttatctattagtaatcaacctaagcagcaacgtgcggaacgtacaagttaagaatcatatattacatcgagcataccttgattgataagttcttgaagggaatatgcagctcacatggtgtccgttgcatgatctcatcaacagggcaggtggtttcgtcctgggtttgcatggcgtccatgcactgtgatcctacctgccccgttgaggcgcagctgctacgattgcctgatgggctgaccattggaggaggtatgtgcagctgggatcgtgtgactgatgtgctgccatgcgttcatccaccttccgggccacctcctcttgcatgctgagctcgtagctcgataccctatactcaagatatgcaatcttcgcctcggtatctctcttgcttctcatccgactcctgtacgtgtggatgtcctccttgaatccaatcttccagggaatcacgcctttccctcgtgttcgtcctgaatgctcgggagtctgtagggcgagtgacagctcgtccttctctctgtcgggtcagaaactgccctgagaagaggcttccactgcatccgttagtcgactggcagcctcgcgtatctgattgctgaagaccagggagccatcaactgggttaagcattccaccgtgagcatagtaccagaacttcgattgatccggccatttagcggtggccggttcgatacccctctcaatcattcttgcctccatctcctcccacttcggtattgcgatgctatagccacctgaccccaagtggtgatgatacttcttcttggcagcgttttccttgtttttaccatcatcgcttgcccttgttgtcctgtcttgtaagcaaccaactcgtcccaatgatcccttagctttgagaatacgtcgaagttcggtgttagtcccttcaggatgtatttcttgtacagatctcccttgaagctctggaactgttctaccattttcttaagagtccactgtttcactatgttctccgtacccacagggagcgtgaacgtctcgagcattgtggtccacagcatctctttctctgattccgggacaaagctttcattatccccgcgtgctctagttctgcgccagtacaccttgctgacaggcacgttatctctcacaacccaaccgctgtggcgtacaaaattcttggctgcttctaccggggcactaggtcagccttctgcgtccacctcagttatgatgtgccgaccctctatcttcttcgcggcacctcgttgtccgcgtgccctcttctgtccagcggagggatgacttccactagcctcctcctcgttcccctccgcatccctctccacgttcccctcctcgttcccctccgcatccctctccacgttcccctcctcgttcccctctgcatccctctccacgttcccctcctcgttcaagtactggtttggatcctcgttcccctcttttttgttccagtactggctgcttccctctgcgattgtatcgtacagtatctgttcgtcatcgtgatcagccatctattcatagaagaaatatttgctaagcgtaatattaaaactctactaatcttgtattaaaactcaaataatcatatatgctaagtctaagtgtcgtgtattataaccctagataatcatatatgctaagtctaattaagtttcgaatattacatctctaataatcttatattaaatctctaacaatctctaacaatcaaatatgctaagtctaattaagttccgtatattaaacctctaataatcttatattaaatctctaacaatctctaacacacacatatgctaagtctaattaagtttcatatattaaacctctaataatcttatattaaatctctaacaatctctaacactcacatatgctaagtctaattaagttttgtcacgtcttgataaattcattccgaaataaaaattattttctaaaaggaataatagaattaattaaaattcgagaagaaattggcaatcactaaaatacgtacaagaaaaatttgaatgtggtccggagaatttttgttaaattctccgtggtctaacaagtgccctcaaattttcttgaattttcagagcaccggaaataattattaagcaacaaaaacaattatcaaagtttactaaaaagaaaaactaaaaataaatcctccttcctcctttgggccaagcccagcccaaagtctccctctcctccctctctttccctcctctcccgggcctctcctcctcctcccggcccacctcttccctgcccctcccgggccagctccctcccctcccctctctctcccgggcctcccctcctccactcctcctaggccgggcgcccagcccaagccggtcccaaaccaagccgagccgagccagccgtgcacacgcgcgccgtgcgtgcgctgaccgcgc

SEQ ID NO: 80575 - DNA, 3571 bp, Oryza sativa
tccgacctcccccgtggctggctccctctcctctcctataaaatggaatccccatcctccgttctatcgttttagcctcatcccgagcctccccgtggtcgtatcacctctccccgccgtcgcccttctctttcccccgcgccggccgcctccagccgcctctccctcctcgcccgagcgccgtccggccgtgccgtcacctcctccagcgtcgcagccgcctcctctccaccggcctgccctccgtttcgcgcggtgctccggaggcgcgttcccgctgtcgtccagtggcgttgccgccactgtaccacctccagccgcccctgccgcgtcgctcaggtgcgggccggccgcgccgtctcctccttcggcgtcgccgcgtcgacctccaccccggcctgctctctgattcgtccggagaccgccgtcgcccgcgccggcctctccatcctcttcgtcgccggcgtcccttcggtcgccccttcctcctccccggctcgtcggctcgctgcgccaccaccacccccggcattgcagcggcaaggtcgccctcggcctcgcctcccctttgtccaaacccctccgcgctccatcgtcgtcgtatcgttcgttctcgtcgtcgacgtcccgtcgatcgcccggctcgtcatctggctgcgctgccaccgtcgtgggcatcgctgcggcgtgtcccacgccgtcctcacctccgtgcagctactgccggctgccctcgtcgcctccccgtcggtcgtcgtcttcctccttcctcctcgtcgtggcgttcgtccctccgtcaagccgatcgcgttcgccgcccgcgtttcgtcaagtgtgcagcagccccgtcgtcgtcttcgtcctcggctccgcgtcatcaagccttgtgccagccgcgtctcgccttcgtccaaggatcgccgccgaagtcgttccctcgccgttcgcctccgtcgtccccgagctgtctccaccgcgcccgttcgttgttgtcgttcccacgcctcatcgcgtggtggtaaggatctctctcctttcgctgccccgtcctcgtcctttcggtgtcgcccgtgcccgttgtgcggttgtcgaccccggtgcccgtgtaccggtgtcggtaatcgttcgtgggtgcgtgtggtgaccgtgtttgtgtgcccgctcggtagccgcgtggtttccacgtgtgcagcccgcgtggtgtctagtggagtccgtttgtcggccactcgcctcggttggcacacggggtccgcttccgtcgacccgtgggccgtctctgtgtactcggtctactggggtcccttaggttgacatgtggggtccgcatgtcaacagcgcagccttcctgtcttttccaagctagcgcttgcacatgttttatagttgcaaaacctaattataataatccgcaaatctccatataacagcattaaacttcggatgaccatgtcttggtcatacgagctccgaatcgatccgttcaagtctcctaatgtttgttataatctaaagaaccgtgtgctttctttttatgtattgttatttcttctttataggcttgtagctttgcttgtgtgcttcgcgtagcttctgtcgttccggaggttccagaagcgtggttcgcggtcgtccccgaaggttcggaaggccgttctctctgagcaaggcaagtcacatcatccttgagcatattgaatcccagtttataaaattattttgatttaaattaatgcattaccgctttatttaaattcccgcgttatcactgttttatttagccatgcctatttacctttgttaagatattattattgctattgttattattatcttgttcaccctagaataaacaaaaccccaactagtgggtactctattcatggttccactagtatgaatttaggtagatgcttcgctgattaataggacaacattaggtggtttttataactttagactttgggaatattcatatctcttggatactatggaatggttggcttatggtggaattggacatacccctttcttcctctttcaaaacccctaaaacctgttgtccggtggggtttgggtgcatgccagttgtgggaagtagcaccccggccaatataaggattaagctcgggcctctgttgcaaagcactaccgtacttccacatgtctagtgggtaaggcttcgtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctccctacctgtctcggggtttccggccgtaggtggggttgggttggtactcttgtctatggttaggatgggttggaaactatgtcatgtcttccgtccatatgccgtggtggcatgtggcacgtggttgcacgtgaggaagacgtgtcttgtgggtaaagatgtacacctctgatcagagtaaaacctattcgaatagccgcaccctcggttatgggcaagcctagcaatgtacccaagttagtgtttttaattcttaaaacctgcttaacaactaaaatgtggaatggttggcctgggttggcttgggacgagctgggacccagggtcaggttgccagttcggtctgaatcatcgtaggccttgggttacggcaggttcgtgtgggtccacggccttgattaataatactgtgtagctctaggatcgtctttataaaatagctttgggcaactaaatgacttttaaatgctgtttactgcaaaacttaacccctattattatctccttgtactcccttgcattaatcatgcaactcccggtgtgacttgctgagtacggtggttgtactcagtcttgctctatctttccccccttcagtaagggaagctttggagaagaagtcttaggtggagtcctggcttataccccagttgagcgcctatgaagatggagccgtaggcccgcaagtccgctgctgtttatttttgtttgtcaggcctgaagtgcctttgtaataatgtaaatattatcgatataataaagatgtgccttttgtatcatgtttgtttggtgtaccccggcttttcctggaacggggattaatacactagcgttcgggaaaaggtaattttctcggtcgcgacaagtttcgtatattaaacctctaataatcttatattaaatctctaacaatctctaacactcaaatatgctaattctaataatctaataatctttaacactcacatatgctaactctaataatctaataatcttatactagaaatctaccaatcttatattatatctctaacaatcacatctttacatcacctgcctgcgcgaattccttcgatggctagctaccacttcagcttgagggacgacgacgacgacgtcttctctgcaacatgcaaaaaaaatgtgttggtctaaacgcaaaggaatatataatgtatttcacgttttcaagtatatataatcatatatatatgctaatttc

SEQ ID NO: 80576 - DNA, 5021 bp, Oryza sativa
caaatttatataatcaacattgttattagatgaatagtattttctatctttgtgctcaaatattggttggatcatgttctattgacacatagacctaaaacaaatatttgacaagattgactaatattaacctggtggctgaaatgtgcaacatatgtagcatgtcaaacaagtgctgtttttactaattacgctcaagccagtacaacaaaaattcaggttgaacagttttctatgacaaaaatacactaccagatgactaggtgccctcttggtaagaaccacaaattctactttgaatattcagtcaagaagcatgtgaaatattccatgttggttggtgccaatttgacttggctgttcatttagcataataaattctggcagaactacagtggtataagcagcagttacttttttctttgctccaaagcagaagaattagagtagaatagttgcaggaggtgaatgagatgtgggcagggcttgggtactaccggagggcttgatttctgctggtgatgattagtaaatagattgatcatgaattcatggctgatcctgtgcgagatgacgtggatctgcaaggggaatgtttgttgcattctttgtaagaatttttcaacttttgcagttcctgtgcactgttcgatgttttgtctcaaagggagagttatatttagaatctgttttgtgttacagatgagggaattatgactattggttgcacaaattggtgaggtctgtggcattggagattacacagagggagccattgcctcgatagccttcaatgaggttgggctctacataatttatatcctattcagatcactatgggtatcctttacatatactcacatgattgtgcaactttcttgctaatgtgggatgtccctgttgtggatggaaatactattcgagttatcagtgggctctaggattcctggtaagcaactgtctttgttgatcactgataaagccttgtaaacatatctatgacattccacgactttttatatttatgacaaaatagctctggtgaatatcacacttcattgggctgtactcacaaggttctgtatggtactgatcctgtgtatcattttcttcctgctgagctggttactggaggtgttggtgattatgaggcatccactttgttgcaagatcatcaattgttttgtgacatgcttcagcagcagttgtctaaggcccaagtagaatgaagtagtatgttgatgagaaatgctccttggtgttttgagtgggagatcaagtgtattcgaagcttcaatcctatgatcagaaatcagttgcttctcggcttaacccaagttagctgttaagtagtttgatccttccccatcttggttcgcattggggaagtggcatacaaactgcaggtttcctaaagattcattgattcaccatgtttttcatgtctcgcagctcaagcagtttgtgctagatcatgtgttttttttttgctgggacagcttgtccatgaagtgtggcccgttttttttttgtccatggatgtcaatgccatgtgggccacatgccacgtaggcaccacgttaaccaaaactagcctccctagtgtattaggatctcttttgcactgtttttgcaagttggaggttaagatttgttgtattgcggttgagggatgcaaattaaatttgacggaatgataagggacataaagtgaacttattactccctcttgcctccactctcgccactgcctcctctcctctctccctgccgccgcaggggtatagcaggccaaacgggcggcccggcccagcacggcacggcacgccgacggcacggcccactagggcacggcccgttaggcacgactcctgtagcgggccgtgccgtgccggcccacgtgccaaggccacggcccaagcacggcccaagaaggtgctgggccgtgccgggccggcacggctactgtagtggcacgtgggcttgtagccggcccactagtacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaataggataaaatgtggaaaaaaaataaaaaatatgagaaatatatgggaaaaattagaaaatcgtaggaaaaataaatgggccggtgggccgtgccatgccggcacgctacagtaaacgtgccgtgccgtgccagcccacgggctgaggcatcggcccaaacacggcacgggataacgggccgtgccggcacggcccacaggctggcgtgccgtgccgggtctgggccggctacagtactgccgtgctcgggccggcccggcttggcacggcccatttggccaggtctacgcaggggtcagtggcggctgggctgatgtggcgtcggcggtggtgatgggtgggtggaggaggaggtgagatgagggcgttgggcatgggcggtgggtgctgcctcctccctcggtgagttttcaccagccacaccttctctacaagacactaacatgtggggcccgtgtgctggctcagctagtcaacggggtgaaccggtgaaagatgcccatcggacgaaactatctcccaaactgtttgaggagtgatttgcgacggctttgtgagttggagataagtaatacctgattttgcggttgtggcatgagcggagggacgtaaagtagacttattcctcttctaataaagtgctggcccatcaggcctttctaacagcccaagcccacacagccagactacacaccaaccgaagtctgaacttgaaactggccgattccgatcaaatgtcgattcagcacgaaaattaataaaaaggaaaagaaacaaagaagaggcgactcgatgcagttaaacctattcgattcgaatccgatggaaggcggcggcagcgattgccggcggccagcctccgacgatcacgaggggacggcggttgccagtctccctagctccaggaagaggaaggcggctaaggatttagaggaggaggaggaggatttgcagccggaggaggaggcgcgtccgccggcgccgccggcgaagggtcggtcgtgtctgccggcggcgtgccatgaggacggcatcatcccggcatttgtgatcccgggcagcaagcatcgcgacgggtccatctacaggacggatgcgcactactggcacggcctctaccacctcgacgataccagcgaaagtaagcaaagcatcaagcatctccaattccccccaattaatcccactactcctcatctgctctcaaagttttcatcaatttaacagttatctgttctccaccttttgattgataaatctgttctccattttatattacaagtcatttgactttttctttagtcaggcttctttgcgttttaacaagtttatagaaaagtttaccaaacatccaaaacaccaaattaatatcgtaaaatgttgcattgaatattttttgttaatatgtttgttttgtgttggaaatatcgttatattctttcataaacttggtcaaatttaaaaaaattgagtagaaaaaaagtcaaagcgatttataatatgatgaaactgaaacggagggaggagtatatactaatcactggttacttaatcgattcattccatcatcagctcgcctggaaccgatgacaccatcatattcagagcaggactgcaggccatgcgtcaccgattgccagtggcacattggttgctccatgatgcagatcttctccctcgagctagccgaaatctcaaatttcgccaccggagctgctggtgccggtgctattcagctgtatgggttcatggctgcgcgggatcttttggacccgctgcgaaactacgtcttcaaccgcaccagggacgatccgttcaccatccgcgacgtctcctatccgtttatacagatgactggccctaagaggggcatcacgatgaactcccgcgtgatgatcgagtacgacctgaggatcaagaggggagagaatgaacaagatgatctggtgctcatcgacggggctgccaccttcagcgagataacgaatttcataccgtacatttatcgcatccatggggattgcggcatggcggtggacataacgctagcacacttcatccttgcaattgaggcaacgttgcaagttcgaatatatgaactaaaggatggctgtggcagcctaaacttgactataacttgtcgtgttagtcatatgaccccacaaattaagctctttcaaggtcccattgataagctacgtgaccaaaataggtttgtggttgttgcaacactgaacactttgatgattacagagttcaagctaacacatcagcatggctcaatcagtcggagatttgagtccagggttgtaccacatggaagtatgtctcattgcgccaagtttgcggatttagccactataggtgtggagatcttttggtcaatcttacccacttcgctacaagaaggcttttgagccttctactttgttacattctatttattttcaggcaaaaaatcacctacctgtaaatagctaagagcaatgcaagttttttattaggatttgtgccatatatattgccatatgaaccagaaccaaccaaggcttcatgtgtatgtcaattgttgggcaaaccttgccatatgagcaaaaaatatttttttttctttcaattgattttgtggctgttgaatttgcacggagattgggatatcaaccacaacaagcacttttagcagtgattacgactccttccagggcaccagtaagttgatgatgtgatatacctaccttttttgttcttctctttgctttggatttcttgttctaacttcactcaatcagctaggaagaatatttatgcaaatttatattttcctgcctctaccctactccatattgctactagataatactatctccatattttaatg

SEQ ID NO: 80577 - DNA, 1286 bp, Oryza sativa
tatatatatatatatatatatatatatatatatatatatatatatatatatatatgtatatatatatatatatgtatatatatgtatatatatgtatatatgtatatatatgtatatatatatatatatatatatatatatatatatatatatatatatatatatatatatgtatatatatatatatatatatatatatatatatatatatatatatgtgtgtgtgtgtgtgtatatatatgtatatatatatatatatatgtattctatatatatgcataatatatatatgtgtatatatatatatatatatgtgtatatatatatatatatgtatatatatacatatatatatatatatatataatcaaccatgcagcaaacagggccatgcaaataaaaaaaatggtacacagatctttagtcccggattcgtagtcccggttggacaaccgggactaaaggggggttacgaagtaggactacaaacggtttctccaccagtgtagggagttttggtgatataaatagacgaggggttgaggctagaaggataactacttttgagagagaaaagttaggatttacttcgatgtttcaattctagttcgtgagttgagagaggagtgctttaagtgcactttgtaaacacatattgatgcaataaagttgatatactttcaagtgtttcgtcgatacgtgtttttctggatcctgacggtttgaccggaggcaagtctacggtctaaccgcgggcggtcacacccgcggcaggaagggggttcaaccggtggcaaggcggcagttaaaccggtggcgtgtgagcggttcgaccgggggcaacagaactacgtcgagatttccatcgatttgagggtaacttttatttccgctaaaagtttttgcgttttttattttccctatcattcacccccctctggtaggcttggttacttgtgttcgatcctacaacggtgaggtagacggccaatctgagacgagctcctccaggcggcggcagcccaagcggagacaaggccgtccgtcgaccgcggagcccggtggaggtcgatacgccgacggtcgccactggaggtaaggcggtggaaaccgcgggcccgaggtggaggactatgagcagaccgacgatgaccggagactctgctactgctgcttgatgacgatgcaaatgcccgagagatcaatctctcttaggacaacgacttgatgatgcgaataaaaaaaaacggtggccgccccgggacatctaaaccctcccgggacga

SEQ ID NO: 80578 - DNA, 1908 bp, Oryza sativa
ttgtctgccgacgacataaccagtgtcagaccggtcgcaaaccagtcactcttgtccaccacgcgtcagattagcaatctgcatgttcgcccttcttcatacaatgtcttgcttgtaatggttgcgatgaagcctggcatatatctgaccgggaccaacgtgccatctccaggagctagcacgctggctccggctagggacgagtgcctggaggctctcatcctgacgggatggggcgaggcgtgtgtcagaccgcctgttgccacctatcccgcgatctgaccggtctgtgaccggtcacagaccggataaacgagcgcgctgcactgcgttacatgcggcatgacgcgctcgtccaaaccgcaataaatgcggttaggtgagccccgctgtgctcatctaacccatacacgcggcgcaaaacccacaaggggtcggggcgcctcggccctcggggccgaaacgggagcggtccgacccctcggggagacaagagaggggcggccatatcaccctcgggcccgacccccccgagggggtcaggccacgtgggtgatcgcgtctgcccaagcctctagtcatgatactcccggtcccatgtcaccgacaaatggcaaaatcgctaatggtttggcaggacttctagaaagtaaacatgaacccaaacaataattatgttcgattttttaaattccaatgataataaagagatgaggtagagaagtatggtgacagtgtttgacgtgacttgtaaaaattatataaacgaaatccaatgagaccataaactctaaaaactagaagatccaatttttaaatgtttcaaggaaaataaatagaagtagtggtagatcggggaagcttaaaaaaatttaagtaagaccgtattaaaaaatagataactttgtattggtgctagccgcgcaattacacgggccacccaactagttctgtctaagcgatcgaatttcccatagtttaagtagattcttcaatggtattgatgctaaccaaatctattattgatgctatcgttaaagaaaattctagttaagagttctttctgatctcccaacacactataaaaaaaccattttttaagacatcccggtttcattttccgaagtggatcataagaaaatctaattgtgattacggtgagagggccaatggtctaaaacctcatgtggaaatcaattttcacaggattttcaatggtggttcattgagagaatggctggtggaaacggggtaatttttaaggtgattttattaaggaaatgtatgtaaaattgatggtttctgatcgaaactgaaaattttgaatgtcaaacgttaactggcagcgatattactatcgctcaacatggtgactctagattaatcattttatatgaagctataatagaaatgtaaaacaggctacgtttgcttataggcggacggccgccctgcctgtgaagaccggtttccaccgccggcgataatgcttttcttagtagtgtactatgagttcatgagcccgctccacatggggctgagcctaatgcggattctatagacaaattgttacctgcatcatgagctaagagataagatgaattcctagacgatgtaccattttgtacgacctgtagcatggcggccgcttgtggagtggtggatgcttcagggtcccaggacatgccacaagcgcttaaatccagtggtttgtattatatggtctatgcacctgaaagcgctcatgtgaaaaaaaaaatatgacaaaaaaaccttcagtcaaaaaatctaacaaaaaccttatgcctctaagggccagttcttttctccaacttaaaacttcaacttcctcgttttctgttagcacgctttttaaactgttaaatgatgtgttttttaagaaaaatt

SEQ ID NO: 80579 - DNA, 1687 bp, Oryza sativa
gcaaattgttcattgagtgcttgcaaatgtgcgtctgacttgttctcaccgtaaatggatatatagtaggggacatcaatattgactgacaccaattgcagtcaggttttcctattgcactacaatcgatgtttacacaacaccaaccctttaaccacatgcatgcatatattaatatcgaactacctcaattgcaacaaactcaagtcattgtagtgaagaaagaatagagcttgtgaaaataccttcaccatgtcgtccttctccaagagagtagctcatcatctcacatcactgctaactgtgatgcacatcctcctgcaagttcaggccacccccacgcttgctgacagaactacgacctccatcgtaacgacaccggttctctgccttccggaacaggcctcggcactgctccagctaaagggctcgttcaacgtgacggccggtgactactccaccgtctttcgatcatgggtcgccggtgcagactgctgccactgggagggcgtccactgcgatggtgccgatggtcgtgtaacctcactcgacttgggcggccaccacctgcaagctgacagcgtccaccctgcattgttcaggttaacctcactcaaacaccttgatctctctggtacaacttcagcatgtccaagctcccgttcactgggttccaggagctcactgagctcatgcaccttgacctctccaacaccaatatcgctggtgaggtgccggcaggcatcgggagcattatgaacctcgtgtatcttgacctctccaccaaattctatgctctcgtttacgatgacgaaaacaacatcatgaagttcaccttggattcattttggcagctcaaagcgccaaacatggagacctttctcacaaacctcaccaacctagagcagctccatatgggaatgatggacatgtccagggaaggtgaacggtggtgtgaccacatagccaagtccacacctaagcttcaggttttaagtttgccttggtgctcactgtcaggtcccatctgcgcatcgttgtcggccatgcaatcactgaatactattgagcttcaccgcaatcacttgtcaggttcaataccagagttcttcgctagcttctccaacctctctgttcttcagctatccaaaaacgactttcaaggatggtttcctcccatcatcttccagcacaagaagttgagaatgattgatctttctaagaatcctggcatatctggtaatctgccgaatttctcacaggaaagtagcttggagaatctgtttgtcagtagcacaaacttcacaggtacgattacaagatccatcagcaatctcaaatctttgaagaagttagaccttggtgcaagtggcttctctggaacgcttccttcttcgttaggtagcctcaaatatttggatttgctagaagtgtctggattacagctagtaggatccataccttcatggatctcaaacctaacttctcttacagctctccagttctctaactgtggattgtctggacaagtaccttcttcaataggaaacttaaggaaattgactaaattagcattgtacaactgcaacttttcagggaaggtgcctccacagatctttaatttgactcagttgcaatctctgcagctccattcgaacaatttggccggcacggtagaactcacatc

SEQ ID NO: 80580 - DNA, 46999 bp, Oryza sativa
  unsure (1)..(46999): unsure at all n locations
tttagtcaaatatgtattgcaaaagtttgggctgcacatacacggttactaatttttactaatcagtaaaatctaataatattgatatgaattccatatttaacatccatcctaatgcagcaaatcatttaaagtataattttcaaggcaatcagacaaatatcctagtctaggtttgaattgtttgatcatgtcaaggtttttctactatcatactatatacatgggatacatggcccaaaacttcataaacatgaatactatgattgcggtcattatccaactgttttttattggctatcctttctgatgtgtcaagcagtccaaaatatataattagaatactaaatagaatacaaatttaaccataactgaattcaaaagcacatatttaacccatgatgtttgtgctacaaataaaccttcttcgtacctcccacggacaacaggtgtttccaaccaattattcacatcttataatcatggccatatcacacttatctcaatacacaagaacccacagccagtttactggagtaaatagccacaaccctgcaagttactcggtctagtacgatccataatagggaggcatggttgtacggtattacatgagcgaacatcccaaccaaccgtccttaatcaactcagatggtgctacgtgcatccgaaataagttccataattagccagatcatgtatgataatttatgtttattaccattcccaatccaagcatgattcattcccattcacctatctcaatcaaccagctatttccgttaactgcataccattgtcttctctatgcatggctaagcatttattcaagtagtagtcccatagatattacccatctactgtttgacaaggtatacaagatcaataattgaaggcaagatgcaaatagcaataggataataaactctacccgacatatttgcaaatggcgatgcatatatagttttaaatcaaaacatgcttttgcaaattgggttcaacataaccaaaatttagccttgttcctgtgctatttattgaggctcttctggttactccttgagctcatcctgcacatcagaatttagcaagaaaccaagagacaaataagaaccaatagataaataggttacaaaactaggaaaacttctaccacggtaaagaaaatgttgtgagatgaagtggtacactgcacattgacaacattcctgactataggttacatttatgcttaacttcaaattttacttgtttgctcactgaaactgtcctcaattttcattcaatagtagagagagaatattggactaattgcattaatcatctaggacagtgtatatatagatagagtacagagatagaagataaggaaggactctaaacaaatcaatcctatctatgatatcatagtttttttaatatataccaatcgattgtttatctttacaggattttggtcttaacctcatgaaactaaaccatcagaaactaactatagagttttgttgatttcacaaatgcgcttcttcaaaaataccatttatgcccaaaagaaatattccgcaagcatacaaaaaaccattgtacctttcacttgggagtattgtatcgaatccacaaggatcctttggtctaggtttcatgttactacttctaattaaacaagctaactaaagtcataatactatgtttcttgcttcaagtacagtagcaccaccaaagaaagggaagagaaaggggtgctaatatgccaaaacacaccaacttaagtagagctaacgttgccgacttttttttttttgagaaacacagtacaaacgcaggcgctcacaacgtgcgcacactcacccctatgaacgcacacacgcacaccctacccctatgagcaccttcggaagactgggctggcatatcttgagattgacgaagtcaccacaggcgcctcgctgtcgacgggtacgttgcctaccactgaaagaataattagccgtaaatgcgagcacccgtatcaaatctaggatttaaacccgggtgggctggtccaccacaaggaacctaaccagttgagctatgctcactttgctaacgctgccgactttaaacaatggccggtctagtcaccacccaactgactacttcgtccaattctctatcatgtattcctagataaaaacgatgcccaagcacacatacttgtagaaataccactagaattagttgcaacagtgaacagaggaagcaagataaataaagtataaagactttatctaaaatagattaggagccaacaggctcttatagtggtaaataaaataatgaaataaataaaaaagtagagttgacatattaaccgaacaagaagattgaaatgactcttccgggtcacttcattttattttacgataagagtggtcacttcttatatagtggaaattggaacacacttaaattcttcctctcatgttttcttcgattgtcgcatttcctacttgccatccaatagactcttcacaaaattcatgcgactctaacacctatagaaatttacaatatgtaaaaaaaattgcattcttcttattcatgttttcaaaatcccgcatttccaaggaggtctaatgtgactgatattgatccctagctacattgcactcactttgtccaaaataaatcaactcataggttcacatgttttcattgcatagagaaaagatcaaagtatccttcattaaaacaaaaaagcactattgatggttggtggtaagtggttttcaaaagatttaacttctttagtcctaacgcttataagaaaagagaaatcaacttattttaggacaaaatttaaattctacaaatcaacttagtcactgtttggcatattccacgttagatttaaaacttgttagttaaactgtagtagtgaattttagatttcatttaaaatatgaacaaaacaattcatctaaattttataacataatcatagatccaatccaaatccatgggttcatggagatagaaatacccaactaaaaaaatcttatatctaaagctactcacaaatattacgcacatacatgtaagctttcaacagaatattagtgaaatcaaatatatgccctagttttcgtctattaaagtatgtgttagatgacatatttacagggtatgactgtgctggatatgactgtgctgttacatgtgcaggaatgtgttcgcgtctatcatgcaatgtaaaaaaaaaacatagccatatttggggatggtgaaaagtgtgcctacaactatcttcaaaacaacgatggttacattcactcgattcgcatgtgtgctcatctctgatgtacgtccagctgtcctgctccaaatttcgttgttactcctctcgttgcgctgcatgtcgatgaggagcgcttcgtcctcctccctcccgcgtcaaaaagagaaaaaaaaaaaaccttacaaaactcctcctccaccaccacctcctcctcctcccctcctccctcctccgccccacccggcgatcccccccacctcccaagacgtcttccccggcgtcctacctccgatcgcgatcgcgggcgcggtcgcggtcgtgctcggacgcggcgtccatgtcgtcgtcggcgtcggagcagccgcgcggggaccaggtgtggtcgtcgtcgtcgccgccgcggtcgtcgacgcctcccccgcagccgctcgtggggggcctgatcgagtcgctctcgttccggagctgcgggttcggccgcgccgccgtctccgcgttcgagaaggaggacctccgcgcccgcgccgcgctgccgcagcggctccgggccgcggtccacgcggcgctgcgtgccaaggacccctccgcgggggcgttcgcctacgtcgccggcaacgcggctgcccggggtgggcgaggaggcggcggcagcggcggcggccgcgaggtgtcggcggccaacccgtggttcgaggtcgcccacgacgacgcccccgagtcccccctcgtcgcgttcgtcaacccccgcagcggcggccgcctcggccccgtcctcaaaacccgcctccaggagctcatcggcgaagaccaggtcaacacctcctctctctctctctctctctctctctctctctctctctctctctcatatattttgttgcgtggcatgatgtgcgggtgaggcattttgtcgagcggttggagagcacgacgtgaggtgatgagatggtcggcgtcgggcgttacgtcgatctgctgtcgcggtgcggcggcgacgcgcgcgcggtcgcgcggatccaggcggcgctggtcacgtcggggtggctgcggcggagtgccgacctccacaacgcgctcatccgggcgctcgcggggtccgcgcgcccgcacctcgcgctcccgctctacgcgcacctcctccgcgcgggccaccaccccaccccgcacaccctcccctccctcctcaagtcgctcgcgctctcccccgccgtccccggcgcgcggggcctcgcgctcgccgtccacgcccacgccgtcaagctcggcctcgcggggttcctcctcgtgagcaacgcgctcatccgcgtccacgcgggcatcctcggccggctctccgacgccctcgtgctgcttcgcaccgcggcttccgtcgacgcctccacgttcaacacgctcatcacggcctacgcgagggccggccgggtcaccgacgcccgcgcgctgttcgacgaaatgcctgcgaggaatgctgtgtcgtggagcgccatggtgaatggctacgtgcaggctggggacgggagggaggcgctggggttgttcgcacggatgcaggccgatggtgtccgcccggatgacacggtccttgtcggtgtgctcgcggcatgcgcgcagcttggcgtgctggagcagggcaaatgggtacatggttacctcaaggcaaataacattaggatcaccgtgtttttgggcactgcattagttgacatgtatgccaaatgtggtgagatgcagctcgccatggaggtgttcaaggtgatgaaggaaaagaatgtgctggcttggaccactatgataaaaggcctggcaatgcatggtcgaggatcggaggcattggagttattctcccagatggagagattaggtgtgaagccagatgacattgccttcattggtgcattgtgcgcatgcacacacactgggttggttgacaaggggcgggagctttttgattctatggtgaggaagtatggtatcaaaccgaagatcgagcattatggatgcatggtggaccttctggcacgaaatggcttgctcaacgaagccagagagatggttgagaaaatgcccatgaaacctgatgccttgatctggggtgctttgatggctggctgtaggtttcataagaatgttgagttggctgagtatgttgtcaagcattggattgaactggagcctgataaaagtggcgcttatgtgcttctgggtaacatatatgctgcctctggtaggcatgcttctgcaagggaaattaggcacctaatgcgtgagaagggagttgataagacaccaggatgcagcactgtggagattaaaggagttattcaccaattcattgttggagatctgtcccatccttttatagaaaagattttgtctaaatgggatgagattgatagtaggataaggttggaggaaggttatgtgcctgataagaaggaagttctgcttgatattgaagaagaagagaaggaaaatgcactcagccgtcatagtgagaagatggcaattgcatttgctttgattaacacaagtgatgatatgcccattcggatagtcaagaacctcagagtttgccatgattgccatcatgtcaccaaacttatatctaaagtatatggtagagaaattattgttagagatcgaacacgattccatttgttcaaagatggcagttgttcgtgcaaggactattggtagtaattaacagatctgtagaataacatcagtacttgattcatgaagtagttcagtcaccaaatgaaaaaaaaaaatctctttcatcttgaagtatacatcaggggtcatgaatgaagaatgtcaaggtgattaaggaataaaactccctgctagttctaatctgcatatgtagtcaggctgccactaagctaatttccatggatattattgttcatctttggtattgaggtgattgttccagaacaataatataattctgcactggtagcatgccaaatccaattgtgaaccaagcatactgcattttttaaatctatcatgatgtatgaatctggtacattagtctagatatgctattgttccattgttatcacgcttatacaaaatagcactacaaacaaaatatgggttgatatcgaatacgaaatgctagggaaacacatggttgaaccctatggaatagagtagaacagttaatttacttgtgttggcatgagaaatttggatacgatgcagggcacataagcataatgagtgcatggaatactttcatgtccaacagttttccaaccaaggaaaagtgtaatagttagtcgtagtcctcaacttacgcaaatgctggaaagattctgatgatccatagtcccatgcaaaacaaatgcattgctttagccttttctgatatgctctgaactttcactaaattagtttatctcatactagtctgaattggctttacttcatacacttttatttactgtcatttaacatccattcttgtaagcaaatataatcatttttagttaactacactaaaaacatatatgaaaatgcagaatggtaggatatcgcttaaactacaaattcatcactggccataaataaatattgaagtaggtaactgtaccggctaattgaccaaatcccactttattgatggttcagttccaactaaattgttgctctgcttcggttaaatgcccttgaattatttctgcaaaagaactaaaatgggtcaattggacacctcaacccaaatcacttgatttcctatagatacttgctctgttaaagaaagtttgagcacgccaaatcacttgctttcctattcttgttctgttaaataaagtttgagcatcatacaatatcttcaattattgggactgctgttcttgaaaaattaaaatgattaaggaataactgctttgttattaacaaccttttgtcagcaggtttttgatcttactgttgtgaagccttctgactttgtgcaatatgttttgggttgcttggaacaacttgctgacgctggtgatcacagtgcaaagtccattcgccataatctaagagtcatggtatgtatgcattttcgtagcttccatagctgtaaagaacacatcattattattctgtgtttttcctgagttgctgaatactaatcacatcatctcttatttttgtcattgttgtagtttcacaaaggtactaaattgtaaaaatgtttttatttttgttctttcgtatgatggaaaacctgtactagtcagcagaaccgttctcatattccaaaagtttcagaattctaaatacttacagtttgtaacctacctaggttgcaggaggtgatggtacagtaggttgggtgttgggatgtttaggagacctttatgttcagaacagggaaccaattcctccagttgctgttataccacttgggacaggaaatgatctttccaggagttttggctgggtaaaacgatctctttcttgcactctttccgtcttcctatgaagctacttactgcaagttttcatgacctcacagttattttcagggtgcttcatttcctttcggatggaaagcagctgctaaacgatctctgtacaaagctatttttggttcagtttcttgtttagacaggtgacttctttactttgttggccagttattttaatcttctgtgcattctggttgcagtttgatgatgatacatcagtatttttgttatgttaagaaaccttatttgagctggttaagtccgcataggtatcactttttcgcaataccatggtcccagcaatgtactcctctatttccaaatatatgtaattttagacactaacatgatcccaaacatacatcggaccattacctttttttctaattacgcgttagtacttgtttattcagcgtattgtcccaatatttctgcatttatgaccaagttcctccttcaacatgtaatactcacgtccccagtataaccacttccagttgctgattaattagttatttctgcagttggcatattgttgtttctatgccagaacgaggagatgaagaggaagaactggattttcctcactcccttaggaatcttggagagtgtaccttttatgatgtaattattttctactatcttatatattgaaatgttgtacaaatgcattggaagtctaccccgtgtacattttatatcgtactccctctggtcataaatatgacatgcacgataagatttggtaaaacttgtgaaactttgaccattaattttatgagaataagtttatgatattatgatagtatttttcaaggcaaatctatgatatcatattttggttttaaactaagcattatatatattatagatggtcaaattttaaaacttttaaccatatattttcctaaatgccaaatatttatgactagaggagcaattatttttatactatcttcttcaagtgttgtacaaatgcattctgcttgattaatacaagtctaccctgcaggacggcactgctgaaggggagttgcctgaaacagtttcttgctttgatggcgtattctataattacttcagcataggtacaatttttacatgataacttatagttgtgttcattattcaatagtgtgtttatagtgtattccaaagtcctagatatactcttggccacacataaataatttgtattgtcatattctacatttctaagcatctattatggtttcatatgatgcatctcatcaagggaaagtatcttcaagaccattgtgctttgtcacttatgctaataaccttgtaactaggtgttcgaaaaattctcctttggttattacattctcataaagtttttaatctacgatgtatgtttgtattgtttgttgtgatgttctttatgcttattttggttctataataaacaaaattaatgcacattgtagcactacaattggaataatgagatgaattatatctcagttatttgtcaccccttacattcattatcagtgtcagagaaagctaccatagaagttatctacggtgtggctttctttgttgttactatatgttgtcattttcaatatgcatattacatatgttctgaagggaccttgaggatgcaaattctgttgtaatgcaggtatggatgctcaagtggcgtatggatttcaccatctacgggatgaaaagccattccttgctagtggtcctttatctaataaggtatgcactcagggatgagatttccatcatttatggcaattcaaaagcttttcagcccaaactcatgatattgaattagcatgtgctcattatctgtctcctgttctttgtataatcataaagttgacccttgaatgggatcaagattgccgtctatagacgcaatgttaaatggtacaaattatttaaaagaaaagataaggggaggacagctgaagaacagtgggcccattatattaatgaattgttttcttttgggtatccagtgtattttctgctagctaaaagcaattcctgacaagaccagcttgtactgtgagtctgtgactgattaacaagaagaatgtccgtgcaggaggggcgtataggagactggcaagggacacaggggaataggagattggataactttttccttttctttaaactattgaataggagcatcgccctaaatgagaggccctaataaataaaattttaagtacaaagacaatgaaccataataaatataaatatatcatggatgatacattaaatggcttcaatcctaagcaaagggtttcaattgggatgtaattggaacgtggtgtgctgcttctgacttccacatgccggccgtaggtctggccgcacatgacattacctttttcaacacttatcgcaactcgcaagctattaattttgatctgatgtaagtaacataggcttccacatattctcactgtaaacatatatacatcaaatagggtttgatacatgggttgaagcacgttatttattgaatgatggttcttataagttctaattgtcagttgatcgggtacataattgacgtttgaactttgtcatgataagccttctgttctgttgatgaatatgataaataatatttcaacagtgaattttttgctaactaaattactgattggctgattttatgacagttaatttacgcagggtatacctgcaagcagggatggttttttacacaatgtgtcagcgaccctgaactgaggtgctgtatcccccctcgatttagtttaaggcatacttatgtttgactgatatctagaaatctggaaagtccatccatcatttgattattttagtgttttctgctctataccttttttggggaagaaatgatccgatgacaatgtgttttccttacaaagagcaaatatactcaagtttttcttttgaccaagtgccaatcatggttaattgattatgttgtatcaatttgtaatgttctaatgatatttatgaaaacttataactttctctaattgtatttacttttttttcattctgtccaaactcatcaaggttgtatttatacatagatatgaaatgtttcttttctgttatcgtcttccagatactgatttgcaaaactgagattagaatggcagagacaggaaaaaggctcttattttgattctcatttcatatatcaggggattgacgaacattattcgtttatcaataaagaagttggacagctctgagtgggagaacatccctgtaccatcaaggcaagttgaagtttttctttcctatttgttattgttatatgattttagttccagatctgaaattcagaaacaataatgatccttgcataagtcactgttctccagtttgaactctgcagaatactattataaacagattactttagtagttctgatactattatatatgggcacactaagtaatgaagtctcacggctgaactagaaattattcttggcacaagtatagaggatacagtttatattgagcagccatgttgtacttcagtgtcagggctattgttgcattaaaccttcacaattatgcaagtggaaggaatccatggggaaacttgaagcctgaatacttggaaaaggtgtgctgagtaaattgcttgtcatttttatgattgctttattggaaaagcacaatagcctgaacttcctcgcaaatactaaaaagcatgctatttttcttaactggaatatcatcaagagaacttctatcttttttatgtaaacagagaggatttgtcgaagctcaatcagacgatggtcttcttgaaatatttggattgaagcaagggtggcatgcatcccttgtgatggttgaactaatatctgcaaagcacatagctcaggtacttttgctccctgcacaagatctgaatagcagaaggtattttaatgcattactgttcaatttggagctcaaaggttaaaaatgtagtagtaaatttttcgctatgtcacctgtgaacaaacatcacattaggtaaaaaaaaaaaagaagtattacaacttagttcaacaggaaaaggcatcatcagtttagataaacagctactttgcaaattacaactccagatggcattcgacactgatatcctcaaaattatttaagcgacgctacctactgttttcaggcagcagcaatacgattggagatcaaaggtgggcaatggagggatgcatacatgcaaatggatggggagccatggaagcaaccattggaccacgagtactcgacgttcgtcgatatcaagaaggtcccttacccatctctaatcatcaatggtggggatcgttagtaacaacaggagagccagccccagatttctttgccctgacctttgctagagctgccaaggaaaaattttccaagctggattccaacttggaagccagacttaaccctgactattcttaactatctcactgtatatgaagttttgaggatatgatatttttgcaggggacgcagccatatacccctgtgctttgatccaagttctcaattaacactgcatgaagtaattgctacatgcatttttttttactaaatgtacagggaaaaaaaaaagaacatccggactttatgccacgtttttgttttccaagaaaatgagcactgttttggggtcacattgtgtagatatagctcaaggattgcatcacatcaactataggcgttgttcgagctttcaaccatcccttctatatcgcgagaaggataggggcacagggaagttgtcagttcaagtataagtgactcaatccatcaaacttaaattctaatttagtgcaaatttaatgcaaattttgtgaagtccgcagatttatccatagccaaagctatgtttaattccacgccaaaattagaagtttgactaaaattgaaagttaatggaccgctccgttttccgtgcgggaagatagattcccaactcccgtatccgaacacaccataaaggttagaccgtcctctttatataccgagaaatttggcactcgagcaccaacccatataacaatgccatacagtaatgcttccccgcactgtgtggttcctacaaaatttgtccaaacccaatgaaatttctgaagattttaatcaggcctgcgtattaaactcaatccaatttatcaaccaagcaaccgtattcatatccccagaaacaaagaattgatcatcactttcccattccattgggaacacttctcagcactaacattgttttcattggtttgtctgagctttgaatgaactgttacaagttgaagttgaagtgacgtagtacctccagcagccgcctcatggcaatgtaaacctgactatcttttacttcatacctctgaagagcagcttacctttcctctgcatccacgagcttctcttataccaaacgaatgccactcaagatcattcatcatctgctacagaaaaacaaaagggctttgcagctatttctattttattgtcaatatgttagctactctctgattggatactgagtactgaaagaattaagttaaaacagcaattgatagttgcatgcttcaacagcaattgatagttgcatgcttcgtgctgtgaacacaatgctccaggtttccttaaatgagtatgccatgccatgatgtctatcaactgtccttccctgatgaacatgccatgacatgattgtatgaatcacccccattatgccacagtatcaaacttctagtcccattatgccacagtatcaaacttctagtaagaaaactcagttatactattacagaatgtcctgtttgcaaagtgacaatgacatggacacatgagatgtagcaactaaacacaagaaaactacagaatactgcagaatatccatgacaagcggcaaatgcacatctacaagatgctcgaaatgtgcttctcaaactacatatagaaaataaaggattccacaccaccagcgatgataatggtaacaatgcaaagtctatcagatgatgatcatgtcccagaaactccacctaataaagatgatgatcatgtccaagaaactccatgtaaagaagatgatcatggccagaaattcaacctaatggagatggtgatgccacatgacagaaacaagcatttagaagaaaatatgcagatgataatttagtaggatgctaaagttcaagttacatcccctctcagtttgaaggagctccatttagagagcccccaattccaccaacagaatccttccttcggccatagggatttttcgaaaatgttcaagacgttaaggacttacaaaccatataaaattagcaaaggaaacataaatatctaatgttaatgtaagtgattattttatttcattgagcaaataaaggatattgaattcgcattccaccacgaccagagctaggaataacagcaccctgtagattatggtgtacagctgatgcagcattcacatcctaaaatttaacaaacagtgagatgcataagaatgtaggataaggttaagataaaattacaatattgtaagtacctacctcaaactcaatgaaacaaacagtgttcctgtcttggcgcaacaccttcatttgtttataaccaggttgcctgaaaggaaaatgaataataatcagttagaactgttgtatctactttctagaaccataccatgcaacaccactgcacacaatagacaacgatattggcgtcgattcttacacgctgaagaggctccgcaattcctcttcaataacagtttctccaagattaccaatgaaaagggtattacagggagggttatcctttgtattctgaaaaagagaaatcaaaatataccattaatactagatttcagaaaactgaacagtataaagcagtcaaaatattgaccccaaacaatgtattctgcatcagcaatgcagcaaccacctcttatttttaatagcattacaatttattaaccaaaatcatgacaagcattatgttcaatgaaaaacaccacaagcatctttgcaaacaagactttatgtactcacacatttgtgcacatattacctggttattttttagggaggaacttgagaagttatagaggataggtaaaggcaacagagtctagtttatttttatcaatgttcatagttcaattatattcaagtggatgaaaaaaaggaagaggttgtctttgaatgatgttattcaagtggtttcgtcacaggttgtaaagtgcaggggccatagatttagacttctctatataagcaaatatgaattcatcatattatatcttacataacagttaatacaaagaaatagagatgatgtgcacacaacggagctatccaatgacctgtgtcaaatttaatcaggaaataatatttaactttcctaagattaagctcaaaaccaaggtgagatatataacataactccgaagtacctgaacaggagcataggcagttggacctggtacgggagaaggtgaagtcattgccacaggaggcactgaataggcagcataatgattgtaaggtggaggtgccgcgatataactgaatgatacacaaaagaaaaaaaggattatagagctccatagctgtgcataattagttgaaagaaagagcaacaaattaagaaatttaccctggagttccccacatggaaacagctggtgggggtggatgatatgggggagcagcataaggagaatgagtataatctccaccagtccgcaagcgtttactttggtccatagcatttgcatcgtttcccacacctaacataagccttaattaattcagcgcataatggatatgcataacagtgtagtaaccatttcatggagtaaatggaaataaacaacagcccaatataaggagtacgtggaacattattgtcaccaggtttcttcatcaagttatagtaattttatcacaatcactaattctataatcattagttcatctttatttcatttgcatatttcctaaagcttatatgaaatgctacaataacattttcaaagattaaaatttggcaacagaaagctttggtaaaacaataatagccttgaatgtgcttatctcacaacacagaactaaatcctgtaaaagttttatgaagccatatgaaaaccaccaattcacctacacattggttaaatgtcctgacctgcataggtttaccaaacagtttaaaggaagacatcaaagctccaatagcaggccacctttcccatatcgaattattctaatattacacataagcttcagaaaatatgcaacaagaaatgaactgcatattcattgccattctctgccaagcttcataataaatgataaaaggtgaaagcttccatgatacaaagcagtatgcgcaaacatggctacatttatatggaccaattccatccaaccaaaaatttatcaggttgatctgcacaacatgacagcgaaagcgagcgcacatcgacaaaggggaacgcacctctcttgacgaagaggttcttcttggccatctcggtgtgcagcgccgtcttggtctccgcatcgaagatgagatcctgcagagagaaactcgtgtcacaccaccatccacccaaaccctataaccaaccccgccatggagaccccaaagagagagagaaaaaaccctagcacctgcagcgcggccttggcggcgatggcgtggtgcgcggaggagaagagcgcgaaccccatgggctggtcgcccttgaagttgatctgggaggcctcgaacccggggagccagcggagcaggttgtggagctcccgctccttgacgtcggtggggagccccgtgatgaagatggtgcggacctcgtcggggcgggcggcagccgccgcagcttcggagtcggcggcggcgggctgcggcgatggtgtcgggcgcgcatgggacgcccggcacggggggtgacgcaggaacgtcggcgaccggggcgggcgcgcccgccgccggcggccgttgctggtggaacgggtggatcgttccggccatcggggcggcggcggcggaggggaggggaggaggtggcgcgcgggcacaaaccctaaccctagagagagattgggttttgggggtttcggggagagagagagagagagagagagagagaggcagcagcgcacgcagatgagatgacgaggtgaggtgaggtgaggtgcgtcctccggcccagcctagcaaagcagctttcagctgatttcaggcccttttggatcgaataaagaacatgcaaaattttctaacttgtgaagtaaccatcataatatttttttcactttgtatgtattttttagacattcagtgcgagtacgtggagtattgtcccaaaatgacacgttaaaaaaattggagtccatgccaagagtcaggctcaaagtcacgtgatccatcacgcgagtagggcagcaagtcgtggacaccactcagcgtccgtgttgcaggggttgttctctagtcacgtcgtgtgagccgtatggtcgcgcagtgtcttcttagtaaagttgggtccatttagttttgcttaattgagtaatatgtgatgcttgggcttatatagcagctaggaaaactcgttggtgtgtcaagcattgttcctataagagtctccaaacatcacctaagataaaaccatctctaaagatactatgtgtccataatgcaagctacacttgttaggatccataaataatttgcatatcggcccctagaattcgaatatgttcaattttaatttgcaaacgtatttaaagttatctattccaatccataaaaaaaattacatattacccctcaccctcatccccttgtacccacacatcattttccccatttgtctctccctccatgctagtgcgccattgacagaattgtcgttccttcctccgctctccacaccgccgactggatcggcacttcttcgtccagtccttgagatcgagtgacaactatgtagctcctattcccaccatcgctcctatccccctacccgggtcctctccctcctatcctctttccctgcctagcgcccctcctctccttcatggctacacttcaagccagggggcagcgatggtctcgagcatggctgaggaccgcccggcgatggagatggtgtgggcgaaggggagagtaaggacaatggggacacaccggcatcgttgtcccaaaatgacacgttaaaaaaattcgagtccatgccgagagtcgggctcaaagtcacgtgatccatgacgcgagtagggcagcaagccgtgggacaccactcagcgtccgtattgccggggttgttctctcgtcacgtcgtgtgagccgtatggtcgcgcagtgttttcttagtaaagttgggtccatttgagtttgctttattgagttatatgtgatgcttgggcctatatagcagctaggaaaactcgttggtgtgtcaagcattgttcctataagagtctccaaacatcacctaagataaaaccatctctaaagatactatgtgtccataatgcaagctacacttgttaggatccataaataatttgcatatcggcccctagaattcgaatatgttcaattttaatttgcaaacgtatttaaagttatctattccaatccataaaaaaattacatattacccctcaccctcatccccttgtacccacacatcattttccccatttgtctctccctccatgctagtgcgccattgacagaatcgtcgttccttcctccgctctccacaccgccgactggatcggcacttcttcatccagtccttgagatcgagtgacaactatgtagctcctattcccaccatcgctcctatccccctacccgggtcctctccctcctatcctctttccctgcctagcgcccctcctctccttcatggctgcacttcaagccagggggcagcgatggtctcgagcatggctgaggaccgcccggtgatggaaatggtgtgggcgaaggggagagtaaggacaatagggacacaccggcttcgttgtccatggttacatatctggccggtgggcatggtagtgacacgttgagagacaaggggctcctcaccagtggtcttgagctcccctagtcgccatcggtcaagctctcctcctcgctagtggtcttgaacaccctcgttctaagcattggcaattgacctgcttggaatgacagcatcagtgctggatcttcttaggcgggtggactcggcaacctattttctcatggcgctagcatggttggtcctcagcgacggctaccccgatggcccacgaagccgacaacctcgacgatgaatggtttgggagggggccggcagcaatgcagggtggagcgacagcttctcccaactcgtctcctcactcaagtggtccctacgccagacgttttgcaaggcaacgcggttgtgcttcctgcatgacacaaggaacctcatgaagccatggccctcacctactgtctcctccatgcctgctagtgtgctaaatggctaggtgagaccacatgtcatgtaggaacattgtgaatggtcttggctttaagattttttactttggacttctttttctctctttgaccctttttcctcaacattggtttcaatccacatggtgatgagctaagaggagcgaggtcatggagtaaatcatgtcggactactaagccggacatcgaggaaaagggtaaaatggttgcaacatgaaactctagtatacaagagagagtacactgtaagaaaaataggtccaaagtgaaagtgcgtctaccccctccccaccaaatttgttgattaacgataacacaattagaaattcctaatgcaactatctaaatgcttgcaaggtcaaaggtgtccccattatttgattgagaaaagatggcaataaactatggtaattcttgaatcatctcattttcttgactctaggagaccatactaataagagggatgctacacaacaataattcagatgtactcttgtgttgagaatcaagtttttgacgcatcgaaaacttccaaaatctcactgaacgcgagtctctaattgtacttcattgaaaacaatcgcaatatccaatcgattggattgtctgaaatgtcaaagaactttgttctatatttgattgtatgtttttgatcgaaaacttgtaatgttcaatcaaaatgctcgacattctggaaactccaatgttgcaaggaactcaactctctggttggttcaacttttaccatcagaatatccgatgtaccagaatgcccaatatttcattgaactcaagtctctctcttaattaaaatcttgcattggaaagtccaatagtgacatcggaatatccgatccgatattctttatagacatctaggatttggacttagctagcagacatataatacatatcagaatattagaccttgaagtcgggatatccaagatgggaagaaaatacatcccccctcccctcccctcccctccccaacaaccagattttgggatcacctatttaaacactggccctatccttttcttggattagttattcaattcactcaaacctgcttttggttagagcttggttctaatgttctttggatcttgagcatgggcgtgctctcactcactctctcaaatctctcttggctttcgtgcttcgattatttgtgtgtggatttgggattgaagacctagttttgtgctattctcttagatcttcagcactaggtttgattccaaggatttgttactcttgaagattgaggactctggatggttaggcatcactccctacccaccgattcatgtttggctataaggagaagtctgtgaaggcaaaatctcaccctcgcaagaaaacagataccccgagtagagatggagtgcatttgtgcaaccttgcaatggaagggttggaaaagacccggctcattgtgagctcctcaatggagagtagaatcccctcaaggatttgaactttgggaaataatcgttgtggagaaatattatatgtctcccataaaactttgttaaatggaatattgtcttgaatttaatgggcaacaaaaatcatctcttgaaatgctattgttagaaatagttttggatggatgttgagatggattaggcatggtaatcatgtttgatctactcccaaaccatctcaactagctccgccacgatgagtttatttgaaataatgcaatatcagaaaaccacctattaacaaacaaccattattccctcttttattctctccttggtttcacaccttaaatcatgcatgtctagattactagtttattccatccatttgcttagtgagtaccacacattcgatgtatgtgttatgttcaatttctactattattaatatgacatctaaagttttaatgttttgacttcaaattctatttgttatgttgttagtgctatgcaaccatctcgttagttatcatcctattagaactgaaattatccaagaagtgggccttttgagtcttttttttttgcacttttttcgattcaattgtgcatgtcataatttggaaacaaatccctaaagttaattgcatataataattttggtacaatattaatgataatcaatatgttccctgattattactgccacacttcttgcatgaatgttcctttgttattctatccctctgcttcgcatgcaccacacatagggagagcatcatctacatccaacgccatcatctcttggtgtcttatacaaagagatgaaaatcaggtcttttggcagtacgtatttgctgacgacaacttcactgtcttcatttcaaatttaaactttacttcaaatatcgttagagcactcataggtatgcgattatagtggttctatttctagaattattaaaatgacatttatggttttagtgagactctgtttgttgtgttgattatgtcattaatgctatgcaaccactctgtttgttgtgttgattatgtcattaatgctatgcaaccatctcgttagttatcacctcattataattgaattaatccaagaagtatgcgtttttaaggtgtattttacacttttttggttcaattgtgtatgtgataatttggaaacaaatctctagagctaattgcatatggtaattttggtattgtattaatgataatcaacatgttcctcaaatgttactagcgactttctcccctcactatattaccccacttcttgagtctaggtttctagattattccatccctttgcttcatgcgcaccacacatagaaagatcatcatctccatccaatgccatcatctttgtgcgtccgacacaaaaagaggcaaatcaagtcttttagccatacatgtttgctcatcacatcttcattatctttgtctgcaacgtacaagctaagaccgtgtattctcgtcgacgtaaagctctacttcaaacatcgttagagcactccttggtatgtgattttagtggttcgatttctagcattattactatggcatttacagtttcagcgatttaacttcaaactatgtttgttgtgttgatcaacttgatgcttctatgcaacaatcttattcattatcaccttactagaattgaaattatccaacaagtaggccttttatgttttttacacttttcccagttctactgagtatttggtaatttggaaacaaatctctagagctaagtgcatattgaaattttagtactatattagttataatcaatatgtttcctaaatgtaactatcgtctttctcctctcgctatattatccacttcttgagtttgggtttttttggttattccatccatttccttagtgtgcaccacacataggaagaacatcatttgcatccaacaccatcatctctttgcgtcccatacaaagagaggcaaatcagggtttttagaagtagatgtttgctcgcaacatattcattgttcttcttcacgacctacgcgttgtgaccgttttctcctcgaactcgactctacttcacgtatcgtcagagcactcctaggtaagtgattttagtggtttgacttctagcattattactatgccatttgtggtttcagcgatttgacttcaaactttgtttgttgtgttgatcgtgttgttagtgctatgcaactgtcttggttagttatcaccttactagaatagaaattattcagggagcaggcctttttagttttgttttcaatttttggttcaattttatgtatgtgatgatttgaaaacaaatctctaaagctaactgcatatgataattttgatattgtattaattgtaatcaatctgttccccgaacattactagtgtatttctcctctcgctatattaacctacttcttaagtctgtgtttctaggttattcctccttagtgcgtgccacacatagggagatcattatctccatccaatgctatcatctttgtgcgttatacacagaaagaagtaaatcgggtcttttagccatacatatttgctcatgacatcttcattgtcttcattcgcaacctacgagccaaaaccatgtaccctcgttgatttaagctctacttcaaacatcgttagagcactccttggtatgtgattttagttattcgacttctagcattattaatatgccatttacggttttaggatttgatttcaaactctattggttgtgttgatcatgttgttagtgctatgcagccatatcattatttatcactttattagaatcgaaattatcctagaagaaggctttttttacacattttttcgattcaattgtgtatgtgataatttggaaacaaatctctagagtttattttatatggtaattttggtactatattaaagatagtcaatgttttccccaaatattatgaataaaattcgaatatatacttttatttttaacgttttgcttttatatacatgcatggaaaagaattgtgaaaatatacctctaccgcagaatggagatgcgggaccgaggcagtgccgctcgctcccgcgtagcgtctgcacggcaccgtcgctcccgcggaacgtccacgcggaaccgttgctcccgcacgcaatgcctagctcccgcgcgccacatacgcgcgaccggcgcggtccggtgcagcggggacgcgtgacaggcgcggtcccacgcgctaacgacgcgcgaccggcgcagcaaagcaagcagcccatgcagcgcatgcattcacgttgcatgcattcaacggcgcggcggttccgcgtttccaggctgtgggatcgatcggtcccgcactgctgttttgcgcgactgccggttccgcggaatggtggtgcgggaccgagacagttccgcatgacccctatgcagtagagctatatttttgcaaaatttcattgcattggtatataaacgcaaaataacgaagaaaaaaaatatattttcaattttttttttcgtttgtcctctctctagattagaccacttcttattacatccttcttcttagcgtgcacctcacgtagggagagcatcatctccatccaatgtcatcgtctctttgcatgttttataaagagaggtaaatcgggtattttagcaatacatgtttgcaagcgacaactccatcaattgtcttcatccacaacctatgcgctatggttgttttctcgtcgaactcaaactcttgtttaaacatcgtcagggcactcctagttaagtgcttttagtgattcgacttctagccttattaaaatgccatttgtgattttagtgatttgacttcaaactcggtttgttgtgttgattatgttgttaatgctacgcaaccatgtcattagttataatcttttgaattcaaattatctaagaagtaggcccttttagtcttttaacactttttgggttcaattgggtatctgataatctagaaacgaatctctagagcttttggcatatggtaattttggtattgtatttattataatcaatatgttctcaaatgctactagtgtctttctctcctcattagattaactcacttcttgtgtctaggtttctttggtactctgtccctctgcttagcgtgcaccacacttaggatgagcagcatatccatccaacaccattgcctctttgcgtcttttacaaatagaggcaaatagagtcttttaaaaacatgtgtttgctcatgacatcttcattgtttttgtccacgacctatgcactatgacaattttctcctcgaactcaaattctacttcaaacatcgtcagagcactccttggtaagtgattttagtggttcgacttctattattattaccgtggcatttacggttttagcgatttggcttcaaactatgtttactacgttgatcaccttgatacttctatgtaatagtctcatcctttatcaccttaccggaattgatattatccaagaagtaggcctttaaaggtttttttttacaccttttctagttcttagtgagtatttggtaatttggaaacaaatctctagagctaagtgcatatggaaattttagtgctattagttataattaacatgtttcctaaaatgtaactattgtctttccatctcttttcttagcgtgcaccacacatagagagaacatcatatgcatccaacatcatcttctccttacgtcccatagagaggcaaatcgaggttttttagaagtacatgtttactcgcaacatcttcattgttcttgttcgtgacctgcgcgctacatccattttttcctcgaactcaaactctacttcaaatatcggcaaaccactcctaagtgagtgattttagtggttcaacttctagcactattactatgccatttgcaattttagcgatttgacttcaatttagtgaattgacttcaaactttgtttgtagttttgatcatgttgttagtgttatgtaaccatcttgttagttatcaccttatcagaattgaaattatccaagaaataggcaattttagtgtttttttacacttttttcggttcaattgtgtatgtgctactttgggacaaatatccggagctaattgcatatggtaattttggtaatatattcattatgatcaatatgttccccaaatgttaatgcatttttctctcctcgctaacctactacttcttgagtctacgtttctatgttattccatccctccaattagcgtgcaccaaacatagagagatgatcatctcatccaatgctagtgtctttgcatcccataaaaagagaggcaaattgttttttttagaaatacatgtttgcttgtgacattttcattggtttcatctgtgacctacgcgctaagattgttaactcgtcgaactcaaactttacttcaaacatcgttagggcactcctaggtaagtgattttagtggttcggcttctagcatttttaatatgccatatgcagttttagtgatttgacttcaaattttgtttgttatgtgtatcatgttgttagtgctaggcaactatcttgttagttatcaccttattagagttgaaattattcgaaaagtaataatttttctagcaataacagttaagtggcaatgggatgagaaatggagagatgagagagatatgataaggaagaagaaaggatgggttgatgacatgtgtgcctgttgcttttctttttgctaggtttgtttggtcgccatatggtccgcacactttgtcatcaagatgaaaatgggcctgtgcggctgcccaggctgcacccggcacgaatagtgccgcactcactgtgcgcagccgcaattgtcggcctgccaaacgtgcccaatataagtctgcccctactttaattgggtaaagctaatgattttgaacttgaagggtaagtctggtaggggtcaagctcgagcacgaccaagcctgactagtatgctttttcctaggcctaagcctggcccaagtaaaacatcgacactgcctaatttcaaataggaaaaaaaaatctttgatgtgaaaagagatgaatgtgaaataagggttaggtagaactcacccaccggtgacaacatggttggactcctagtcagagacttcgtgatgggcgacggtgagaggtgattggcattgaaggaatatgctgcgcgtgtggccgtcgcatgcagactacactaagccaaagcggagtcgagggcgaggcatctgatttctgatcagctaatgtacgtgcaagaagttgaggcatcaatcaacggccttgtatgattccattgtctctgatgggttgagtaggcttctatcattaggggggtttccctgggattgaaggaatgacaatttttttttaaattccccttcccaatcatttctaaaactcctatgtttaccaaccaaacaaaacgcgtcatcatcattcctcaaactctcattccttcttaacaattctctccaatcaaacgcgccgtgagagtcaaaggcagggcagatcacggactatttgactctcattcatttttttcttaaaacaaactccttccgtgattacatgtagttgtttcaactggattttttggggggccgggttttgacgtcttctgaaattgaaaggagctgtgttcgtgattgcaatcacgggagatcgagttggacatttaattacatatcgttgttgtttgcagctaaccatcaacctcttcgatctgcctgtgctgcaagccacatcaccgtcgagttgactaaaaaccaaagatatttttgccatctggtattcccacaagtacatacacaaagcctctgattattttcattgtaacacaagttctcttgcattaatgaaatgtatctgctacattttgctctctttttaatttttttatggttttctacttaaagatgcatattatggacaaaatatgcacactgcatttatagaaacacactcaaaccccccccccccaccccccccaactcccaaataaaaaaaaaccttatatccacctaataataaaactaggaactagacacatactgatgaatattgcaaatcttgaagccaaacatctcaaccattttccttcacaaaataagtaaatgtgtgcaccacgcaaattaaaatatcatgtatatatccttcctctaacttcaaatacaagtcatgttatgtaaaacagtacaattaaggaaacgactcaaataattttatcgccctaatacattaaaaagtgacttatttatttatttatttatttgtaagagtgacaccatttatttggtaagaacaaaccaaagcaaaatgatgaaagattgaaggttctatttttttatgagaggttgtaaaactaattaacttaaattttggaaaataagacgtaaagtaggattaaaaattacatttataagcaaagaaaatactacacaattacacattaccacaaaacagaggacagtactaaatcctctatttctatttaaagagaaaatgaaaaataactggtcgatccgctctaaagaatttctctctacaatacaaaaatcatggctcttattacaactaatagtaatgctacacatacttaaaacttccttacaaacttataacaaaaatctcattatagaagattcaaccataatgtgacaaatccgtatttgtaaaaagtttataaaaaaaatagtacacgtatatcgtttccctactgctaattaaccctctataaatgcatgcctctcaccactctccctccattgccatttcccctactctctctctctctctcaactctcaagccaagaattgtcagggacacgtagccatgaggacgatggttgcggcgccgccgccgtcgccggcgatggctgtctcgccgtggcactcgccggtgccgtacctgttcggcgggctggccgccatgctggggctcatcacgctcgcgctcctcatcctcgcctgctcctactggaagctcaacagctacctcggcaccggccactcttcctccgccgccgccgccgccgccgccggagatggaggcgacggcgatggcggctcgaagtcgccggcgaccgcggtggccgcgtttccggtggtgtacggggacctcgtcgccgtcgtcatggcaggggagaggatgcccacgttcttggccgcgccgatcgtccgtcgaccgccgtccactgacacctcctcctccgccgttgccgaggtggcctcgccggagaacggatgcgacgcggcggagggaggcgcggccagccggccacctccgcagccggtggcggcgaggcaagccgtacagctagctcagctctgaacttccaactgtaaaaaggagaatttgtgggggccttttctgataatttttttgtctccttttttccaaatcgtactctttttttttcctattttcatctctactaggattgtaaataatatattggtgagaattcagatgaagaataatttagttggagatgaaaatatgataggaatgttgtagattctcgtcgagcaaatataattaatcttcgaacaaccagcataaaaaaaacacgacagcatgacactcccacacaaaccatgcatattctactattctaggatatgttatgcgcagtgctaattgagcattctaattatgcaacctctaattctatctataaaaccttcacgtaccttgaaaattattttcctcactatcgaaatatgagtcgcgtctaggttttttaaaaggacggttttacatgacttctatataaaaaattaaacgtattcaaaagttacaggcaaaataaatcatgcaactctcatatatatacacttatatgtttgcttaattacctttttcccccttttatgtgaactttagactggatttcatggaaaagatgtcctagcttcatgtccaaaggaaaaaccgggcgggaaagctggagtcggttgcttccggtgataaagttgcttatttggttggcaaaaggacacccttttgctttgtcacgtagacaactttgtctcatcaaattgaagaggaagccctcgtactatagatgttggggatgttcatataaatgttggattttgatcaaattttgttagaaagttgtttttctttttttttccttttggcaaatggacaccttttgctttgtcacgaagctaactctgtctcatcaaattaaataagatggctctaactcatatcaattctgaagcttggagatgttcatctaaatatcggattttgatcaaattttgttagtaatttgtatttccttttcttttcagatctgattaagtttgcagtaactagcacaggttcggttgctgacaattgagctgtttgtggctgattaacattgggccctgtaggcccagtactagttcttctcttgaatcaccagaaccacagaattcagatcgaatcctgccaaagtgatggtcgttgtaagctgtgatgcatgaataataaattaataatcaagtcattttttttaggtatacattgaccacaagtagctctctacaggttattaatgaaaactatgtatatatgtttgactatacattgagagaaaatgactgctacatggcaaatgcagaagaagaaagttatagagaagataaaaagaaaattaaagggaatatgtgtgtgtgagagagaattcaaggaggaaattaaaggggaccgacctagctacacgagtgggacaaatccgatggtacatgggactaactgtacctacacgtcgtcacatacatatgcgacactgagacgacattgcaaaatgagctgtctgtttaacacctggtttaagttcacaacctactcttctattggattacattactctccatggagtgattttgggactgctcgcttgtggctgccgcagccgcgtcctaccgatcagcgtctttaattaccttctctttcaacgtatggggaaatatatagataccctattttcattgtaagctagctagtgtattaagtagctcattcgtgcgactatagtcatcaatcatgttataaatggtgtgtaagaaaatatattaatgataatatgaaattaaatgattagttattcaaaacgtataaaacatctgaatttgttcgaaacttaattagttgatataaattaaattaattacatgtatatacacttgtatagatacacaactttgagtattcttaagattaggaatactcatgtttaattgtagagtttagagtaccatgtttacacagtttttactttgtaattaattatctgaatttaaagatgtatttgtaatataaatataggcaaatgaatgatttgtacattatacaatttactatattactaagtgcgaaaatagaatcacatatcctctctacatcaagctccatgcggtccacctgtaatcactttgtctccttatatacattatgttttgattaagtaagcggttatatctctatttgtaaataataatacctttttaccatctcaagcaagtagctcttctattgccagagaagggtcacaccctatgtttgttactactactttgagtttcatcctatggtcaaaattgattcttgcttttaatctgatggctaatattcattcgatgatgtggcacactctagttgtatgttgggtttactttcattagataacatttgacgtacaccttctattgtcgtaagtatcaccaaattttacattaccctttgatacttttaagaaccacaattctttttttttcccgcctaacccaatagcgcaccgccactattgaagaaacatcgatagttgtgaagataaattattggctctttcaacatcaaagatggctctcgagtacggttttgggaagataaatggttggggaatgcctgtttaagagaataatatccttctctctataatgctgttaggcataaacatgtaactatttcagaaattttacagaccagtcctctaagcttttcttggcgcagggaccttactagctctaagttagtggcgtggaatcaccttgtctcacgcatcgctatattatattatctcacgaccaagatgagtttaaatggaatctaaccactgatggcagattctcagttaaatctctttatcttgcgttggtgcagaccgatgttcccaatataaacaaaagaatctagaagatcaaagctccccctaaagattaatatcttcttatggtacttacgccgtggagtagtcttaacaaaagataatctgattaaaaggaattggagaggaaacaagtcttgttctttctacctcaaagatgaaactattaatcatttgttctttgattgtcgttttgccagcgcggtttagtctttaatccagattgcttcgaatattagtttacctaatagtacaactcatatgtttgggcattggataagaagacaaccacgcattttgagaactttggtcttattagaggcaactaccactatttgatcaatttggctttacagaaataatgtggtttttgaaaggaaaagcatatcttctcctttgcaggttatctttttgactacacattggctctgctcataggctatcctccagaagatcaatttgcggggtactatcattgcggcttgtcaacaattggagctagtgaccatggagttttctaccccggcacatgggtggcgctctaggctacggttagagagctcctgaagttctttttgttcatgctattttggatgatgagtttatcttttgtttctttcttgttggctgtgtgcactctttgggtgtagaagccagaggtgctctcagaataattgtatcacttgatgaaatttactaagattaataaagcttccattatctaaaaactattgaagaaacaattggcctcctctcaaacactatatttgaccatttaaatatgtgatgttgttaactttttaatatgatatttgatctttcatgttattttaaaattttgtgcaagtacagaaaaatataagtatgcttaaacaaaagtacttattgtgaaccttattgagaaggttaaaatatttatgaccgggaagaatacattatactgatcttatccacattgcatatgagtacgtgatcccttccctaatcaaggcgtcacacactcccaacaaacaccccaacagtaagtgtgtggaacatatataggccccccacaagatcgttgtgcaagtgcagctaatgatcatctccttctaagtgagagagaagctaagaaacctctctaaaaagagatggatgatgaatcacacacaatcacccccaataatcacctgatctgctgatcctactatgtgggagccaagtgtcccactgcaacagcagagtgtgattagatcaaaccagatgcactagctacatggatgcatatgtgtttgtgtgtttgtggatcttggccatgatggtaggctaagctagacctgtaccctgcactcatgtttcccctgacttcactgccaagagagactagcaacacacaggggatccctacactgcctttctttctttgcttccaccctaaacaagcctctgctatgtatgctaccttctcttggtctctaccaaccagcattactgtctcaaccaatggcagttccttcagtcactaactaattgtcatcctggttacaagattagtgtgaatctgaaacctaataattgaacttgtatgttttgttgtaaatggatattggatagcatgccttggttttagtgacagcatgtgtgtacttgcaagaaatgagttggttttggtccttggaaaagatcatcgatgatagaagataaatgtcttattggagtaattattattagttcaccgagctacaaatgggaattgattcttaatgttgagctgaaaattggagagaccaataaaccccaatggagggaagtggacactgacaaatatgctatggtgatttatagtcagtgaaaatcttattcaattgattcttacgaatgattgaggaattcaacaggaaactccagatgaattcagtaggaaacaattttattaccatggaaatcatccaattcctacattggtaatgcatgacctgattcactattaaggttgattaaaagctgttgatgtaactcgtctaacaactagatttaacggttcataaccgaaaaacggttgcttttctagaacatgttgattgcatcaaaccagtcaagattcttttcagtggacagcatcatatgctttactaccaaactaccaactcaaaattgacataatagaatgtacatgtttctgtactaatcactcgagataaaattaaggaccatgaattaaaagcaactctaattttgtgtgtactacatcacaggttgcactacttctaatggtccatgatttggctaaagcatcaattctacctgttttttcccattgtcatgtaggtaggtgcagcactggaaacacaaacatgtattgaaaactaaagaccaaagggcagcaaaattcagcatctaggccaaatttctttgtaaattccagatttagaagttgggaaaaaaaagtgaaaatccatatatcatcaatcttttgccacaacactaacatttttatggttaaatttcattgaatttgttaacatgtagatccctcaaaagttctttaaaaaaaaactctgcaagatcaaaccgggcaacagtcaagtacacctgaagggtaacaatactctgcaagatccaatcagaagcagccacatttcctaggttggcactactctacaactcccatgcaaactctacctatctctgtaccttcacgcatcttcagtcccaagcaaccccaatttttcctctcttttttttcttcttctttttggtaatgcatgccatggccattaccattctgctgctactgctcctctccttccatggtggtcgcccacatggcatagagctcacaagctcgatcagctaatggccatcactacctccaactaactaaccaccttttctctccactgcacagcaacttcatcagtcccatatctatcaaggctatcaccatgagtgtgcaaaatattcatccggccatgcctcccctacaaatacaatccctgtccttgtcgtggccgtcgacatcgccggagtcggagcgaaagaaagaacagtgctggcactaggccactagctaagtagctagctagctagctagtagcagtggtagctgaagaggaggagctagttgatcagctgagctgagctagaggtagaagaagaagatggacaccattgaggagtgcagtgtggacgatggacgccggctgatgctgctggggtcgaggatactggtcggcgtgcccaacaactcccggggatgctccgagctgctctcgtgggcgatccgcgtcgtcgcgaggcccaacgattcggttgtcgccgtccatgttcttggtacgcacttgaattaatctttctttcctgtgtttgactgtgtgtttgtgatttgagttgttcttctcctttctttttgtttgcattgattgattgtttgattgttaattgcttgattggtttgttggttatggttgtggtgattgatgttgtgggttgtggcaggagggagggggaggaagaacaggctgcagaaggcgaacgcgtttgtgatctacagctcggggagtttgtggagacttgtgaggctaaacaggtgagatttgattgaaatcaaagcgaatgcagtttggtttggatttattgagttgtatgcactgaccagttcaacccaaaagcctacactgataaggaaagacagacaattcactttatattctaacaggattgtgttctcttttttatttgttcatgcataggcggtcagtttctggtgaattattttttggtgcattggctatgcaaagatggtactagtgttctgttctttcttttctcggtttatattaatcttgaatacttttctttctgttggcatttcaaaaagaaaatcttttcttcttcttttatgttgatcttggattccttttctttttggcgaacacattgcagtgggaacttgaaagcaaagtctgtgatcattagtgttagtttggtgcccctctctgtcaggtttgtcatgtctcttgtcagctgttagtgttaggtgaagttgtgactacagtctagtacaggtcatgattagcactgtgctctgagtctatctcttctctctctctctgattttgttttttgaaaaacaatctagtttcaattttctctgtctctgatttttcttcatgtagttgtcaagtcttatcagttggaattttgggaagatgtactatcatttgaacttgtaggattacttttgagtgaagctgaaactaagggttacagttatactgaatactgaatttttggtcgtactaattatctgaatccctatcattttggtttaccttttatttatgctgtcaggtaaatttggaggccaaggtggtttgcagcccaagcatttggagagcacttacccaggaagctacattgactgatgcaaacttcctcattgttgggagatcaggaaatgcatatcgtaggtaatctcaggaagctgcttctttgttcagaaaatgaacttggattttcttttagttgatactctcattaacgtaatcatgtattatctagttagtattcatctcaaacgtaattatggatattctttatcttgatagaagtactgtacaaaatatttatccccactgttaattaggcctaaagcactaaatgctacaattgtcatcataacaggaatcattttgaggttgcaaactactgctacatgaatgctccaagaaactgttcagtgattgcagttggaagggatggtctaccacagagcgccgctcgattcaagtctcgatcatttgatggtaaaaatgatcatttttttctaactttcatcactagcaagtttcatttacaatgtactaattctgaacctgaaattacagacagtagtatcttctcaagctcaacatggagcaggagatttccaccacttcagaagctactcagatcaaactcagcgcgaaaaccggcacaatcaacgggtgaagccacagaggacaagagctcaccaagggcagttcttgatggtccagaggcaggggagcaacatgtcactgaagaatgctacagcacaacatctagcaatgaggtgagccggcgtggtcaaaatggcatctggaggaggctatctgacatgaagctctggcttccattcctgcggtccatcgacgatgaaaacgtgaaaggaggtgataattcttcgaattatactgaagatcagaagcctgcctggaggtgtttcagctaccaggagatttcagttgctaccaatgacttccatccaggtaaatatttccatcacttaactatgcatttttaattttagtcacctcgaaaatttctatttcagacatgaattctgttaaaaaaaaggttgtgtttggttttataaaagttagtctgaatttgagaaaaatacaaatgcagaagcaagtttagtactaagatttgcaattcatttgatggtttttcatagataacatggctgggagaggaggctatgcagaagtatacaagggtatcctatctgatggacaatgtgtagctgtgaagagattggcacaaggtaagccaactgaacagaaggaaaaagagttcctgacagaattgggaatccagggacatgtctgccacccaaacacagcataccttcttggctgctgtgttgagaatggactctatttagtattcgagttctgcgaaaacgggacacttgcatcggcactgcacggtattgaatttgatacagtagtaattttcaagtatgcgttgaaatttttgttggtaaacatgtaacagtaggagatgaacttttgcagggaagagtgccaaaatccttgagtggcctttgaggtacaagattgcggtaggtgtcgcgaggggcttgcagtatctgcacatgttctgtaggcaccggatcatccatcgcgacatcaaagcctccaatgtgctacttggtgatgattttgagcctcaggtagccccccattttcatgctgaaaaaatggttttggccatgcgctttgcacaacaatggaatcaaattggatcaaacatgttaagatttaataagaactgtggcatctgtaacagatatcagacttcggactggcaaagtggcttcccaagcagtggactcatcactctgtcatacctatagagggcacatttgggtgagcacagtgctaatgtctgaagacgtactataaaaaatacaaaaacatgtgtcaattaagtactatgaagataaaattgcattatgtcaactgaatctttcccttaaatgaattcaatgatttgagcaggtatttagcaccagagtacttcatgcatggcattgtcgatgagaagaccgacattttcgcattcggagttttgctgctagagattgtcactggaaggaggcctattgactgctccaagctgagccttcttcagtgggtgagtactgagtaccactgcaacaatgcaagtagtgtaacaattactagcacctaacaaagcatatatagaactcattttcttctactgctccaggcaaagccacttcttgaagctggacaagtgactgaacttgcagacccgaatctcggcggcgattatgacaaggatcagctgaagaggatggtcgcagtcgcgtcacgctgcattatgcgaccggcgatgtggcggccctccatggctgaggtagaacagttcatcaatccagtggttgagcagatcaaactattacaacttctgaaacaaaaatgttacctatgagcatatgacaaaatgttccccctactgtgcattgtcaaatttcaggtgctgcatttcctgtcaactgatgagtgcctgaaggagccggagaagtggaacattccggaagacgaggtcgacgacatggatgattgcactatgttttctgaatctttgtctccatgaagacaggctctgatattatttggtctttggcatggctgttcttcatggtgatgtcaagtgctaccttttatgtttcttctcttggttttggaatgttaggtgcttggtatgtaatcatgcaatttagggagaagattttgaagatatggttcgaatttatctttttatggatgaacataaaaagatcacattttcctgtaaattattcatgagaaaatttggtgctgttgagccaagcatatatcatgtgcactaataaacagctcatttgtaagtatgtctccaaacaggcgctgacaagtagatccacttttcgccaaaatattcatgcacattttaggaggaatgaataattttgtatgtagtaaaatcgtacagcaaaaaataaataaatggtgacaatcttcagaaccatacacacgtaggactgaaatagtttcatcgtaaaggatgtaatgtgagaccattataaccaggtcagaaacaacatgaatgtgtacaaattatggaataaatggtaaatgtgtcacattatgcccagggttgtctctgggcatagctaaaaacagaatgaacattctgtaaattggagaatgggatttatgcaggcaaagttgtgcaagaactgcaaatacacaggtttgaagttgcatccgaaaagagtgctgctccacatcagagatatacatatttcacttcagcaataccgacttatctataaatcctccaaaaaacatttttgaattggaaatataaataaatcaggaaaaatcctataaatgttataaccatggttctacgtcctctactatgtggcatcaaaccataaataaacaagggtcaaatttatatgaattctggcacttcaaaacaatcagataactaaaaagagagagaaaattattcttttatattttattgcaattggaacgaagtggagcattccaccagagaaccgaataactgaatattcccaacaaggattcctgataaggaaaacattccaccggcccaaaacagataactcctgcatgcgtcatgccatcaccacccaaaaacctaaacaaaccaccatgatcaggcaccaccctcaatgctcaaaacccattgattaaaagaaagctgcagtcatcatgctattattaataagaaatgacataggatttgttatcttagcaatgataattgcaccatgaaaactacaggtgaacaactatatacaagctacctttgcaatacattaatccgctataattcgatgaaggagatgaggatctaccattggaaagtagaacgggatcgccgaattctgccatgaatgttgactgcaactatgacactttttttttttagataatgggaatttataaaaccacaataactatgacgcataacataattctgcaactacgacttgtaagatagcatcaataattcatcatttcattagcaaacagtataaaatgaccgcagaaactaaattgacctctaattcattcatggaaatggaattttacccaatgaaaacctacatcatcagttaaaaacgactacggatcatcaccgtcgaatttggattgcgagttatgtgatgacacacaattgtttgtgctagtacaactcataagagaaaaatcacattggattttttttattatttcagcactgaaccatagaaattaactacatgagttatcttacaaaagtcacaatgcattaataataatccccctaattttaaccgatggaatttggaattccacccaccgaaaacccgcatcagcagttaaaaatagtgatgcgggtttccaccacggaatcagaaagcgacggcgaagaagacgacgacatgaacaccatgcgccaccattagcatgacggcgagattatgacatgttgcccttttcttaatgtttgtcttaagacgggcaaacgccattgccgttgccgcgttggcgcccattgggagaggggtttctggaactttctagaaggttggcacgacgccgtaggccgcggtggcagcggtggtgctgtccatgtagaaccctacgccgtcggcgcggccgtcgtcggagaaggagagccagaacttggcctccttcgtggcggcggcgccggcgccgccggcgccgctgactccggcggcggccgtgctgtcgtcgtccgatgacgaggaggcggcggcggtggtggcgcgcttgacgaagcggcccttgatcctcggccgcgcctcggcgtaggccttgcgtgaggcgtagcggatggtcttctggaacttgcggttcttgcgcttctcccggtagcgcctcaccctctcctccctcgccgccgccgccgcggcgaccgcgccggccgccgaggtcgggacgacgacggagtcggccggtgaccacggcgtcaacgcggcgagctggcctgggtgcaagccccagcgncggcgcggcggcgccgtcgaacgacgacgcgaggccgccgccgccgcaggacatgatgtcgacgtcggagagcaggtcaaagaggctcctttcggcgccgccgcngccgccgccgccggcgctgtcgttggtgaagctcgacgagctgtcgttggggctcccctgcccctgcccctgcaccgccgcccccgccgccgcggcggcagcccatgacgaggcggcgtcgtcgtcgggcgcgaacaggtggtcgtacaccccggagctcgccgccgccatggcgaccgcgagcggcacgcggtcgtggcgcgacgccagcgggttggccgcgtgcaccgcggcgtcgcacggcacgcagagcgccgccgcgtccgccgcgcagtacaccgtcgccgcgccgccgcacaccccgcacgccgcgccgccgcagctggccgggctcgcgctgccgtcgcttgccatcatctcctcaacaagatcttgcttgcttagttagcttggctaattaatggcttaatcttaagctaattttaagcttgagcttgagatcaagtggcttaagctaagctaaattgtgtgtgtttgtgagtgggagtgagggtgctgagctgtataaatagggggaagaagagacgccaagagaggttaaggggaaggtggagttggtgaagtgcctaagaggacacgtggagcgctaatggccaagagaaacttggcatgagagagaggaggccaagtgtgatttcaggagaaaatggtaggtgtactatggtaggtacccttgtttctcggcctaaccaaactgtgcatatgtctcgttgtctcgatattacgcgatacaagtagattctgtaacaggacgattaagattatttcggtcctgtaccatatcacatcgatttttctctaatcgggacgcttttgactttttagtttcaaataaaattcatgtaaatattgtaactaatcttgcaaaatgtgtaaatatatgttgtctttatggttcgattaagatactttaaatataattggcatgtataaaaactaacaaaatcataggtgaggtaaataggatacttactaagatcgatgaaaattaatatgaactcaagaggattgttcaccattttttttctagaaataaccattgtaggagtatcttgtatcttggttgctaagtaggttggaaggaagcatagaacaacatgtgattttttttaaaaaaaagggatttatgcagcaaccaattacaaaggaaaataatgtgttaaccagacttggcattcaggactgtttgtataaggagtttgcctgatggacccataactacaaatctaccaattagtaacttactattattttcagctctatagtttacttttacaattatccataatataagtttatatgaagaaaatcaaaatagaacatcattaagtaattttcaaccaggctacgtagagaatagcccgcacatcaacctcttacctatcactcagtcatcgctacatctatgtgaaaatcacttggctacgccgagaacagcgcatccaccgctgtcctacgtcacaatcaccccgttaactgtgtgcaattcctagtggacctacgatttttccactaatcaaaaccgggtgattaagcttaagtgatcaaaggtggagagatgagggtagagagagctgtcacactttggtctgtgccgacgtagggcccacaccacaccagagagcgcaggaaatgatccctggcagatgacgtggcgtgtgcaatcatccaggatgttatattgtggtggggcccaccggaatttcaacgcgcatatataatactgcgctccgattggttgcagcatgcttggcttggcttggtcgtcttgatcaatcagctgttgacggtggggaaaactcggtttgattttcaattttgtttaatttggctatctctttgcgaaagggcctatagcctggtgattacaagagcctcagtagcacctgaggtcctgggttcgactccccttgggagcgaattttccaggatttaacggcgttgtgcttttagtggtaggcgacgtacccgtcgacagcgaagcgcctgtagtgacttcatcaatctctccaggatttgtcggcccagttttcaaagatgctcttataggggtagggtttgcgtgcatgtgttcacaggggtgagtgcacgtgcattgtgagtgtctgcgtgcgtacatgtgttcacaggggtgagtgcgcgtgcgttgtgagtgtctgcgtcataattctcaaaaaaatttggctatctctttctatctgcactgtttaatcctgccgtacaagctagaaaaacttgaaatctggtttctatctgcactgtttaatcctgccgtacaagtggtggtggtgatggtgtagtaataactcttttccttcccaagggaaaaagaaattggttttgtggttaggggaaaatggattttcttctaagaataatttagataagtactactgcaaattaaagacgtattgaagctcatgaaccctctagaacgtatgaatttggcataattaatttgtacatgaagtagatgacacccgcgcggaaaattgtatatatggataaaaatcaactatatttgattaagggcatgttcactttgatgaaaaaaaaaattactaaaatttggtattgctaaaattttggcaacttaccaaaaatttggcaagattttttatatagggcttgtttggtttggagccaatttttgccctaccaaaatcttgatagtaccaaaacattggcaaattttggcactaccaaatttggtagtattcaatttgaactatggtgggtaaaatttggtagcaaaccaaacatccacttgctactattgaagttgccaaaattttggtagggtagtaaattggtatcaaaccaaataagcccatagttaccaaaacttggcagcaaactaaatatagccacttttttgacaactttactaaaatttggtaaggttgaaaaagacattaaagtgaacagggcctaaatagctagagtatgatagccaagaataaacagaaactgtaccggttatcactattggtgttgagttttttttttggtgatgtggccttatacatgggttaataatttatttataggagtaaattcttaatgtgttgtaactaggattagttcaattcctactggaaattggaagattgcttttgagtgttgtataagaggcacggatctttattttgagatatactcaagcttactgactcctttggacctaccgaatttttgcagggtttcagtataaataatagttcaattccagcatttagatgaatccacatgttctaaatgaggctcaaggctccatttggaatgcataaatgagatttgtaagaaataatttagttttgtaggaatatatacaaataaggacagcttgaatggagcctaattattataatttaatcgccaatctcttgcaacggattctctcttaaagtgaaatcgaaaatagtggtggagccaacggcgccatcgagtctaagcaactaatagtgttttctagtggccaatcaatattttcatatgttgatggctatctacaatggagatgccagcgtagggctcagaatggcacccgaccaacccgctgtgtctgattgaaaaagatataacaaaacaatatggcataagaccacttgttattgtccacgatacatgaaagaatctctttttaacgtgccaaaaatactttatgggcatgataaacaattccataaaatccaaattactcattttgtcacaaaatataactgcagcgagtaatatatattatagcctaaatatgtacagtcaaaattctataatattgccactatatagtgcaagtcgttcatagattctatacagaactggagacaagatcacaagatttgccatgcatgataaaggcattgatgtcaaaacggattaacattgtaatatttggtaattttccttataagcataacgttagagaataccaaacctgtacattacaaactatgtcgatcgcttacaatgactactaagaaaacatagatactactaagtatctttcagtgaaaataaaataattaaggatatacttccacgagcgagcacatgttaattttttactctccctattgtagtataaattaattccccattaaccacgtacgttaacactggaggtaactaaaggtaccacttaacttttgccattatcatacatacaaacaaatcagctgcattaccatccggataaactttttttttacaccaaaacaaaccgagagcaattgttcttggtttggtccagctagctagctagtggacgacgactactacaaaaggtagtatgaaactttttcttcttgccaaaaaataaaacgaaagagagcaaaaaaaaaattactgctctactttagctaagcctgtagcttaatcatggcttagctagatcgcactgatctctgatctgatgttgctccacactgcactccatcattgcgtatattttttgcggccatcgttatctcctctctcctccatcgtgctgcgaaaaggcggccactcgaaagtcaacggggtcgcacgcgttgacattttcgtcgagcgcggaaacaaaagccggctcgagcgcacgcacgcacgcccgccccgcccgcctcctttcccgcttcgcgagcgcgcgacacgtgtccttctggaacattcggccagagatcattcatagtacagcaactgatagcggtaaaaattgatagaagtattatttgtagttaatctaataatctaaatttacaatagttttatataaatatatacaataccatatgcaactgatacacatacattattttaaagctcgtgctataggtctacaggtgactatatatatgtataccatttttcttatcttttacttcctccgtttctaaatatttgacgccgttaaattttttaaatatatttgaccattcgtcttattaaaaaattattaattctttttctatcatttaattcattgttaaatatacttatatgtatacatatggttttatatatttcacaaaagttttttaataaaacgaacggtcaaacatgtgctaaaaagtcaacggtgtaaaatatttagaaactaagggagtactatcttttttctttgcttgtagatggcttatagccttctaccccctatgtttcataatataagttatttgaaatttttttcttagtcaaacttttttaagttttaccaagtttatagaaaaaatataataatattttcaacacaaaacaaacatattatcaaatatattcaatgttagatttaatgaaacgaatttaatatttaggtgttgctaaatttttctatgaatttgatcaaacttaacataatttgactagaaaaaaagtcaaatgacttataatatgaaacaaagggaatagcattatactctctctatccttcactaagttaatctagtactacatatgatatatcttagtaatacgaatttgaataagagtctattcagattcataatattaggatgtgtcataatactagagtaatttattttgagaagaagtgaatacttggtagagcaaggataatagtaagttataaactaactacaaacttacgtggaggagagaggtaataa

SEQ ID NO: 80581 - DNA, 1758 bp, Oryza sativa
aatttagcaacatctattattatatatgttagctttaaaatagactaatacttcctctattttatattataagttgtttgattttttttcctagtaaaacttctttaagttaaccaaatttatagaaaaatatactattattttcaacacgaaacaaatatattatcaactatattcaatattgttaggtttaatgaaactaattttatattttagatgttgttaattttttctataaacttaatcaaacttaacaaagtttaacttaaaaaaatattgaacaacttataatatgaaacggaaggaatagctcacagtgaactctatactactccctccatttcacaatgtaagactttcaagcattacccatattcatatagatgttaataaatttagatagatatatattatatctatattcatattcatattcattaatatatatatatatataaatgtgggtaatgctagaaaatcttatattataaaacgtaagaagtactaaacttgctcttagagcaagtttaatagtatagcccactactagctctaattcacctatagccaaactaatagccaattcatacaatagttaattactatactattaatatatggtcccacatgtcatacacacattgcgttttggagtccacgctgcagctggctatagatctgtagcccgctgctcttctctttcattttttatctcattaaaatatgtttatagttggctaatagtctgttattgtacctgctcttagtgggctagtgggaatacgggggactaaagctaattaatcaataagctgcgggcgtcgctgcctcgccggtagctatagttggctccggcctaggggcctagctagtgccacgtcggactgcttgatgctgacgtgggcggcggttgcttgcgtgtacatacaattctttttatttactaagcatataaaaaaccggaggagtattatttttggttttctgttttctctgcgtacgctgcatctggtcgtgtttgtatctgctgttgttgttgtttggttaacagaacaaaccgtccacgagtggatttatttatttatttttgctctgtgtatttggttgactgaaaatgaccggtgttctttgcaaaccaatatataaatccatccgtgttagttaaggtgtaagtgctggattggtccagagatgcattttaataatcatggtgctataaacgagaaaatgtctcacgaagcatcttacgcatattgtcgatctatgtggttttctgatgtactagtataatagaatttaaattagtttagatcgtagcataatccagagctaactaagcggtttgcaactgttaatggattcacattgtttgattcgacggctcaaggctacccattgccgtcatcttcgtacggattcaaatcatcgactttaccctttaaatgcagtggaaaccaataataaaaatgagttttaagagggtggcttgtagtgattattataaccgttggaaatataagcacaatctatttgatgtaatttatattatgtaaagacatttaacatatggacatatcaaatatgcgaaacattttggctacgtgtattggcagtcagtggcggacccagcgttaaaatttagctatggcggactaacgtgccatatcgaacatcattgtaatttcaacaaataaactaaaatttgtttatacataaatcacactatatttacactcattaggtagaaaatatagcact

SEQ ID NO: 80582 - DNA, 7478 bp, Oryza sativa
ttttttttcgttgttgcttcctgttgtgccttttggttagagcattggacggtccgtccaatcaacagtatgcttaagaaaaagaatgcagtaatctagtgggtattttactagaggttgcacttatacgggttaatattttgttattagacaattcattcatttttagagacacaaggcaattatactatagcccttacatccaagtaatcaaacaaatagagtttcaaccaaaccaaatagtcaattaatcatctaaatggctaaatgttcagatgtgttacttagtttggctgtggcatagctacggcagctgccataccatgccacaagagagggtccgccaccgtcgacagtcctgacgaactggataagttgtgtgtaggtcgttcacatgtcgacaatcctgaagaacgggatacgtcgcacgtagaccgttcacacatatgtcacgcacgtgcaccattctaggggagtcaagcgaggtgcgaggcgagtgcatgtttttctctagttctctctaccacacatgtctaaattagctaaaagagatcactctctcttctcttttgagaatgtatctcttttagaataagtaaggtaataataaaggtgggtttctgtgattttttataaagttaattcttaacacatttattaatttcaacaataactcaagttaggtattttatggtattatagatctcttatttttcacgaataagcgatccgatggggccaatagacttgtagagtgacaatcaaatcctctccatatgcacatgcgcacgtgagattctcacgattagagtttacatatagtgattttcttttcaatgagatttttttcttttccataattgtaaggcgttgtgcctatgccaaggctaaaatatcacacacgttttttggttgcccaacaagattttcttccggaaccgtgtgcgttgaccttgaaattagctgctcgatcagtcacatcatcatcgatcgatctagtcctaaatttcactgtgcggctcacaaaaaagacgaacaaaaagatctcactagctttagctagcgtgtaatttaggcatgtgtggcagcagcaagtggaatgggtgacagtgtcaagtgggggggggggggggaggggtcttctttctttaaaaaagagatctcccacatgaaagcgggggattgatccttggactgcgataaatctcgccagaccgcaatatgatatatcttatgctctctttaggctgttcgaaatcatacaggagaccgttgatataaacaatttcttataacagtctatatttcgatcatcgatattatggtaaccgagtgggtaccaacttgaacaattcttgttattttttatttttataataaatagccgttttatcaagtagttcctaaatgtggagtgtctcggaaagatgataatgaactgagagactatccacgcatatataaaccttacttatacatacattctctacaatattttcttaaattttcgttgagggagagattaattactttgggatgaaactgtcacttaacttaaaaaggtctaacaacgtaaacagagaaaatgtaaagcaaatgatgtattcagtcaaagctaaaacctgttttaaaagttggatggttttcaagctttccttaaaacttaaggttctgaaataatttttttccccttgcagataagtgcgtgcaaatcaagctcaactcatcatcaacgggttaccttttccggcacggtcggctgctcatccaagcactagaaggtttcttcaattaggagtcgcccaggttttctgttcatttggacttatcatcttatcctcttttttttttcttctcatggttccagaaccttcaagccacgtagcctccaaacaaacaggacgactgctatctttcggcttgatgcacaatcacattctgagacactttccattgtcttctagtagcacttggtagaagctgctctcttgtgggccatcacaccaatagatattttttcttgagctagtgattcttgtcaagctggtgttccatccaattcaattgattattaattagctcatgactagtgtgcatttgggaaaagttgacagccagttgataaccaatcagttcaattcctggcatgctaatccttcccaagaaaattgactaatgcccgactagtgcagttgcaattataagcatcttaaaacacaaaaggcgatcgacagtgaaatgtaagataacaaaatacgtggagtacttatgggcggatccaacatgggcgctgggactcgagttctccctatcgtgttggatccccatgaagaaggtgaggagaaacggaaaagatgaggaagatgggggactgaaaaaaggatgaagaggatgagtacccccttcatataggatcgatcctgaatccactcccctatacttgtgaacatcacttgcagattatttatcggattagttacttcatgctatgaaaaatgtattttcttcttgaaaaagcattcttctactgcactgcaaaaactgttgtcttaagctatttattaaacttatttatgaaaatattaatttatctctataatcaagtagataatcaatagcaacaatctaattaataatccaaatcaaacatgtcttagtatgcatctgccaagtagtctagtgctaagttgcttgagtgaaggcttcttgttattcttgacatctcggcatgtcttagccggtctcggaaatgttcatggtgatctctcgagaaaattgtgagatgcaattttgtgaaggttttgggttatcttctggagtagagaagaactaccgctaaagggcgctcacagatttcatggccatgagaggaagtaaaactctcacttatagtgctccaaattagagtactagtggagattgcccaattttcgatatcttgggaaaaagtctcagcatcttgtttgcttttcctatctcaatctctttacctctcgcattttactttcatagattgaattagaattgagtaaaacttcaactcagttgcaaattttgggtcacaatggttgtcaaacataggaacttagggtagatataatcttctgttattgagttctaatttggccttgtacttagaaaatcctattcaccccgatcctatacacagatagattttttttcctacagatattttttccgcaactagtgattcttgtcaagccagtgttccatccaattcaattggttattaactcatgactagtgcgtttgcaaaagttgacagtcagttgataaccaatcaatccaattccctgcatgctaatccttccaaaaaaaattgactagtgtagttgcaagttgcaactacaagtatcttaaaacacaaaagatgatcgatggtgaaatgtagtgaaataagtggaatacttgtgaagaaacttgtgcagattatacagaaacacttctgatgtagtggagttatggctgtcctggtacctataattacataaacgcagaaacatttttcataggaattcagcctgatttacttaacgactttaatatcttttaaagttgttaaaatcgtgatcctaaatcgaaaggtataagtaagatcacaatcataaaatcgtgtacgtaaaaatcataaattctacctacatggtaaaatcatagaatcaaacaccttaattagaatcgtaaaattatataacagaatcgatatattttaacaaccttaatctccttcgtgcaattgaaaaaacaaatctccttctttgggcaaatgtgattactgactcaagtattatatggacacttggccttgcctatatctaacggaatcggaactgttcgccgcaaacgcgatgaattgtcggcacaacacgtgtctgatgtttaaggggatattgtagcaaccgtgacatttctatggaacaggatgtcgccgtaaacaaattaattaattaatcctcctaattccatgtccaagttgttaaggctgtgtttagttcacaccaaaattgaaagtttagttgaaattagaacgatatgatgaaaaagttagaagtttacgtgtgtaggaaaattttgatatgataaaaaagttagaagtttaaagaaaaagtctataactaaacacggactaggcgacagtgactattcgcgacgacggttgaacagtcgttgcaagaaaaaacaaacggcctgccctggtcctggtgttcagcacaagttatcagatgacgtccctgctgacgtcaattcgcagctggctttgtgctgggccaggtctatctagctccttttgtttaccagcagcaaagtcgctacatcaattattactagacgctatattaattagtggtatgactaataagccgtcgaaaaataaacaaaacgataaaagtaattcgtagataaatattaatctgtatattattgttgttttaagagtcaatgctagaaaataagccacggtgagaaaaagaatcccaaaatcaaatgcaaatatcatgatgttttggacttatggtagtgttttcttaagagaaatatacatataatatcaaaggaagattttaaaaacatataactcaaaagtaaggttttaagatgtgcttatccaagagtagagacgtatcatactttactactttaccatccgtacccttgtgcttatgatgttattgagttattgtggtaactttctgcgaattatgatttcatagttgtattacatgtcatcagaattgctaccaattgaacagtgatcataaagatgtatagatgaggtcaagagtagatttaatttagttacagagggtcaagaatcaagatcacttctttcattcatttcaatataacattattaagaaatgactagtggataatgttcccaagcattcgtatcaccagagtaaaagaatatgtagaaaacgacatgaaactcggcgacaaggtggaaattaggcgtgttcaatcatcggaaaaaaatgtcacaatagaagggatttacgggtaaagccaccagtgaccaagagtcctgacagtttgctcgtcattttctacaaatctattcttgatctcaatatggaggtacatctaaagtcgtatccgaaaactttaacaagcactttacagataatcgatggtataaaacttctggagttaaaacaaagagaatgggggttctcacgcagacttgtgaggaaaagggagcagtgtccctgttctttaccatcaagcaatgatccatggaacagaggctcctaaattagctgcttttggatttcagtgcattactgagcctgcagcaagaatcaaaccaggcttttgtaagttaattccatcagatattcccatatgcattcatcagggaggaattgcagaataatgtgttgtaaaacagaactggaaaaaatgtaacatgggagttcagtctaatcatattcacaggaaaacaaaccgtccagtactcacgtcactacaagaaacaggatagtacaggattttaccagcataaacattttagccattatttcatttgttccgtagagaaaagaaaatttcatgtgacttaccagtccaaaccttcaaaaaggccctctccttttatggcagatgttttgaaaatcgcccattgacggctcttaatcttgtggagttctaatgattccgttatggcagcatcatcaagtgcacctggaagatcctgcattcattgtaggcatgacagcacatgagacatcatattgggcgtctacattgttgccatagaataaagcatctccaacttatttgtatagaaaatgcaagcaacaaagaatgacaattgacaaaaagacattcacatttgaaacctaatgtccaagtaacataatggaaaatcataataaataggctacgtttgtttggtacagagagcgatatattttattaaccaaaaaaaatgcttaaatagtgcaagttcagaacagctagaagtaacttttgtttaaggacttaagatgccatgggctgtcaaaatccaagtgaaccacatgcagaaaaatgtagcaccggagtacgtttgaaaccaatttaagcacacaaaattaacaacagtgtatgagacccagaatggtttggttttacctgtttattcgcatatacaaggacaactgcaccttttagctcatcctcctgccagttgaaggcaagcagccaataagcaaatgcacctaaatgaaatcaattcatgtgtactgctatagccttaaaatcattaggatattggatttatgtctacacaagcgtaacaccatgctaacgaaatgctgctaatatttctaaccataaaaagaatgaaaatagcaaactagatagggatcctggcctcctgtggtgcataaacactgttagtgttcatgaacaaacgagcatgagatattgatttatcaaatttataacagaccagttgttgggatcaaaattaaactgcaaaaggaggcatagcctgtgaatcacaaagcgcctgaaatcccctgacaagtaagcaatccgttaaatcctgacaaaaatacatggattttttattaccaattaatgattttaaagaatgagcaagcagcatgcttcactaaacttgcagtcataatcaccctttgagaaatatgtgcaaaatcccatttgtttcttccatgtaatggttacatatgacacagtaaatatatataccgagtccctcaagcacaggtggcccatacctcaaggatagcatgaaactcttcttttgccgttacaagcctatctgtatcacttgaatcgacaacataaatgatagcctgggtatttggaaagtagcatctccagtatggcctaaaaaggtgaatatgttaatggcgtagagaaacgtgtcatgcctagtctttaaaaggaaggaagtcaaataatctaagagaatccatgcctaacaaaggaaacatacttgaatacaaaagagtaacagaaaggaatcagaagtagcaagacataagtgaaggttgactataaagtttaaatattcttgtgaatcctgaactaaacacgtaagtataaggtaaacaattacaatttcatttcaatgaatggtcgcattacgctcatttggacacctatgtactccactgtgcagatctatatatgtttgttatgggaaaggtcaagtgctgtagtatatggaatatcataagcgatagtatttagaaagctgtcttagccccggggtaaatgtgtagcccccatttcttgtggtaagcatctatgtcccttctctatacatatccggctgaagaacaggatgaccaagtaaattttatatatatccagttgcctgcctctcaaacgcaaaaactccatggagaataattagatatttgaagcccaaggaaaaaaacaaactagccatatttacaccccataaaaggaattttacaaaaggttggattattttttac

SEQ ID NO: 80583 - DNA, 17496 bp, Oryza sativa
attcttgcagatttcaattaaatgacatggaaaatggaatgcaatgtgtagctccccagtgttccggtgattacaaggtattgctacagtaaatcgtacatgtaatgttacacgatggtggcaattaaaaaaatatgtttctttactaaccacaggagacaactagctttgaaatggtgcaatcaaacgctaagcaaatgaatccatatttcgaaaaccaggccacacttttccgagattggaatattagtcaaagctatatgagtttcggagatcgaaatactagtcaaagctatgtgagttccatagttatcaatgtgctataagctctaagctctaacggtttgggggtacagtagaatggctattgtttttaatacaaactttatttagcagtgataaaaaaatactcatggttttacttgcccaccatacaagactcttgttatttcgcaaatgaacatgctgactaaagtctgatttgagcacgttctcctcattgttttccactattttttttatttcttcatttctacttccgcaggaattctacatcattattgttgctgtgcaagaatccaagtgttagtgtattactgcatatgaacttccccttaggattgtgaaatgctagtgaaccaaatacttcttatactaaggcttggcgatcagtgccaaagcagatgagaggatagtattttaagaataaccacatcagccttcaaacataggaaaaaacaggtcactgaattgcttaagatgctcagaatggtcatttttgaactctttgcagacaagccatgaaagccattaggcaacaactcatttacttcaacaccacatagaataaacagaaccccattttgattcaattcaggaactcagcatacaagtaaaaaaggtcacgttatactaaaattccctcaaaacctaggacagaatcagaattgtaatggtcaaaccctagtcagctaggtctcaaccattggtccactcaatcataaattgtagtacccacaattggcctcatggatattgtcgtaaattgtacttataaattgtctcgcggaaaaatctaaaccagtcctcgtgaatcagagacttgggggcacactcaccgagatcccagacttggaacttgatgttgttgtactgcaccgtctccacgttgaacccaatcgctgcagcaacgcaacaacaacaagcacacacgtcaccaaacccgcggagcaaaccgaatggaagaaaaaaaatgagggaatcgggagcggggaacccacttgggatcgtggagacgacctcccccatctgcagccgatctgcgaggaaaaaaaaacacaagcacccagatcagatccgaggtggagacggcgagattacattcgatggagtcggggggcgaggtgggcttacataggatggtggtcttgccggcattgtcgaggccgaggacgaggatgcgggcctcgcggttgccgaagaccgacgagaagagccgcgtgaagacgatgcccatggcggcggcggcgcggaggtcacccccgcgcgcgcggcggaaggcggggggctgggctagggtttcggcggcggcggcggtggagatctgagacggggaggagaggaggggggagatctgggagtgagctggcgcgcgcgagtacccaagacgacgaagacgactcaccgaatggggaaggtggatggatggattttttgtttggaggggaaaaggggagaagcggtttggtttggtttggtggatttaggagagattccaattgcaaaggtttttaggtgggtttgtatggtttttctatttcctaagaaaaagattgcagctacaaaaggtttttatgtggggtttgtatggtttttttattgggattatctaaaactactgtaagatttttttatgaaaaactttcaaatctaactataatataattgtaatgtaattccactacaactatgtatataaatattaaaataatatatataactttatatctaacttatatagagattacagtacagtacattgtaactatattgtagttacactataactatactataactacatttgaaagttttttgcaaaaataacttgtgacggttttttaacaattccatcctctattttacctaagaaaaagacatggtttctctgggttggttttaagttcaggttagttgaagatcaaaatgtaaatggaaaattttaggatatggaataaatactccatccattgtagaatactagtaatcatgcatatactaggcacattttctttcatgctcactgaattgagaaacgttgcaaggacacgtttatactcgcttaattcaggtagtatatgccaagcaagttaaaacagaaatctggattttacaagtatatgtctttcaaatccaaattcaaatagtttctattcatcattgtataatattcaggttccgtttggcacagctctagctcctaactccaacttccctagagctggagttgtgccacacggtacaaattcttcatttttttagcggagtttgcagagttactccccaaaattgtactacggggtagaactgggtttttctacttcacagctccatttcgtccctaatgacccactaccctttaattttttcatgtatttatgcgatatgccactgaactaccccttcacaccccctctcctccctttctctctcatccacatcttcctcccttgacggcggcggcaggcgtcggtgggggcgggtggcgtggcgcatgagagcagcaaggccacaagcgatggcagcggcggcaagaggcgcgtgggtggcggcgcagggtcagcatcggcaaggcgacacgcgtgcggtggcacgtgggtggagcggcgactacggcaggacaatgccaacaagggacgtggtgacacaatctagccaaacactttcatacccacctcagctcatataggaaccagttctcactgaagttgaaggttagagttgagagttggagtttggaaccctaccaaacgaggcaagaggaattttgttacaataattgattcaccaaaaaaccatgctttttttgttggccaacaacatggtggggtacccagcaggtataagtaaaatggcatgtaattatgttgagattgagcagaggaacaatcagtgtacatagataaaatacaaactttagatgatttacaaatagtcaataaaaggaaaatgatagggaaatgtgcttcaacaatatggcatcctccatttgagtcatttgccttgactaatgtcatccttcaaacctgtggtcagtcgtatcgccatgctaattaggtttgcctcctattgaaaagaaggaaaactatagtacatgcctaacaactcaaaggggcaaatacgtcttttttactttatagttaacggtcaacacacaatcaataggcggagtcaatagacgggagtggcatgagagggtgcacaaatttggaccgatggcatgtaggggaagaaccgattttcactggcatataaaggatcagacaattcttagtggcatataagggattatctctacatgttaatatccaaccatatcccaaaacctccatctatttgttggtcatgccttaccatcaaggcactatactgttagctgaatttatcagctttgaactttttgcgtttattagccaatttcaaatttctttttttctttttctaatgacatttcgtatattcgtcagtctgatattcaatgctacttgatttgcgatgcatgtatgcagcagttagtaatgtcctgatgaagctcgacgcctattcaagaaacctaatgttaatttccatgttcctgtgcggcaactgcaatggactaaacatgataaagcggtacacctacagatcggaccttgcttacttgccattaaaccacatccatccatcgtgaatgtatccaattgattctggccgttttccagagacttattttgctcctgctaaaagaaaatggtttaagtgaacatcgggtgaccaatgtatgagtatttttttggttgtaatgttcagttcaaccattattttctagtttttttctcaaacatacaggaggagagctgtgtattttctttatagtaaagagagaagagaataaaactcttctcatgttttgatttttgttgtgtaggccatacagatgatcaaatctagcatgtgcatctttaatggagtgcttgtgcagatattttacttgtcgaaattgatcctattgtactaacttttgacctcattgtcgaaattgatcctatttactaacttttgacctcatgtgaccagaatgaccgttgacaaaatgtcatctcacccaccatgcttatatagttatatttatggtttagccttatctgtagtcatcaaatattcaaatatatagtcagtatataaatagatgcatgccaagtaacatttggtctagtgctgtaatatgtgttattgaaataacaagtttatggccttctacggcatgttttccccgtcaagactgataatgtatttcatgttaaatcatatatgttgaactgcactatagtttaatactttgttttctatatcagtgcttaagctcacgattcctattgtcatacaaatgcagaaagcctcggagaaagatacagagacagcttcgaaaaaggaaactaagaaataagtctaaaggtgtcatgtgcattttaacggtttgccaacagtaattccattagcattagaacttgtattccttctcttttcctaatcttctacccaacaaattaaaatcaaacatacttatatttcaattaaaaagaggcactaaattagtttcattacatctaacattgaatatattttgatagttttttgtgttaaaaatattattatatttttctatgaatctagtcaaacgtaaagaagtttgacttaaaatcaatatgacttataatataaaatataccctctttgtccccacaaataaattaaaccttaggttgccaattggaattaaggaagaagataatgagccaaaatgtctctaattaatagaaaagttacattggtggtgaataggtagttgaggggtattgatggaataaaattttttgatttgcggaccgatggtagaaaagttacattggtggtgaataggtagttgaggggtattgatggaataaaattttttgatttgcggaccgatggtagataagaaggtaactgttgatttattttaggacaaattcaaattaagttgatttatttttggacggatggagtagtagtaattttgtagttattgattatgttggttttttaacgtagtttatcttacaacatttgcttttgaatcactaaggatatgtctataaaagttttacttataaattaattttaatcagtaataaacggttcggaaaatgaaggtaattttcggggatcattagtattttgacacatttgtaacccaaattaataagatctaaccctttttcactatcaaactaatatgttattttttttgtttcttaccatcaatattctattatatatgtaaaagttaaattatttaatggatatcacaaaaagctcaatacttaactatctaatgaataaaggaatttttttaattgtgtgctagttattgtctctcattgtagctcatcgtggtacttagtatggcttgccctaagtgacgcaccacaatccatttataagactatttttagagttgttctttttgccaaatggcatataatctaaccgatgcaaccaaatatcttcttgtgtgcataaaaaagatataacaaataacataattaggtatatggaattcctgagtcaacaaatagattgtttgaaagtgcatctagaccccctagctaaattttggctaattaatgacaaatgaataatgtaataatgtctttaatgagtgatacggaggcattaagtcctttgaagtggaaaagtgagccaaaacaacactcaaagcaaatgagttgaagcgaaagttaattgggcaaagtttggaagatagaagatcaatttgccccaaagttataatggattggacaatcatgtgcggtataggaaaattcgggtctaacatggaccggacaatctaggtggagtcggaaaaatctagtgaagatgatcacgagaaactaagtgaactagattgtttgggaactttcggataatcatggtcgaacagtccgatgcggtaccggactatctaacacgctctggacgtggctagatgattgttcatcagatgttgaagaagcagtggagtagacaatatggtactataccggagtgtttgggagaagcaatgttgaacaatcctacagctatcggatcgtccacctctttatggcccaatggcttgtagttcaatgaatgttggaaaagcataaagtgttggacaatctggatcctatacaaattttggcagactctatcaacggtaataaacaactagttgaaggagttggggctataaatgggtggtgctatggactcatttagagacttttggacccctcttcacccttagaaagccaaacaagtgtccaaacggctaggagtcaacctcgagacaccgatttgttcgtggtgtgctgagggagtatgtgaaggtcagatctcacctctaaaagggaagagatacccttagtggaaggagtgtatttgtgcaatctcacaaggatagggttggaaaagacccgacggagagtagaatcccctcaaggatttgaactttaggaacacattatctcataagaatcccgatgatatctctctcactcatctagttttgctatttggtgttgctaatagtttagttgctatttgtgcaattctttccctaattatgccgaacccctttttgcttgacttgctagtttgcttgtaaatatgagtttttctaaaatatccaaaaatattttagaaatatctgaaaatactaggaagtatccaaaacgttcagcttccgcattttcttaaaagttttagatgcctgttcaccccctctgtaacatcaaggtcgtttcctcaggacacaaaactagagtattctcttcgagccagcatcaatttcagactacgacaattttcttgctaaccatttgcaatattccctactaagaaaaatattccccatcaccttcactggtcactgtttctatcacaagaaaaagaacaagaaaagaaaaaaaaacacaagaatatactactaaaacaagtctagggaggtccaacaaccaagtccaaaccgatcaaacatccgacgaaaaaacacacgaaaatccaaaattaacaatagaaaaaatcctcctccttaaacccccttaaaccctagctcccgccgctccgcacagtaagctcacttctcctcctcctcccccatccatggcggccgcccgcgccaccctcccgctcccgcgtgtccccgccccctcgccgaggccccagctcaggcccttcccctccctccccgctcgccgcggcgcggtggcatgcggcgccggctcggcggcggcgggggtcgcggcgtcgctgcggctcggggacgtgatcgaggcgcagcagttcgaccgggacgcgctgacggagatcttcgaggtggcgcgggagatggaggccctggagcgcgggtcctcctcccgcggcgccgggaggagccgcgtcctcgaggggtacctcatggccacgctcttctatgagccgtccacgcgcacgcgcctctccttcgaggccgccatgcggcggctcggcggggaggtgctcaccaccgagaacgcccgcgagttctcctccgccgccaagggcgagaccctggaaggtgagttcctgggttcagtgcgttgagtgatgtagtgactgaacctttggttggagcggcaaatttcgaagtattgggatgaaattggagtggttttgtgagttgtcgatagtgaacaggtgaggaaatgctcattctgtgccttctgggtacatgttggttttgcattgtcggaattggtagatcttgatttgtctctcgttgtgcaaatggccgcgaaacggagttgaaaattatgggagagtttgaaatggttttggatcaactgtggtatggagtgatgtggattagtcaagtttatttggagcggagtgggatgacatggagtgtcaactagaaatttggtattgtttggaacagttttagtcttgtcgtattataggatgtcatggaaacaaatgctaggaataactagttgtacagtgaactctttggatagtttcggcgtgctcgatgacatttcagttggatatttttgcttgaatctgcgagatagaaaatttcaagggtagttcttgactttcattgtggagcgaacatgagttttctgtcatttgcgctaagggcatcaaagaatggtgagatatctaggataggttgattcatgggatgttggtgttcatcacatttttttttgttttagaatcacggtggtatcttcaatgccttggagttgtgatgtcgaatgccaaaagaaattatcttgaaatgtgttgttgggattaatgatactagttcaagtaccagggcgctggtattgctgccagttggctactatgtttgtatagttgcatcagtagttattccttcgaggaagatagggaggatctaaggacatcagtttgcatcatttgtggtaaaccacgaatagtacaaatataaaaggtttacccataaattatttttgttgtcctaaatgttttgattgtgatgttgggtggcatacttgcatttaggacctatatattcaattaatatgttatattagtattgtgtgggaatataaattcccggaataatctcactatttaatctggatctgacagttgactggtgcttacctcacaaaacagatctaaaactaacattttcaagtaaaaataaatccctctgaatcaaaatatataagtttcttttagccttctcaacatttttaaaatgttactgtagaattacaaggaacttttgtttctttttctttgtatgtttcccttgctaaatgaatgtactcgtgaacaaatattcattctctcctatgtgggtataaatgaaggaccgcaaatcatttgtctattttgtttatttttatgcatgtctgatatgacttattttttggaccagaggatgtaggttgttaaccatgtgtatccatgctgcagataccataaggactgttgagggttattctgatattattgttctgagacattttgaaagtggggctgcaaggagagcagccgccactgcagacattccagttattaatgcaggcgatgggccagggcaacatccaactcaggtaattgttctgcccctgactccttttgaactctcttgtttttaccaataaacagtgtcatcatgcttggattcctggaaaaggacagttttaggcaggtgattgctgttttcttaaggagctaaaaatgcattttaacgaatgatgttctgaccagactctggatggatcattcaatagaaattgcagttttgttgccaatgtacggtgttgatcagaatcacatattaccggctgataaaatagactgtatagtgatgtggatgcagatttcattttattattaagctttctctggagcatttatagttaattcatgacactgaatactccatagtaacaacacctgtaaaattatcagtgctcctcttggggatatacaacatttttgttgtattgctagtgaataggatgaaatgaatgggtgtcagtgaatcagtgtttctagctagtctggtattcctttaggcaagtaagaatgttgcagctttataaacacattttcagcttaatacttgtggcagctttataggtttgtccactgtatctctttatctctgccatcatgttgataactaaaatcagtttggaatctagtttctgttcttacatcctgaatcctgatgcagtatgatttatgtactattttatttgtaattgataattttgttcttttgttcaggctttattggatgtctattcaatagagagagaaattggcacactagatggaataaaacttggtttggttggagaccttgctaatggaagaactgttcgttctctagcctatttgattgccaaataccaaaacattaagatatactttgtatctccagatgttgtaaaaatgaaggtattactcgtcctatcaaatgttaactgcattccgctcttttgatgtctgttatggcccagatagaacagattggatgatgatttttttcttctgtcccataggatgacatcaaggaatacttaacttctcaaggtgttgagtgggaagaaagttcagatttgttggaggtggcatcaaaatgcgatgttatttatcaaacacgcattcaaaaagaaagattcggtgagaggatagatctttatgaagcagctcgtggtaagtacattgtggacaagaaggtcttagatgtgctgccaaaacatgctgttatcatgcatccccttccaaggcttgatgaggttagcaattatccttttaaataaaatcatctaacagtattcatttatcagtgttttacattcaatagtgtcccagatgagatattattggttatatttagcattagtaaaattgttttatattgccaaaaaaaggcaggatatagtttctgttacatttgcatatcataatatccaatatgagctttcaagtttcaaagccttaatagtaaatatgtctgtgaatggatgcaccaaagtgatatgtttttactagttacttagtagttgctgtgtcccaaatgatatggcttggtgcaggcagatgctgagcaccgcttttcatttagtatgtaagcgtgctgtttcagtcagctatgtgaaaagtcaattgtgaacttgggaaatgggaactccttaccaaaagtgtgtctagaataggtgagagttaacccaagtcaactgtcagctatgagaaaagtcatcaatgaaataacagaggatgtatttatctagaatagatgagaattgcccagggcatagcttgatgccttgatgaaacaattgttgtcatttacacatctgggaactagcactagcagtcagcatgctttcctaggccttatggcggcccaagatctaatcacattcaaaattttctgttttgcagatcacaatagatgttgacagtgatccgagagctgcatattttagacaggccaaaaacggcctctacatcagaatggcgttgctcaaacttctgcttgttggtcgctgacagctttcttagtgcgtggcgctgtggtgttgatgggggtcaaaaaatgtttgtcttaatcaatggctccaaatcaactgattagtattgtactaggcaccataagttagatccttgcaaggatttaaccatgtctagaactctagatgcataattttcgatgtaacaaaatattctgaaacagagatttgttgctctcatatgttcttgtgaatcattatcaccgaggactgcactaattttcctacagtgttgttgcaaggactgcagtgatttaccgagtagctctttctgccctcttttgttgaccaaggacaaagaactcaatgtaactggctggctatcagtaccagacgagctctggtattttccccatatcctgttttaaccctaggcgctgacacgttgattgtttttctcttgtcatgtgtaggtatatgatctattgatctatatgattggcacttgccaaggaatagcatggttgtcacctttcagagtatgacagattcctgactgaagcataatcccattggcatcgctttctgcaattccaagtttccatatcatgactgcaggtgaaaatgactatcatgacttccaggggtgacacattcagggtttgtgatgtatactggtaaattgtcatgagagagaggtgatggtgagcccacaccagcaatctcaaatggttggccagacagaagaaggtttcaaagcccttcatgtcagcaatatgacacaatgcataaccggccggctcacacatttcatgccttgggaccccggtacggcttcaagatgttgacctagaacctgctgcattctaaagcctctgagaagtgaattagttagcttgattaattggcttgaattcagcatcactctcactctcatgatgtgtagtgttggcatctccgaatcaaaaccatggtaatttgcagtcaattagggtccacagacagtgactggtccgatacatgacagtggaaatatacatggctgattggcaacattccctgaccatcttgttctaattagattaacattgtgtttaggctcaagagaagcttctttctcagtcatgagttgcgtcagagtttcatgattgtaacaccagggaatattgtcgcagaggccatgcatgaaagtgactattgtgaggatataaagtcctttttcttcttccagtgaaagccaccttgcatttttatctgagctcatcagtcctatctgatctttgacagaatggtgccaagattacatcatctcttggacctggtatatatattttttaccatacctttttatttatcccttgctacaaatttcttacaacaaactccttacagtttggttttaggtgtcactgatcaaagaacacaaaggctagacaatccctatttatattattattattattacctccctaattaacatccttatcaaacctcttcacaattttcagatgtcataaactgttgcataatcctggaagatggagctggtttcaggggtgaaatcccagcaagtcacaggtgactgctttccctgatcatagctccaccagtccacatccccctgcggcggcgcgccgccgtcgacgatcgcgccgccgccggcgtagagaagctcctggagctcggcctcgatggcgacgacgacgttggagttctcgccgccgctcgacggcgacgcctgctgcatggcggcggcgccggcgccgctctccagctgctgcccatcgaggcggtggtggtcgctcacagagcttgacattccatgttcagccacagtgacattgttgtgattctgatcatcaatggtggccttgcttggccactgatgagagagcaaggggttgtggtggatggacagtgggttctgcagctcctgcagctgcatgcagagctggatcctctccatcgccgacgcgctcagcgaccgctctccgccgccgccgccgccgtcgttcatgccgccgtcaccaccggccggaagatcgtcggcggtgctctggctgcggtggtggtggccgccgccgcggtccttgcgccggccaaggagtctcttcttcagctttgtgttccagtagttcttgacatcgttgtccgtcctccctggcagctgtgctgctatgattgaccacctgtggttaattatgtcaagtttagtgtgattatgatgattgattgatagttagtgagaagggagagtggttagtggtgtaattatgtacctgctccctatgctaatgtagaggctgcagatgatgctgtcctcctctggggtgaagtccccatgctttatgtttggcctcaggtaattcagccaccttagcctgcagctcttgccacacctcttcagccctgcaacattacacacataaactaaattaactacacatgaacacacaaaaccagaagatacatttgaaaacatttctagaaagaaaaacagtcacatgaaaagcttgatgatgagcacaatttgcacagatgacaatcttagcatgtctgaaaatttataatctcttctgaaactatcagtgataagtaaaaatggtaataattgctaccaatcttgtgaggcagtgcaatccagttgccaccggtgccatgctcctcaatgtagttcttgagcattgcatcctcctcaggtgaccatggccccttcttcactgttgccttgtcacagcaaggtgccctccccatctctctcagtctctctcagaacctcttatctctttctgcttcttctctctgaatgtagtagtatcaccttagcttgaagctgctatggatgtgtgtatggaatgtgatgagatgagttgtgatgggtttggtcatggtgctgggatttataggagcagatgaagagtgcattaaaatagtacggatatggtttgacctttgattgctgatgctgctgaaagagcatgacacacataccggctcttgttctggtctattggtactttggagatgcatgcatggcctttttgtttctgcattgcatgaatgcatgcagaaaggtgcatggaatgatttgttgtgctttttgctaaacttctgtgtcatccatgcatatatatgtcctcttttttgttctctgggacatggatttctgtctcctaactgttctctgcaaaataatcattgttttgggttatctttgttatagataatctacattaactaattagtttgatttaaagattataatttttggtgctattacacagcttaatttcgggaaattgtgaattttatggcaaagtggttgattatagcaaaattagttatttcgacggtaagtacggtgtaatttgcctcaaattcaatggatgtggtcttggtcctttcctgtacaaacaagtctatgagtacatgaaacagtagtgtcccagtctgttaggggtaaaatcaccaaccttactcctgtagcgttgtcgaagtacaattgaatcgtcttgttttcttgagtttttaagttgaactggttgatgcatgcgactcaataaatctaaacggtggatgcgagaaaatgcattcaaaatggcactatatatttagagctacatgtgggtttaggagagattaggagtgcacagatcacgaagaacagtaagtactctgaactctgcgtaggtttatgggtatcgcagaaagatgaacttatgctctcaagtcaagaactctagcttcaggcaggtcatgtggcagatgaagctagtgttaccacctgtacattgcaaaccaactgccatgaacatagttaaattcagttaggatttagagcctagatggttagaagaaatgaagcctttactgaatcattgaaacgtgccaaaggataagcatggaatgcagtcttcttgtttccttcttgtctccatgcatcccttaggatcacaccgcattgagataagcaacattgattgatcttgatattctattaattttttaattataataatgtagtagtaataatagtatggaatataatgtgaagctgctggaagcctgaaattagtgtaactccaactctgaattttggcatcataaacagggcaatagtggaactagaagaattactatcagactttcagttagggtttctcgtaataagcagtaaacaggccatcacatccaaatggattcccatttctgaaatcaaatagtttgtgctattttaaagtatgatagttattcaaaaactgttttttgtgatattagcaagaacctcttgcagctttcacaatgaactgtgcacatgaagtatcataccaagtactgcaataaagctgaatacgccaaaaaaaaaaatcggcatacgaaaaaattcctccttttctcaaagaaatagagagaacaaacgtcaccaataatgtagttaccagtactttgacaacaagtgtactctacaatgcagcgtacatatagatcaagattcacagcatgggtatgcatgaccagtccaagtcctgcattttcagttattgctgtacccttctctcaagtcaagaactctaactcaaggctgggccatgatagaaaaaaaaaatgttcatagctagatggaataccaaaccatgctgtttgtaagtaactctctttgtagggacccctattgctggctaggctgacctgccaaaagtccatgggcagttacaactgacaatgcagcagcatcctccaatggtgtcatcatttttgaccctcaagactggttcctacaagttcagttattctatacttaagagcaaatgttaagttccttcttttgtcttgtcatttcttttgtgtgcaatcatggttaatatgatattggaggtaatatgatactgcctctattcgtaaatacatgtcgccactcatattaaaacaaaattataaacactttttttattttttagataatggcattttttactcggcctctacatcctatcggatatacaaaatcatttaaattgagaatttagctccacaaacaatccaatctgaaattcactcctatggagatttgaactcggacatttgggtgctattctagtcactgcaaccactaggctacatgccctttcgctattagctatttaaaaaattgaaatgagaccatattattgaacttgccacatcttaatataaacactaagatattgtttattgtaggctaaccatttaaaaattattagccgtcaaagttcaaacagtgctagtcaacggtgacatgtatttttttttcgggaatacgaaaaaggattgcgcacttttgtattaagaggaataaatttacacaaaaggcaaaacaaagaaaagaaggggggtttgggaagaaaaggaggaaaaagtggaaaacaaggacttaagcctattctcgcaattacaatgtgatgaccaaacgacctagcacgctaagaaggaagcgttggcgacaggcaatgggcaagataccaaagggcggcctcttgcgccatgcctacgatcacctcggaccagggtcgagaacagttgttgaatacgcggttgtcccgttccttccaaatggaccacgcgccaagggtcacgatagtgtcgaatccacgacgatgctccctcccaactttgagccggcaggggtgacatgtatttgagaacggagaaacattgggcttgccttatgttctgtggttgtgtgtactctttttatcagcatatccagatatcatacaatgcacgccgtgttgaacagtgctgtatgcgcattgtgcaatgaggatcaagtaggtcttttgtttggagcatggacctttgtgttttcatattactagattattgactcttttcttgtttatgttctccctttttgttagagagtaaagtgacactgcattttggggtggttggttttagattgattgctattgaattgtgatcagccgcaatttggataaaaatatggtactaatgagacccatcttgtgtagttttgtgataatataagatgaacattatggtaaaaagaggtagtttgatatgcattgaagaacaacaccagaaattgcgattcttttcttgatttttttgttggaactcacaaaagccttgcgtgtcattccattggacataggaaaaaagaagtatttatattctagaaaagaaa

SEQ ID NO: 80584 - DNA, 18223 bp, Oryza sativa
cctttggtatcctaaggggaatagtaccgtatgtgtaccatttttgtggtaccggttttccagcactggctgccttgttaatatggagtatgtacatttgttcagtatacagtcctgtcagaatcctcctttggtcagagagaagcaggtctgggcattacagagggaagaggtacacttttgactaactgtatgaagttgttgcagcttcaatatccatggtgatgtatagtagagtagtgtgtatcatgctcacactaccagaagctaccaatgaagatatctgtagatcacaatgccattaggtgtgtctagcttagtattctactatcattatcacaccagaagaaatcttaatcgttgatttatgagttctactataagttgaaaaaaatattctacactgtagtggtggtataaatagatatgatccgttggattagaaaaaaaaaacattctagattggttctactactaatagagagcaatgtagaacaccttgtctagttatgtactacattgtttactttgatcaggaatgaatgcatgcatccatcttggtggtgttagttgttgtttcagaagagatatggttttatccaagatgctgccctaaaagaagtggcattagtaaggaagacaagccctaaaaaaggagcaaagctaagacagagaaaaggggtgactttgaatgatatatgcaattagaaatccatgtcttgggcaaaagagattgcatggccaacttgccactttgtcaagcacaaaagaacacttaagtaagtagcagggcatgaagcatcacaactctatcagtaggatccaagcagaagcaggttaaaccatctgacaccatggagtagactcacctaaacaacttacaaaaataaggtcattagaccttcacaagtctaatgattaatcaaattaagtaatgtgagcctgcctgttgcttaatattttacagggataaggttgagttgaccacattattcaaggatcccaggagaagtaagataagcttatagtggtgttgttggcagatcaagtaagtaaacttgaaaagctgattagtatctcagtgcaattaacttcttttttgtcctaggaagaatattttgcatatgttattatttttgtaccttttgactagtgtttgctacttcttttctttaatgatggatgacaaaaaaaggctgaacaaaaaatgtttattatgcacttgcacccgtggatagaccatgacataatcctggatttcttgtgtctgagtttcttaactaattaggtgctactgctgggagaaaagtttagtaccattgtacatagctttgacagctgttctacacatctcgtgccatttggtaagaataaagaatttgcatgatagaatttgagtattatatacacaaaatgtttggaactttgattttgtcttcaaagttgaactcaacattaataaatgataaaagaaagagtaaatttcacaaaactacatatacttggtcaaattatcacaaaactacagatttaagaatgcgtatcacaagactacaaatttagcgtcaaacttttcacggaattacagatttaatataccatatacaaaactacagatttagtaatgaagttatcaaagaactacatattctagagtttagatcatagcactattaattacttaaagttataaagtctgtagttttatgataaaatagttttaaatgtgtagttttgtgataaaatagttgttaaatctatattttttgatataaatccttaaatatgtagttccgtgataaatttgacactaaatctgtagtgctgtgaaacacattcttaaatctgtagttttgtgataatttgatcaaagtatgcatagttttgtaaaatttactcaaaaagaaaggatagagacgctttaattgttaccatttcttttatataagcccgtctgctctttattgtgagcagtgaaccgaatatacatacttataattgcatgacgcgaaaaacgacacatgttgattactagcaaaaacttgataggaacatgtagtacacaagcaagctttatattgattaatatggtctaatgcactaacattttcatgttgattactataaagaacttgagtcaatttcataaaactacatatacttcggttaaattatcagaaaactatagatttaatatgatgtatcacaaaacaacagatttaacactaattttattatagaactatagatttatggtaaaatatcgcaaaactacagatttagtaacaaagttatcacaaaactatagatttaatatcaatttaatcttggacttttgtaacttaaacataacactagtgcaaaaaaaattaaaccgtaaaatctatagttttgtgataattttatcaataaatatgttgttttgttatacttagtcttaaacctatagttttgtgataaatttattgctaaatatgtagttctatgatatatgaatatatagttttacgataatttggttaaagtatttgtagttttgtgaaatttactcaaagaactttatataaacatcactgtgttcttcaccctattttccgaactcacctcgctcgtttttcgtgcgcatgcttttcaaaccgctaaacagtatattttttagaaaaaaattctatataatagttgcttaaaaaaatcatattaatctatttttcaaaaataattttattaatacttagttaatcatgtgctaatgaactcatctaacgaacatagcctacaagcaaactttatatttattactatggtctactgcactaacattttttacaaagaagagtatgaagtaacatgctcacaaacaatgctactgggaatcgatcatctcacggttaaaggcttcagatgagctagagttcaatgatgttttcaactatacacagttaatatgattacacggtaaatacactacaattacactgtaaatacactataattacaccttaattatattgtaattacattctagtgatgtctattaaaaactttttcaagtgatttattgtatatttttgcttttaatcatgttcattagttttgttttgatcctatggctgaaaaatcgtgtgagacgtaaggaaaaatctgtcaaatgatatctaggtagtttctataaaaataattccaatattctctccacatgttatatggaaatatttagtttatttgtttcaccccagtatctcatgaagtaaacacgcattatgctagaataaggcgatatgttaggacgacacatgctaaatatatatagcgagaggtgatcacaggctggcttctcttctcgtcattccactttttcctatcagtcacgcatttagttgatattctttcccacgattcttctcgttctgattaactgggcgctgttttgtgtgaaggaaatactacatgaaaactatgtgagaacatcatgcaaaaggaaggaaaggagtgatctaatctccgtttatactggtattaatccggtgcgacggttgattggtaactacggtagttacattttttttaataaaaagtaaattgtgccgaaggcataacgccttggccggtgagtgtactgagcacaacaacctaaatttcagcatacaggtacagcaacttagttctgggagtattgactttctgaccacattggcaggccatgggcctccaaccagtttaggaaaaaaaaaccttaataatccttagttacttcctttttgtgacaattactcatcttttatatatcgtatatataatccagtctttgcttcaacatgacgtacttcctccgtttcataatgtaagtcattctagcattttccacattcacattgatgttaatgaatctagaaagatatatatatctaaattcattaacatcaatataaatgtgggaaatgctagaataacttacattgtgaaacggaggaagtatatagaatcatttattacaaaataaagtccttagcttaaaaccaagcacataaaatatctaagcaaaaacgtttggaactttgattttgtcttcaaactttagtgaaatcaatattagcttaaaaccaagtatggaaaatatctaagcaaaattgtttggaactttgattttgtcttcaaactttagtgaaatcaatattaacaaataactaaagaaacaataaaggcattcctgtgggagaggattatctattcgttagagactccattttcccattgaggacgaacctcaacctgtgctcgagagatagctctccatacactgataagggatgtatggattctcgagaagagaggagccgtactcctgtggaagaggattacctattcgttagttgaagcgccatcacgttgctgtttctttcttcaatcattttagaagagctagctcagtgactcctgcttgtttccaagtttgcattgtttttcatgaatgcatcataagcttacacatcccacgttgctgtttctttcttcaattattttagaagagctagctcagtgactcctgtttgtttccaaatttgcattgtttttctttgaatgcatcataagcttacacagcccaaaattttaggtccttatcgagcctatagaacccaaaaggctaatttgataggtgagaactatccccaccctattaagtcgtgcttccctattatcaatgattgatgtgggactaatcccaacagctaatcacgaaaaattttacttcaatggaacaattttacttttggatagtaatagataagcacagactcacaatttttacagtctagtactaatgcactagattgtagtatttgtttcttcatgagtccttccaaattgcaggcctgtaattttctgaaggaaattaagggtatctacacgcattcttggtcaaagctgccacatgtgattttttttttggtcacattcgtggtccacgtcaacaacagccgggtgaaacagccagttgttgttactgggcgcactctgcacaagagaagactctgtttaggaaggcgaatgaaaggtaaagtttagaataataatgacctatttgctcggacaatgtggcaactgtcaaaaactgccactcctgggacatggattgatcacggtgatacaaaatgtgtgtttcatgatatccagagaggttgagtaagtcatcacctgcattccactcggcaagagtacttgagaagatcatgatggtcctcttatctgtccgaaattcaaagcgcatatcatgttcagttcgaactattcgataaaaggtctatatttccagaaaccccccttttttttttgttttctgaaaaagaacaccgcatatggcttcttcagagagtggagggtttgacagttctcttttgggaaatcatggataccctccacttgcttttttaccaaacctgaagcttggaagtgacattctgattgctggacccatccacttgtgtttatgtgaccctgttgacacttttgcatgattagaaagtgaattagagcattgaatcaacaaagtgaagatttagaagttccattttttagacagataagtcaggaagttgctatccagaagacattttggaagtccgcatgatatccgccaggcatttagaccccagcaatgaagtcatttgatggattgtactatgaaacatgcttactaatatagtacttcctccatccaatattaagttcatttctaactccttccatttgtcccaaaataagttcatttttggagtaatcattgcataagagtttgtgaaagtaaggaatagttgtattggaagaagataaagtgagaaatagttgcattgggattttataaagtaggggtattatagtttttttagttttgtattggtatatttgggattgttgaaaaaaaataaacttattttgggatggaggtagtatttggttttagctccaaaggagcagccattgaaacccatgcagttttagtgaaaagagccttctatactaatagatattgaatgaattatttaaaatggatattgaagtgaaaaacatcatgcatcgttgatgcattaagcagataagttccaactcaccggtaagtggggcacttgcacaaatgccttgtaatcttgatctcacggtcattcccttgcttggagaaggtcgagcgcaacccaagcaagctcaggaagccatttgatttcaccaatggcttatttgtaagcacatcagtttcagtctatcacattcgaacaatgttcatgcgatagaaaggttatagacacagtaaacatttgtcaagcttaatcatgaaagtacactgaatactattgtacccctacaacaagccagcatggctttttttcccaagaatctgtgagaatgtagcaacatggcttgggagtacaacttcctacaggaataaaaatggccttgatcagggtaattgtaacaaagcagatggacagagcataaaagcaaatgaggggattgtggtgtcaccttgtgaccggtgccagcaggcttcgcgctgttcaccagcactctagcaacccatctgtaaatgagttcagagacttcagaacaaaccaacagaacacccactgcaagacctttccatcatagaattagacaacgtcacatcacattcgtgtcaaacactaagctgttatcaagcaaaatcaacactgatctagtaggcatttttttattgattttgcagggattcgaacctggcacaaggcacagctcgaacaccattttattcaatcagatattgcttagcaacagaatttatttatttttataatcaaatactgcattcggtgaataacaatacttttctcttttcttcagtatggaaaaagacaaactagtgctgacccaacaatacccataattgaaatcaatgaaacgctcttgattgagatacataccttggtcaagaatttattcttcatacaactaatttagagaaggccaatgatgtctgcataactgtaggcattttcaaacagccctggatttcacaaaggagtggtacttctcagggagacccttcatatgttgattgtacttcccacttgaaaccagcaaaatcagtaactcagcagtggaagcttcaagggagaagtcatttttatcaattttggacagataaacaccagccctgcctatctcccctttctgaagtaactttctgacgatgcaattaagcatacgggagttaggaacacagccattcttctccattgaaagaaatagattatcagactcttcgagcaagccatcttctatgagattttcaatcattaaggtataggtcacaacatccggtgctaaaccatttgccgagagagcagcaaacaaatcctttgattcatcctttctgccacttctaagcaaggaaccaatcattatattgaaagttctagtctcaagctttacatccatcaaacatagattctgaaacatctgaagtgcctcaccagtgagattatttttgcaaagtccttgaaggactatgttgcatgtgctaatttcaagctgtattccccttttgataatcctgacatagatttctttagcagcacgagtttgtccagtctgaaataaaccttgaagaactatgttatacgtgataatattaggactaacaccattgcacaccatctgcctgaaaagagataatgcattctccatcctactaattttacagtagccattaatcaaagtgctataagtaacagtatcaggtttcaacccaactgagaccatgtcagaaagtaacttcattgcttcatccatcttacctgccaagcaatatccatcgatgagtgtactgtatgtaatgacatcaaccttcacatcaatgttagaatttcaatggttactctcattgagaagaggatggcactcgagatggggcaattttctggttttcttcattcactaaacacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaaggcaccacaagaccaagaccaaccagccaagacttattcctacattctccccctaagtcttgtgcgccgtcttgtgggagagttgagccatcccgatccgggagcaaagctcaaggaacttgatcctcccaaggggtttggtgagcaaatccgcaagctggtccttggtgttgatgtagctcgccttgatgctcccttcctccaagtagcttcggatgaaatggtacctcactcggatgtgcttgctccgttcgtgaaaaacggggtttttttgccagggccagagcggacttgctatccaccctgagctccaccgctccagtatctctgccgaggagatcactaagcagtcgagcaagccagagcgcctgggtcgaagcggcggatgctgccatgtactcggcctcgcagctggacagggccaccacctgctgcttgattgactgccagctaacgaggcactcgccgaggaaaaagagaatcccgctcgtgctcttgctggtgtcgatgtcgccggcgtggtcgctgtcgctgtacccgacgaagtgtgccttgccaggacacctcgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgtcggtactgtgtagcatccacctcctccgctgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagctgccgtgaattcgccgccgttgtcggtgcgcagcatgcgcagcttgcggccgcactccgcctctgcagcagcctgcgcatgcctgatggcgtccgcagcctctcccttgctgccgaggaccatcacccacatgtagcgggagaggtcgtcgacgagcagcaggaaataacgtcgtcctcctggtgtggccggtgtcactgggccacacaagtccccgtgcacgagcccgagccgctccttggctcggaagctcgtctgctggggaaaggggagccgccgctgctttgtcaccacgcagacgtcgcagagctgctccacgtggtcaaggcacggcatgcctcgcaccatctccttggcactgagctgcttcagggcctcgaagtggaggtgcccgaagcgctcgtgccactgccacgcctcgtcgtcccgacgagcggcgaggcaaactggatgtgcgacctgcgcgctgaggatgtagagtcgattagtgcctctggttaccttggcaagaaggcgacgacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcacagagggagacgagtaccttcggctcatcaaggtggaggaaagccgctgcggccggtgccgctggaggtagctcgatgcttgcgtgagctaggagcagagccggctcttcctcctccacccgtgcgacgtgggcctggccgcgtcgtggctgtcgacagtctttggcccaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttatggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcacgatcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgccgagaccgagcgtcggacatggcgcacctccggggggctgctgtgtggagagggggaagggaaaggggaaggaggggcaaccggtgctgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcactaaacacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaaggcaccacaagaccaagaccaaccagccaagacttattcctacaatcaatacgtcccatcaggccaaagagtttttcagattctataaacctcccttctttgcaaagattatcaattattgaattaaaggaaattgtgtccggacagattcctctgttaatcatttcagagattaactcctcagccttctcccatttgtcactggtacagagaccatgaatcagtgtgttgaaaataacgatgttaggggttacaccttcactaatcatctgctccaaattaagcattgcatcatctactctgcctgacttacaaagtccatctatcaatgttccgtaggtcactacatccggagttaatctttgctgcctcattttgctgaatacaaacatggccacatctacattttgatgcttagtgcatgcacatattagtatgctaaagacatgacgatcaggttggataccatttcgtaccatcaaatccaagagatcacgcatctcaacaagagctcctttcgtagcataaccatgaagcaaggtactgtatgtaataacattaggctttaggcccctcttgatcatagaatcaagaatctttctagcttctatgcatcttccgttcttgcagagatagtccattagagatgtataagtaacagcatctggttcaacaccatcgctgcacatcttttccaaaattccaatagcttctttcgactgtccagaagagcaatatccatgcacaatactattatatgtgatgcaatcgggcatgactccattcttaaccatcctattaagtacatccatggccttatccatagcttgagccttgcacaaggcagcgacaatagtgttgtaagtcacaacatctggtaaaatccctcgctccagcatttcatggtatgtactgtaagctttgtccgaatccccctctttgaacaagccatcgatgatggtgctgtacgacaccacatcaggagggcagtctcctccatcatccgccatcatgtgcagcagctcgagagcttcttggcttctgctctcatgacagagtcccttgagaagaatgttgtaggagaagacatgcggcgcgcagccaagctctgtcattctgcggagcactatgttcattgcgttgctcgtcctcttctcggcacagaggctcttgagcagaggagtaaagatgatgggttccactctatatcccttcttaataacattgcccaatcccgcgaaaccgaggtccaaacggcccgcgcggcagcagcagccgatgaggatgccataggtgtgcaaggtgggagtcaccgcgccgtcgctggatcgtgccatgcggttgaagccggacacggcggccgcggggctgtcgcgcgcgacggcggcgagggcgcggttcaagctgcggatgatcgaggcgcccccgcccccgcccctgccttgccggagcaattcgtcgaacacgtggagtgcgtcctcggcgccacccccgctggcgcctgctgctccggtctttggtccgggtcgcgcaccctcggagcgagggccgccgccgacggatcgtgctcgggcggggacgcggcgtgccatgcgtgcgccgacggagctcgcagcaacctccgggtagcgccgcgccgcgccgcgcctgagcaactaactgacccgagggaaggaaaccggaggcaaggaaagggaggagctaagcagcacgcgaagaatggcgtccggatcttgtgttggcggtggcggcggcgagccggcgacggcgacggcgtgaggggacgacgggcgcaccgggataattggctgagagactgatgatgcgcggagagaccgtcagagtagagtaaaagacgcgaagagatcagcagtttattaaatttgttattttgtctttttttcccccaaaattcccccctgcaaatttacattttttttgcctgttgttagtggtgcattgtatttcaattgcaactttttttaaaaaaaaactagttaaataaaatgcagataatgaaaaccccaagtatcaactattaagaagtaataaatcagcttagatggatctggggagatggatgtggtggctccggcggtgggtatggaagcgaggaggtggcattagggatgtggatgaggaggtaaggctgtcgaaaaagctcgaggcttgagagctgctcaagctcgactcgtcctagcttgattcgagctcggctcgagctcaagcttctaacgagactagatatacatattttttttgttgttattttataaattaggagattaaatatattatttgtatgtcttgtagtggcatcatatatttattttattctttttcctcttctattaatatgatgaaccataaattaattactttttaaagattatccttctaattaaaaatcaagatcggtagtcgagctcgagcttgatcgagctcaaacctagacagacgagcgagctcgttgacagccctatgaggaggagagcatctcgtcactgaagctccatgaggcgatcttcggaccttgggaggagattgcagcggtgcttggcatgggagcaagatggtccattggcggggctcggtatggggaggtcgggaggaggacgacctagcggtggcagcaaggaggagggaggaggcggtggggctcggcactcggcatgatggttcattgttaaatttaatgaaacttagtgttgtagatgttaataatttttttctataaacttaatcaaaactaaagaattttgagtaagaaaaaagtcaaacaacttataatataaaacttataatataaaatagagggtgtaccgtacagtagcggcagtgcgtagaggcatttgacagtgtaattcaggcatagcagggacgttttggtgatttgtctggctggaccatgcctgttagtgtgctatgtttacaatgttgatgctttctctgtgtttctacaactttacatgttttccattttatttttctattgggagtgcctagcgaacctgaatgttttttcacccatctcactcagatttttcagagtctggatggacgtcatgatgccaagtgaaaacggacttataatggttaattgttgttatgtatatgcatctcagtccatgggccgattgttagtgcagataaagagaagcccagccggctcttcattattattgtccgtaaaagcccaagatgcctaacaaaaagaaaaatattactaagacatctactaaaaagttattacatctagttacattaattataactagcatggtggcccacgtagattgcgcggctagtatcattatattttctcttatataatagcatacattatttctcaatgtattattcaaatatattaaaatgacaacataattttaaattttgtactaactttacgaaactactactccctccgttccaaaatataaggcacaaccactcttaacccaaagaccaagaaacaattattatcatctcctagtttggatcaccttaataaatataatgtatgcatccaatagaattagagatattgaggatagatgatttaaaaaagtaataatttaatggggaagtgctcctaattaattgtatgcatgcatgcaagccttatattatggaacatccaaaaaaattagttgtgccttatattatggaacaaagggagtaatgtgtaatatgcacattgtattttatatatgttttagttattaattatttttaatatcaaattttagttatttgtaaattatattactatatggactctagactcatctttcaatatacatagactctaggctcttcttcaaataatatttatttttaattctgaaactttattatttctaattgtatttctatgtgtactctaaactcatcttttaatattctttaatttttaattttaaatatcagttacttcgaaattgtattcctatattgattttagactcttcttcccatgtttttttaattttgaattttatttatttgtaaattttatttttatacggactctaaactctacttttaattttattatgtttattccgaattttagttagttttaaattcctatatggactctatactctacttctaatattcgttatttttaattctgaatttctattatttcttaattgtatttctatatggctctataaactacttctaatattccttatttttaattccgtctttctattatttcctaattatatttctatatggactctatactcttcttttaatattctttatcatatctagcaaatcgctttttggataattctgaatttcagctatttctaaattatatttctatgtggactctgtttttctttttctcctgttaatatgagaatttctaggccgtgagagcgaacgtggaggctcctttttctattcctttaataagttaatagattgtaattagatagtagtaacaatataattatagtgcaattatattatgatactgtaattttgcactttatctctgtaaccactaaccagtatttattttttttaggaaccactattcagcattagctgcttgctcggtgttaatgactttctagcgggaagcgtaggtcgtgtgatagactgatccatcactcgttttttactccctccatcctaaaatgtttgacgccg

SEQ ID NO: 80585 - DNA, 15579 bp, Oryza sativa
ttatgtatatagttttacacattcacaaaatttttcgaataagacgaatggtcaaacatgtttaaaaaagtcaacggcgtcaaacatttaggaaaggagggagtattttctcgcccgtacaaacactaatcttgacacaattacacggctagaaaattgaaaatctgtaaccaaaaatattttcctgcccatacaaacacgaatcttgacataatcctacggccaaaaaaatcgacaaataggtaacaaaaaaattgtcaaaagattaatacaagtcctgacgctcaattaaccatgagcacggctatttcaataggttggttttagtcacactgcagtggatgcacgcttttccggtagtctgtgatatgcccaacacatgagcctagtcccaatacacgagataaatcacgacctagtttttctggatcttgtggcattgcggcactcgcttcaaagactataaatccccatgcactccctagctccttcatcccgccgcgccagtcatgaggggagtcttggactccgatatatcaaaggaaatgaaagcaaacaatggttcattttactcgatatgtcattaacacactcactatcctttttctccattcacaacacatgaagttcagaaccggccatgactagggtgtcgtcccatcagaatcacctagtccactaggtctaggcctatatgagaaaagcggtcgtagttgttcgtttcctacatattttcttaactcggttcttacctagccagggtcggcgctaaccttttccaggaatcactcaatttaattcttgccaccctagccaaaaaatagttttgttcattaaatttggtttttcacaaacaatttaggtgtgcatcgcaagtggcatttcatgtctctacttgcagcaatgtaaccactcactacccgaagtgatcactcccatcccatccaataatcatataggatatgaatcatctatcaagcatgactaagaatttatcgataattgattagggacataaagtagtgtatagcatattagcatcaaggtatatggcaacaatatcaaaggatatacacacgcaacaatgtgggaatacaatttaacatagcatgcaattttagttgcaaacagaacatttgacgataggatcagcatgctcgaaggagcggaatatgatgacttgccttgcctagctacatgaaccttctcctcagcgtcaaattgtttttcgcacaaatgtaacctagacggcgaacagctaactcaaaatacggtccagtggctaattaataaggaattaaataccaataaaaatgagaaaaataacaagccaacgccaatagataaagagagtatctatgcatctttcgaaagatttttattatcatatcacacagatttttaatctttagattaaaatctaatagatacagtaaaagacaaaaagcaactaagaaacaccataatggacactaattgccatatcttcaagaaaaagaccaaatccaatataaatttcaaaacttacgtgcgaaggttccaaaattatactgtaacttataaaagttacaatataagtttataaattacactgtaacttacaagaaaatacactgcaaatttgagtgagaaatcaggtgaaagataagaaaaatatatttcgagtgagatatagcaaaatcgattgataaatcttgatttagatgaatttaggtaaaagcttcactagtggtgatggggttaaggtggactaggtcaatttgaccagtcaatggcccagagccatatatcggtgacatatatcattaaacatcttttgatcagagtttctaaataaccaggaaccatatgttatactaaggattaagggggtcattatcttaatatttcattagtgaataaggaaggattaaagaaaggtgggccctgcatgctagttagagtaaggtggtgcagaagggtggtggcggcgtaagagggctagcggggttgccggagctttaacacccgacggatgagcagcggtgggccttggggcaggtttacgcaggcagggttaaacctatcggtttagtcgatttaatcggtgcccaccgaaatggcgaaatttccgaaattgcaaaggtgaatattgaagctaaccaaatttttcgaattatgggattagctcaatcatctccatggtcgaacttgcccttaccctgatatgctaaaaatcatatatacaagatatatacacataaacaaaagatgatggtcacgcaccatttacttccttatattctcctcggttgcccctctcgcgttgctctaggaaagttcctgcatactcctattcaattttgttgtcaccatattttactccaatatcccaaaattcatcaaccttaggaagcaaaaacagtcaccatatgtagacagatacacaatgagagatgtgatgtcctcatgtgtatagaaactccaccgcttattatgttttgctgcagttgatttgttcgatctgtcttatagcatctatatatactactgtactcttgttcggttcgtttcacaacttcatttttggaagacagaacataagtacaacttgtgtgttgacgaaggatgaaaaaagtgcctctagtcatgcgattgttggagggcaagcatctggaccagcaccatgttttcatgacattgtaaagagaagaaatgcttgtgtatggaaattgaaaggatccggtttacatgacaagaatcgaggaagtctgacttgtaatggctccattccacaatccacatctgtcttgctgtaccatcaacttgtgcagcctcactttctcgcttatgcttatacttattagctaaaatttaaatttttaactttaaatttgaaattgatttgggttttttttatcaaagtttatttttaacctttaagtacatgtatagggaaaaaatatttttcgtttacaaataagccaaacagtggtgtccggaagtatggtgaaaatccgtattagggtattctgactgcaacgtggattcaatttgccaccatgaaacaatgcacccatgtgtatgaatgtaacaagaaaataatacggcctgctcagaagacctgtataggcccgaaaacggaagcaaattacaggcccgtaaacttactcgcatcagactgagaaaggccgtttgggttcgccggttttccaccgccgccaccgcctccccatctcgatccgaatcgccggcctcctcccgccggcgatctgcctggccggcattctcgcctgccgtctatctgctcggtctgtgccgccggagtcgatccgcgcggccgacctcctcgagtcgccgatccaagcggttgcccgctggcatcggtccacggcggcggccatccgcgcgcatcgttgtcttcaggccttggcgaagccaggttcatcagccatccttgtcatctcatcttctacccctttcggtttgcctcattcgcttcattgcacagtgcacccgaacaacatttttttttccttctgggataataaaataacaaggctgtattttttttttggtttccagtaattacatcggtaaaagatttactggtgaaagatagtactaatcatccaacctggctctaaatatatatatatttttaaaaaggattaaatggtaagatttgtgctgttctttaatgtcatattattattctgatgtgattttttcattactaaacaacaacaactggatagtgcaaaggtgcaaacgggagcaggttcaggggtctgagaaaccaaattgcaagtccagggggctaggttaaatattggcgtaaaaccaatatttactcttttaaaccatgggtaacacctccaaaatacaaaaatgaaatggataaaaattacaagaagagaagaaaataaactgtactgacaatattctggacttcagaaacaaacaaagtatgcttcagtaagtaacaacttctcaagcagacaaccaaatctagttacattcattgcttacccagattacttcgttgctcgaaattcattatcaggcatatgtatgagctgagaatgccttctttatagcattcaattccttgactacattatccatcttcattctttcccttggtgattccttgcagcatgctagaccaagtcgaaatataggataaacaactagttgtgtcatatcttgggtgtttccattgtaggttgcattagtgtccaatatttccaatagattgttaggataggctgtcttgacataatcgataagacttgccataccattgataaaattgtcagttggtcttcttccagtaaacatttccaacaacaacaccccatagctatatatgtccccatccatagagaccggagatcctgagccatattctgcaaacatatataaatcataaaaaagttttagtggatacatagtgagtatgggataaaaggtggatctcgcactacaattttcagtcaaatataacatcaatattacattttgtttttgcatcgctaggtcacattaaaatactatcgtatcattttgttaaactagtaaaatatatagaatggaaataattattgagatcctgacatagttgagttgaataatatccacttacctggtgcaacatatccaattgttcctttaattacaaatgagctgctttctttgcacggttcagcaatattgattatctttgctagaccaaagtccgtaacatgcgccaccatgtcatcgtctaaaagaatgttgcttggtttaatatcacagtgaactataggcggcacaatatgatggtgaagatattccaatgcctctgccacatcaagagcaatatgcagccttttcatcagatttagccttctgtagcttgtgctaattgctgccgtgcttgcatgcagccactcatctaaacttccattacaaatgaattctaggacaagcgccttgaactcatcaccattttggtctgatccactgcatatggtgatcaccttgacaagtttccgatgtcgaattctcctaagagcatcacactcagtcaagaaacttctactggctcctcgttggctaaggttaagaaccttgactgcaataggtactagattctgatcaataatcaaatttccaatgtaaacattgccaaagcttccagaaccaatcaaatttgccggtgagaatgactcggttgctgcttgtagttcggcataagatatcctctcattcgtctcataaagaaataggttttcattatcaatgatattcggtttcatccttgtcttaatgaagcagtatgcagtcatacaaaacaaagagaaaatcaaagttccaacaatgcaaaagattaagacatgtagtcgatgcactgaagcctggtctgaatctttagatgggcatgaagggaattgcaaatctggagggccgccacatagcattgtattacctgagagtgacactatagtgccattacaaaaaatccctgtatttggaacaggacctgacagtgcgttgaaggagaggtttagattagttagaagcgtgaaattcgctagaaattcaggtatgggacctgccaagttgttgttagagagatcaaggatttcaaggctcctcaaattgttcagattttctggtatttgtccctggagaagatttcctttgaaatttaggaaactcaattggacacagctgccaatagcttttgggatttcaccagatagcttattcattgagagatccattttgacaaggctgttcaagagcccaatctgtcttggaatagagccacttagagcattgttggagaggctgagaagtttggtaagggaaggtattgtaagtatttcttgtgggatttggcccatcaaggcgttaccggaaagatccaagtattgaagttttgtgagattgccaaggcttgatggaatgcttccatccagaaaattatttgacaaagtgagagagctcaactgtgaggcattgcctaatgattgtggaatctgcccagtgattctattatgtgatacatagatagaattgattcttgtaagccagccaatatcatgaggtaaagttcctgtgaagagattatatgacaggttgagagatgtaagtttaagcttccacaaatctgcaggtatggtcccaattaattggttgccacttaggtcaatccatgagagctctccgctcaggttggcaatgttattggcattgcaccaacaaggttgttctggccaacatctagcatttgcaagctgctacaattggtcaatgatgtaaaaaattccaaatcactaggccgtgtggcttggagcacattgtctcctaacgcaaagaacttcaggttaccatggatgccaatttccctaggaatcatgccgtgatatttgtttccacgaagttgcaaggattcgagagcagatgcgtttgagaaggtcggtggtattatgccctcaaaatggttagcaatagtgctaaaaatttttatcctgggaagcttaaaaccaatatcgagtggaagtgatcctgacagtctgttgaaaccaagatccaagaatctaatggaagaaatattgaagatcggtagaggaacatggccttccaactgattatctttgacattaaagtaaataagattagccattttaccaaaagattcagggatgttaccagtgaaacggttcccttcaagaacgaagtgtgtcaatgatgtgaggttacccatccagctcaaatctttgccatcaatgaagttcgtctctatgataaacttcacaagtgttgtgaggttggagaatgacttgggaacattaccagtaagattgttgtggccgacatcgaaaatggcaagctttgatgactgaccaagatcatcagggattgaacctgacaggtggttcgtgctcaagttcaatgtacgaagctttcgacaaccaccaaggctagctgggatatcaccatcgaggctgttggctgacagatcaaggacacggaggtgggtcaggttgccgagctgaggggagatggtgccgactaggccagcgccactcagacggagagtggttacgcgacctggatgccggcgattgttgcaggaaacaccagtccattggcagatgacaggtgctggcatgtttgtaccattgccagcggtgtcccaagatgacatcacctctcttgggtcatcccttatgagggatttgaatgacaagagtgctgagagatcatcaccattgatggtctgagaggtgactgtttgcaagaggagggcatgtgtgagaagagagagcatggtttccatggcagaggaaggaggttgagaggttgcaatatggtgataacacttgttaacaagagtatgtcagcatataaggtgtagaagaacgtaggatgactgcacttcattacatttagaagaaataaacaattacagagaagggaccaaaactccaaaaggtgaccccttcacaccaaaacccactcacacatctcacctggccggcgcacgaccacaatatcccttgtgaaacgacttttgtggtgatattgtttaatttcacatgttttgtaacttttgtcttgttgatcaattcatgcaatggttgtcaatggagatataaactacgtgattccctcttgttgcattggcaagccagaaatatttcagcactcctgagagccactatatttggaaggttctgttttttctgcaaaattagtgatgcaacttacatgttttcttatttagtatttatgacaccaacacacactaccaccacttttactggctgtgaaatggatccttaatatagtggctgtgaaatggagccttaatatctctctttcattcttatgcaaaggaaacgtatagtggctgccaaatgcagccttaatatatctcctttacgttaattcaacaaataatacagaaatgtttgtatttttcaaactgtaaaatatttgaagttaacaattcaaaatgaacttactgtagaggcttacattttcatgatgcttaggggttgtttttttaaaattatcaatccgtatatatttcaaatctttgtgatggctaattaagcagaattgaccctgcaaatgatgttttgaaataagtagataacattttactttgagaagtatggtctctatcaggaattagtatttgtgacaaagactatagcatgcaagaccaaacctcgaactgttcaagtgatgctgaaatctcgtacatgaaaactaacagtgtaaaaaaattagtcgtaaagagataagttgtgttgaattcactgttcacctggcacaatcaactcaatcagaaagtgacacattttgatagttctatgtaaaatagtttgcccacatgattttgcaaaacaatgggtatttaatattgagatagtcaattttgaagtttacagtttcatctgatttgttcaaaatatatgttgatgctttgatcatttacaatttcggtcttctgtttgagaagaccgaactttctttagaccataaggaccagaccgaactattggtccagaccgattgcccacccctagttaacaagtttactttcactaacatctgaacaaaagaatcagcagcctttctattcaccgatttcaaaaatactgaaaatgggaatatccaattcagttgtagatttggaggcaattttccaatgtcggcacaacatgaccaacatgtgaactttgtgattgcaccatgctattattttgtcttgcaaaacctcttttctaactgtccaaaagatggtccaatatcagatatgacatttgacctaacacctattctaaaccacagggctgtctccatagcagcctgcatcatttggaacaggaacacaaacaaactgttgcctgggagcagcagtttcatatgctattgtctagtgcgatgaagtcacgatgcttttcaaaattcgtgttgtaacattcgtgttgtaactttgcttcaaaaaaaaaaaattcgtgttgtaacatttgtcatttgtcatttccccagggaatccaaaggttagaccgcataactttcaggtgatattagggccctacaagttagtgctgtgccggccattggaatatgatacttgatgtaacgaaatgatcaattattgaggcctaacaatgttctttacattgatccacgaggagtgttgaagttgagaaagatgctgacaagatatcaaccagacccactcagcatcctcatcctctcaactgaacctggttctgctgcagtttgcagtgtatctacaacttttaagctgccacctgtttgttgttgttggataaaccccaaaacacttcattttaggagttttcattttcccttgatttcagcacttttcgccgtcggcgcagcgtgtttatagcagttcgtgtgcaacttctgtttgctattctaaattagaggtaaaaaaaatcaagaaagtgtgtggttttggctgcacaaccgtgttcgatttgtccaatttatccttcttgatatgtgctttgtttttccgtttccagtccattgtcagattcttggtgctcctactgcaaatctgttcatggcaaggcacaactccaacggctgtcagatccaaatccaagggctcacatgctctatggtactatagaaatacttaggttactgtaacatcagtattgtggctatgtatctaatacgttcatcagaaaaaaaaaactgaaaaagatggataaaacagcatggagtccttcccaattgcctctcaagcatattcgccaacaacgatcaacgtttatctttgggttcaaactagagatgttgctgagttgacgcattgaacattgacttgcttgttagtaatttggtagacttgttgactgcttgatctttgatatcctttgacctttgatatgcatgccatctgtactgtaactcaggagagtgagagaggggagaatcgtaagacatgacatatactccctccgtcctagaaaaaactcaacctcgtattacgatgcgacacattctagtacaacgaattaggacatactctatatctagattcgacatcctagtactatgttgtcttttttttggatggagggagtacttagtacattcagtacgtacttgattgaacttattggtaatactacaggcgattcaatcattgattacagaaaagccttcactagacataacctcgattaaaaggggaaaacgacagctgacatgttatcatcatgcaaatcatggtgcggctctcacgcggttgttgtttatggttggacccaagcaccgtaggaagagtgtgaaatgtactagcaaaaattaaaaaatgcaatagtattgtgtaatgatatgtatatttaatttgtgcacgatggtttctaatttgtcatcatcgcttctccaaaaaatatgctcctggtttttcccaagtgaactttaggtaggcacctcggtacatttctaattttagtgttactccgttaatgttttttatccatccaatgtaatatactattctttatgactcaacgtttattatcatggacatcttctcaacagtttattatcatgaacatcaccaccggcacatttgctatcggcattactttcatcttcggccaactattgtcaacaaagttatttgcttcatgagtctggacttcgtcaacgctaaaatccgactggatcaccaacatcattatcttcatcagcaaaaggaaactggagccatatccggctatgttttcctctttgtaaccttgtccgtcaacctatatacattagcaaaagatggcaagcgagccctccaaggacataagcacgatcagatcgtcagatcaatatacattcggcggatacaatcccttgaaataagtagggtattacctcttatctagagggtctgaacttgtctaaatccatgtcttccgcatccattcacttttagatctcgtacgctaccccttttattattgacggtttacataatcgatagcttacaaactgaattgaattattaaaattttggcaaataaactcctaatcaaaacaaaatgataatgaacctaatctgaaatgccagtacacaccatcgtaaagcgtccgagccttatcactgctcttttttcttcccacgtctggttgtaaccgattccccacataacattagacacatctatcatcaccaaactttgaacataaaattaatccatctgttctacagagaaaccctaggaaccagcactacctaggaatcctagttcacccgccaccatggatgacctcgccgcaatccgctcacttccatcacggacgacctctcatggatctgcctgctggccgttatcgataatccatagctatcaccaccgaccaactccgcaaccttcaactgccgaattcagtgtgcccgaggtctcaaagccgctgcacacactgcgcgagccgcaaaccttttgacttttgtagacacagcccacttcgccgttgtcgataccgcctcgccacatccgtctccatggttgtcgttgctgctagatctgttgatcctgagcacctaggaagccaaattcatcatggagaccatcagggaggaatggtggcagttgccagagtggtggggggactacgaggggtggaagagcgggaggggggggggagccaagttgtctaccaatagggtgccaatacaccattatacatttataaaatgtttatatagcaacgaaagattttttacgattgcatccgctcttgtcctacaatataatgaattttatgggaggtaaacatgtcatcaaaaagtgtatacatgcaaaataaccagagactttgaccaaatagaaaattggatgatccaaccaactagcatacggcctgaaattgctaattagcgcgtacgcgctattagcgcaagttgcgcgtgtttctagcccacgtggcccacgccctcacgaagcccatctcttttctctttttctttttttctcgcttctttttttccaccacggggagactgtgaaacgttttttttccgtgattttttattttagaaattgaatctttcatctttaatttctactgaaagttttgaatttgagttgaaagtttttaagattcgagatgaaaatttttaaatctgagttgaatgtttttgaatctgagatgaaagtttttaaatctgagctgaaagttttcaaatctttagttgaaagttttcaaatcatgacttaaatagttgaaagtttttaggttttgagatgaaagtttttaaatttgagttgaatgtttttgaatatgagatgaaagtttttaaattcgagtagaaagttttcaaatattgacttgaatttttcaaatcaagattttaaagtttcaagatgtgagttgaaaatttttaaatttaagatgaaagtattcaaatcttgacttgaaaatttttaaatctgagtttaattctggacttgaaagttttcaaatcttagttgaaaagtttccaaatcctaaataaggccctgtttagttcccaaaacatcacatcgatctttttatacatgcacgaagtattaaatatagataaatttaaaaactaattgcatagttaggggggaaattgcgagacgaatcttttgagcttaattagtccatgattagctataagtgctacagtaacccacatgtgctaatgacggattaattaaactaaaaagattcgtctcgcggtttccatgcgagttatgaaattagttttttcattcgtatccgaaaaccccttccgacatctggtaaaacgtccgacgtaacacccaaaaattttccttttcgcgaactaaaaaggccctaaatatgagttgaaagtttgtttcagtcaactaaacaagaagacacaaacgcatgacaaatttttatcaaaaaaaaacttaaaaaacggcgccgtgaaagtgcgcgcctccgttgctagagcgtacgcgcggaacaggaatcccccatacggcctgctcggaagaattgtattgggccgaaatcagattaaatgaccataaacttattcgcatcagaccgagaaaggccgagtgggttcgctggttttccaccacctccggttgccgcagctggtgacagcctcgattcgattaatgcggtctcctcccagcgtcaatctgcttggccggctgccggcgtcgatccgctcggccgacctcctcgcatcgccgatccaagcgggtggccgttggcatcgacctacgccctcgcgatggtggcgacccaccgtttctgagccagccaaggttaagaccgcacggttccctcacgaacgatcacatgtaagtataccacatctaattaagtggtgaacacatgatgaattttcttccacacatgttttgcagatcggtagcaatatgggcagatggcctatttatcggagacgactacgcgtcggatgtccgacaaaatacaaaaaatcggacgtcacgcccagctcagcatctgtcacacgcaagagcgtccatctcagcctctgtcacatgcgcaattatatatcagtcgaagagatatggcatagccacttactagtagctacatgcatgcttagtagggtagtacaagctagtagggtaggtataacacttattttccaaattttaaactagtttatcttttaaattatttatccaatttacgatccgattacatcatttaattcattgcaattaaatctttaaaacaagaccacacatgcatatatttcgatgaaaaaaatattttaactttcttaatggttttctttgaaatgttgcacatgttatatttaaatgtttcagctagtatacatatgttgtttcattagttaatttgcaaattttgtaggttgttttccttaaatgtttcactaagtatttaataatgtttcaatagttatagtttaatactcattagtcatataaaaatatttgaacaatatcaagtttttaaaatattttgtaaatctcatatgacttttcttgtttcgctctctgagactcaatgtttcatataggtggttaatggtgttgcagtcgatatttttttaatgttacatttctctagaacattttatacaactgaaacaatttttttaagggggtgaaacaacatttattttttttatcaaaatataattgtgtgatatctttttataaaaatataattgtaatgaatacaatggtgtaatcggattaaagaacgaataattattttagatacaagttgtgatccgattgcaccgttgaatttgttgcagttaaatctttacaaagagatctcacatgattatattttgtataaataaagcatatatatttatattactaattgaaacatttctatattataaatagaatattgatttgtaatcgctgaaacattacaaaatacacgttgaattatcgaaagaacaacacgtgcaacaacctaaatgacctagtgaaacatttgctaaaacatccaaataatacaatatgcaacatttcaaatgaactactaaaataccttctgaggcattcaaataacaccacgtgcaacatttcgattgagctagtgaaatacgttctgaaacatcacaaaaataccttctgaaacatccaaagaacacgacatggaacattccaaatgcaatagtgaaatatcacaaaatacctagttaaacatcacaaaatacctagaaaaacatcaaaataatacaatgcaacacttcaaaatgacctagtgaaacattagctacaatatcacgaaatacctcatgaaacattcaaagaacaccacgtgtaacattaaaaaaatgataccgtgaaacatcagccgaagaaatcacaaaatacctcctgaaacattaaaaaacaccatatgcaacatttcaaaatgacctagcgaaaacatcattaaatacccattgcaacaattaaaaaatccattaaaaaaataaaaaaatatatagtcaagtaagatcttgttgtgaagatttaattgcggtgaatacaatggtatactccaattacggattagataaatactttatgaaataagattatttgaagttatacattaagaagtaccagcaagcatatgaaagggaataaaaaaaggagagggtggactacttcatgtcagagcagtgcatgctgcatgcatgcagaagttagagtgagaggggaggggttgcaagttgcaacgggcaggataaaaaacattcatcacatggtttgagaagaggcgtgcgggtgtccgatttttttcttaccatcgggcgtccagataggagcgttttccctatttatcacaacattgttcttccaagattgctatcttttacccaactaatgttcttccaagattactattacaatactactctcttatttgtactacctgcaattcagactttgctacactgtttgtccatgttctttttatatcaattttttaattggtgctcaatttaatcctaaggcaaattttggtacaggacacttgttatgtgtggttttagccctaggatactgccaaactcacttttggggg

SEQ ID NO: 80586 - DNA, 7122 bp, Oryza sativa
aggcgcgcggcatcgcctacgagaagaagcgttggaaacgcccgcccacctcgtcttctcactctcaggccgccgccgccgctacctcctcgcgagccagccgctagcccgctgccgccaccgccgttgccggagagatcagccgacgtgggagcttgtgtcgccatcgccgtcaccatggggtgcacgccactctcgccagccgcccgccgccgcggctcctatcgcgcgctcgctcgctgcctcctgccacgcactcgctcgccgccgctgccgctccgccggccgcgtgctcgtccaccgccgccgccgccccactccactccgctggccgccgttctcaccatctccgccgtgactgatgctaccccatgcgagcgcgctctgagagagaaaagagagatagatgaggagagggataggagatagaactgacatgtgggcccaaggacatttttgacatttcacgcgatttctctctcctccccaaccggaaagtattattttaattggcgcggtgtccactggcaaattaccacgtttatggagtgttttcccccaaaagtgagtttgggtagtgtcctagagctaaaaccacaaataacaagtgtcctgtagcaaaatttacctaatcctaatggtgatcacacttgctctctcatcgtatctattgattattttaggtggttgactgtgcctgattccttaatggtggttttatgtgcacaagtgcaaattaagagcaaagccgaggtaagaaattttttaatctgttggttccttttgattatgttcatatggattgtcctccattgtgtacatagtttattccaaaattttgcaagtgtctgtatctattttgtggttgaagtcgatattcttaagttctattttctttatttgtttgacagcgtaaaaggctgtggatgctgccatctgattcaccttcaactggaacccatctgaccttaaaggacagctcagaaatttcagagaatacaattagttggtaattaaattattctctttgtattgtgttttcagaatcattgtttcagtgtcacaccttaggtgacaatcttcggaatccatttttcggttggctaacgtgctattcggttgattgtctgtctgtctcaattttaccctcctgaccagtttggagttgacagattttgtgggcagtgaaatcctaagcttcacaacttcagtttgtgcatatacagaaagacctctctgactgatcgttcacataaaacaatgcaaccaagctgtgtaagttatgtcacagcagtaaactagacctgctactgtctcttggatgaacatgctcaaaatactatttattttcacttgatgaattgccaatgagctacaagcgtagctggaagcatggaagaactcaaggagaaagaatacagcaaacttgaaccgggaagctacaagcatagctggaatggtacaactctaggtataaactgtggcttgcagacgttttcggattcacgaaaattcgtgatgtgtttatgtgtcttcttctgtttttaatcgttccttttcatttatttgccttttcagtaatatgtcaacatattatagcactttgtgatcctgagtaggtttaatttatctaaagagtaatatgtaggattcaattagttttatgaaactattcatcacagttgttctatacattcagcaatcagcactgcatctttttttttctactgcatataccgtagcaatgcgcgaggtatcaactagttatacgtatgatgttgccatgcaatttaatagaattttttttgttcttttccatacactcttaactcatcacaattggatgtgtatatattcaatcatttgttaatttgtggtaatcctggcattatgaaagagaaaaatacaaattatcctctagacccgaaaaccagacatctttcacccttaactattaatatcagacgaattacccccctaactcaatttaaagtggttttggtcctacgtgacagtctagtcagcaatttttttttaaaaaaaaacagcaggaccctccatatctctctgactctgtctctttccaaaatcctcactctctctcttctccctccctcacctccatctctctctgtcaccaaggcagcagcgaaggggaagtcaaggattcgacagcggagggggagccgaggatggcgagcgacaacacctccatctctctctatcaccgagaggcagcgtcggagggagagtcaagaatggcgacgggcaaagctcgcaggatggcggaatgggcgggtgggtctcatggcaacggaggggataggcggagctcgaggtggcaagcagagctcgggacagccgaggatggcgagcggcggagacggcactctctttcttctccctccccttctatcaatcggttcggatggtgagcggtgtaggcggcgctctctcgtttcccaccccttcagtcaatcggttcggacgatgagcaacggtggcggcgctgcattgtgggggcggcgagtggcggaggcagctccttcgcagcctctgccgacgtgcgcctcctccacggccgcctcgtgagcttgttgctgtcatcatcgtcatcgccgctgagacctgccgcacccaaggttgtctacaatggtgtgcacgtgtgacgtcaccgtcgcctcccgcgctcaaggatgctcgcagccaccggcgcacagtttgtcctcggcttccgccggtgcacggggctcctcctcggcatctaacgcgtgcgagagagggggtgagagacgaaagagatagagaggagagagatctaataggtgggccccatcattttaataaaagaattatggactggactgtcacgtaggaccagaaccgcttgcaaagctgctggggaagggggggtttcatcaggtattgatagttgagggtgaaagatgtcagattttagggtttagggggtaattcgtactcacccaatagtgcagggtgtaatttggacttttccctagtgaaaagtatcataccaattggcatgcttcctaatgttgagcgttaaaagaagattaaaaaattaggtctgcatataagcacatatcctttatgattaattttgttcaaatgataacttgtattactaatcttccaaccaggctccaagtaacatttattttagaaatgaattaaacggtacgatttctgctgttcttttaacgtcatattgttactctaatgaacaattgaatagtgcaaaggtgcaaatgggagcaggttcaggggtcggagaaaccaaattgcaagtccagggggctaggttaaatattggcgcaaattcatcaagtttactcttttaaaccttggatagcacctccaaaatagaaaaaatggaagggataaaaattactagatgaaaaaggaaataaactgtactgcaatatactggacatcaaggaaaaaaaaaagcagcctgctgtaagtaacaacttctcaagcaggcaaccaaatcaagttacatatcattgcttacccagattacttacatagtatattgaaggagaggtttagattcattagaagcgtgaaattcgctagaaattcagctacgggacctgccaagttgttataaaaatcaaggatttcaaggctcctcaaattgttcaggttttctgggatttgtccttagagaggatttcctcttcccaaactgtcatggaattaatggaacaacttagagaattgttggagaggttgagacgtctgataacggaaggtatatgtatctcttatgggatttggcccgtcaaggcattaacagaaagatccaacttttgaagttctgtaaggtttccaaggctaactggaacgctgccgtatagtaaattattagacaaatcgagagagctcaactgtgagatattacctaatgattctggaatctgcccagtgattctattatgtgatatatagatataattgatacttggaagccggccaatatctggaggcaaggttcccgttaagagattatatgacaggttgagaaatattagtttaagcttccacaaatcggtatgtatggtcccaattatttggttgccgcctaggtcaatccaattgagctctttgctcaggtttgcaatgctaattggcattgcaccagcaaggttgttctggccaacatctagcatttgcaagctgctacaattggccaatgatgtaaaaaattcccaatcactaggccgtgtggcttggagcatattgtctcctaatgcaaagaacttcaggttaccatggatgccaatttccctaggaatcgtgtcatgatatttgtttccacgaagaagcaaggattcaatagcagatgtgtttgagaaggtcggtggtattatgccctcaaaatggttagcaattgtgctaaaataatttatcctgggaagcttaaaaccaatatcgagtggaattgatcctgacagtctgttgaaaccaagatccaagaatctaatgcaagaaatattgaagatcggtagaggaacatggccttccaactgattatctctgacattgaagtaaataagattagccattttaccaaagattcagagatgttaccggtgaaacggttcccgtcaagaacgaagtgtgtcatgatgtcaggttacccatccaactcaaatttttgccatggatgatgttcctctttatgataaacttcatgagtgttgtgaggttggataaagactcgggaacattaccactaagattggttgtagccagcatcgaaaatggcaagctttgatgattgaccaagatcagcgggcattgaacctaacaggtggttcctgctcaagttcaatgtatgaagctttcgacaactacctaggctggctgggatatcaccatcgaggctgttggctgacagatcaaggacacgaaggagggtcaggttgccgagctgaggggagatggtgccgactaggccagcaccactcagacggagagtggttacacgacctggatgccggcaattgttgcaggaaacaccggtccatcgacagaagacatgtgctggcatgttggtatcattgccaatggagtcccaagaggacagcacctgtcttggatcgttccttatgagggatttgaatgacaggagtgctgagaggtcatctccattgatggtctgagaggtggctgtgagcaagagcagggcatgtttgataagagagagcatccaaagctgccacttgatcgccatgatagaggaaggaggttgagaggttgtagtatggtgatagcacttgtaagcaagagtaagtcagcatataaggtgtagaaatcggcaccagtagaatagagttgtaccggtgatagcaagtagtggtaattgtgggcttccttggaaacgcaggatgactgcaattcattgcatcaagaagacataaaaaattaccaagaagggaccaaaaggtgagccggccggcacaccacaacaatatcccttacttatgaaacgatttttgtggtggtggtttttagtttcacatgttttgtaactttagtttattgttgattcattcaatgattgtcaatggagatatataaactaggcgactccctcttgttggagcggcaatatatttgaaagggcctgttatttctggaaactagtgatgcaacgtacatgtgaaatggagctatgacacgaacatgaactccaacgcacgctaccaccacttttactggctgtgaaatggagccttaatatctctccttcattcttatgcaaaggaaacatatagaggcagtgaaatgcagccttaatatctctcctttaggttaattcaacaacaaatacataaaacagaaatgtttgtatttttcaaagtgtaaactatttgaagttaacagttcaaaataaacttactgtatgaggcttatattatcatgatgcgcagaggtcgttttttaaacttatcaatccataaatatttcaaatctttaatatggctaattaagtagaattgacgtccttgcaaatgatgttttgaaataagttgatagcattttactttgagaagtactttctctattaggaatcaatatgtgcgacaaagactatagcatgcaagaacattttacttggagagtgatgctgaaatctcgtacatgaaaactgacactgtaaaaaatttagtcataaagatataagttgtgtagaatttactgttcacctggcacaatcagctcaatcagaaattgagacatattcaacaacaaaccatgcgaacaaattttaaataatcattgtttgttcgcatggttttgcaaaacaatgattatttaaaattgacgtagtcaattttgaagtttacagttttctctgattagttcaaaatatacattgatgcttcgatcatttacagttttggtctcctgtttgagaagaccgaactttctttggaccaaaaggaccggaccgaacaaaagaatcaattttagtttcactaacctctgaacaaaagaatcggcccttctattcaccgaattcaaaatactgaaaaagggaatatccaattcagttgtctagatttgaaggcagtttaacatgtgaattttgtgattgcaccattctattatcttgtctttcaaaacctcttttctaactgtccaaagtatggttcaatttcagatatgacatttgacctaacacctatgctgaggcacagggctgtctccatagcagcttgcatcatttcaaactacaatatccaccatgtcatgttcatgggtggaaaaccatctatcaacggtgttatgtccctggttttttgaaaaattcagtattataattgacgggaatactacaattttatgaaacttcggggaaactaactccatctgttccttttgtaaaagaaaaggaagacactattgatcatgtatgtagggcctatttggaacaggaacaaaagcaaactgttgtttgagagcaccaatttcatatgatattgtctagtgcgatgaagtcacaatgtattcatgctctttaaaatttgtcttgaacaattgtcatttcccctggaaattgaaagggtaggccgctttactttcagg

SEQ ID NO: 80587 - DNA, 15343 bp, Oryza sativa
  unsure (1)..(15343): unsure at all n locations
aaaatcggtgaccaaatttcattaagaaaggggagtttaaaatacaaatatagctttgcatcgacagtaggctgtcgagatggggttgaggctgagcctcttccccatcaaagcggaaaaagaaaacaaagcccgaaggctacatcacgaaggtgtgtttctattacagacttggaaataacctccggacttccacacgaatatttcctccttgatgctctctagaagctgctccgccgtctgcaatctgtgctgaaaaatcctagcattgcgctccttccacagcagccaacaagacagggcaacaacacaacactgtcgaaattatccctgtagccggtccgaaaacgcaatcgcgctatcagccaccagtctgctagcgtctccccgtcctgccccggcaaagggaaatccacgttgatccaatcccgcagcagacgccatactcgttttgtgtagtcgcagctgacaaagaggtgcaaacaatcttcctgctgtcgttgacagaggacgcattgatcttgatgcggccagcccctctttgccaagttgtctgctgtgaggcatctactcttcgttgcaagccagagaaagaatctgactttggaaggagctttggtttgccaaacaagttgacccgagagagaaacctcccttgccatgaagaagaggtcataagcagatgacacggagaaaaatccatctggagtaagcttccatcgtattgtatcatcctcctggttcaggctgagctgctgttctttatcttgatccatgaggattgtggaagagacaatgacaaccagcttcactaaattaagaaagatgctgaattgctgaccagagatcaattaaacccactcgccaaacagccacattgctggagtgttggtcattgttgaataaactccaacacatttcatttttaggaatttcactttctctttgatttcagaacttatctccatctgctcagcgtgtttttagcatttcgtgtgcaacttctgtttgctactctaaataagaggtaaaagaaaaagcaagtgtgcggtgtgccgttttggctacataaccatgttcaatttgtccaattttgagttcagcgcctccttgctatatgctatgtttcccctgtttttccctttcctattcattgtcagattttttgtgcaactactgcaaaggtgttcatcgcaagggccaactccatcggctgtaagatcgctcacattatctccagtgcagtagacagcacttaggttactgtaagagcagtattttggctatgtaatttatctgatccgttcgtcagaaaaactgaaaaacggtggataaaatagcatgcagtccatcccaatcgcctctcaagcatgagttgtcgagccgggatgactactagcatttctgataatcaaccaatttttacaaacgtcaatgggaaattggaaatccaaagtggcaacatcaacggcggagcccgggcggctgcccaactagcccgggaactagctccactgctgcatattcatcaactgcaatcaatgtttatcttttcgttcaaactagatgttgctgagttgaggcattgaacactgacttgctttttactaatactccctctattcctaaatatttgacgccgttgacttttttaaatatgtntgagcgttgattttattaaaaacttgaaatatgtaaaactatatgtatacataaaagtatatttaacaataaatcaaatgataggaaaaaatttaataattacttaaattttttgaataagacgaacggtcaaacatatttaaaaaagtcaacagggtcaaatatttagggatggagggagtaatttggtagacttgtttagtcgttaatcatctttcgaaatccatgtaaaaaattaggcaaaattttctacaggacacgcaaaaaaacgtgtaattggctgggggacaccgtaaaaacgagacactgcccatggacagtacaaaagttgtgtaattggctataggacatcggacgcattattttatcattttcgggatgaaagagtggagagaaatttctaaatgacgggaatgccccctctactcctccttcctttcttcacactgcagccgacatgtggacccgcacacagtgtcgtcatcctcctctcgcaacgctcaatgccggtcgcgtccccgccctcgatgccgctgttgcctccgttcgccgctgcaccaacgctcagaccacctcctccacctcatatcctccctcctcaccccgcccacacctcccctcctctgcgagccgccgttgccttcgcctgccaccgcgccgacatccagatcacctccctccacctcatttcctccctcctcgccccgcccgcacctcccctcctccactacgccctcgcccacacccgcgctcaccccgctagattccacagcggggacatcaagcgctgtccagatcgtccaattcggtggcaatatcagattctgacggcgcattgtccccctcatcatctccaagaaatccatcaggctcggcggcaagaggcgacctgtcttcccctatctcgtcgtcggagaggtgggaggggttcttgaagaagccgggcaggttggggtcggcgtcctcgacatctctgccctcgctgatgaccgggctcagcggcggcgcgacctgctgtgcttgctggtggacatggcggagacgagggagaaggacagattgcggctctgaggcggcgggcagaggaagaacgcgcagctggcgttgagcgttggcgtgaggaggacgacgacactgcgcgggcccacatgtcggctgcagtgagaagaaaggaggagtagaggggggcattcccatcatttagaaatttctctcccctctttcaacccgaaaatgataaaataatgtgtccggtgtcctatagctaattaaacaacttttgtagtgtctatggacagtgttacttttcacggtgtccctcagccaattacacgttttttgcgtgtcctgtaataattttgccaaaaagttatcaaccacaagcatgccatctggtgatctggactgtaactttttttttggtgggaggggggggggtgttggagggaatggtaaaacatgacatatactccattatacatttgtactacgtatatacggagtatatagcagccaaatctatactttctatatagttggtacccactaacaatcattagaagctaaagctcaacatgcaaatatgctacatcatcacccactagcaattactattttagaccatttaaaatctcatgcaagcatgccacatcttcactcttttaaaccatggatagcagctccatggtttaaaaattacaagatggaaaaggaaataaactgtactgacaatatcaaattttgaatatattttgataatatgtttattttgtgttgaaaatactattatatgttttctataaacttagtcagactcgaaaaagtttgactagaaaaaaggtcaaatgaattataatataaaatggacggagtactgaacttcagggggaaaataagcatgcttctgtaggtaacaacttctcaagcagacaatcaaatctagtaacatatcattgcttaaccagattacttcgttgcgcgaaattcatcatcaggaatatgtatgtgctgagtatgtcttaattatagcattcaattccttgactacatcattcatcttcatcctttcccttggtgattccttgcagcatgctagaccaagtcgaaatataggataaacaactagttctatgatatcttgggtgtttccattgtaggttgcgctagcatccagtatttccagaatattgttaggataggctgcctgacatagtcgacaagacttgttgtaccatagttaaaattgtcagttggtcttcttccagtaaacatttccaataacagcaccccatagctatatatgtcaccatccatggagacctgagatccggagccatattctgaaaacatatatataaaataaagtttgattaggggggtaaaaggtggattccacactaacaattcatcagtcaaatataatatcaatattacattttgtttttgcatctttagtcacagtaaaataatatcttatcattttgttaaactagtaaaatgcagaacggaaataattaatgagatgctaacacatagttgaattaaataatagccacttacctggtgcaacatatccaattgttcctttaattacaaatgagctgctttctttgaacggttcagcaatattcattatcctcgctagaccaaagtccgtaacatgcgccaccaggtcatcgtctagaagaatgttgcttggtttaatatcacagtgaactataggcggcacaatatgatggtgaagatattccaatgcatctgcaacatcaagagcaatatgcagccttttcatcaaatttatccttgtgtagcttcttctaactgctgtcgtgtttgcatgaagccactcatctaaagttccattgcaaataaattctaggacaagtgccttgaattcgtcgccattttggtctgatccactacagacggtgatcaccttgacaagtttccggtgtcgaattctcctaagagcgtcacactcggtcaaaaagcttctactggctcctcgttggctaagattaagaaccttgattgcaactggcactagattctgatcaataattaaatttccaatgtatacatggccaaagcttcccgaaccgatcaaatttgccggcgagaatgaattggttgctgcttgtagttcggcataagatatcctctcatttgtctcattgagaaataggttctcattatcaacaacattcagtttcatctttctcttaatgaagcagtatgcagtcatgcaacacatagaggaaattaaagttccaacaatgcaaaagattaagacatgaagtcgatgcactgaagcctggtcagaatcttcatatgagcatgaagggaattgcatgtatggagggccaccacataacattttatttcttaagagtaacactatagtgacattacgaaaaatccctgtatttggaactgggccagatagtttgttgaaggagaggtttagattagttagaaacgtgaagttcgctagaaattctggtatgcgaccttccaagctgttcttagagagatcaaggatttgaaggctcctcaaattgtttaggctttttgggatttgtccttggagaagatttccttgaaaatttagggaactcaattggacacagctcccaatagcttctgggattccaccagacagcttattcattgacatatccattttgacaaggctgttcaagagcccaatctgtgttggaatggagccaattagagcattgttggagaggtttaggcgtctggtaagggacgttattgcaagtatttcttgtggaatttgacctgtcaagctgttacaagaaagatccatgacttcaagttttgtgaagttgccaaggctagttggaatgctgccatctagaaaattattagacagagacagatagctcaattgtgtgatatttcctaatgactgaggaattttcccatcgattctattatgggatatgtagaaagaattgagccttggaagcccgccaatatcaggaggtaatgttcctgtgaagaggttatatgacaggttgacagaagtaagtttgttaaacttccataaatcttcaggtatggtcccaattatttggttgccacctaggtcaatccatgacagctcattgctcaggtttgcaatgttaattggcattgcaccaacaaggttgttctttccaatatctagaaatcgcaagctactacagttggtcaatgatataaaaaattcccaatcactaggccgtgtggcttggagtgcgttgtctcctaacgaaaaaaccttcaggttaccatggatgccaatttccctaggaataatgccatggtagttgtttccacgaagaagcaaggattcaagagcagatgcgtttgagaaggtgggtggtattataccctcaaaatggttagcaagtgtgttaaaacgatttatcctgggaagcttaacaccaacatcgagtggaagtgatcctgacagtctattgaagccaagatcaaagaatctaatggaagaaatattgaagattgataaaggaacatggccttccaagtgattatcttggacactgaagtaaataagcttaaccatcttaccaaaagtttcggggatgttaccagtgaaactgttcccttcaagaacaaagtgtgtcaatgttgtcaagttacccatccagctcaaatcttggccatggatgaagttcctctcgacgataaactttgttagtgttgtgaggttggagagtgacttgggaatatcacaggtaagattgttgtggccaatgtcgaaaacagcaagttttgataactttccaagatcagcagggatggtacctgacagatggttcctgctaaagttcaacgaacgaagctttgggcaaccgccaaggctggttgggatatcaccatcaagactgttggctgacagatcaaggacatggaggtgagtcaggttgccaagctgctgggagatggtgccggttaggccagcatctctcagattgagagtggtaacacgactggggtattggcgatcattgcaagtcacgccggtccattggcagaagacaggtgctgtcatgttggtaccattgccgatggcgtcccaagaggacagcacccctcttgggtcgtttcttatgagggatttgaatgacatgagtgccgagaggtcatctccattgatggtctgtgaggaggctgtgagcaagaggagggcatgtgtgagaagagagagcatcgaaagctgccacttgattgccatggtagtagaaggaggttgagaggttgtactgtagtgatagcacttgtaagcatgaatatgtcagtatataaggtgtagaaatcggcaccagtagaatagagttgtaccagtgataacaagtggttgtaattgtgaggcttcttgaaaacgcatgatgactgtgcatcattgcattaagaagtaaagaattactcgtacaaatcagggaccaaaaggtgaccccttcacaccaaaacccactcaaacatgtcacctggctgacgtacaacacaatatcttataaaacgactttagtggtgatattttttaatttcacatgttttgtaatatcattattgttaattcatttaatggttgtcaatggagatatataaactaaggccctgtttaaatcacaccctaaaatttttcaccttgtcacatcgaacgtttggacacatgcatggagtattaaatatggacaaaaaaaaaccaattacacaatttgcgtgtaaattgcgagatgaatcttttaagcctaattgcgtcatgatttgacaatgtggtgctacaataaacattttctaatagcgaattaattaggcttaataaatttgtctcgcagtttataggcggattatgtaatttgattttgttattagactacgtttaatacttcaaatgtgtatccgtatgtccgatgtgacacgccaaaactttacacctctgcatctaaacaccccttaagcaatttcctcttgttgcagtggcaagctagaaagacttcttagtacaatatatttgaaaggggctagctgttttttcggcaaactttgatgaaacttacatgtgttttcttatatgttatttatgacaccgacatgagctccaacacacaccattttactagtcataagttcgtgaaaactcataaaactataatgatatggaaatttttcatgccaaatccacttgtcccacttttacatgaaaatcttattatcttaggtggtgttttggaaggagggactaaacttcagttcctgagggactaaaatttttgtgagttccttcccaaacacccccttaatctattcccaagagatctttaaactatgacgcaagaatttcaacatgaaatttctttctgaatgaagggtgtatagcttgtaactattataaaaaaaaagaaacaacagtagattatctcatacatagtaagagttattaatctgagtaactcacatcgcatcctaatgtacaatgaacattttcaacattgacgtatcctttttgcttttttaccggcaaacattcacaagctcttgagaatgcaatttcaaaattattatgcaaaggaaacatatagtggctgtgatggagccttaatatctctcctttagattatttcaccaccaaatacagaaaaaacagaaatgtttgtatttttcaaattgtaaaatatttgaggttaccaattcaaaattaacttaccgtatgagggcttacattttcatgatgtttagaggttgtttttttaaaaacttatcaatccctatatatttaaaaacttcaatatggctaattaagcaaaatcgaccctgccattgatatttgaaataaatagataacattttattttgagaagtatggtctctatgactctatcaggaattaatatatatttgtgacaaagactatggcatgcaagaccaaacctcaaactattggagtgatgcaaatctcgtacaggaaagctgacagtgtcaaaaatttagtcgtatagagataagatgtgtagaattcattgttcacaacttcacatagcacaattaacccaatcagaaagtggcacatatggcgagttctatgtaaaatagtttgtcttcatgcttttgcaaaataatgcgaattttaaattgaggtagtcaattttgaaatttacagtttcgcctgattagttcaaaatatatattgatcctttgatcattaacaagtttagtttgactaacctcaggtctattgaccctcataaattttcatagtagtaaacttgacctctgaacaaaagaataatcagctcttctattcatttatttcgacataataaaaaactgaatatccaattcacttatctagatttgaaggcaattttccaatgccggcacaacatgaccaacatgtcaacttggtgattgcaccatgctattatctttatctttcaaacctcatttctaaatgtccaaaatatggtccaatatcagatatgacatttgacctaacacctatgcgaggcacatgatattctccattgcagcttgcaactctttgaactggtatatccacctagtcatggtcttgggtcatctataaaactaatcaaaggtgttatgtctcaggttttttgaaaaatccagtattgtaattaacgagaaacattgaaatttatgaaagtttaggcaagcaactccatttaagctgagttcgtttgttgaggttcccaactcacctcactcgtttttcgcgtgcacacttccaaaacggttaaatagcgtgttttctgcaaaaaaaatctatatgaaagttgctttaaaaattatattaatctattttttaaaaaataatacttaattaattatgtactaatgagtcgctccgttttacgtgcgcaagggatttttttaccaacgtcagcagccgaacacagcttaattatttgtccaatcaccgcatatctctttttcttatttgttaacaaacttatatatggttgtgtgtcttacggtagaagccagagatataaatcatctctattatctaaaaatataatacatttgttcctttcgtaaaaaaactcacaattgaccttctatgtagggcctattggaacaggaacgcaaacaaatagcagttcgtgtgagaacaataatttcatatatagcctattggctagtgcgatgaagccacaatatattcatggtcctcaaaatttgtcttgaacatttgtcatttgtcatttcccatggaaattcaaaggctagaccgcttaactatcacgtgacactacaagttagtgacagccattgaaatctgaggcttgatctgacggaatgagcaattattgagacctaggagtaacagtgttccttatcttgatccatgaggagtgtcgaagagaaaatgacaaccagcttcaccatgttgagaaagatgctgaatttctgaccagaaatcagccaaaccccactcgccatcctttcaactgaacttggttttcctgcagttctatagtgtatctacaacctaagcagccagactgtttttgttttataaaacccaaaacacttcattttaattccattttccctttgatttcaacacttttagccatcagctcagcgtggttttagcagttcgtgtgcaacttctgcttaaataagagcaacaaaaacaagattgtggttttggctacataactgtgctcaatttgtccaatttcgagttaagtttctccttcttcatatgtcctctgtttctgtaaaatcaaagtgggtttaattgttattttgtgatgaaaaattggcatgtgagataattagttttgatatgtggagattattggcgaggtggtttttgcatcgattgggccggggtatgtgaaccggtcagaccgggtgatgatgaacagggttttcagatgttgaacaggtgttgcggttgtggtaagccggtcagactggagtatggcgactagtcagaccaaccagcccgcggtctgaccggccgacactttgttagtttcggtttccggttgtttctttggatatccgtggataattcatgtttatagcttctagatggatactatgtgtatgtaatattgttgtttggtaacaatgagtcaagttggttagaacttgtgctcggatattggcgcaaattcatcaagtttactcttttaaacctccaaaatacaaaaatgaaagtgataaaaatcactagatgaaaatggaaataaactgtactaacaatatagaggacttcagaacaaaaaaaacatgcttatgtatgtaacaacttctcaagcagacaaccaaatctagttacatatcattgcttatccagactactttgttgctccaaattcattatcaggcatatgtatgtgctgagaatgccttctttgtatcaatcaattccttgactacattattcatcttcattctttcccttggtgattccttgcagcatgttagaccaagtcgaatacaggataaataactagttgtgtcatatcttgggtatttccgttgtagattgcattagcatccaatccaatatttctagtagattgttaggataggccgttttgacaatgtcgacaagacttgtcataccatttataaaaatgttagttagtcttcttctagtaaacatttccaacaacaacaccctgtagctatatatgtccccatccatagagaccggagaccctgagccatattctgcaaacatatataaatcataaaaatgttttagtggatacatagtgaatataggataaaaggtggatcccacactataatctttagtcaaatataagttcaattttacattttgtttttgcatctctaggtcacattaaaatactgtcgtatcgttttgttaaactagtaaaatatagaacggaaataattattgagatgctgacatagttgaattaaataaaagccacttacctgttgcgacatatctaattgttcctttagttacaaatgagctgctttctttgcacggttcagcaatattcattatctttgctagaccaaagtctgtagcttgcgtcaccatgtcatcgtctagaagaatgttgcttggtttaatatcacagtgaactatagacagcataatatgatggtgaagatattccaatgcctctgccacatcaagaccgaactttctttagaccaaatggaccggaccaaactttccgtctggaccgattgcctacccataattaacaagtttagtttcagtaacccctgaacaagaatcatcccttctattctccagtatcaacatactgaaaaagggaaaatccaattcagttgtctagattggaaggcaattttccaacgtacaacatgagaccaacatgtgaactttgtgattgcaccatggtattatctttgtctttcaaaacctcttttttctaactgtccaaagtatggtccaatatcagttatgacatttgacctaacacctaatcaccaatgctgaggcacagggcggtctctattgcagcttgcatcatttcaaactagtatatccaccatgtcatgttcatgggtggaaaaccatctataaaactagtcaaaggtgttatgtccctggtttttttttttggaaaatcctgtattgtaattaacgggaatatgacaattttatgaaactttaggggaagtaacttcatttgtaccttttgtagaaaaaaataaactattgaccctgtatgtagggcctatttggaacaggaacaaaaacaaactgttgtctgagagcaacagtgtcatatgctattgtctagtgagatgaagtcacaatgtattcatgctcttcaaaattcgtcttgaacatttgtcgtttgtcattttccctggaaattcaaaaggctagaccgctcaactttcaggtcacattagggccctacaagttagtgccgggcattatatagaaacttgatgcttgatgtgacagaatgaacaattatgggacaattgcttatttgaccccgttttgaacggtaaccgctgatttggcctctacgttttgaactttgcttatttgaccctccttttagagtacgaagcctctatctgaccccatttcaatgactctgttagggttcgatttaaaaaaaatagaaaatgtttcaagagttcctaatggcgaaaataccttccaaaccctattttgactctctctctctctctctctcttactcgtgcatgactctcacagtctcacctctctcagtcgtgcgtgcggcagcggcggcgagctacgcgtgcgagctaagggggcattcggcaggcatagtgaaacattgtgagtacattaggtgaaacattttttgtagaacaaaaaatgaaacgagttcccttaatagagggttttcaaaatatgtgggtgatttgttgcaatggagtatgtggtggagacatgtggtggggcccaatgggggagacacgtgcgcgtatttggggagcgactgatctgggcgccgggcgccagtcgaccgatccggcgcattttccatatcattcacaagaagtgagcatgctctctttttcatttgttccattttacttgacaaccatttccatcttcagcgtttacatgggttctgtttttaggaatggataagtattcttaattcacaaatgtgagggtaggggtggggctgggggcgtaactatgtgagaggtgtattttacctacccctccgttttaggttatgagacattttgactttagtcaaagttgaactactttaaatttgattaagtttatagacaaatatagtaatatttataatattaaattagtttcattaaatcaataattgaatatatttttataataaatttgtcttgggttgaaaatgttattatttctttctacaaacttagtcaaatttaaagcagtttaattttgaccaaagtcaaaaagtcttataacctgaaacggaggtagtataacacaacctattgttgtatagtatgtatatatatgtttgttttatatatcgcagatgagcacaatagtaaaagaactagtgacttgaactatagacttttgactcaactccgcatgccaacaatcatgtttctagttagtcatatgatttttcatgttgtctaaattgaactgactaattgtatctgcgcatcagggggatccgttctctagcagtaggccaatatcgtaacatttcccttctcctttgcaattggcggctgcttttcactactagaaaaaacattttcgccgacgttggcaaatcattttcgcaggtagaaaattttctacctatggaatgatttcactccaatatccatgaaaccatctccagagaacaaaatggttaccaagatgtgatgtgctggtgaactccaccagttataatgctttaccgcatttcattgactatatatggccatgtttagttataggggtgaaaagttttggcgtgtcacatcggatatacagacacacatttaaagtattaaatgtagtctaataacaaaaacaaattacagattctgtctgtaaactgcgagacgaacttattaagcctaattaatccatcattagcaagagtttattgtagcaccacattgtcaaatcttggcgcaactaggcttaaaagatttgtctcgcaatttacacgcaatctgtataattagttttttttctatatttaatacttcatgcatgtatcaaacattcgatatgacgggatgaaaagtttttgcgcgggaactaaacatggcctattccttgtagcatctacatactactattacactcttgttcttttattccaatttatttcacaactttattttgggatacaaaagtgcatgttatgtgccaatgaccacggaagaagtgtgacatcccggcttaggacttaatagaattaatagaatactcatatcaacaagttacaacttctttttcagaaattgatctctaaagaactccagggttaagcgtgcttgggatgggtgactggccgggaaattattcccgggtgcgcacgagtgaggacaaaatatgcagaaaagacttatgttgatctgtgaagcgggcccggtctggaaaaggcgggacgttacaacaagcatctggactagtaccatttttttttgacattgtgaagagaaacgctcatgtatgcaagcaaaaaagcatctggattgtacgacaagaattggggaacagcctgaacctgtaatgcctccattttacgtcctgtatctagctgtactattattttcttaactgtcaacgtcgagtagtatggtggaatctttatttggatatattctgacagcagtatctgtgcaatgtgaattctgtgtaccatgaaaagatctataacgagaacaaacaaaggaattgcaaggtggatgataattgtatggcagacctccagagttccactactgttagataataattctgtgaggttagaacccaatgctacaatggatgccttgtttttaggctagaagacaggaggcatattaaccaaggtgatgccattgtagaagttcagagtatcggcatctagcacatacagtgccactaatctgtttggtacagctctaactcctaaatataacttcaggagttaaatctggagtggag

SEQ ID NO: 80588 - DNA, 7839 bp, Oryza sativa
agtatattttgtgacagagctccacccaacttcactcccagttttggtggagctgaaattgtttggctgagctccagctccaggaggggtggagttggagctggagctgtgccaaacaggctttaagactcatgttgaaacttgctccatcaccatagctgaaacctctatttgtatgcactcccattagaataacggaacgcgggcgtgaccacaaacacagatcaaatcactttgttagctggcaactggctcttgttgctggacgaatatgccatcacactgtaaaaagacgtttttaaaggtgccacccttttactacacaggcggctgtcattaatgctggtttgtggtttcttgaactctgctattgccctttcagccatatttacatattcttcacatggatgctttgttttctcccatatcatagtgtggatacgtctctcctagctccactactgtggtctgtggccacagatttgtgaaagaattataaccgtgcaacaattcctaactcaccatttatattcaactttaatagacaagggtcttgttaacctctctctctcccttttttaaaaaataacttttatagacaagggtcttgttaacctctctctctccctttttaaaaaaaatgatactgctggtttgttaacccaaattagtcatgtaaatttttatatgatggcaatattatctgttcaccagatcaatttgaacaactaaacaaatgtatgcatatgtattatagtaagatttgcatgtatagacttttcatcaaacttctgcttcatttatttatgtgggagaaaatattctttcaaaaaatagttcttacaaacttgtacctataaacactttgtctatgttttcagcgtccatgttttcagcttcttcccatgtcggagagacaagctcttcccatgacattaatgtttcctcaatgtggttagcagaaccaaggagactgttgatttgctttactccaacatcacaatgcataacactgcaggtattacacatgaccttcctagctacagtacattgcaactgcagatcttataaagaatacgaaatgctattctcccgaaccactcatatctataatattggggtaagctctggaacatgtttaacgcgtcaaagaagcatgaatgactacagtgcaaaagtatgggctgatcttagattcatgcaaatctcccaaaatgctcactagttcgttctaaagtataagatgcattagagtttttagatggtctctaacattatgcattgatcactaattttattcataatgtattatgaaaaacaatgaaattaatgtcatatgtaaatacttttagatatgaatatagcaatactatatatatgtttatagaaacaaatacacaattttttagttcaattattaactaaaagattcaaatattgattttctggaaaaataaggatgatttatactctattttatttttgacagagggaataccatatgttaaaatatactcctattttttttgtatgatgttgattagtttaaaaatgaactaacgaaaaaaaaacttttttttgggaattggataggttcggttggatagttccagatatttttagatttagaaacgaattaggattgaaacgaaagcaaatacagtaagggcactatccgttgaaatcgaaaaacagtaggaaactatccggaatttttctccggttattctcatgtagcaattaatttttagaaggaaaacacgtatatatacacctaactttgtcatacgaaaacagatgaagacaaactttatatcaaattgtagagctcgacaagatatacgactttgttgctgacagtttattgtttgaatcatatatgggggtccaaatattcattagaaaataccatatctatttttacaaaatctcagatctacaattgaaatgacatcagatggagacgtactctggatatcaaagttatatagttcagtgaatctactactgtgtagtttatgacacttgtatttgaaaatattttaagtgtaaaacaaatattacaagtttcgaagaggtgaaatacaatgaattcaatctataaaacgagaacttgacatgtgatatagacaagtgatatagtaagtaagctatgcatgaagtaagaggtattggaactaggaagtggataatcatattaaaacgtgggtcttttaggggaatgtccatgaaaatcgattttcacatacggttgtgagacctcctaaaaaaattgatgatacaattttggagatgttgatatcttattttagaaaaataacaagcgatacctcttgcttcattaaggaatctcaattcgaggtattttttatattcagcaaatattcgttattgtactcattccgttttgtattcgttccgtatttgtattcgataatatttgattccatttccgtatccgtgtttttgatttcgattccgatttcatccctatggcacagtatacttgtgtgctggactagttactactagtcaccaattgagcctaaaagcctgggtaattaattaatccgatcatagttgattctctctctcttttctcttctgctttttttcaatgtgactgttcttttacataaatgtggctgtttatatgtccattatcatccattctaatcctttcttgtaagttgtaaggcatattttactgtactatggtgtatataacaacgaatggatcttatgattatatccatgcatagtttgaaaatgcacatcgtcgtcttcaggcctgggtgaagcctaggccagcttagctatcttcttctctgctttggtttgtcttcattgcacccaaacattttttttcttgggtaataaaatatggttgtattttttttgcccaatgattacagtcgtaaaagatttacagctgaaacattattactaatcttccaagtagcccctacataacattttttatatggattattttttgagaaacccatttttatatggattaaacggtaagatttgtaatgttatttattgtcctattattatcctaataatgatgtgatttttcatcgtaaacaactgaagattgcaaagctgcaaaccaggacaggttcaggggactgagaaagtaaaatgcaagttccggggcctacgttaaacagtggctcaaattcatggagtttactctttaaaaccatatatagatagcacccccaaaatacagaaacaaaagggatacaaagaaatacaagatgaaaatgaaataaacagtagtgacaacaatataatggacttcagatacaccaaaagcatacttctgtgacaactttttgagcagacataaccaaatttagttacatataattgcttacccagattacttggttgctcgaatttcatttaggcatagctgtgcatgccttctttatagcaatcaattctttgactacatcatccatcttcattctttcccttggtgattccttgcagcatcctagaccaagtcgaaatataggataaataactagttctaccaattcttgagtgtttccattgtaggttgcgctagcatccaatatttccagtagattgttaggataggccatcttaacatagtcaacaagacttgttataccattgataaaattgtcagttggtcttcttccagtaaatatttccagtaacaacaccccgtagctatatatgtcaccatccatggatacttgagatcccgctccatattctgtgtatataaatgaatgttttagttgctactaataagtagggataaaaggtggatttcacactacaatttttcagtcaaatagaagatcagtatcacattttaattcttttagcatctttaggtcacattaaaataccatactatcatttttatgaaactagtacaatttagagtggaaagaattttcactgtggccatagtttagttaaataataatcatttacctggtgggacatatccaattgttcctttaattactaatgagctgctttgtatgcgtggttcagaatgcattatctttgctagaccaaagtcggtaacatgtgccaccatgtcgtcatctagaagaatgttgcctggtttaatatcacagtgaactatcggcggcacaatatgatggtgaagatattccaatgcctctgcaacatcaacagcaatatgcagcctttccaccatatttagctttctgtagcttgtgctggttgttgtacttgttgcatgcagccactcatccaaacttccattgcaaatgaattctaggacaagtgccttgaattcatcaccattttggtctaagccactgcagacagtgatcaccttgacaagtttccggtgtcgaattctcctaagagcatcacactcgctcaggaaacttctgctggctcctctttggtcaagattaagaactttgattgcaacaggcactagattctgatcaataattagatttccaatgtatacattgccgaagcttccagaaccaatcaaatttgccggtgagaatgactcggttgctgcttgtagttcggcataagatatcctctcattcgtctcataaagaaatgggttttcattatcaacgatgttaggtttcatccttgtcttaatgaagcaatatgcagtcatacaaaacaaagagaaaatcaacgttccagcaatgcaaaagattaagacatgtagtcgatgcactgaagcatggttagaatcttcaatgagcatgaagggaactgcaagtatggagggccacctcatagcattctattacctgagattgacactatagtggcattacaaaaaatccctatatttggaacaggacctgacagtttgttgaaggagaggtttagattagttaggagcgtgaagtttgcaagaaataaaggtacaggacctgccaagttgttgttagacagatcaagggtttcaaggctcctcaaattgttcaggctttctgggatttgtccttggagaaggtttctataaaaatttaggaaactcaattggacacagctgccaatagcttttgggatttcaccagatagcttattcattgagaggtccattttgatgaggttgttcaagtgcccaatctgtgttggaatggagccacttagagcattgttggagaggctgagaagtaaggtaagggaaggtattgtaagtatctcttgtgggatttggcccatcaaggcattactggaaagatccaagagattaagttttgtgaggttcccaaggctaattggaatgctgccatccagaagattattagacagagatagaaagatcaactgtgagatattgcctaatggttgtggaatctgcccagtgattctattatgtgacataaagatagaattgattattggaaggcggccaatatcaggaggtaaggttcctgtgaagaggttgcaggacaggttgagagaagtaagtttattgagcttccataaatcttcaggtatggtcccagttatttggttttcacttaggtaaatccctatgagctctttgctcaggttggcaatgttaattggcatttcaccaacgaggtttttgtgtgcaacatctagccttgttaagctgctacagttggtcagtgatgtcataaattcccaatcactagatcgtgtggcttggagcgcgttgtatcctaacacaaataccttcaggttaccatggatgccaatttccctaggaataatgccatggtagttgtttccatgaagaagcaatacttcaagtgcagatgcatttgacaaggtgggtggtattataccctcgaaacggttattaattgtgttaaaacgacttatcctaggaagtttaatgccgatatcgagtggatgtgatcctgacagtctattgaagccaagatccaagattcttatggaagaaatattgaagattgatagaggaacatggccttccaattgattattttggacactgaagtaagtaaggttaagtatcttaccaaaagtttcagggatgttaccagtgaaaatgttgccttcaagaataaagtctctcaatgatgtgaggttgcccatccaactcaaatcttggccatggatgaagttcctcttgacgttggagagtgacttggggaatatcaccggtaagattgttgtggccgacactgaaaaccacaagctttgataactgtccaagatcagcagggatgttacctgacagatggttcatgctcaagttcatggcatgaagctttgggcaaccgccaaggctgattgggatatctccatcaagactgttggttgacagatcaaggacacggaggtgggtcaggtttccaagctgctgggatatggtgccgactaggccggcatcgctcagattgagggtggtaacacgacctggatgccggcgatcgttgcaggaaatgccggtccatcggcagaagacaggtgctgtcatgttggtagtgttgctgctggtgtcccacgaggacagcacctctcttgggtcgttccttatgagggatttgaatgacaggagtgctgagaggtcatctccattgatggactgagagctggctgtgaacaataggatggcatgtgtgagaagagagagcaaccaaagttgccatgtcctcttgattgccatggttagagtaaggaggttgagaggttgcagtctggtgataacacttgggagcaaaaaccaagtcagcatatatagacatatggtggtgtagaagtctgcaccagtggaacagagttatactcactaggtagaacaagtagtagtaacagggggaccatatcccactcatgaaagacacttttatggtgacaccttttattttgtaaatttcctattcttaactcatttaatgatggtcaatggaaataaataaactagacgattcccccactacattgctgcagcaatccagaaaaaaattattccctccttcccaaattgatcatcatatgatagaattcaaaatttctcaaattgatcatcatgtaacctccgcatagacacggattccatcataatacaattaatgcagcatggaagaatgtgtgcatgctaaggatttcaaaaattctgactgcaagaatttccgaatgaaaagggtgtatagctaattattgctcagtttgtttcaaaatataaggcctattatgttttgttaggtactttgaccaacaattattttttataataaaactaataaggtaacccgcacattcgcgtgggtaagtatgttttttacacgtgtttgaccatttgtcttatttaacgtttttatgcaaacatgtggaaatgtaagttatgcttaataaagttataaaccaagtcacaacaaaataaataataattatttatttttaatttaaataaattgtcgaacgtgtaccgaaaattcaatggtgttatctatcgaaaattgtacctttaataatcgtacattttttttgaaaaatattctttatcgacattgattatttttaagctatttgttagatatttatagatcaatactcactctctaaagtataagtatatttggattttggtacggtgtttgagatcctggattttttttacaatttggtccttccaaaaacttaatttacaaatacatcccttaaaaaacttattccagaaataatcattttttgtgtgccagagtggctggtgttgtcatccaatagggctccacctgccatactggcgccaaccccccaccaccccaatgcgctagtgcctcttgcatgctcctccggggtggggctagcacttaacccgtgggccccacccct

SEQ ID NO: 80589 - DNA, 14164 bp, Oryza sativa
cttacatcaaaagagagagagtggtaagagttcttcatctccactgtttttccttccagttttgaacaaacatatggttcagggcaaggaaattgcccagcagttgtgaatgccttcaccacagctggagtcgcctttgcacaatcgtcgtacccagtagcaacatagtaggtctccaaaccaagagcaggaacagaagctctccaataaagacggtgctggccagtagaaaccttttcgccactaacatactgccactcaggggaaatttgacttctcaaacaggaaccatttgaattgagaacagatacatcaggattacttacaacaaccataacaatctcatcccttgtttgctctaatgggttaaaaaggacaacagaatgtgccttccctccatgagggttgagaaccttgtatacaggttgaacatcatattttgaccgttcctgcactggctcaaaatgcgatagtaaggtaggatcagatctgtcatggatatcacctaaaagcacttcaaccgccctggacataaagagctgcaagtcttgcaaagaagtgtgcattcgagtcccatagtccactacaacatgatccttagctgtgccagttacaccatcatgatgctggaagagtgccaggttcctcctagctgctgttagcttgtgagaaaagctgatggggagttttacacattgaagcttctgacagtatcctagaacaaaagaactcagaatctctgaggcacgtagtgtctgttctagtactcggtcaactgctttgaagtacggccttgatacatagtaaccactccagtaatcctgatttctatcagcatatgtaaagaaatcacctgaaagtgttggaaaacctggcagctcagaagaaaccagttcaccagggcgtgtatagtttatcctttcagcttcatctctcagcgtggagaagtaatcctccagggtaccaaattttacttcagccttaagatggggattagagtttatgtaatcaaaaagcttttcataattgcggaactgtgcttctgcttcctctgtactaacataccggaaatcatcccccaatggaatgagaagtgtatttgttctgtacagcgtagactttttcctgtattgatctagaagtttcattgccctctcttgcacattgttagcatttgtttcaactggatcaaatctccacgggcaagattcatagctgaagctacgcattcgagcaaagtcaaactggcagcagatagctggttctggtccacaggtgtgtggaatgtcataagaatagaagggcatcatatgaacaaatatatcagttgtttcatctatatcccagttctgcctccataaatattcaaggttcttattcatcgcaagctcctttttcaattcataatgcgttcgctggattaacatgttgtggaaacccattctcctcagcagataagccatggtagctgaataaccaaatggatcaattgaccaagaatttttaggaacaactccaatggtatcattgagccacatgtttccctccatcatctgaggacgaagaatagaaagattggcataattaaataatgttccagcccatatactatagtcacataactgacaattagagatttgttcattatatattgcaggttggtcagagtaacacaactttggagtaaaaaatagaagtacgcaaactttgtctccgtaaaaaaatcaggcactatgaaaattgaagcatcaggtttccattaaaacaaaagatgtagctggatttgaacaagatataaagcatatttgcttcatttgttagattactcttctgccctgactccaatgttcaggccaacatagatagcattagcaacacaaagaaaatcgacattaagctatgacacagcttgatcgattaaaagagggatttgttggagggaattgtgtaccttttggagtgatttttaaaaagtattaatgtaacttcaacaatacagaaccaaaacgttaaaaaaattatatggtccatatgtgaatacaaccaggatatcttaaaaagggtaaagtctaaggactaagtgcgcaccatgaaattgatgaatctagttgtcaagggtttcttgtaaaaaaagacaattctgagttcatgcatttgataatcagaagaggtgtggattgctccacaaattattaaacatgaaactgaatagtgaaatcatgcaatacaagcacattgcaacattctgtctacgatactgtccctgtatttttcttcaagagcaccatctaaacacagaccaagtcaccaagatggtgtaaactaaaactgtattaacttcattcaattggagaacagaataaggtgcatttgtccactccatactattgtatgcttgttaaattgtactatcgatgcaaagtgtcagtgctaataatgaacagtcaggtgagttcaaatagctaaagcagcatgatagcacgtagcattaaacatatgtttgcagcacgtactgaagtgttttttcgatatgtacaatttacttttatgggtatttcaggtcagtgatatacacaataggaaaaggaataaataatgtgatttctttatgcatcaggtacaaatgaagctaagaacctggcgcatttagcaattagcacagaggagataaaagaagatgtgatgcacaaagagtcaagagtgtacttgcctgctctatgatagcaaaatagtgggagtttgcctgcacaaagaaagaaagatggttacatttagcttcttcttcaaaaggaaaaaaaaaaagaaagaagtgtgaaatacttctgatcagaaatccataacacagtaaacaattgaactaaaatagcatctctccaaggacttctacatcatccagaaaaccgcaataccggacagatcattcatcaaactgacaattgatcttaatactccatttgtgtaactctgaaacatgctgttctcaaggaaaaataacatggaaattatgcagcagtcaaatattcaaatcatgagttctattttattatttaaacaatggataccaagtatctcatggcaagaggtaaaatattgaaggaaaacatattagacacatcagagttgttgctgatcctttatctagtgctgaatctccaacatgtttactaacaaattggaacttcagaagcatcacccgtcaaaagcgcatttgcataattcaaaacagcaatgtgtacacaacataaaatgcgaataaaactgattcctgagcattgaaactacggcccaatcaggtaaagcatgaaatgaaatttcactccattcataaccaagcaacaaatgacaagcataccatgcctcaaatgccaacaaatacacaaaaggcaacccaattagacaagcaaaaactgccatctactcctaagatcatgtataaaccacaaatgtttccttccgtctcacctcgtcattcatgacccaccctccactgacaatctccagctgtccatcacgcacaagcttggtgaacgcctcctgcttcttccgaggggcgtcgcgccaccacctctccaggtatgacatctcctcccataaaaatttcctacgcgaatcctacatgacaacaaaaaggttaaagttaggcatcaaaaaccgcactaaaaccctaacaccgaatctgggtttagatcgcagcgaccttggagagcgactcgatgatggtgtcgaggatgtggcgcgactgcttctcgtagtactcctcgacggtgagacgccatccggggtcgttgtgggagtggggcgcgacaaacaccttgagcttctcgccgtcccactcgtcgctcttgtaggagacctcccacccttgcttccacgcgccgccatccacgtccaggaactggatccggtcgtacaggtccttggtggtgatgtccacgtgcgcctcgcggccgatccgcgcggccacggcggcggcggccgcctccgccgcagccgagtcgcggcggaaggccggcctgcgggtgaggcgcgggcgcaggcgggccggggaggtcgcggcggggcgggaggaggggaggccgaggcggaagaaggcgaggaggaacagggcggcgaaggcggcggccgcgacgtagaggacgcggcggcgggaggaggaggaggccgacgaggaggcggagtgggccccgcggcggcgggaggcggccggggaggagaggcccttggagcggaggtggtggtggcccttgggcttggaggtcgtcgggaggagcgcgcccgagcggccgcctccgccgccggagaagaacggcatcgccgccgccggcgaggcgaggcgggtgggaggaagtgggaagttgggtgggggggggggagtgacgacgacgtcgcgtcgcgggtttctccggtgatatttttcggcgaaatggcacgctaagggacagacaggtgagagagaccggaggaggaggaactgtaccatcactgacatatgggtcccacatttaggtgggccaggacagtaagcgggacgtggcaacgcgctgtactgtgatgtttggattagttgggtactttggcgtacctgtcaaaaaagaagagtcagttggacattttaaagaatttggtattctctggcaataaagtaaacttctagaaattctcatatgcatatatactgattagtaataataaatacctgattatttaaaataaatctgaaatattataaaatgctatatttttagtgttacaatatttacaacatggtacctagattctaggtctggaatgtcttgtatcatacttcctccatcccgtaaaagaccaacccagtactggatgtaacacatcctaatattatgaatttggacataattttgttcagattcgttatacataatgtgtcacatccagtctcagatttcttattttgatacagagagattatctagtacttagtagttaggataaccacgatgtttatttatcaacttggtagtaagatgggtttcagtatcatgcaataattgttactagcaggtttcataatgtgtaataccttaaatggtaagtaagatgggatccacattgaatgcggagattgtcattcatgcatacccaagcaaatactactcatatattttaatggtttattgctagtagtaagcatactaccggttataactaataccacctaccacaaaagtatcttactaccatgtaataagctaacattaattgctttttacattttttttctcacatcgtggttgcttttaatgcttctccatcttaaaatgttgctacctaatacatgattggacactttataatataagacattagcatgatacctaggtaccataatctaatacccataagtgcgtgctgacgttagcacataaagaattctgttaggtaagtggtacaccgttctttagtcattctcttaaaaaactgggaaccctaagttatgtataaggaggagcggatcataataaggctatagtgagtgaatacatggtcatggaattaatgaaatagtccctacctcatttgccacaaatgtatttcatggaaatggtacagagtatactctaccttgtcattggtcttcatgtctgagtgtgtttgagggtggtttagtgtataagtgtggtatgtatgtagtgatgtttgtgcacgtgtgtcttccgtgtaataaaaaaatggcttatatcagcaacaaaccaaacatgatcaatacaattctgcaatatcaaaatttagcttgggacttcttaaatgactgtaccaaggaattctaccatactccgtgcaaatatagttgatcctacggagcccacccaaaggttcagaccggaatgtaggaagtggtgatatttatttatttgtttctatgaaaagaaatatgacatctacgattcatagcggtaagttgcaagtaatattgcgcataacaaatatttattaataagaaatggcattgttaaaaaggctagcttagaatttagtcctaactcttaatctacctcctacctcaatgtcgcctcttcatccagctctatcaacaggccccttctctcataatacaaaggttttttcctactagagaactatagtataaagatctaaagtggctcttagattttcttttgtttgagagttttgtaacatttttaagcagtatcatgagttttagtatgaaaatattgtaacatgtttgatgcttgtataagttggtttttataaaagttgaatatgctcggtctttgattaaaccaagctcgagcctgtctgacctcaaagatcaactcaagctcgactcagctcaattcaaatctataatctatatcgtgcttgagcctacgtatgtagataagcttgttgctattagacaaccctcaccgagaactagactctaaaataaataacttttgatatgtttcctattggcacctttgttagggaggccaaattccttctttgctgtaactttatcgagtttgctgtaactaactgttcttatgggtgtaacttaggccttgtttgtttcagcttaagattattgaaatctagattattaaatcagatttctctaaactagattatattaagctgacataaaataagctacgagttgtttgtttctctggattattagaggcatctaagggtagtgggtctttagacactcaataatctggaaaaagctcctctagaggagattattggattatagtaatctggcttatagattgtaataatctagcataataatctacttgtttgtttcagcttacttctaataatctagattataataattctaagctgaatcaaacagggcctaagtagctcgtgaacttgctcactttggtgtgaaccttgatccggctagtgtgatgctgtgactggacttggttccaatttgtgttacctcattggtggctggcgatctcgccatggtctaggttaatggaatcactaacatttttttaataaaaaattagcagtgctatacgtatttaaataatcataacaaaactttaatttgcaaataaagatatcaaaaccgcttaatttagatcgtggtggctcttgtggtccaatggtccctagaccaaactcaattttggcctagaaggaccccctcccctaaatccatgtcaaagtcactctataggcatggtctattgatttttttacactgtattttttaatatttgcactcaaatgtgagttttagggatttgtaataccatgagatactttgagcaaatttggcttatgtgtattgaatttatgatgttatagaagtttagagcatggagtaggatcatctaacgaaaaattgctatagccgccactgaatttagtaaattagttgtcacataagcataaaaacatttttttctagagacatatcaatttgcaagaaatatgttttactttaagaaagcctaaaagcatacagagtcttatacatcgtaaaacatttacacgtgaaaaagaaaacatttcgtaagaaaaagtttagtgtatcatttttccatcagtgacttcacgagaaagagccgaagcatgagttgtttaagatagcgtttgattaagcaagacgggtgagaaattttatcctatttagtataggcttctcgaattgttaaatagggtggtttttttaaaaaatatatagaaaaattagtctattattttaagtttaaaataattaatacttaattattatatgctaatagtttatctttattttacatatactctcattcttcttaaaataaaatatcctataaaaacgggctagaactagtgtagatatatgaaatacattcttaccaaatcttaagtcaaaactcaaattaatttgtaagaaataaatggcaaatttaatggtaacagtgtcatcacccgaaaattgtcttttttttactcgcaaataaaattgagtttctatttggtttggtgagaatgcatttcatatctaacacatatctttatagtaatttgctcataaatttataaaatttgtatgatgttcacgagtttcaacagtgaattcgttttcaccggaaatgttcttcttaaatccactccacacacacagccttattatacttgtgtgagaggataatcggacggcggatgctcaacccatcgtctccaccccacacttcaatcgcgataacccccgcgacgcccagcaagccaaaaccacaaacaccatacgcgcgcggacgcggaggccgcggagctctcagccatggaggcggccgcactcctatcccccaccgccacctctcgctcccctctccccctcctctccaccgcgcccgccgcccaccgcctccacgttctcctgcctctctccggccgccgccgccgcctgtgcctccgctcctctcctcgaccccgcggtaactcactcctcactgctgttcgaatccgcggaccgcgggcttctgaggcggtgcagaatttgatgcgtgatgctgcgctgcagggtcgttgggctgtgcgggagattgcgtcgtgaggagtatgggttcgtctcgtgagcgcggggtgctcgtgaagaccagcagctcatcaggtttagtaatttataatccctttagtctgattgatgattagtacttcttccgttttatattataactcgtttgacttttttcctagtcaaatttcttcaaatttgaccggatttatagaaaaatatattactattttcaacacaagaaacatattatcaaaatatatgcaatgtgagatttaatgaaactaatttgatattttaaatgttgctagctttttctataaaattagtacttaatagtaaaaaagtcaaacgacttttaatatgaaacggatggatggagtagtaagtttctgcttggtatgtatggttcggtttgtaattgtggtgaaattgaatgtaatccacagcctcagtcgaatcggcaacccaggaggtgggcgcagcgagttcgggggagtggagcggggacgccatacgccgacgtttccttgatttctatgctgcccgtggccacaagatccttcctagctcgtcgcttgtgccagatgaccccaccgtgttcctcactatcgccgggatgcttcagttcaagcctatattccttggcaaggtgattctcataagatacatattgcattcagtagtgcaaactgcacatttttgaaaagtgacccgtaaggtcatcactaagcgtttttaataagaacattggggaaaaaaggggatcattgcacacattgagctagcatttacaagacgttgaagtgcacatgagttttccacttgcgggaagcaaaagctacgcaagtgacaagtcttgtggcatgatctttgcacgatctcagaatcagaaacaaatttgcgaaatgacaacagtaagaggggctaatagtacgtagcaagtgaattaacatgggtgtctatatgtactaatgtgaatactaactttaatatttcagttaataagtgaagttctttagttgtccaatgttcattggtaatcttgatgcttatgtggaagaatccgttatcgaatataatcgttggctcgataatggtagtaaatagtaacacaatgagtattgctttgttctttatagatcatgtcacagcaaactatgttgcaacatgcatctgtttcttgtaacttcgttctgaagtccttatattgctattcctaggaacctaggcgtgtaccgtgtgctactacctcccagaaatgcatacggacaaatgacattgaaaatgtggggcgtacgagccggcatcaaaccttctttgagatgcttgggaacttcagctttggtgattacttcaagaaggaagcaatcacatgggcatgggagctaacaaccaaggagtatgaacaatttccttactccctatggagcatgatctctgtattggtaaatcttaagctgttcatctgaaaagtttgccatgtcaccatgaatattacattcatgcacacatgcctctaagtccactctcaagaaaaaaagggggaaaaacttccggacatttagggttgttcaaatgcttatgtcgatccccagagtattgaacagctcttctttcatctgaaattttatactttgtttgtacccattaatgctattaaaaatttagattatttgaggattatcagtattcctgcaattgtctttgatttctttgtcaatgctaatgacttgcatattgactttatctttccaaccatcagcatgctgttttagtgtatactactttactaggcttgatattcttgcatgcttttgttgctttaattctgcagctttcattttttgttatttatttaggtttgggttacccccagaaagactatggattagtgtatttcaagatgatgatgaagcattttccatttggcacaatgaggtcagttatcaaaaacctgcatgtttctgcaatcttgaagagctttgtttatttttggtttacacaacaatggaacatttattacattttagctgcatctcagagttactcttcatggttagctagaccatacaatatgcttactcactagcaaaataattatggtcaagaaaaacttatttctttaataacttattaatagtaaaagtatatagatctgatgttattgtacatcagttatttacagtgtcaaaatatgcttattctgttcaagaggtgatgggattgtatatggaaatatattgactgacacataaacacattgtcttaaaataatgttctgtgcctgactaagtacttcataagcttgtagtatgggtgagtgattttatatctatttattttatcaaggttggagtaccaaaggagcgaataaagagattgggcgaggatgataacttttggactagtggtgcaactggaccctgtggcccatgttctgaaatttactatgatttctatcctgagagaggatcctcagatgcggtatgtaaagactgtggtattactagttaagaaattcaaagcgccttttccattgtgtatgcaagatattcaccattaactgaaactagtgatatacatatagttgtatgcaggatttgggtgatgatagtcgattcatcgaattctacaatcttgtcttcatgcaatacaacaaaaaggatgacggatctcttgaaccattgaaacaaaagaacattgatacagggatgggccttgagcgtatggcacgtattcttcaaaaggtattgcctaccatctatttcttaaaacaaatgaatgtcatccttactaggtttaagctactctcttactcaattgtctatcataggttccaaacaactatgagacagacttgattttcccaattattgaaaaggcagcaagcatggcattagtgtcgtacaccacagctgatgatgctatgaagacaaatcttaaagtatgctattcaggaccttttactagtttcatcataaataaggaggttacccataacctttgctctttctttttctgttattccagataattggggatcacatgagagcagttgtttatctcatatcagatggagtcattccctcaaatattgggagaggatatgttgtccgaaggcttataagaagagtagttcgaactggtagactgataggtataagaggtgatgggcatggaaattcagaaggtgcctttttaccttcactagctgaggtagcaatcagtcttagcactgagatagatccggatgttgaatctagaaggaaatcaattcttggagaacttcaaagggaagaactgcgatttgtgcagactttggaaagaggtgaaaaattattggacgaacttctggatgaggcattatcaagtgctggtaataatggtggtaaaccttgtctatctggaaaagatgttttccttttgtatgatacatatggttttccagtagagattacagctgaaatatcaggtgaacgaggtgtaattgttgacatgaagggatttgatatggaaatggaaaaccaaaggaaacaatctcaggctgctcataatgtagttaaactttctgtaggaaatgagactgagattgtcaagagtatccccgatactgaatttctggggtacgactctctttctgccactgctgttgttaaaggtcttttagttaatggaaactcagtgaatgtagtttcagaaggttctgatgtagaaatatttttagatcggacaccattttatgctgaatcaggtggtcaagtgggagataatggtttcttgtatgtctatggagaagaagatgcaaaacagaaggcagtcatagaaatcaatgacgtccaaaaatccctggggaatatctttgttcacaaaggcacaattaaacaggggtccgtagaagttgggaaggaaatcgatgctgctgttgatgcaaaattgaggcagggggctaaggtatgaaattgtggaggcatcggattgttttttctggttgacatttttttttttgttttcaagattcaatgataatttgttttatttggattcacattaacttagcttatgtatttatttacctgacgaggtttctcgagattctgaaaaatctatctgatcagactactttaaagagcaaaataggaacatttgcaatagctaatttcttgtgttccatgactaattacagcttagattgttggcatttgaaacatgcaaatgtggttagaatataggttcataggctttattgcttccattatcttggttcttactttcatatgctatctttgttttgtactaggcccatcatactgcaacacatctcctacaatctgctcttaaaagtatcattggttcagaaacatcacaggcaggatcccttgtggcatttgaccgtctccgatttgacttcaatttccaccgccccctttctgaagaggaattgatgaaaattgaatcacttgtaaaccaatgggttagcagtgctactcatcttgagacaaaagtgatggatctgcaagatgcaaaaaatgctggtgcaattgcaatgtttggagagaaatatggcgagcaggttagtctgtatatatagatgtttttttcttcaaaaatagttagtgccctggcctctggaaattagtatgttgcagtgacatgcctgagtagggaagtgccaagtcatgaaagtttgtgcagatgaaattccgaacttgaaggagcatagaacaatgaaaatgcatgttataccatagtagcatagccaatagtttaacctcaataagactttttttttgttctgataggtcagagttgtagaggtccctggggtgtctatggaactctgtggtggaactcatgtgagtaacaccgctgagatccgtggtttcaagattatctcagagcagggaatagcttctggagtcagaaggattgaggctgttgcaggtgatgcatttgttgagtatgtttgtgcccgtgacaactatatgcggtgcttgtgctcatcccttaaggtatgatggtgctcatgctgttgcccttctgatttgtcttgtgtttgtttgtaagtttggttgctatactttgtgaatctatgatcgtttacttctttgccccatgttcaaatagacaaacatgcatgcttctaactactgctaatcataggcacatgtgttcagatacagcatgttggcaacaaattttactctgtaacttgattatagacatcatgttaatcacaagcaaaatgccaacagcatgctcatcctgtcatccatgcctaggatgatcaattcttgcaacaacaaactatgctgattatgtcttccatttgtgtttttcaattgatgtccatctactcaaaataactttgcaggtcaaggctgaagatgtgaatggcagagtagaaacaattcttgaagagctaagaacaaccagaaacgaagtatcatctctacgcagcaaaatcgcggtgctcaaagcagcatccctcgcaaataaagctacaactatcgataacacgaggtatgacgcctccgctttcgccattttcacatccagtcttcatgatcatcacttgctagttgctactagaaaaccaataacatttggcagttgacaatttgacataagcaacaaatccatcccaaaaat

SEQ ID NO: 80590 - DNA, 16677 bp, Oryza sativa
tcacagtggcagtaacattgttcgtcaaccaagaataggaaattgttgtttgggatttttttctgcccggttgcgtacgtactttgcagaaaaccagcttgtaccatttgtaactaccccgtcccaaaaaaaactcaacagagcaagtttaataatatagtccactactagctataaatcatctatatacaatgtaatagtcaattcatactatagttacttaatatactattaatacatggtcctatctatcatatacatattacgtcttggagttcgtgctacagctggctacagatttgtagcccgctgctcttctctctcttcctttatctctttaaaatatatttatagctggcttatagcccgctattgcaccttctcttataggtttgagttttttttttagatggagggagtagtgacaaattaatgttactatggcccttatcagcgcagcttctggctagcttttggaagaagaacgagaaagaatgcaaatctctcttttttttttctcaaatatgcatgggagctgctgaggaggggtgttcaagacgcaattacaaataacagagaaaacaaaggtcaaaaagcaaacacacaaaaaacaaacagaatacaacgaacaaagcatcccaagaagacccttgtaatgttctactccctccgtcccataaaaaactaatctagactgtgtttagttccacgtcaaaattgaaagtttgaagaaattggaatgatatgacggaaaagttggaagtttgtgtgtgtaggaaagttcgatgtgacggaatagttagaagtttgaagaaaaaagttggaatctaaacagggccctagtactggatgtgacacattctagtaatacaaatatggacacatctctgtccagattcattgtactagaatatgtcacattcagtcctagattcatttttttgaatggagggagtaactctcacttaggttgtgctttttttgttgggaaccctcccttcgcacgtaaacggagcgatggattaacgcataattaagtaagtattagctataaaatattgaaaatagattactatgtttttttaaagcaactttcctatagaaactttttttaaaaaacacactgtttaacagtttgaaaaatgaacacgcgaaaaacaagagaagtgagttgagaacttaggctaagccttagccgggatcagtaatcagtgaaagtcccttgggccttggccttggccaatctccaaagacatgcaagaaccaagcaagctgaaatacttagggaagcctcgaaggcaaatttcttgaagggctggtttctccaataggcttctaaaaaaaaggtcatttgtgaagattatgatgttttcattaaactcttgttagatatagtagtgagcacatatggttgtgaactcattcacaaagacttaagtctcacctttctttcagcatgtgtgagacaaaataagtatttatctctctctattttttattatttctttcccgacaatatttttttataaaaaaagttgacacttcttaatcaaccttattccgcttcctcgccctgcttgagctctactatcgttgtcaccactgtcatcttaagctcctccatggcatacctctagatcccaatcatgatattggtatccatgttgtggccgccttcaccttgaggtcttggtcgctactatctctactttgagctatggctatcgttgttgccttgagctcatgagtagtgccatgttgaagttgtagtcattatcaccgtctcgagctcatcattgtggttgccattactgcatgaagctcctcccttttaccaactatacatcctagttgctattttcatcgagccacctctaggagcttgttgccaccatgttttgttggactatctccaagagggatgaggctcccctgacgttgtacggtttgcagttgtgctactgatatgtgggcccacatattagtgactcatctgcaaactgcacaacatcagaggatctatttccctccaagagctagccgttgctaattctactccaacaccacatcaccacctccttctacggtttctattcacaccattgattgtggatttgcacattgattcctaagcaaatggaaaagataaaggatgctatatgtagttgttgatatggttttacacttcaataactagactgttaaacaaaccagataatataaatagtagcttcttttggaatctaggtaaacatgataggacaatgtaggactaatttagactataataatttcataagaaaacaaaactatcaatttcccgcaagaatggagaaaaatttcccatgttctaaacaagtctaataagcatgtacaactgctatttatttatctcgttccactcccttggcctgcttatgagctcctagtcatcgtatctctacattgagctatagccacaatcaacattgccaccttaagctcgttgatggcaccatagcatccacctaagctttggtcactatcatcgttcctatctttagcttcttgacaacaccacctctaggtatcaatattgtcacggcctcaatctctgttgtagctacctccactttgagcttataagcgctaccgtccaattccagatcctaatcattatccatgccttgagtagccacatctctagatcaaactcctccattgctcctctagagtctagatcctagttgagttctcgttatccacttctcgaagttcgttgcaacatggtcagttggtcatcaaaatgcctccaagtgctttccattgcttcctctgccacaatgccacctccctatgtggattccattgcctaaagatttgatcacattgattgttgatttgggcgttaattgatattgatattatatgtagctattgatattgtttcacgtttcgatggctagtgtactaataaataatcagattctaagaaaaatatcttatccataataccattcaaattgcactatataaaactaatttagagctttacaatacaaaagttacgtaaaactaccgttccgaaccgataaattttcctgcgttctaaataggtcttaaaaaaaggagtttaaagaaaaaaatataacaataaaccaacacgaaatttggctacgatttacggtcaattactagttaccattccttgcaattttcaccagctagcggtactcccaaattcccccccatttcgcgctcggctccgttgcgcccgcgctccaaaaatcccgaaccggtggcgcgtactacccaacgacccgcaccacacctatcacaccgacacgcgggccccatccgtcaccaaccgacaccgacccgagccgcacccgcgcgcgggggacggacggaagcgttttgaaaaacatcgccgccgcccgcgcgccgccaccaaaaaaaggaaaaaaaaatcgcgcataaatcatttccccccccccccctccacaaccaaatctctcctcccgctcgccgaaaccctcgccgtcgccgcgccatggccgccgccgccgatgctcccccgcctcctccggaggtcgccccgcccgcgcccgcgcccgcccccgcgccggcgccatatcagccgccgcggctggcggtggccgacggagcgggaggtggcggcggcggcggcgggaagccgtgcaggcaccacgcgtacagccgcaagcagaagtcgctcggcctcctctgcaccaagtaaacagctaacaaccctccccctcccctccgcgcagcttcgcgcaaccgctatagctttctcgaggttgatttggctggccctccctggtgtgtttggtttgctagcttcgtggcgctgtacgaccgggaggacgtggagtcggtggggctggacgacgcggcgaggcggctgggcgtcgagaggcgccggatctacgacatcgtcaacgtgctcgagagcatcggggtcaggaaaattttttcatctcctcgcctcgtctccctttcttggatttgaggagcgatcttgttctgcgttcgctaaacatttcttggccggtcgtgcgcagatgctcgtgaggagggccaagaatcggtatacgtggatcggcttcggtggagtccctgcggcgctcgcgaaactcaaggttaggaggatccgcatattctgttcttaccatagtgtcattgtatgctttgtgaggcgtaatcagatcggaatttcgatgtatttattgaattttctgttgtttcggtttggtcaggagatgtcactgagggcggtgtcaagcgtggcgtcaccgtcgctggatgaaacatctgctgctaatgttagatttattctctcctctttgctagctcttggtattgttacaaatcgacgaaatgattagcacttgtactgacaaaagtggcacattttgggttttgtgaattatgattataaaaggtctcggatgatgaggatgatgacaagttagatgatgctgagggcgatgcggagagcgagaagctcagcctcagccagtccattgacaatccttctgataagcctgatgcacccccttgcaagcttcgatccggtatagttggttaatcgcttttcttgctatctcaccgtgcctgttggaacacatggtttgtactgactggttgttgtattagcagagcataggaaggagaagtcccttgggctgctcactcagaattttgtcaagctcttcctcaccatggaggtaagcagcactggatttgttcctcaactgtttgattaagttggatgtcctttgtggttaattttagcggaatttgtatttgattcagattgagacgatctcacttgatgaagccgcaaagcggctccttggagagggacatgcggcgaacaatatgagaagtaattgttcacatttcctatttataattccaaactgacagtagtttttactatccaactggaactcacaatgattctgatgttcttgatacagccaaagttcggcgattgtacgatattgccaatgtgctgtcttctttgaatcttattgagaaggtataccctcaaaccgcattcgatttcagttgaacctaagtgattttttcttaacttggtatcttctgctgcttctttcagacacaacaggcggactcaagaaaacctgcattccggtggctgggccaggcaaaacggaatgaaggcgtcacggttgctttacccccaaccaagacgttgcctaacaagagagcatttggtactgatctgactaacattgacaataagaggggtaagttggactccacaatggagaacagaggcaagcccacgcaggatggtggcaacctattcaataatttgcagaggcaattagggcaagagaacaggagcgattttgtttatggccccttccaccctgctgttgcaaggaaacaagaacatggtaatcgcacagtacaagagaaggagaggaagagcattcaagactgggagaaccttgcttcttctttccgtccgcaatatcaaaatccaggtgagctccaactctctctatatatctatatcgccaaacgaatgctgtttcaagaacccattttgcattagctattagtccatctgtctagctagcatttttggttgctctctacataccatgtgatatgtcagtgctacacaaacgtcaagaagcaaatgaaacctggaaattactgagtgctcgtggattgttgtgaacaattgaagggcttcttaggttcatacatgtgtcatcagttacaagtttaaccccttcaacccttagttgatatacacttgtagggtagagctcctttacctgtgccttgcgcatctgctttactcaacacatcgtttcctctagttcacttgtttgccagcatacattctgtatttgaattccttgaaatcaaatcaaaacatcaaagactggtggatagaagaccatgtaccgacgtttaatagtagttctgaacattttgtatatggcatgttgataagtttagtatcattcggtcttctcaagtagttcaccttctgctagtgatctatcttctattatctatctatctatctattatatactaaaagtccattaaacttcctacaaacgctctcaagccgccacgtggcgttcctacaaacactcctaaaccgccacgtggcaatgtctaatcgcaccgtcgattttcacttaaatcggtggacccgataatttagaccattagattagattagatgtattttatttaataaaaggaaatgaataccatactgttggccggaaaaaaaacaaaagcataattactccttaaatacgtacgactacaaaaacaatcaagcttacataatgttcatcgaagaaaaaaaagacctacgcacagacttacttaaaaaaaaagccaaaagcaacataagtacatagtaccattgaaaaaatataaaaacaacaaagccaaaaaaaatatacgtacgtaataccattgaaaaaaaaaattgatgacctttaaaatataattttctattatttaaagataaaatatatcactctataaatttaagcaaatattatagttaattttcacttaaattagtgaacccaatagtttagaccgttagattagatgtattttattaaactaataccttattactctgtgtatgggagaattatataactattggctagaaaaagacaaaagaaaaaacataagtagcctttctacaaatgctactaaatcgacatgtggcatcctataaacgctcctaagccgccacgtggcactctaatagttaaagatttttttttaaaaaagcaaaacatctaaccgttaattttcattaaatttggtggacccattatttgtaacctttagatttatctataaaaaaaatctccttctaatatctgggcccacctgggcctgttggcatgtacgtacctacatagtacctacatacgtatgtttcttacgtctactccccctccctcttttttacctatttcttttcctactttcacgcttttagaaaagcaaaaattctatgttaaacaattaagcaaatgtaacatctaaatcataaaactaatatttgatctgcttatgtcttttgattattttacatttaaaaactcatatccactttaattcaattttgagaagaaatatgtaacattaattaggggtacatcttctgacttttgcatgccacttaagaaattatacaattataaaaaataatgatatatattttatcatcgtacaaaacttcataaaaaataatagatataatataagtaaaatgaacataactttgggtaatattaaaaagaattagacccccattctaacacaacaaaaagtcaaaataacagttagattattagatttgtagtgtgctccttacaaaaaaaattatttgcagtgttcatattttaatatcaactatgaatatattgtaggtacagacgagtaaaaaagattgattttaatcaatcattaaagcttttgttttatttttagttaataaagtaatagcagctaaaacactataactgataataattattataattatatgcatacatactctctccccttcgactatctcttcctctctcccattcaattatttggtcttctaaattttaactgattaatcaaaatgattaataattagaaaactaaataattaaattttttaagttatatctaacccacttttagtttacttgaatttgtttttttataattaaatatataattcaagatctgtattacccatattttatgctattaaaataaaagtttgtcattttaacatatacccctatcctttacaagtacctaaatagaaaaaatatcagaacattataaaatataataataagtattatataaccttaaatcattgtatatcctctgcaatgcacttaagatgtcatgtgttacatcttaaataaaaataaaaactagaaattataggaaaaaaacatctgactatcagttttcacttaaataggtggatccattattttaaaacaattgatatacttttagaacaatcctatccctccatgtgttagtcggatattagaaattatgagaaaaaaatggatcatcggtttcacttcaattattttaaaaaggaaaaagtatgaattacaccaccgaactatcgcgatcgaccaaattaaacccctaaacccaaaaaccaaacatcactcaccctgacctttcaatactttacaaattaccccctcgacccaatccagagcaattttgtcctacatggcgtacgcatgacaatccagtcaatattttctttttttaatggtgggcccaccagtcatatatactttctcacctcctctttcccctcgtcccccctctctctccatctctctcggtgcacatggcggcgcgtggcgcgcggtcggtcggcggcaacgcacggcccatgtttaagtgcttagatgttaatgaccttccatctatgctatatcatggcattacgagtttctcaatatattattacatatataaaacacatagttggataaaaacttatatatgctactattaactttaaatttaggactcatgttgactaggtatttttttagaaaaaacactgtagatcacatatagtaatagggaagcgagctgtacaatatgtatatctcctacatacttattgacacggttttttttctagaaaatgaagaattagtgataatcgcttatagtaataaagtaaatattatatagttcaaaccttacaaatatcatgtaaaaaaattatatgagcaatgcagatgaagaaaatttataaagaaattgtactttttcaagtacgaaatgtgtctcgatatccatcttacaagttagtcaaacctatcctactttgcatgcctgcgcaatgcgcgggctatcttcctagttctattaaatgtactgttaaagagaaggttctgttgtaacaaacttaacataatttcttccattttctaatgcaggactgaacgatctttttggccactacatggaagcatggaggtcatggtactcggatctcaggcgagacagagcatcataaaaccagattcaggccggtccgttgtaaacaaaattcttgtaggcagataaactcatttgttgatgcatggttagggatttttgagttatacaagatgtcacaaaaacaaaggctagtgctggcctttgattgattgtatttactcagtgcaagaaattggaaagtcgtttcgtcaataatactaggatacctgattgtcgatttgtttaacgagtcacctgctgctggcaacgcattctttgaatttgttccctcttttcttttcgtcgttccctttgtgatcaggtgtcaggaccgggcgctccaattaatagactgttaattcgttaacagaaaagagaatcagactaaggttagaaacttcttttatgcatgtaaacgagatgacttaggtggtgtttaggaaggcacgaaagcataagtcccttccatagagactaaaatttttatgagtttagtccctcctttccaaacaccaccttattactttcttggatgagaatgtaagtattttttatataggcatgggtacttaaaaaaaaaaaggtagatagagataattagagaatgattgcgattggagattggagaagaaaatgtaagtgaagagaataattgtgatttgtttagaagaaatgatatgtggagaaatagctttattttagaacagattagtgtgctacaaagagttactttttttagtggaaactattagcaaaatttattcaactaggatatccagcttagtcatccgtcaaacagaaaaaaaaaagtttcggaggaacctaaaccaaagtcgtaaagcaccttctttagctagcctatgagcaactttatttgttgaccgccaaatagttacattttgcgatgtaggtagtagcacataattaattaattattattttaaaaacttcaaaataaatcaatacaattttaaagaaaaaagtattttttttaaaaaaaaacacaccgtttaaaaattgtgcccatgaagaaaaagggagtagaagttgacaacacgtactaagcttcccagcaagagtcagctggaatgcggtcaatgtgacaggaccataaataaagaggttacataattgcatttgtgttttctgctgaaattgttttccatgtcgataatatatacaatgtatatttctttccatgtagcaaaattcggtgcaaccaatcggcatcagcagtgcaaaggcagttcattccccttgttcctgactataccatcatgtaggtacagtaatttcacatgatatagacaatgagtatagagaatcaagcagggtaatgtaacactcatcaatcatcagacaaatagtattagaacatttgactagtcattgaccacaaacacatatggtaacttccaacaagaggcatttgatgtcctccgatttatggatgagacaacatatgtaatgcttgaaatgggtaaaatccattaaatcaatccgcaatagtaactaatagcagagcaatcaacaaccaactaaattccttcatcattttgttggctcagtgaagaacttgttgatagctggcatgatctcaggggtcttgtcgcgcacatagtttcttagcccatgctctgcgtagcgccttccctcctcatggttctcgagcactccagctgccctccctaccttgttaaccctgaataaaagcattttattatttcaggcttacacttcattgttgacaaaataagcatcagccgccgagggttcgaattatcaccataatcaatgttacccttgaaacccaagggtttaattatccatcaaaattcactatataagacaatggttaatacactacgacttcctgtctatgacacaataagatttaagcactaataaatcctgcttggtttaaactggaattgaattatgcttggagccggtttggagcagcgaaagattaacaccaacatgtcatgagttgaacatactaataacacataagctcatagtgaagacagattccacacacacgccgacacgaaatacattgtgtctagccatgttagcaactctttggtctatgctatcatgcccaagacgcatagaaatttacaatatacttatcatcataatcaccacgctttctgtaaaagacattcttaacgtcatgacaccgtaccaactactccacctctataaaacaaacaagaaaaaaaatatgtaaagagtacattttcccaagcaaattgacacatggcaagctcatccttatgtttctctaccagctcaggtacaggtttcttaaattgtctaataacaaaccctaattaaacaaaaaaaaaaggacacatcacacatgatatacccactccttggctccttgccccgtaaaatactaaaattcaccatcacaaaatttcacctgagaaatactagcatgtcaatcaatcaagcaaggtaagtcaacgctcagcgccaggtaataggctcaaatcgtaaagaaatcgatgacggtaagctacagtaagtccaccactagaacaggcttatcaagcacagtagatctctcctccaacgagcaaagcaaaaaataaaaataaataaaaataaaaaatcaagcaagcaagcaagcaaagagggcaggaacacgcagtggcggagatccggacctgacttcggggttgccggtgatgttgcggaagagctggaagccgcagatgccgacggccacgcccatcgccgcgaacagcgggtacacctgagacacgcgcgcctccgggtgagcgagcgagcagctaagcgcaaagagcaagaagagaggagtagacgcgtgtgggagcttggctcacctccggtcggacccagcggctggaggccatcgtcggcgtcggcggcggcggagagagagagagaggggaaagtggaaggcgacggtaggagagagagagaggaagtggacggagtgggtgcagagcggcttttatcacagtgacgcagtgtggttcgcttggcgagtttggaggtgacctgtatggaatgacgaaaatgcccctcacccgtttcgtttgggggctttcttcctttgctgctgcggtgctgcccactgttttccatgaagctgtgagcccggtgtaccaccgtcggcgtgctatataatcaaaccaaacctacgatcaacttaatatctattgtatcttctcgctttaaatttcaattcaactcaccttttatggatctaccgcatgtaattgaatccagctatcataatagatgtgtaaaataccttggtatagtggaatatgcttgtggttgcagaggaatgctccggtgcaatctacttgcagtattctactccaagtagaattgatctcgaccgtttattttaaagggcaggtaagtaatctcctaatattgtttaggggtaattttggcatggattattttcttctgttcgatcgcatcaggtcggactccgcatcgcatcgcatcaggtccgactccgttgcacgcagtctcgtcgctattcctcccccggcgtcgccgccttgtccaccccctccgtcgccgtccgtatcccccgtcctctcagtcgccgccttgtccgcctcctcagtcgccgtctgcctcccccgccctcgctgccttctccgctccctccgtccccgtacgtttcccctgccctctccgtcgccgtccgttggccccgccctctccacctccggcaccgttggcgtctcctcccccttcagtgcccttgcctcctccgtcgtcttcctaccgcgcgtggcatcaggtcggaggcaggcaccggcaggcggcggcgcggccggcagctagtcctcccggcaagcggcgtcgcggccggtggcgcggcgcgtcgcatctgtccgacgcaagcaccggcaagcggcggcgcggtgaaatcctcaggtgtccactcctcccccctcccccaccacctgactttctgttccccttcctctcctcagtgttgaacttgtctgaatttttcctctacaaatacatatacttacttgtaaatgactgtgtatactagcttgtaactatactagagaatctacatttgcggatgttaaattgaataggagatttattaaatcgattttgtatgttgagttgtaagcatgaacgataaacctgaacaataattttggtcttaagctgcaaatgaaatacacctgtcacttgaaattccactcaaaacagtttgctgaaattgatgtgttactaatataagtccagcattaaacctcagcaaaggtggcaagttaaatcatatcttgtgcaattgatctttgatcttttctaccaaatgattgccttgtcaactggttaaagcatccagcattttctgctagttcatcagtagtactaatagtacattgaattaatttattagtgcatgccttagttcttttatcatacatacaaaatttgcagccattgtgggggaactgtagtaattgttctaaactcaatagtttagagtggcattgtgagatggatactcttttatagcagattaaacatgtcttcctgaatttggccatctctgcatctgcattacactctgaaactgaggcacttaatttattttagatgtgtacagaggcaaataagctgaaatgctttagaactataaaagaattctttgtcagaaacattacagaaatacggtattgagcttgatttaatccattttcagaaaattacagaattgagctgcctcctgtgtcctaacttgacttgttgctgcttggtttctgaaaataggtcctggatgatgatcatggagctgtggtttaccctgtcaggaggtcagtagctcctcctgcagttcagcgttggggcgacatccctgggcagcataactgcggcgcacctggttgccctgagatgattccggcgcaagcacagttctgttgtttgcgttgcaaggctgcagttcattgctgcttatttatttttaaaggagtgtaatgaacaaataaatttagttgcctttttaaatattaggattaaatgatctacaactggaatggtgacttcattttgtgatgcttgtgtgatgctttaatggtgctgtttgctggaatgatgctattgttgatgctggaatgatactgctactattggaaattgtgctgctgctagaactgcactgttgttgctggaatgaaactgaattgctgttgttggaatgaaactgaactgctggtgctgctgaaactgtaatgctgctgctgctgctgctgctgaaactggttgttttttcatgcagagcctaccagatcaatgagaatgcacatgctgctggaggactcattctgtccatatttttctagttccaacttcgaattgcgacagctctattcggagtctcgaagccaccaaaaaggattggtggtgggagatttggcatcctcagccatcagatctccagaagatgctgattcaggagcgaagcaaaccataggaacagtttcagggggaacatgtcgtccccaagaaagaatgatactgacacatcattttgttctccgtagcatccgattttgatacaacattaacttacacatttgacagtttgacaggatgtaagatgttgcattgagcagcttctttacgaaagattttgcagtgcagaagcacaaaggtgcttcgtcgtggtacgagatgtttctttaaactcgcagaaagtacttatcataaaaaaagcatggtttttcaatcgaccgcgcgcatatattatagcagaacgttattttttttacaaaagaaagaagaagtccccgcatctgacatcgttgaataaccagattgagtatcatttaataaataatagatagagtttaatattaaaaaatttaacacctagcttattcgaaatgaacatctgacaagacaaactaagaatctccaaaataaaacatctcaatgataaatgaacatcttagaatttaatgaaagaatatcctcccaatgcaaagctgaacatcttagatttacttcggagatggcctgtgcatgattccgaaatttgttgggatggagagatgtaaagaatcgctgctagctttcttctgtattcatcgatgtcttcctgcatagatcacaactatatgttatctttcttattttctacaaatgtccttctgtcataatcaaactttttgtttgctatgatgggcctaccatccagtccgcgtactcatatttcatatttgtatccatttgagaaggagcggtatatgaaaccttacgcttcggggtgactcagggcagtaagcagtcaacgtcaccgacgtgcatctgcttcaacgtcgcacctgaacaccgagaacccctttgccggcatgtggttcagagtaagtaagtaaaaatgctgttaacattaaccgttctgttctgaaataaacaatgtatttacttaaccaaaacgagcaatataattggtgaaaaggcaaccaaagttcaaaggaaagagacaccacacatcatctactcgtcattaattgatggtggcataacaatgccaatgcaaatatagccactagtaacatccacccattacaaagcccccacaacaggtgaacattagtttcattcagaaagatgacaactttagacatcataattcaatagcacaacattgcgcgccaaatccaattggtacgacgaagcagccacacgtaccttccaagatggcttcgcgcacttgctcttgctccttgcaaataccgaatgctcccaccagcatcccaatgccatggcacctcggagcacccagtaagcatgcctctctcgggatcgccaacgccatggtggagttgttcagatatagatggatcatctcatccttcatgctacagattaataggaaacagtagccttggaaatcaaatcaaaatttaagaaaaacaaacaacttgagattgaaagttgaggggcagcattaggggagcgcatcttactgcaaatttccgggcattaccttccgctattctccaatggcgagtcttcctcctgctccgaaggaggtgcttgaggcagcatggggacgaaggggagccaggcgtgcattgccattggatccagaggctgcgtcctccgcttgtgggcgatggattgggggctctcccacgcggctgcaggagcgatggcgggcggagatggacggggctagagccgagcgtgggggaggaggccgacggcgagtaaggggatagcgaggaggaggaaggctcggcggcggcgagtggcacggtgctggggtctgaggtggaactcgccacaaggtgtgccgacgcgggtagcggcgggatagggcggagctctggagatcccagacggagatgcgggatcgccgagaggagtggagaagggggaggcggttgatggggaggaggacgtggcggcggtggcgggtggaggtgacgcggcggagagggctggtggcgaagagaacgtggcggcagtgacgggtggaggcgcgacgacgtgaggcgactcgctggagaagagggcgggggacgaggacggcgaccgagggggctcacaaggcggcgtggagac

SEQ ID NO: 80591 - DNA, 55642 bp, Oryza sativa
agggattcggcccatcgaacccgggggaggcaaactagacttttgggagggatttgatttggaaggatttggattcggaaatgaacttgacgatagatcggggattgagatattgagatggcacggacactagacaacaagcaaagaaacaaatttcgcaattagggtttttaggagataattttcccgctaggcgccacgacggaacaggcgctacaatagcttgagctctagaggaagcacagctagggtttcccaggagctcaagatctcttgtaagaactccactataattcctcgcacaggagtaggttgttacgcttcccagcggcccgaacctgtataatccctcatcttccacacatattcgcaagcgatctagtagccagaccctaagcgaagatacgctcttgatcatcgcgccttatcccccggccgaactcacaaagggggggtctcacgacctcccgctagagaggatcactcctcgacacccttgtttcatattataagtcgtttaatttttttactagtcaaactttgttagatttgaccaaatttataaacaaaatttagtaacacttaaaatattaaattagtttcattaaatctaacattgaatatattttgataatatgtatgatttgtgttgaaaatactgctatatttttctataaatttggtcaaagttaaagaagtttgacttgaaaaagtcaaatgatttataatatgaaatcgaggtagtaatatgtttaactacacatgtgttgcatgcaatgatttccataatatgtacaaacttgaaaaggactatttggagtgggaaggattgggccagttgttagtcgggatcagggtttcccaaaccgccggggacggggttaccgcgccccggcggtaagcacggttaccgcgcagttaccgcggtaaccgtgaaaaaccgttcaaaatttatcaaaaattcaaattattttttaaatttatttaaatttaaggaggttaccgcggtatttatattactgtatcccgcggtaagcctggtaaccgtggtaaccacgcggttaccggctgtaaggtgaaccctggctgggatatccttatctcatgaggaggatatgatcctatggcccctggaaaaaaacagaagctattctacaaaatctttgtatgatatgctctcttttcattgtgttagggaccttagagggatgaaaaaaaaaacacaaatattaggaaaatacctaatattaaataaatagaaagggtgagacttcgaacactggccggctagcccaccatcttgtggagctagctaaaagatcccttggcgtttctctaaccttagagggatggacatatggaaatcgccaatttcactgaaagtgaatcactttgtgtgtcttgcttgcttagatagaattcaaactaaaaagaactaggaaggctctgagagatgtgttgtatgtaatgaggtggaaactgttgatcacataatctttgcttatcctattaatctcaatttcaaattattgtcctagtttaccgaccgtttatgataatcgaattttacaaacgaacatattattcacttgtcagcatggacatagtcctcgaataggtgttttcgactaagttggcgagccagcgggaggcagtgaagcacagataaagcaaacatatataagtgctctcttatacagccatgtcatcctaccctgaatcatttttctcaaaaattttgttatctcagctttgtatctcctttaatagacaaattctcaattggtcagtaggggaacgaaagaatgcacggctagcttctttgataattcagtattcaacaagaaattctagaatcatatatattctttttttttcaattcgtgtttatcgagatttatatcatagcgcaatgtcaccagggtaaaccatgagatttaatttcttgaacacatcgatcatttattagcaactatggttggaaatttacaaatagacttcaataattgtgatctccttacgttaggctgctttttttgtttttctagtgttctattcttttagatttacactacgttcatgaaaactactatataataattggctgtaactcttttgagtaaagaccgagatattatattccattatcttaaaaaaaaattagcaactacgagaagagacacacaccaatatatatcacttgtcagcgaggacatagtcctcgaaatagaaggtcttctcgatgaagccggcgagccagcgggaggcggcgaagcacagcaccgccgcagccacgacggcggctctctgaacacccgacgtgaccaccgtccccttgccggcggcgaggaacccgacgacggcgaccgaagccacctgcagggcgacctccagagctctcatccacttcagtgcagcgctgcagctcgtgcactgcatgacatgcgaccagtacctgttcatatctattttagattcaagaaattttacggtccttaaaaagtatctccaggtacaagtacaacctttagattaacactgaattctcctatggaaattctatatgttttaggtcgatcagtgtgactgtgtgaagatcagcagactagcttgttaatttacctctcgtagacctcaactctggtagaagctggtggcagctgattaaccattggggttaaccagccaacctgattgttacagtacttcttgaaccagtttctgaaggcgatgatcaagttgtcagatgatgtgggcacgtagcatgctttatgccagttatcaaggccaaacgcggcgtaattacgctcctgcagaagcatatatattgttcaggtcaagtaagatctgagataatcgattgcatccatgcaaccacatacatagctcgaatcattcagtttgagctgaaaagagaattaaccggtcacctcaatatgaaggacagacgagtctgaatccaggacttggttcgtcttaatatgcaaccaccaacgtggtatcatcttgtcgaaccagccatcaagattatacccgttcgcccagatgaccctgcatcttcccggagacaccgggatgcagaagaacactgtcccctgacctcaggctgcttcttgttgttggtgttgttgttgtcctgatcaacctgcagctagcacaaagtgtaatcttttcaacatgattctttgagcttgtaacagtggctgcaatatggcgaagtgatcagaggcagataccactggcttagcacgaaatggcgagcctatgagagtaaccggcgcgatgaacttgaagtagccccagttctcctctgggttggaatggaaccctgcgatgttgagctcctctatattcatcttgatcgggaggccaccttcctggtcaaattcaactgtggagaggagatcaaatgtttcagaatcagtaacgcagcttagcattgagaaattgagattaacacggcattggctcaattaacagatcgtgtcaacgcagatgatgaggaacatatctgcctatatcttcctccctggggacatgagggaattggcccctgtgcgcgtagggaacgtgagcagggtccatgaaattctccaccaacaactcgtatctgcattggttcgattcggatttcagaatccatggcacatacatacatacatacatacatacatacatacatacatacatacatacatacatacatacatacatatacacacacacacacacacacacacacacatacacacacatacatcgaggcatcgagctgcttgtgaatagcttgtaaataatttctgtacccgtataagaggtctctgacgccggagttgatgacggacgacgggtcgtcgagctcccggatgtacggcggccgcttcctctgcaggatctccttgtactccggctccgatctcgggtagaaccacaggatgttgttctgcaccacgctcgggtacgacgccacgcacgccttgctattcttgtgcacctgccattagttgatccaagaactcggttaattaatcttgagaaaatgttgatgtttttttaaaaaaatttgttttacaggagggcctagggcgggggcctgggggatgaactggcaggagccgtggccatcgaagcaccagccatggtaggcgcactggaggcagcccttgccgtcgacgcgtccctcggagagcggcgcgaggcggtgcgggcacgcgtcgtccaccacgcgccactcgccgccgccgccgtcgaaccacacgacgacgctgatgcccatcaccatcttcccgtgcggcttgcgcttgtcgaggtcgcgcaccggagccaccgggtaccactggtccagccagtcgaaccgctcctcccctgccgccggcgtctccttctcatccacggctcgtgggagcggcgcctcggccgccactgccgacaccggcattgacagccgccgccgccgcgcgtcggtggggctgatccactgccggcgccatggtggtattcttggtgtgctcgggttggttacagtgtcgcggaagggaagcgaaaggcgggtgagcgagagcaggtggagggagacaggagccatggatgattcggagtgtggagtgtttagttaatacacgtgagtaggaaaacagatccctgactctgtgtctgtgcagtgtgcagtcgtgccactgacatgtaggccccatctaagatccatatatcagtgatacaactatacactgtataatttcaggggagtctcatccacggagtagtgactaagcaagacatagaccggaaacataaacgaatgcactgtatattttttcgggaaacggaaatggggacctacagcccatattgctctacacctgctacaatggttaacactggcgtagggtctatatattttttttataatactatttctgaagtagacaaacaacttttgaaagcgtgctaaacatcccaccgtagcaaattttttaaaagttgtgatagcaaaaagcttttcttactaaattcttactaacgctgataagtcatgttatgaatgcatctatattttttataatttctatatatctaaatcaaacggttgagataattgttagtacaaatttagtaagaaaaaattataacagtgctctttaagatactagcgtactactccttttcaaaatagttatctttttattcaaaatttattctaaaatatttgttactacttaatccatttatcacctctcattcaaatttccctctattttacccttaactgccactctaatcccaatcatgtatcatttaatgaaggatagtatgtcttttatttaaataaaaaaattaccaagaataacaagtatttcagatggagggctagttagttctcttaaaataattgtagattttaagccgtgtttgatgtctaactcggaatctggctgaggcaggagctgttgcctcaaccacaatgttattgtaccttacgtaacgtgcttttctttcgtttttagtaaaaaccggccagtgtttcttccgctaacccaagaaaaaaagttaatttaattataattttcatgtcattgagtgcattaaatttacgtatttttttactcatataatggctatgtgcatacgtgtccttaaatttcaagactattaccctataaggcagtagtaaggaaaacaaaaacaaaacactaccaccacacacactcacaacaactacacacgaccaagaaaagagctaacaccacatcggtcacagctagacccaacaaaggagctatagctaaatcgcccaaaatcaatccctaaaaaatgagtaccaagccagcaaggtgacaacggacgaaaaggtagtagagggagatagcgagagagaagaaatatccctttccctcgctcgaacccgtcgactcgttgccacttaccagattcgcacaaactgtctgagcacggttttggcaaaagagagtctcctagacgacatctccatggagaaaagcgatgaagagcaccaccgctatccatcgaggtctctaggagatccaaggcaaggttctcacccggcaaccccactaaggagggagagggatgtctcaacaatgccccaaagaggataaacgacgcccaaagcgtcgtagttgtcagcctcgtaaaactgggctaggcttacacctgttgcctatccctgttgacctgcaattgtagttccattgctccaccaccaaccacccaacattgttttcaattatgatctatctatcctgccaagttctacgcgagaacaacaatagcagcctatcctctatcttaaaatgttgcaatctagaatgagatttgacacatcctaaaacaacgaatctggacaaaattctatccagattcgttgtcctaggatggattaaataaaatctcattctaaattacaatatttgggatggaggtattaatatccaacatgtttgtacgattatattgacacgtactatatgcacacattttattggatttcaatgacacgatatataatccaaatttacatataattatgaattgacccatgtgacatttctctaggattattgagattgtgtcctcaccttacttgacgtgtaacattggatctatttcgttttatttccatatctcaaactcttttattgccaagtattctaactctacaaattcataattttgaagctgtgattgcatccatttataacataatgtttcaactaattgtttcgttctaatatttgaggaaatataaaattttaagaacattataatctaagttttaaatccaggaccttaggagctaaaagtgggggcattcaatgttatgacatccttaaccgtgaataacatacaatttaccattctaacccatattcaataatttaaatggtcccactcggtgacggagccaaaatggtttttaagctcagacaaactttaatataaattgtatttgctataaaagttttatcattaatttactcattaatattaaaatttaatggagttttggtcggtgagtcctggcagccgtccgagctaaccggacgatgtctccgccactagtcccactgtcccacaaaactaatcagatcgctgccacgcgtcggtgctgatctaccaccgactccatggcccatggcactagtctgattgaatgtgctcgatcggcgtggtgtcattgtgcaatttgtgccctattttttgtgcatggtggagtaacagtcaccgccagaaaccttcaaaagcgtgtacagaagcaccctgggtactgtacccaccccaccacatcgtgagcttttcaaaagttgtgatagccgacttatccttgcgaacttccaaaacagatacatagttggtaaattttaattgtattttttatgccatttagttcattgtttatataattttgcgttgatgacttattttgatgaccatccgaatatgagcaattttaccattcaacatttagtacttcgaggtaccaaattttacattagatagtactttgagaactaaaaaattgtggtacctcgaggtaccaaatgttgaatgataaaattgctcatcggaatatatataatttaatgaactgacacttggatatcataatatatcatttttatacgtcactagcaaaaatgtttatgtgttaaaacaggtgaagataattttcacgattgataaatttttttgtcaaacaatagcaaaacaaatttagaaatcatatataacattgaatccggttccgctcttcatgcatcatcacacgaagaatagcttatatacacatttccaatagcctcacaaattgatcggatggttattccataagttgacacatgtggattttattatacctcatggtccaaagattaaaattttgagtattcaattagtaaaagttttttcccgtaaaatttttttactgtagatggaaggcatttgcaaagtaccaaacttaatgcatacaccttaacaatgataaattcaataggaaaataattgtgaggagagaaatttggaagagaaaaaagagaaaagaaggagatggagagaatcatgattattgagggaaaagaaaaggagaaaaagaaaatgaaaaaagagagaaaaaaaaaagaagccaatcgaggaagggtgtacgcagcgccgtctagtggaggcgtgcgggatggtgtgggccatttgggttgggctaggagggagagagaatgaactgggatatgggtgcataataattattctagactcacgtcaaattggatacgtgtgacatataactaactcatcaaacacagacgacgtatcaaagcgccgaagaaaatattttcaatttttgtaatattaaagatagacatagagataaatattgtactctttgaccgtgtcatatggagcctttttcatattaactagctgggtggcccgcgcaattgcgcggctagcaccgatataaaattatctattttttaatatagttttacttagaattttgttaaatagatatctcgttgtcttaagactttgaaaaaccaaaccttatcatccttgtgtttctaattttatattttttaaaagttatgtcagttgctactcctaaatattttgtcacccctcgtttatttgcttcctcgatctaccactacttctatttgttctcactaaaacctctaaaaattagaccttatagtttttagagtttattgtctcgtttgggttttgtttttataattttcagaagtctcgtcaaatgttgccaccatactactctacggtcaatccactgcctcttctctttatttttattgggattttaaaaatcaaacgtaattatcatttaggttctttttttactttctagaagttccaccaaactgtcagcgactttaccactgtactcatgtacagctcacccgctgccccctctttattgtctttgagattttaaaattcgaacatgattatcattagggttttttttttttactttttagaagtcccgccaaccgttgtgaccatgctgcttaatgacccgtccatcgtccctccttttaatcatcattgggattctatttgggggttttgtttatagtttttagatattccatcaaccgccaccactctaatcctttacattcatgttgcttctcctatatttgttgtcatttgtcatctttttataatttttagaagtcatgtcaaaccctatcaccatacttctcttcggcctgtccactacctcttctttttattgtcattaggattttaaaaatcgaacataattattattttggttcatattttactttctataagtcctgccaaccgccatgaccgggctgcttaacggcccatccgtcgtccctccttttaatcgtcattgggattctatttaaggttttgttaatagtttttagatgtcctatcaaccgtcaccattctacttctttataaacctgttgcttctccccctctttattattatttgtcatcatttgtgttctagatggagttttttttagaagtccatatttttcattctgatatttttatttataaattatatttctacttgaactcttataattatttttatatttacagaatttatttttttgttatttcaaattttagttaatctcgtcatatgttctaaatggtctcttatttcaatagtttttactttttatgacgaatttaagttatttataaattgtattcctagttgaactattatttttatttttctatttttggaatttattttaatttttatttagaattttagttaatatcgtattatgtcttatatgaattatttttttatgttttttaattttcaattttatagttgtttcatcctactcaaactatcttttttatttatctaatttcagattttattttatttttattttaaattttagttaatatcgtattgaattcttatatggactcttcttttaatatttcttatttttaattctgtattcctacatggactcttctttttaagattttattttatttttattctgaattttaattaatctcgtattggattcttatacggacttttctttcaatattgcttatttgtaattccgaatttcagctatttttaaattgtatttctacttggactcttcttttctttttctccgattaatgtgggaatttctagcccccgcagcaaacgtggtgccttcttttcgagctgttttaataatataatataatagatagatagatagatagatagatagatagatagatagatagatagatagatagatagatagatagatagatagatagatacttgtttttcttttgtaagctagcatatatagggatcgaactccactcccagattttcttagacactgtcacttgtaagcatggacgtagtcctggaagtagaagctcttctcaatgaagctcgcgagccagcgggaggcggcgaagcacagcacggcggtagacacggcggcggctcgccggacaaccgacggtgctagactccccttggcgacggcgaggaatccgacgatggcgaccgacgccacctgcagggcgacctccagcgccttcatcttcttcagtgcagcgctgcagctcgtgcactgcatgacatgcgacctgtacctgttgatggcaccagagaattaattgatcagcatcacagcagcccacaaattctgaatgaaaattttcgatgaagctgatcttgtaacgtgtttcgggtcagtgtgaagatcaacttatcacctctccaagacctgatctttggtaggagttggtggcagctgattagccattggggttgcccagccgatctgatgcttacagtactttctgaaccagtttctgaaggtgatgaccatgttgtcagatgatgtgggcacataacaagctttgtgccagttatcaaggccaaccgtggcgaagttgcgctcctagagaatgaaaatcttcaggtcaaaacatatatatgggcatagtaagtcagcaggcataatagctcacatcgccttctgtgtgtcttagaatagaaaccggatatgtaatccatttccgttatctaaaaatgtactcttttaaaaaaagagaaattttatagttcttaagaagatatcatgaggtaccactttttctattataaatttggtacctcatagtaactaggtaccaagagataccaaattttatactaaatttttttacatcatggtaccttcttatgaaccgtaaaattgctcttaaaaaaatcttgtgatgaattgtgaatctgccaccaccctcaccattaacttcctgatttttgaagttcaaaaaaaaaagagtgtgggaccaaatggtctacctattagctgaaagatacatgaatagaaaaatagataagatatgcagaatgagatggaaaaacggattgatgataatgttatttttttttaaaaaaaagtaaaaaatctgtcacaatgcatggacaatatgctagttttatcatgaatcattcagcttgagctaaacaaataggtcacctcaatatggaggaggtaggaatctgaatccaagacgatgttcgtcacaatgtggtacaaccaccgtggtattatattgtcgagccacgcatcaacattccgcgggaacgcccatatcaacctgcttcttcccggagccaccgggacgcacaagaacaccgtcatcgcctcaggttgcttcttcttctttttctccttgccctgatcaatctacacaaaatctaaccatttaatacgattatttgatcttcaagccttgaactagggacagatgtgccatgggggtggtgagggctcaagcccccactacccgtattgatactttaggagcctccactaaatccccttaattttacatcctgatactttttcaatgatgataaaattacgaacatctttcccatccttgaggaggtaccatgaggtaccaatataatctaaccgttgatttagaaggggtatgatggggctaaataaatttagggtggcgctaatccctcaccctcttgatggcgttttgcttgcttgctcgtggtggctcaaagggacccaaccatgtccgccgctggcggcggcaagagctgcatgggaggaggcgaggaggcgattgccgggctcctcgacagcggcagcggcgtctggcgagtacacgctcgtgacgacgagggcgacaagatactcgtcggcgacgtgccatgaatgaatgaatctctcgtcttctccaaatctttgccacatctccgtgccggcgtcgcatcgagtccgctgctgccgccgtcgcgtcgcatcgagtccgccgcggccgccgtcacgtcgcatcgagtccgccgcggccgccgtcacgtcgcatcgagtccgccactgccgccgccacgtcgcatcgagtccgccatcgagtccgccgtggccgccgtcgcgtcgcgtcgcatcgagtccgcagcggcagccatcgcgtcgagcttccgacgaatcgccgccgtaaccatcgtcgagctcccgatgaatggccgctgcaaccatcgccggccttaccctcttcccctctcttccctttgccgcatctccgtgccgacgtcgcatcaagttcgccgcggccaccgtcacatcgagcttccgacgaatcaccgccgcaaccatcgccgtggccgccgtcgccgatgaatcgtcgccgcaaccatcatcaagctcccgacgttgcagctatcctggtcctcccgccacccatcgccgatctgggccgccgccgggtttccgatctagggttcgggacctatatgcccctgctcccgccgccatctctcgccgccggttagttcaacgctgctcctgccctgtgagatgcagagacggaggaggaagagatgccgcgtgcgtgcgtgacgcggaataaagacgaaagtacaaaactgccctcccacccacggtaccgtttcaatgggtaggtgcggtacctcatggtaccgacgatttttgaccgtaggatgttgccagatcaacggtcacgatttggtactgcacaaccttaaagacagtaaaaaatctctaaaattacccaaaacttcatctagtttatttagcctcctctagtatttcttctttgctccgtaatggcaaagtaagagggtgctagggggcagatacctgtggttctttggtgcgaaagggcttgccatagagcgtgcagggcgcatcaaacttcatgtagcatacgtcatcctcctgtaccgacaggaagccgtcgatctttgcctgctccgtcctaatcttgaccgggtagcctccttcctgatcggactcaactgtggagaggagatgaacagttgaacactatcagtggtaggtgcagccggaacattacaaaatggcactagctcagtagcatgttcatgcgtgcagtagactgaagaattaaaactgatcatgtcatgatagatgatgaacatatctgcctggatcttctttgttctgtatgggcatcagccccttgtgcgcgtatgggacatgagcagggtccataagattctccaccaacacgtcgtacctacattacaatggagctagctaagcaaggtaaaatatgtggtggaaatgcagtggaaacctgaaagtaatagttggttcgaaaaataaacgtatgagatttgtccacgtcatcacggataaaaattttactcgcagattcactcatgagttaaaatttaactcctagtaaaattttaagattttaactcatgtagcacgttttaacttagacgtcgaattttaactcatggtgacatagatgaattccagatgtccatttttcggtccaacggtagttttcaaattttcactatatataggctttgcaactacatattttcccctaagcgaatgatcgagctgccatgctaatgggggagcaagaaattaagatttaggagaaatgcttggagatttctgtacccgtagaagaggtccctgacgccgaagactgtgttgaaggacgggtcatcgaggtctgggaagtacggcggccgcttcctctgcaggatctccttgtactccggctccgacctcgggtagaaccacaggatgttgttctgcaccacgctcgggtacgacgccacgcacgccttgctgttcttgtgcacctgccattaattgatccaagaactcggttaatcttcagaaaatgttgctgtttttttaaattttgttttgatttgttttacaggagggccgagggcgggggcctgggggatgaactggcaggagccgtggccatcgaagcaccagccatggtaggcgcactggaggcggcccttgccgtcgacgcgcccctccgacagcggcgcgaggcggtgcgggcacgcgtcgtccaccacgcgccactcgccgccgccgccgccgtcgaaccacgcgacgacgcggaggcccatcaccatcttcccgtgcggcttgcgcgggtcgaggtcgcacaccggagccacgggataccactggtccagccactcgaaccgcccctcctcgccgccgcccacggccggggcggcctcctcctcctcctcggcgcgcgcgtgtggcggcggcgtctcggccgccacggccgacgccggcattgatagccgtcgccgccgctcgccgctggtgtgtttccactgttggcgccatggaggaggtagcctgaccgtgctcagcttgacgccggcgtcgcggagcaggagaggagggcgagcgcgggagagcaggggaagggagaccggagccatggcgcttccgagggggagcttaagcgcgggacatcttttttaaagtggttacgcagaccatggccgaatgaaacgtgctacagtgggtaatattgtttcgtagggtccataagaggaatcatgctatcttttatttctgtatgtatacctattttttagctatccatgtgttgcgtgcaaatgatttctataataactagattacaaacttaaaatagtacaattctttttggaaaacgcaaacatattttagattgtgttggcaaactgagttgggaactaatagataccttccgcatgcaaaacatagtgactcattagcgtatgattaataaaatattagctatttttctaggacaacttgtcaacgaacaaaacgatctctttggacctgcactagagtaaagcaaaacgatctctttggaccttcattatttatatatcatccaaatggttatgaacaactagatagattaatatggaataaatcatttttcacaacacatgcaggttcaaatttaacttctacaagttgcaacgaaaaatacaaatttaaacgtagacatagtttaatttgtctgtttttgcaactcgtagagttgatttttaacttgcatatgcgtccagtgatatatcatatattaatctatcttgttatttttctttattttttccataaccaattagatgacatagactagctaaaaaaaatgtcgagtgttttttgaggggaaaactttcaaatctaactatagtatataatttcactagaactatactataataataataacttatatatatgtattaaaataatatatataactttatatctaatttatatagagataacaatgtagttataatgtagttacactgtagttacaatgtaattataatgtaattatagtgtaactacgatgtaactagcatgtaattggaatataacttagatgtaacttgaacaaatctaccataaacatgcgatgatgggactagcttgtaaaaaaagggtttagatccaatagtaaaatatctcagcacaaatcttagagcggaattgacggccaaaatttttttttgacagtcatctagcagttccgtataaataacggggagagacttttcgaaaacgagactacgctcagtcgttttcattctaggcctcccctaagcccactcaacatccagcgtcttcgtttctccgacacgtgtgctgccgaagacacaaaggcgatttagatttttttttataagaaaacatacatcagcaatgaaaaggaagagtgcataataacaaactggtcagactaaattagagttcaatcaaaagaagatcgaataaaatcaaacgtcagactaaattagagttcaatcaagagaagatcgaataaaaccaaacgtttgcaggtaagttctctcaatcaaaagcatcacccatttcacatatctatgttaaatcatgaaagaaaccaaagcatcgggtcaacaaaaacggttctaaatttttagttcagtggttatctgcaactttcatgtcttattttacttccaataatgcatcgaaatgtgaaaagaaaaaacaattttagtgggaacactgatacagacgctccattccccatgcaaacaaatatagagttttacatttttttttagataatgggcagcgtccggcctctacatcataagatcataaggtgaatacacacggccagatttagagttttacatatgtggttttttttttctttttcgttggacgccgatcgatcgaccaaatttattttccacagcattaaaactcacagagtttactgggcacatcgatcacttgtaagcatggacatagtcctggaagtagaagcttttctcgatgaagttggcgagccagcgggaggcagcgaagcacagcgcggccgcagccacgacggcggctctctgaaccgccgacgtgaccaccgtcgtccccttgccggcggcgaggaacccgacgacggcgaccgacgccacctgcagtgcgacctccatcgccctcatccacttcagtgcagcgctgcagctggtgcactgcatgacatgtgaccagtacctgttgatggcatcgcaagaatccaattttgatggtcactgaattctcttgtgttaattttgtgtttcagatcagtgtaaagatcactagatcagcagatttctatactacctctccatgagctgatctttggtaggagttgttggcagctgattaaccattggagttgcccagccaacctgatgcttgcagtactttctgaaccagtttctgaaggtgatgatcatgttgtcagataaagtgggaacatagcaagctttctgccatttatcaacgccaaccgccgcgaaattgcgctcctggagaaggattaattcgtcaggtcaagactgaacatatcacatatgggcatataatcaaggcagtttgatctgaagaaatgggtcacctcgatatggaggaggtacaaatccgaatccaaaacggtgttcgtcaccatgtggtgaagccaccgtggtatgaacttgtcaggccaggcgctgacgctctgtggaaacacccatatcaccctgctccttccaggagccacagggatgcacaagaacaccagcatcccctgaggctgctgctgctgcttctcctgatcaaaatctgaactttttagacggtttttttagcctgaataatgcaacggatcgagagggtggctgatgctgatacgtgccagtgtctcgaggggcaactctgaccggttgatcgtgcacggcgcgatgaacctgaagtggccccaattctccccctggattgacaggaacccgtcgatgttggcctcctctatcttcatcttgaccgggccgccgcgttcctgatcaaactcaactgtggagaggagatgaatgttctgaatcagtgacgacgcatatgagcattggagaatggcactagatgactaaactgaagaaaatttgggtagaaaattgattgatcatgtgatgagatagaacatatctgcctggatcttccttgtcttggaactgagggaagagccccttgtgtgcgtaggggacgtgagcagggtccatgaggttctccaccaacatgtcgtacctgcattgcaatggagccacggcatagtatatcaagctgcatgcctatgtgtccgtttcggagaagaatggcttgagcatttctgtacccgtaggggaagtccctgacgccgaagacggtgttgaaggacggatcatcgagatctgggaagtatggcggccgcttcctctgcagcacgtcgcggtactctggctccgttctcgggtagaaccacaggatgttgttctgtaccacgctcgggtacgacgccacgcacgccttgctgttcttgtgcacctgccattcatccaacaactcgataatcctgagaaattttgctttgagatcgacgcgggaatgtagattagatcgacgagagtagtggggctctgccttcaccctcccaatataggagcagtgtttagcatccgttatctattttttttctctcttttttttccctttcccttagcaatgggtctttcggggcggttgcgtgtaactaaaactctgcttcttctaatatattgacatgtaattctttttatgtgttcgtgaaaacaaagtttatcgttaagagaatgtagcaaaggagagtacgggagggccaatggcaagagcttcggggataaactggccagacccatgttcattgaatcaccaaccatggccagcgcactggatgcggcccttgccgtcgacgcgtccctccgacagcggcgcgaggcggtgcgggcacacgtagtccacgcgcgccactcgccgccgccgtgtaaccacgcgacgacgcggaggcccagcaccatcttcccgtgcggcttgcgcgggtcgaggtcgcacaccggagccacgggataccactggtccagccagtcaaaccgctcctcccctgccgccggcgcccgcacctcctcggccaccggcggcgtctcggtctcggtctcggccgccgatacggccgagaccgacgtcggcagccgcagcgccacgccacggccgatccacggccgacgcggtggcgccgctaggctagctattctctgactggcggcgccatcgacacggaggggaagcgaagcaggccgcgcgccggaacggaggaggagggaaaggggagccatggctttctttcacgttggcaacacagtgtgcgcgtgtgtgccagtgtgcatggctgtttggactttggatgtggcgcgcgatgttaaatatttgaagctccaggtggttcttgtagctgtagcctgtaggttgaggtggatctcgcaacaaattgtacagtctacagtaccatgtatagtaagaatctgcctgcccatccacatcatcatccaactatcctatccgtcggatgtcgggttgtatgtggcatttttttttcttggaccatatgatgcttttcttcacgtgctagctagtaggagtgaaaatgtaggaacagggtttacactttcctaaataaccgaaaattagtgaatttcggtactttcgaaactttttgtatgaaattatttaaaaatctaacaatttttttactgaatttgaattaattttgcaagttaaaaaaggtaaaattcaaaaaaattggctaggatagttgcttgccggagggggtccgaaattttaatcccttaatttgtataggaaaacaatctcaccgtgaccatacttttttctcacaagggtaaaataaaaggcaaaggtgatatcgaaactatagtgaacgaaactattcgagggggaagcacatcgatattgatcagaaactgacacttcatgagcaaagagataataagggccctttctccttattactttcatgtattaataagaagagaagaggtataacaatcaaggaagatcgttgtgttgtatgttgtcaaactttggaagatggcaggcatctttctttgaagggtagaggaataatagtgtgctactgtgttgggaatttgcaaatggaggatattggatcaaatcacctctgacctctgttaacaataaaataatagatattctagaagctgacaaacaaacaacagttaattactccctccaatctttagtgtaaaatgatattgattttaggatattacgtatgactatccatcttatttaaaattttagtgtaaatatgaaaaagtcccttctaaaaaaatatgaaaaagtataaatcatgttaaagtatttcagatgataaaacaagttacaacaaataatatttttaattagataaatgatcaaacggcttgtttaaaagttaatgacatcataccatgagacacggtattgtatttatggttgtaatgtgataagaggaacaggatatgtgagttcagagagagaaagaaagacggctacattgtcccaatgctatgtacaaactattttaaactctcgaggggacgtcccctcgttgtttacatgtcactaaaatggttatgaaaaaaactaaaaaaagttctacaacatagattaatatgcgatacatcaatccacaaatatgtaaggtaaaatttaacttttacactgattgtgaacatgtgttaactagttgtagtttgtttttttttttttgcaaagtgtagaagttcaatttaaacttgtatgtttgtgaaatgatatgccatatgataatacatgttttcaattttttattttttctataaccatttaaattacatgcaaacaacgagtgtacgtcctctcgaaagtttaaaatccactcctacacttaaaaaggcagtcctagccaacagtcaaaatggtcgctgcaggagggcaccagcaccaacctgaaggcaaatgtcatcataggataggaaggatatctagttacctctaacctctggttgttggagagtcatataactcgaaatggagctggtgaaccgacgaatatttggtagtgtagcactgtagcaagtcaatgttcactgccaaattaggacgggttattttactgtctccggtttttttcccgattccgcaagaactcccttgtccccctatcttgctatggaacctttgagaggtgatcatgtatcttttatatccttcttaatgaaattggcagagctcctatccttccccctcaaaaaaaaatatacgtatatgtgatatggaatagagctcctgtccttccccctcaaaaaaaatatacgcatacgtgatatggaattctcagggccctttctaaattgattagccgaacgttaaaaaaaagtaattatcatgtgattaatcggatatctatctatctatctattatatactaaaagttcattaaacatcttataaacactcctaagccgccaagtggcgctctaataaattagataaattcttagaaattctaagaaaaaagcaaaacatctagcccttggatttcacttaaaccggtggacccattattttacaccgtaagattagatttgtgagaaaaaaaagttaattcatctgtgatcctccttgcctgctattcgctttggatctataaaaacgtaacacactccacgattcttacacgtgatggggcatcagttaatcacaaaccaacgcactcctccaggtagcagggttctgcacgcaccatgaaacgttgactaggtacgtcaatctctttcaccggcgatcggcctgcccagctgccctagatgatcggctacaagggcagccataaccatgagtccgttgatgtcgaccagactctcgcgtcccccaacctctaccactccggcaatattttatcaattaatatttgatccaaactgaaatttgcaaactattgttgctgtttttttaaaagaaaatttccgttccaacttccaagttttttcatgtttctgatatgaaacgacatcatgaacttccaaattgtttctttccatgttaatgatatgaaacgatcgacatcgtggtcattcagtaacctaacaaatttgcactactgtatataagtaataaattgtgacactttcttattattactaattttgaagtttgcatctatttaagtggcaccaaatcataataacttactaatggttaattttaaaataagttctcaagttgataaaatattactgttgagagttacagatgagcacaattttatttttatatgttgtacttcccaaacgataaaatcatgaaaaattaaagttgtaactccaagtagagcacataccttttatgaattattttatcattagaaaaaaaatctaaaaattataactccatgcaaagatgactctagatgcattaactgttcaagtcataactctacatgtataacttgatatttactactcccaccatccttcctccatgccagtttgatctcatccaagttttttatatctccctaaaataattaacatataacaaatgacttttcgtttatttgtgtaaagagtaaataaatgggcatcgttgaataagctcatgcatgcaactaaccaaaattactttctattggtgtaaccctaaaaaaaattctcttggtgtaaactccacgaaatatttacagcgtgatgcaatcaacaccttgattgatgaaaataattttagaaccatggaggttttgttgtttttggtctcagcatcctttgcttaggtgatgatcaaattggaatagagggagtaatttctaagtcagaaatattctgtcttatttgtaagtgacaaattgcatcaatgtaaactgggctagcttgatgccaaataaaacacatgtgttagtagaaaataaacaaatttaataaaaaaaatagttagctcctaaacatttttttaaaaaaaaaccttatttttaattcacatttagtttattagatatgttttctaaatagactaagtcaacactatcttagatgatgaagaaaactatagggatgaattaaatattatacggtataaatctatcaaatagattaaacaattattgaatgcgcgggctagcttccttgttaattattaaaaacttaaaaaatagatttatttgatttttttaagcaacatgtatatagaaaagtttttgcatgaaacatataaaaacatgctaacaaaaatcaaataattagccaagctgaaattaacgtagtttagaacgcgcccgaaatttgttttctccatccatttgtttagctgcatcctatgaaatcgtcagctaactcttaagatgatcagttgtttatatacagatgctatcgatatcaagcatacttggttgtgttttctatatacatttttaagctgctaaattagaagctaaggaattcccagcaacaaagaactctctgatttcctggacgcatcgacgatcacttgtaagcatggacgtagtcctggaaatagaagttcttctcgatgaagttggcgagccagcgggaggcggcgaagcacagcacggccgcagccacgacggcggatctctgcacaaccgacgtgaccaccgtccccttggcgacggcgaggaacccgacgacggcgaccgacgccacctgcagggcgacctccagcgccttcatcttcttcagtgcaccgctgcagctcgtgcactgcatgacgtgcgaccaatacctgcagacggcatcacaagaatcatttgaattcaaaattcaaaagaagaataattgaattctcttgtgttaagttttgtgtttcaagtcagtgtgcaagagcagcagactgatgcaggtagattgtttagctgtttacctgtccaagagctgatctttgctaggagttggtggcagctgattagttattggggttgcccagccaatctgatgcttgcagtactttctgaaccagtttctgaaggtgatgatcatgttgtcagatgatgtgggcacatagcaagctttctgccagttatcaagaccaaccgtagcgaaattgcgctcctggagaaggaataataatgcttcaggtctagaatggcataacacttggcctgaatcattcagtttcagctgaagaaatagtcacctcaatgtggagcaggtagatgtctgaatccaagatggcattctgcccaatgtggtagtaccaccgtggtatgatcttgtccatccagacgccgacgttccgcgggaatgcccagaccaacctgctcctccccggagacaccgggatgcacaagaacaccagcatcactgtgggttgcttcttcttcttctccttgccctgatcatcctgtacagaatccagcagcaccaacaaggtaattgacaatactgatcttgtaagatggttctatgagcttgaacaatgcctgagatggagtctgaagtggcgagccgtagaacgtgcacggcgcgacgaacttgaagaagcccctgtctagcattgacaggaacccctcgacgttggtttcctctatctccatcttgagcggcccgccgccttccttgtcgaactcaactgtgtagaggagatgaatgttctgaatcagtgacgcagctaagcattgcaatttgcactagactgaaagaacagattaaattggggagcaaattggaaaagaaaatttgatcatgactaatgacagatgaggaacatatcttcctggatcttccttcttgcgggtgcgcatcaaccccttgtgcgcgtaggggacatgagcagggtccatgagattctccaccaacacatcgtacctgcattgcaaaatttgcaatggagctagccatgatcaacagctgcctgacaatggtgcagaaagaaagatttcagagaatggatttgggatttctgtacccataggggagatccctgacgccatagacggtgacgaaggacgggtcgtcgatctgcgggatgtatggcggccgcttcctctgcaggatctccttgtactccggctccgatctcgggtagaaccacaggatgttgttctgcaccacgcatgggtatgatgccacgcacgccttgctgttcttgtgcacctgccattgatgcgaaagctcgattaatcttgattgatttgagatggaggagaggggatgaagaagaagaggaggaggagagtaccgcggggccgagggcgggggcctgggggatgaactggcaggcgccgcggccgtcgaagcaccagccatggtagacgcactggaggcggcccttgtcgtcgacgcggccctcggacagcggcgcgaggcggtgcgggcacgagtcgtcgaacacccgccactcgccgccgccgccgtcggcggcggcggtggtgcggtcgaaccaggcgacgatgcggaggcccagcaccgtcttcccgtgcggcgcgcccgggtcgaggtcgcagacgggcgccaccgggtaccactggtccagccagtcgaaccgctcctccttacccgacgccgacggcgcgtcctccgcccgcggcgtctcggccgccacggccgcaaccgacgtcgacaacagccgcctcgccacggcgcggctccacggcagccgaggcggcgggacgcgggcggcggcggcggcggcggcggcgtcgcggaggtggagcgcggggcgcgcggggcgcgcggcggggaggaggaggagggagagggcatccatggctactcgcgtggtgggggaggggggcgcgagcggcccgcaacgaacttgtggcgcgcgcgcgcgcggttacgttgggtggggcccggcacaaacttatcggcgccgcaggtgattagctggacgctcgccacttggccaaattggagacgggagaggccgatgccgatgcaccggttttacagggtacatttaattatttgccatttttaaaatatgccaattaataatttgctacttttataacatgtggttccttatgtgcctataacatatggattcagagccaaattcttttgaaccactcgtaaaagtggcaaaaagttaattatttcgttttctagtatcacttgtcgagtcgtcgccaacgagccgccagaaactgtccgtgcaacttgtgccgatttttttattgaaagtacaaacagcaaggtagaaccatcactctttggatgataagacagttggttggttttatcggctaaatgccggttaactaaagaagggataaatcccctttatctgtttctaataaaattgaatatgtgatagagttaattttgtgatcggtaaaactaatctctaaaactgtattcgagataaaccctagagcccctccagcgtctataaaatagaagttgaacacaaaggagaagggacgccaaattctctatctaaacttcaaaaccctaaattgcccgaccaactagaaaaggtttgtgaggcgatctcggtgaaattttacattggcgcataagaagaaaagaaacagaagaataagagaaggaagaaactaaaggagaataattaacatcgatggcatattatgtgggtattgaagcataggtgattatgtataagctaaatcattgagatcgtaaatttatattccaacacagacatgctagatttttcattaacgaatcggttcgcgccaattccattaagtagagcaggaaaaaaatgttagaaaaaaatatcgaaaggtatataggaatgaatggaagctgccagtttctaggcacccgaaaggttcaagttttggcatgataaaatactaataagggtgtgttagatccaattttacaccccatcacatcgaacgtttgaacacatgtatgaagtattaaatatatgctaaaaaaataactaattgcacatattgctactactttgcaagatgacttttaaacataattgctccatgatttgacaatatggtgctacattaaacatctgctaatgacggattaattaggcttaagtctcgcggtttagtgatggatactataattagttttttcgttagtgcagaataccctatacgacacctatataatacctgatgtgacacataaaaactttacaccctgatctaaataacccgtaagaatgtactacctccgttttgttttttaatagataacgccgttgactttttttcacatgtttgaccattcatcttattcaaaaaatttacgtaattataatttattttgttatgagttgttttattactcatagtattttaagtatgatttatatcttatacatttgtataaaatttttaaaaaagacgaatggtcaaacatgtgagaaaaagttaacggcgtcgtgtattaaaaaacggagagagtattttgctatagccgtttttacttatggaagagtgacgacatctgagacagatcgaagagcatcgccattgtcacgatggcgacccaatcacaaacatggcagaattgcagagagtctagtaaggcagaagctgaggctgagcttaccaaacacaagcacacgcacacgcacaccacacagtctacctatacctactactacctgtcatcttctccttcttaatcccaactaaatgcgcacataaacgaagaagatttgcactgatacccgcgctgatacaagcaagcatccggcgatggcggcggcggcggcggcaagggggagcgtgtgggagatccagcagcgggacgtggaggccgcggggctggccgacgccgacgcgggcgccttcgtcgcggcgcttcgctccgccgccgccgttgcgacgggtgggcctgacgccgcgtgggaggccgtggcggcgggggtgctgcggccggagcacccgcacgcgctccaccagctcgtctactactccgtctacgccggctgggatcgcgccgcccggggcccgccgccgtactggttcccgtcacagtaagtcacctcgccggagacgaccagactggcaaactgacagtggctggtttcagtgtatgcaaagttcaagcttatgttgatagcgtcctagtactacttaatttctagtgtgatatcatcagtgataagatttccttgtgttaatttccacttgtcatgtcaagtaacctatttgaagtacaatgatcagtgcatgatttctctacgtagtgatttagtgtttgaaatgtgacaggattgacactaaacaaacaaatcttggtagactgatggaagcacatggtcctaggttgttaggatcatcatataaggacccagtttcaagttttcacctcttccacaagttctccgtagagcatcaagaggtcagtcggttgctctaaactagtcagctccagctaagcaaccaaacaagtttgaagtcatttctttacaaccattggagtggctatatgaatgttatttcttgaatggacagtttaagtttccacaggcattttgatcctactcccagtctatcctttgttaggtctactggtcaatggtgctgaaggagatctcaatcaagttccaacaagaaccaaagtcaattctagatacatcagataaatcaaggaaagggggaacatggctccaaggtgctgtgcttaatattgctgaatgttgtctgttaccttggccttcccaaaacaggacagatgacagcacagctattgtttggagggatgagggtcttgacaatcacccagtgaaccgtatgtcactgaaggagcttcacaatcaagtgatgtatgtatatgttatcagactaacagtaagaatcatgctaaagcgtattaagctttgccataacttattctgaatcatcaccattgttttgctgcttttggtgttttcagtacagttgctactgcgcttgataccatgttccaaaagggggatcgaattgcaatagacatgcctatgacatgcaatgcagtcatcatatatttggctattgtccttggtggttttgttgttgtgtcgatagcagacagttttgcacctcaggagattggtacacgcatgagtgtgtcaaaggcgaaagctatttttactcaggtaggaaattagtgaatctttcatgacatagtcattaacactaaagtagggcttcatctaaatttcacgagatttcaggatttcataattagaggagggaagaaggttccactatacaggtacgaacggatgattgatcagttcatttcagtttgtctattctgatagtataatgcacttagcattttgtttttttaaaaaaatgcattttcttcatatatttttctaatttatgacatttgcttagtttgaagttaagtaggagtgtaggacgttatcatgtgaacactgaaaacattctctttcattgattttagaattcagcttagatttttcctgtgaatctaaaaaataggagtacttaagtaccagatagttcatagtacatttcaatcagaaagacaatttgcagaacagataaatatttcataataattccattcttcagccgtgttgtgcaagggacttcatctaaagctgttgtaattcctgcaactggaggctttcttggggtttcactaaggaatggtgatatgtcctggaaagatttcctttcttgtgctgctggaaggtatattatacagaaataaatcttagatggctttggataagtgtattgtctttccattgaagaaaaaaggaacatgcaattgttttttttttctttactaatttcatgatatgagtgacaatatatgttggatttgcaggtcgtccatttatcccacagtttatcaaccttcagacgctctaactaatatactattttcttcagggacaactggtatattaacactatttcattgcttcccctgattttagtatttcttttgtccacccctgatttttgtctgttttatttacttgtgcaggagaaccaaaagctatcccatggtcacaactttctccaataagatgcacatgtgatacatgggcgcatttggatatccagccacaggacatattttgttggcctactaatcttggatgggttatggggcctatactcttgtactcatgctttttaagtggtgcaacgttggctttgtatcatgggtcaccacttggtcgtggtttttgcaagtttgtacaggtacatctgatgtactttgcaccgtcacttgctttggaatgttaaagaagatttatattttatcattgcttcttgtgtgcactgtaaactgtactaattatgtaggatttgagaccctgcttggttgagcttcaggttataatctaaagctgattttgaattttagaatttgattttaggattaatcttaggggtttcctttgttacttttgtcatctagctctcttctcacaattactataacaagacaagtaaaaatcctaactaaattattcttaaaaattaaacctcaaagttccaaattgcttttgatttttcttaaaaattaaaaatctgattattctttgtttattcattctgatttcatatttggttatggcacatctctactgggtagtgagtactaacaacgtgtttcacctcaaaaactgtttttgctctcagatcctgtttctttgagccccctttccccccacaaatcaggaagagttttgccaaatgcttatgtttgaagataaatatgaactgaacttacttaatcatcatgctctgtgaaatattttgcaggatgctggtgtcactatattaggaagtgtacctagcttagtgaagtcatggaaagctgggaattttactgaagggcttcactggaccaaaatcaggtgagtcatccttccactatcagaaggctcacagcttcatcacaatcagaaaggaagttaaaagtagtattataattgcagggtactctccacgacaggagaggcttctgatattgatgatgatctatggctatcttcgcgtgcctcttacaagccgattattgaatgttgtgggggtactgagctggcatcgtcatacattcaaggcagtcttctgcgttcgcaagcttttggagcttttagtgtgcatccatgtccactgggtttgtcatacttgatgaacaaggaactccatatgtaagcatctcccctgaaagttatgtattctggcattatgtttgaagcataaccatttcagttgactatgatagcctgatgatgtaccttgtgctggagaagtgggcctcttcccttatattttggcgctacagatcgacttctcaatgctgacaacaataaggtttattttgatggaatgcccatttacaatggaagggtatggagttatgtacttccttgtctccttttctccaataagattgctatataaacagtccattattctttgatgaaccaaatggatccatttgcatactaagttctagccagaatgacatgaactcatatgttgtattggtactgcagcaacttcgacggcatggagatataatccaaaggacagtaggtggttactatattgtgcagggaagagcagatgacactatgaatcttggaggaattaaggttgaccctcctatttcaaatgttttcaatagcttgttgtcacccttgaattttatgaaactaaataaatactgctcgtcttataaacagacaagttccgtggaaatagagcggatatgtaatagagccgatgaggctctactagaaacagcagcggttagcatcaaacctgctggtgggggaccagaacagctggctatcttggctgtgctaaaagatagatcaccaccatgtgatgcaaatgttctcaagagcaaatttcagagagccatccaaaagaacttaaatcctcttttcaaggtaagagttactacttactcgtttctgatgttaaggtcagatagtgagatgtgcacacgtgtaccgaggtcattggaatcactctttgtcatcttgacaggtgagctatgtcaaaatagttcctgagttcccaagaacagcttcaaacaagctgctaagaagagtactgagggatcagctgagcaaagaactctcgaatcgcagcaagctatgaccgacgtgacatattcaacaaggaccacaacaacaacaacaatagtagactttagtccaaagcaaggtagagatgaagagccatacgaacagtgagggtaattcaaaatcgcttcaaaaatgccctcttgcttgtcaaatggtaatattgaattatgagtgtgtcaaaaaaaaaacagccacttgaataaagagtcatgattcattgggggcgtatagagaacttcaggaaactatttttttccatgttaataaatgttgttgaattgtgagcatgttcaataggcaacggcttgaaaaagtgacatttcccgatgggaatttgtagagaacttcagaatactcatcgctgtactgtattatgttcagctcatgataaagtggtggcatggtgtttggattattttggcacaattcatcccctttgaagctttctgttccttttttaaaatgtttctttgaggggttttatgtgccattgctaggtcaaatggttcatcatatccagacatccagttaatcgtgttcctgaagtgtaaagaatgcatcatcttgaaaattaagtcgtaacaatatttcggtggaaggagccgtgctcacctagtcacgttacagaactgcatccatattctgactttatgcacaccctacatagattaatttctggtgttagacggctaaattgactagcgtgaagcttagttgacagaatgcagagatatggccaatatttcctgcgtgacaaatatgaagaagtcaagctagacatgcagaacaattaattgtattcccattttttttccatatcatgtgtgctgaaacagaactaaaaactcctccaaaaaaaaaagaaccgaaaacacctccaagactccaagtcagccggcacatctatgggatcacaacccccgttcttcctgatcactagaatccaaataccaccagagcaggtggaaattttgttgtacaatgttgaattttttttctttgtttgattggaccattttataattgattttaccaaaattatagttcagtattgtatgctacaggttgtctggaatgagaattaagcaatattacatcagaaaattagacatgctgagtccttccctgcaaaagaaaaaaaaagtgagtcaatttaccgaaatacattaagcctgtccagtaggagaaaatccaactaggtaggcaatgacatcaggttgtataacctttctaatcgccagctaataaccattatcctatgccattatgctcccaaaaggtcattagcataacagcaatgtagtatgtattaaaagcgagagaaagataattctcccagtaacagtcatccatgtccggttttttccacgcagatatgaggaggaaatgagaatatggtactcaagtctgaacagctaattgcccattagcgtgtctttagcatgtaatgatatcgaagtaattttagtgataaatataacaaaattataactaaatgaaagttcaaatttatgcgagctaaaccttcggtgtttaggtttcttgaggtgaaaactatctttccaggctaagtattaaatttaatatgagtgcttatatttatggttaattatttttttaaattgataagtgatatacagtacctcttaacagcgaggccattaatgattaatctcaatgtatgccaagtcaattctacttttaagattcaactatattatacgcgcttcaatttgttttacttttgaaatcaatttcaaagtatgccgagaaacccgggctaggctaggggaggttagcctgcgttcgtaccatgttttcaaaaaaaaaacaaaatttactaaagtcttttaaaaaattgatttttattagctataaacagaagttctttgaaaaataaaaaggagtactccagtatgcacagagcagaagtttggaagcttccaaagtcaaaatcaggtcatagaaaattttagaaacccacggatcacaacatcacgtgaaaaaaaaaagaagaggaaaaactagaagttgccgagagccgcgtggtgttcgtccggtctccggtccagagcgggaggcggccggcaatccgcgacctccacctcctcctcctcctcctctcgtcaccaccaccacggcgaccccgtcctcctcgcccctctaaaagcctctcccttcctttctctctccccttctcgtgggatcttgtattcttgcgtcgtcttgggactcttgtggtggtcaagaacgaggacgagagaggtcggagagcgaggcggcggctgtgccgttgcgcgtgcggtgcgggtgaggtagctagcgagcgagaggggagatggaggcggtggcggttgcgggcggtggcgcggggctgacaaggtggcaggcggcggcgctgtcggcggtggcggggtgggtgtgggcggcctcctccttcgacctcacgcggcggtcgcgcgcgctggtgcagccgtgggtcacccgccgcgtgctcgccgagacgccgtccatcgtcagattccaggtccgttttttctattttttgtttgcatcgcgcgtctcctgatctcctcaagattggagggaaattcactgcatttgctgggattgttatattttttgtagagataatcaggatgttgagacgatttcttgagtgaatagggaatggattttgatagctttgtgttatggaatagtaattgcttcgatttttacatatgtttttgtccttgtagatttctgaattatttttttttggatgttgaattattgcagaaggtgcatcacaagttgctggacagtttcttctctgtgctgtcatgcgttgtctctgtccctttctacaccggattcctccctctcctcttctgggtatgccttcttgtcttacacacataaaaaatgcatgtttcttttcctctgtaattctagctggattagctatgaattgctcttactcttatgtttatgtaattctagctgtattagctgtgaattgctcttgctcttctgtttatgtaattctagtgggattagccgtgaatcattcttgttcttgtgattattgtagagcggacactccaagctggctaggcagatgacgctgctcatggcattctgcgattaccttggcaattctgtgaaggtcactatcgatttatcatacaatagatgagagttgctgatattcgattcgtttagctgttgacactctggaagtctgtggatacaggacgcggtgtcagcccctcggccaagctctcctccggtgagaagagtgacagctactgaagacgagaaggaaaatgccatggaatatggattgccttcatcgcacgctcttaataccgtttgtttgatggggtatgctcgtgtacctattcttttactaagaattgtattctgatgtattattccgtttgtttcgatgtgggaagctctgaagagttcctttgctaatggcccttctggttgatgtagatatctgctgcattatgtcctaacatatggatcacacgacaatgttatggttgtcacgggcttatctctagctttcttgcttgttatgttagttggcattggtgagtctccaaatttctctatgcaacactcttagagttacgtcgttcaaaaaacactcttagagttactagtagatattgatgatgtggtttatttgaaattgataggacggatatatttgggcatgcacagcttgattgatgttattgctggcatctgttttggcgttgtaatcctggcattctggttggctgtccataatcatgtcgatgcttttgttgtctccggtcaaaatggtatatctatacgcctctgagttttgtctgataggtgaaatgtaattttggaaggcttattctcgttatcttttcccttgcagttacaaccttctgggcgagcctttctctgttgctgtgcttcgcatatccaaaaccagaattcccaactcctagctttgaataccacacagcattcaatggggtggcttttggaattgtaagttcttgttgactaatgcctgggtaatccaaaatttttagtagctccaaacttgcttgcatcatagtggattctggtcacatttaatatattatctacaataaagaacaagactttttaggaaaggcctgcccttgaaacaggataaaacagcacactgtttaccgcgtgaatttcattatctagagaagcagctctgacactgtttcttaacacttttcaggtctatggaatccaacaaacctacttccatttccacaatcctgatgtccccctcattttcagcccacaattaccgcttattgtatttgtcgggagggttctcgtggggatcccaaccatcctagttgtgaaattctgcagtaaagctctctcgaaatggcttctaccggtgatgtgcaacaccctgggcattcctattgtatcaacctgctatgttccagcgctgaaggcttccgaaaagtgcaaggtcaagtccgacgcgaagcagggcggttatctccagaaggtgttctccctctttccacagaaggcgtacgatgtggacaccggcataaggttcgttcagtacgccagccttgcatggtcagtggtcgacctggtgccggccatattcactcatttaagtttgtagtgaacactgcaagatgcattctacttggagacttgcaaaatcccaaatgggctattcctactcatgagagagagataatcttatgggactgtaaatccgatgatctccactttatttttatttttgcgtggtgtgtgtagaggtgttttgtccatagtagcaaccaggaagtattaacatgctgtgaaattttgtttcatgatgaagacagcgaccaccacgaactctgaaacttaactgcaaagaaatgccattccttttcttgcattgtattgatgcaggttctttgtatccatttcactttcatgcccatgtcattatctgccaaactaagagtctaagatcaacatcatcttatgaagagactgactgatgtgtccctctttttcttcaaagaaaaaattaaagaaaaatacagaaaccagttaagatcagcaagatgatgaagaaattgcagtgttttgtccccctcccaagtctaaagcctgacggtgaataaacgaccagtttgtatgctgctgttttgtgcgatatcatcgctgtgtgcttgcgttgtgcagaattgacaaagcgagttgctgggccgccggcgaggcgagaacgacgtgcacacttcgcctccggttttctagaactcgaatttcccgcggcgctggcgttggcgagcgcaccaaccgcgctgatggcgacgagagaaacaacctgccacaggaatcgaaggcacagaggctctttttttaagcctacatcaaccatccattgagatatacagtacacctgaacatgcctaaaagaaattcctgaatgtttggggggaaaaggcaaacacaatttgctactaaacgcaaacataagttacataaaaaggtgaaatctcttctctcttttttatggccggtttgcttggtaaattcatgagtgtgtgaccgtgtgaaacatatttgatagtagcggcatcgtagagaccccaagggaagcgatatgtaaaacaagattaaagagtcaatcagcagtacagtttattgcctcggttgaatcgggaacgcaatagaacctatcccacacgacacaaataatccatccactggcaataatccatggccttccttatcagctgataagaggtactattaacttcatccaacggtttcttggggggcaaaaatcatcacatcttcaaggaaagaaaaatcggagctcaagtgttggtcacaaagaattctaatactgtttttcaagcaattatgtacggcaaatcaagatgtactcagaaagacctaccggctcaacagggagccatacaactacattgttcatctctacaaggatcatgaaaaaagaaaaaagaaaattaggtgaaatttgtggggaagaaaggcgaacaaaatgaatacaaagagaatagttttcctttcataatacaaatttgctacttgatgcttcgagtcaccactgcagcccccaagccaagcatcagccaattagagataagtgagaacacgatgaatcctcccagctgtaggtatacacttgaatcatgatgcagcaaagcagctcgcgatagccaagcgccacgggcaaaggtagtaagaataacacacaggagattcgaggggaaaaaaatatctgcaaccagggaacttcacctagctatcaaacatttgctgcagagacagtccaccacttttacatcacaggaaatagtcaggtgttctacgagttacatctggctctccccttcttggggctggctcaaactgcagaatgaaacaacatatagctcataaggtgcaacagaaaataaccgtggagccagatcacaaaggcataagcaaaatgggaacccaacacatagaatgagagttgcaaaagcagaacatgtaccaatcatgcattcatgtttcattagtcaaatacctgtcactggggaccatgaaggggcatgtttcttaatagtcttagtttgtttctataaaccatgaaggggcatgtttcttaatagtcttagtttgtttctataaactaaaagtcaatgaatgttcaaccattacctggatgaatgtatgctccctgcaatcatcaacttccaagattgatgccatgttcccacagcgatagcaataattaggtgcactaaatatggtaacaactttttgctcctgttcagtgtttgcaaaatgttagtgaaccggtatggaaaccaaaaatactgagttcaagtagagataattacatgagcccaattgaatccctccatgaccaactggtgagctctagcaataagtcttaaattattggtatggttgaactgctctgatatatcctgaaatgatagaattgataagtcgatgaacatgaggtgcacagctaaatatagagattctttttcttatataaaatgttacctgcccgaaggtgtatccagcacctcgaggagaaataccccaaccacatcgatcgtctggatcagaccacagaagatcacacatgggcccttcatggggaacttcttggacacgatcgaagttacgtatgttatcaagtgtctcaatggatggcgataatccaccatgcaggcaaaatatttctgactcaacctacagaacaaatgaacagcttctgtcagattcactagataatgtgggaaggatgttggcatatacatatgaaaatgctgaatacacaccaatgctgtcaaggggaagtaatcgaagagatctgtaaaagttttccacacatttgcattcccgtacctgcaagaaatacagaaaaaaaaacggttcttgtaagcttaattcaccaagaaaagggagaataaatttcagtctcaaattaaaaaggtaattgatataatacaagcagcagtgaagtttattgtatgaaacaaattgttgaaaaatagcctaaatacctttttacacatgattcatcactatatttttatcagcacaaaatggccttttagaacattgcagtaggttcatcttatgtcttagtaacaatagttgcaagttgcaaacaactatacacatgaatgatacaaatatccttaatggtcaatggaccaagctgacccatcataaaattatatagaagtaaattagttactaatggatcatattattttaccaccgctgtcatttatcagaacaagactagataaaagcttgcctagaacaaatttactttagttacaacacataacaaaaggcacttacttccttaagcactcgtcatagaatccataaacttgagtgatctgcaaaatgattcaaaaagcatcattcagttcatcagttgtgacttgtgagcatgtacagttgtacacagaaaggataacaaagaatgaagagatgcaacaaaagctttaactttcatataatgacagtaagcaaacatcaagaatctgcattttaaaaaaagtacatacctgtcgactttcgtggtttcctctgagaatagtaattcgctgaggataacgaacctttaaagccaccaaaagctgtttttgtaaaggaatacattaaaatcaagaactattaattttagaagtatttgtaagttaaatgtgcccaccaaaacaaaatgataatcagccatgttgatgcttaaactactcttaccgtgacagtttcaacagaataataaccacgatccacgtaatctcccataaacaagtagtttgtatctgggcactggtaaagtgaagagaaagcataaatatatttgaagtttgatggactcaagatatgcaaaggggacaacgaacaggaaaatacaactgatacctttccaccgattcggaacagttctgcaaggtcatgaaactgcccatgaatatcaccacatattgtaacaggactctttacaggctgcagaagcatggcaaagaaaatgttaaattatcaacaaaagaattcataatttattatatgggaggcacataaccatctcaaggaatcactgtaagttaaaagtatacaaaataaagctgctttaactttcgtttgcacggcagtttcaaaacaaaacaaaacctgtaaggctataccatgcaacacataatacagaacaaaaccaaatataagtacttctgtcaatattatggatttacataaattcagaacaagaaactagaataaaattttccgaggagacatgcatatacatgatctgaagactaaatccttgtgtggttcaacctgggtttcgtctcaagactaccccaacttcctctagattacccgcaacttattttgctattgttgttctattctttaattattatattttgtaaccaagtttgatgtacaatttaatttttttttcgtttctggttgacttacaaaagaatttgatcctagatgaatatttctagtgatctgagcaaagatccatgacaaatttaagagattaatgaagtgtgattgttgcactgccaacatgaaatattcatccttgtcaaagacaaaccatgctcataggttcccattacttcaaagactatagaagctaattcgtcagtcaaatagtaccatcatttcatgcaagtgatccaagaaaacaagctggagtattgcacatttagacaaactaaattttggaagttttccatgcaaggtattgtaacagatgacaccatcacagcatagaagactagtctggtagagatgaccttagtctcaaaagccataagaatataagatattgttggctttttcattgagttttcatgagaaatagatctgatgttttcccttaactattaccacctaaattatactgcgatgaacaaaagcaggcccaaaaatgagatcctggctaatcctagcgaatcaagaaagacatcatagagctgtaaaatatcatacttgaacgttgctctcctccatcaatatctcttttgccttctcgcaaagtgctctgacctgtacgaaaaatactcaagaatgagagcaaatctatggtggctcactaattaaccagaaagaatttaatcgagagaggtgtgaatttggcaaaaggcataaatctatcggtttggaagaccaataacaccctaaacattttcctgccaagactcattttttctttcacaattcaaccagctgccaaaattctgccattgacgacgagcatccagagaacattggcacttcatgcaaaagccaggggcctcagacagaaaataatttcgtcatctcaccgcatctaatcctgtgagatgcaaacctcgtcgctttgcaacccggagagtaaacacacagcgttcgctccaccaaatcacaacaaccgaaaatccgagcaaactttttttcttcaacaaaaaaaaaacgaaatggagccgagcgcaacccgaggcccgatctcccccgaaaggcccgcaaatccgccagatctggccacacccgccacgcccgaaccgaaagaacagacagcaacagcgcgaggtcgagcggcggcggaggaggaggaagaacgaacagccagcagagggagagcaggccgtgtgggtggtgggtacctcgggctcggggaggggcttgcactgcatgaggcgctcgatctggtcgtcgaggccgccatgggggctgctcatcctcctcgccgcggggggggggcgtcgcgcgcgcccaaccctagatctcggcgcggcgtcgggggacgcgctcgtgtgtggaggaggcggaggagaggaggggggcaaaaggtctggtaaggagcaagggacggcggatatataactgagatttggaggcttgtggccatcggaaaaggaggtgaggaagggagggaacggaggagaaggcttctgccaaggtggggccacggttgttttggtgattcaaacctcctccttttttttctttttttttggttgagaaattggtgattcaaacctttgcttaaatttaccatttggtgatttctggttaaatttatctaagtatttgcatgtgtttgcttaaatttaggtgttgaatttgtaattggctacaacaccagccgcctttaggatgagtttagttccaaacgttttcttcaaactttcaacttttccatcacattaaaacttttctacacacacaaacttttaacttttccgtcacatcgttccaatttcaaccaaactttcaattttgacgtgaaacacacccttatatatgacattggaaaaagagccatttacagggtgtgttcggcactaagtttctcaaccaatcttcctcgttttccgcgcgcacacttttcaaactgttaaacggtgtgtgttttgcaaaaagtttctatacaaaagttgcttaaaaactcaaattaatccatttttgaaaaaaaatagctaatacttaattaatcacgcactaattgatcgctccgttttccgtgcgggagggattagttcccatccaaggaatctgaacagagccaatagataatacaacatttaacttctctaaggtgttcacgttgggccgatcgttaagatgtccacgacggatgttagcaattttaatgtgattgttcgtctctttttgcctctgcgagctagtgagatcataaggatgcttgcttgttttcttttttcgtacttcgtgcccaaccatgtgttgcgtgagtggaccaatttttcaggcgcgcgcgagtagtgtgcccacatgtctctcatatgtgggctccagctaggagagacacaccaatcaacgttggcctcacgtatcggttggaacgtgggacatttacttgtttttgttgtcgcgcttgttgcgtgtaggactccgccccagagtctgcctcaaggcagccaagctaaatgaggcgtaagatgacggttcacataccagcgctggtgactaaaggacgcaagcaagtgcaaggggatttagacgatggttttcacctgcagtaaatactagtaacatgagaggatgaaaatgatttttttctaatttattttttttgcttaccaaggtgatatgtaacctaaaatccaaactagaatagagctgaagaataacataacttgttttgaaagttatactacgtggtattttccaattaaaagtaaccatacttgtattgctaacatgcctatctacgtagatgaacacggtagaatacagtgttgatgacaatctggaagaaaataatgatatctgaaagaagaattatggctgcatgaaacaattccacctacaggtcaggctttctgagatgataagacaataaatgcaattagcttttttttcaaaaaaaaaaacctaaaccagttgttgctggttttatattaagcgagtgaagagctgtacatagtaacaagaacggtgaggaacagagaaagaacgaaaacaaaaaagaagcagaaaaagagaacagacagggagatcagaggagctacatagaagcaaggaaggttacaacaaggtgctatttggcgctaatctcgctaagtcttttggcccacatcctatccatgtgttgatttcatccacaattctcgtcaccatatgcaacattgtgagttccttgttcccgaaagctcgccggttccattcacaccaaatctcccagctgagaagcgtatgtatggagtgtgttccttttgttttgctcttgtcgctgtggctcgttcttctttcccaccagtcaagcaagacgtcgttggcatttgcgtggcatgaaagcgtgatcgcaattcaatcttgaagagaccctagccccaacttcctttgtgaatgtgatctcctttaatagatgatgcgctgtctccaagtttctgtagcaaagctgataaaaaatagttgttgggctattgccagagttgcaaccgatcaatcgtccaaatattttttgcagcagcaaccatgcgaggttcttgcatttggatggcgcctaagttttccagatcatactaatggctattgatctggttataccgttgatttgagccaaatatgctgattttgatgaatacttgcaactagttgcattttatgttaatctagtttgcatggtttgattcgaaaatttcgcactgacagactaacaggtgtacattcaaagttgcagaaccactgctacagaagccgagccacaaactgaaatttcacgtctcattttattttaaccctgaaacaaagtcaacaccatgtcatcatggaagcatggacacttcaagcaaagatgactcttgttcattaccaggaattaaattgaagtaattaattactctgttgacgcagcagatgcactaataacaccgatcaaaataaagagagaaacgaacaataacaaggtacaacaaccagatggaactgcaacatgtagcttccctccagtaattcacaagtaacagcggttacttttctgtccaattatcgcaaaaaaaaaatacttttctgtccaatttcttttttcctcgagcagtgctaacaaaaaaactcatccaaatcaatcacttgacaatttcctcttgattgcagttgacgagcactcctccaaatcaccacggttgttagacactttttaggtacgttttagtatgttttttaatacaagttttaagttttttgttcatgcatatgcaaagtgtcctgtaggtgcagggcattggattcagcaccatgaaactgatttgtgctggtggaaccttgccctaacaaaacgatactcaaaattatttaccggtatctccaaatatgcctgcaaggtcatctgtgacgtgaaacatgttctccttttatttttttaaaaaaagaaagatagaaatctagcatctatatccgcaaaggatatagacagccaataaacatattcttctcacagtagtagaacaacaatgtcatatgtgcacgctaacttattgtgtataaggtcaatggctatgtgaaacaacaaatacaaattatgcacgttagagctacaatactccctccattcataaatagatacagtacaaattatgcaattaaaacctttaaatcatcaatatgtaaaatattatatcttatataaaaaaatatattaatagttttttcatgtacatgtattttcaataattttcataaatacatgtttataaaaatcattcatgaaatatattcattagagactaaggccaagttattttattttatttttctaatttctgcgatggactatttactccacgcttattaaaaatatgatttcttgaacttattttactgcaattgtttgcatcacttattctaagttatgtataaagtttttctgttaaaatgttaattaatcgtgtcaatcgagtaaacaaccggtctcaacaatccacgtaaaaaaatgttccaatcaagccttaacgtgtgttttatagtccttctttccaacttctattacttcgttttccgtacgtacgtttcccgaattgctaaacgatacaatttttttagaaaaaaaactaaggaaagttgcttaaaaatcatattaacctattttttatgtatttttagttaatatttaattaatcatactctaatccatagctcttttacttgctagggaaggtttccaaccgaacacaaccttattcatttctctaagtgtaaaaaaagtgacaataaaaaaaaagaaacgtcttaatgtcactgtatggccaatgcaggccacctcacgccacacgctgtatcgcgcccatagtttagcgtggtttaggtggtggcccatagtatacaacgtcatacaaaaagcttccgtacccgggccgcttccggatccggcccataccgggcccatcaacggggccaccgtcatagagcgcgcaagaggcgtgacgtgtcccgtcgcgtcgcgggccaagtcagatatttccggtgcgcggtgcgcccacctcgctcgtataaagccctcccctagttgcccctcttcgaactttcggcatccgctgctgttttctcttccgctttttcctctctctctcgcctcgcctctgcttcctcctcccgttcgtctcccctacctacctagggtttctcgccgcctcgcatcccctcctcctcctcggctggttcgcctcctactctacgcttgctgctgcaggtgagcatccccccgatcccgtctattcgtcttcgcgcgcgcgcttccgctgccgatttgctcgatccagttcgttttgacgggcgattgctcttgtttttgggaggaattccggttgtttttttgtttcgagggcgtttgcttggagttggcggtgtcggcggtgctgcttgcttgttgaatctattggtgaggtgttttgagatttggagctgcttccgctaggttgcatgcgggctatgtagatttggtcgattcgtagggtttccgcggggggattggccgcggattggaaaggaatcacggtttagggtagggttctcccgcttaatcgtgtgggagacgtacctcgtttcgtggcttcgattcacgagtttatatggggtttccccgcttgcatgctgctcttatcgtcgtatctgagatgattgcgttagtttggtgtgattgctgcccgttggtactgtttttgtgttgaatacgttttctaaccgatgagatctactggttaatgttaatgcaagtgtagtcaatttactttgtgctgtaagtagattatgattccctgtccacattactagttggagattggttttggtgctgtttactgagtaatttgcttagcatagttgtagctaccagagctcttagcaaaaatctgccaatgctacgaaatatgataattcccactcggctctttgcctctgttagctttagtgcttctttattgtggattttaagcttcattttaatttctggatgatgtttatagagacataatttggattgtttcatatatgttttcatacaatctccagtaatttgactgcagttacatgttgtgttagccttatttgtttgccacttaccaaaggcttaccaaaggattgacaagaaaaaaaattgatagttgttcatttagttgatattctgtattgttgccgctgaagcacctttcttttttgttcccagatgtcacattatgtttgtattgacttgctttatgtatctgttatctccaggtacaagcgataagcagtagcttcttcatcaaaggttttgtgcaaaattatgcgatcttcatgggctgattcagttgcgaacgccgaggaatcggcgcccgcgactggtgctgctcccacccctgttgctaatcaccagaactcacgccccactcgcagcgcatacgtgcctcctcacctccgtggccaggcaccaaccacaactgcagctccagctccagctccaggaccagctgctgtccagccctcagcttctgtacagccttctggttacgcagctattgttggtggctctcgctgggctggccctgccagtggtgatggtactggcgctgtaggtggcccacgccagagcgttggtggtcgtggtgggggtgggggtgggggtgggggttggaactcccgccctgggtgggaccggagagaccgtgaacctaacccttttgccaatagcgaggcagaggaagccacagaggttgattttgatacggcaaacactggcatcaactttgatgcctatgaggacattcctgtggaaacaagtggccatgatgtgccaccgccagtcaatactttcgcagagattgatttgggtgatgcgctgaatgagaacatacggaggtgcaaatatgtgaaacctacgccagtgcagcggtatgccattccaatctccattgcagggcgggatctcatggcttgtgctcagacagggtctggaaagacagccgccttttgtttccctatcattagtgggattatgagctctaggccaccacagaggccaaggggatcgaggactgcataccctcttgcattgattttatcccccactcgcgaattatcagtccaagtacgttttccactccttttttggtttggggtggggcatggggctgtccttattgttgcattgtttcttactatatacttttctgtttcagattcatgaagaagcaaggaaattcgcataccagactggtgttagggtggttgttgcgtatggtggagcaccaatacatcaacaggtttttctcgcagccttatttatttccgcataatgatggatcaatcaaccttggagctttgctgtttggtctgctgatttcctttgtaccttaaaagagatcattatattgtgttgtgcatatgagccccccttccattcatgtgcactctagccccaaattgtaaccttgctcaataatgtataacgaaagctcgcaggtctctaggcattctagaaaggttatgatagccatcctattttgtttgtgggtgctataaatctaacaagtgatctttgctgctggctgcatacatgctgtaatgtggaagagacattattaattatatgaatgtctttccaaatcattggacttgtgaccataccgtgctaaaaattgactggagctctcataacatagatatgcgagctatcttaactatgtatatggtgatagatgattgaagtatgtaggcccagaaaaatagtcatgcatctgtttaggcaatcatatcatgaccaaatattattagctttggtaagctagcctagaaagtaaacagccatcctttgcatagtgacgtgcatagctattgaacacacgctttatctgttattgcagttgagggaattggaaaggggcgttgaaatccttgtggcaactcctggtcggttgatggatctgctggagagggctagagtatcactgcaaatggtgaagtacttagctcttgatgaagctgatcgaatgcttgacatggggttcgagccgcaaattcgtaaaattgttgagcagatggacatgccccctcgcggtgtgaggcagacaatgttgtttagtgctacttttccaaaagaaatacaggtatgttttctactttaaacttcctgctttgataatatccatcagcatatgatgtatttaacgattttattggcagtcctgcaatttagtcaatttatacctgtccaatagttggttgtgtgtttttatcaaacgtgtattccaaagtaaaaaaatcagatctattactatagtggtctatctacctacatttaagaaagatcacatgcaacatgtttcaggggtattgttttccaaatattgtgtggtagaatttgatcggaaaaattgtaggcacaaatgcctacagtaaaatactgcgataatctatatgcagtcatctggttagataatcttatatttttcttgatgcaaatctcctttgcccccttgcagcgcatggcttcagatttccttgcggactacatcttccttgctgtaggaagagttggttcaagtactgacttgattgctcaaagggtagagtttgtccttgaagcggataaaagaagttacctcatggatctcctccatgcccaaaaagcgaatggtactcatgggaaggtattgatgcatcaatagttcttgatgtaatttactttatgatatcatgaacatttattcactagactaatgaaagctactcttaaggaagataggttcagctcaaactgtgatcaattatgaatctttatgaataggagtattgttccaccagctcatgttttcatcttgtttgcagcaagcgcttactctggtctttgtggagacaaagaggggagctgatgctttggagaactggctttacacaaacgggttccctgcaacaagtattcatggcgaccgaacacaacaggtacgccaatctgtggatgaccttgcactatatgacatgggcatttcaattattttctgatttatctgtgcatatcataattggattttagggaaataaaaagaacttcaatgctccaacaaggcaaaaacaaatgcatgttactaccatacttgatatgtataattttacaaatggaagtgatagctcatcactcgtctaaaacaatgcagtgataaagctatcttatatagagaaaattggaaccatgccattataatttgtagaaaaaagttataacatattcaacctaaaataaatttattatgaaaacatattcaattattgatttaattgcttccagtttaatcaagtttgtagaaaaaagttataacatattcaacataaatggttggcattctttatgttttgtttcaataattcagactgagcagcatgatgcttgtttctgatgtcacataggcacatgtatggcaccttgttgatgccttaggtctgctgaaatgtaacatctttgttatctctgtatgcttggtattcccaggaaagagagtacgcgcttagatcattcaagagtggagcaacacccatccttgttgcgactgatgtagctgcccgtggacttgacatacctcatgttgcccatgtcatcaattttgacctcccaaatgacatagatgactatgttcatcgtatcggacgaacaggacgagcagggaagtctggcttggcaactgcatttttcaacgagggcaatctatccctggcgaggccgttatgtgagctaatgcaggaagcaaaccaggaggttcctcaatggcttgaacgatactcggcccgttcttcgttcggaggtggtggtggcagaaaccgccgatcaggcggtgcccgttttggtggccgtgacttccgccgcgacaataggggtggaggcggcggcggttatggtggtggcggtggtggctatggaggcggcggttatggagggggcggtggatatggcggtggctatggtggtggtcaaggctcaactagttcgtgggactgatactgattcccggctgtcgcgagcaacgatcatattctattgatttccctgaaaacatctgatgtgttgggatttgtaatcagcctggttggcatggtgctggaaaatgcgcccgtttaccttcaatttatggatggttgttactgcactggctttctcgtttactggcaatagtcttggttggctgattcacctgtccttttcagttgattgtttcgcgtagtttactagtttcggacgaggcattactggccagatgttttttttcttttgtttattaatgttctttcatttttgaccggaatacttctatactagttttggcacatttgcattgttacgcagaagtgattaacattcgacggtgttacatatggtatggataaacatacatgtttttcatcaggcaggtgagagccaagataaatggatactgcatataatgaataaacaaaagaatgtcgccgggaaaataaacactcgcatgatcttaaattacatcaatataacacaagctaacaaaaccacagctatcttcattatcgaacaaattcttttttgccccattctacccaaaattttgcaagaaacaacccgcattcttataaaccatgaaaaggtttagggtgaacagataggtgaagagatccaacttcatagaagtacagtctattcttgcagtcagtcagtacttataattgctgcatgtgctttggagttggcgctgataataaatctggatatcaaattcacttcatgatcaaatgcagcaggcccttccctgtttcaaattttaaaacgaaatagaacaggtaaaattgttgaaaccatttgacatacctgatgcgcatagattgtctagttgagggcaatggaccacctaggacgaatcacttggcatatatcatgcccaaaacaatagccaccaacagaagtacaaccattatctgagcaagtcacagaaacagtttgagaaagataaatagaaacagaatcactaaaaggatttaaggtttatatattattctcaccagcatggagttgtactttgacttctccaaatcgtatcccctgcataattaagatgatcggtagggatgagaaatgccaacagaaataaatggaacactaaatcagaatcaaccaacaaaccttctctttagtgagcaagatgacttgcaggttctctttatcgcatcaacacgtttccgcgttagggaagcatttggatcattattatcaatctggacatgtgggtaaaacatcatacactcttgagcaggacaactaaggtagcctttgaaggccagaaataacagtgcacatcctatatttgctgtttagaacattctgctgaagactaaaataatttcatgatccttaaatcaacacaacatttaatgcaaaagtggctcaaagaacaagttcaaaagaaatgtttacatattaacaaaaaataattatactgagtgaagatttttgtgcaatacaattgatggatagcaatctattgtaaaaaatgaaatatttgagtgtcttattatctatatggaagaaatgagcgacagccaccctacattcatggtagcaaagatcatggtccttaccttcgattctatcagcgaagagaactcatagaaagcagtatagacatctgacattgtgtttgtctcatcaattactcgtgcagtgagccctgagagaacatgttaatttcctgaggtgagagaacataaaggtaactagagactggagcagatgtacttagtttataatagataaaggtgacaaaacaaaataaagttgcttaaggaaattattactactatgcaaattcagtgataaatatatataaattatagttgcaccttctgctaactaaattatagctgttctactgagatatggagccatgtgcccaaaaaacaaagcatacaataattctaaagatactcatctagtcatcttactcaacaaatcaccattctttgtctaaaccaaaagggacaaagaaatgccagcaatgaagtggtgaaatcttatgatacactaatcaacaaaactgacacaagttacaatgatgccaacttgtgacaatgaacacaggagcactccattgtgtaaccaataggattattgttgcacattgatcaatttctgacaactgagtaaataaatacaattactcttaaattaaccatacaaaagaagagaaccggatagcctatccatattgaattccattaagcaaactctgacaaggtggtcatggagataaaataactattctcctcaaagtaaagagaggttactgcaatttgaatttacttagtatgtcttatgtaatcttaccacgcctcatcttaacaactcctctaaagacattcacattattgtagcaaatagcacatgtcccaattgccattatctgaaaagatggaatgatgtattagtatcctaaagtttgttccaaaataatacataccaaacatattacaagaatagaagtgtataatactcaaacacaaaatgttaggtcaattaacagcttcaaccaacgaggaatgctacccaactgccaacaaatatcaactatcattggcccaagatttagcatgtcaacagtgatcaaacatgaactaataaacaaaccaattcaaatagctggctcctctttaccacagatatggtacaaagatttgctatagcagtaaattactgtgagtctgtgacgccccagaataattaggaaaaaaatagagatgaaggggaaaagatagagaagaagagcaagtaagcaggcagcaatgagcaagctagttagcgtaggcgcaagtgagcagcaagcagaacagccatctggccttgggccacatgtgagcacagcagcaatagcgctagctagtaaacacgacagcaaatgcaggagcaggagcaggagcagcagcagcagcaagcaagcctgtagctagttttttagattgcctcattattgccgcgacaacagcctagttcttcacattcaccgagcaatgcatgcagtcattgaattacagaaaaataaaggtatgcatttctgtgtattagctaaagcgttgtgggcagagggctccgctacttcattcaggggggctagcctcatgacttcactggacgaggggtactacttggaatatagataggccccattctgattcgtgcgtaattaatgtgatgattccatgaatctcagaaaaggtaggggtcaaggacctagcctaactatttctaatggtacaaccctacttcgagaaagcctgtcttactgcatctcgatctatatgaaagagcactggtattttctttcggtttcatcgatagcagaagagtacgctagctagcatagcctgaaaacgcttgctcagtaccacctcggctagctggctccatgtgcaccagcttataagtagtagtctggtagaataaattcccggttaaccgtcactcagatgtgtggttcaagtagatgagttgggcttagatccatacctggaccctaggcattacaatcagcattacatacaggtattttaaaaaaaagagtaaaatttcctagacgtgtacactagcaataggtgtacactagcaatagcttaactaaacttcatggccaatataaaagttatcattatatactgcaagcaagcacaagagaatatcataaactgttaatatttgacacagactggcacaatttgcattggttcaaaaatttggtactataaaagattaacatatacctgaggtattgcacaaaaacggaaaatggcatgatccttcaatgctgacatgtattggaggcagtcttcagcatgagacagagcgttagtcaccatatcattcaaacactgaactgccttttctgaattttcctcgtatttcaaatcctgattttataaaaaaatgtgtattattacacacagaaaatagataaaactgtagtggactttccagcataataaatgaatttatattatttggttattgacagttggatttaacacttcaaatggcatctcttgtcaattgtggtgacaatttaatcatttcgaataaatttaaagctacttcctccgtcccgaatacttgtcccaaaatagttgtcactttaaaatactacttgtcatatcaaccacttccaattcaaatttctccccattatacccccaaccatcattccacatccaactatgcattattaattaaggggtattatagtctttgtcttcaaaccttagtacatgccaaataacgtagaacgacaagtattttgggacggaggtag

SEQ ID NO: 80592 - DNA, 4228 bp, Oryza sativa
aggagacgccaggacgggcgacagaggcggcgagggagatgggcggcgacggaggcggggatggaggggaatggcgtcgggatggagtgaaatggcgacgatgcgatacgaatccataggatagggatagggtgagtaagagactgataatatatgataatacccctacgcgaattatttttcttggacgaaaacaccccttcacatttctactcccactaattctggtgggagtagaactagatcttaacccttcaattaaatatgatcaatggcccagattactttctactctgagtagaaagcaccggagtgggactcggtggttgcacaccttatacccaaacaaccatttctatacggtacgagttgtagtccaatatagtgctctgaacaatatattttctttacgagatgatgatgtgtgtcatcttctacgatttctaccctccaactcaccttgcatctgacattgagatatgaactaatgaaccatgtttataactgatggcttataatgctccccaaaaaatgttaatttaatgcaacactaagcaaatgttgatagttttgtaaaattaaaagaacagtagttttcgtgaaattttctcatagtctgtgacatagttggtctatctacattaattaaaacatatgctcgacaactttacgcgtgatgataaaagataggagccttaatacagctactaaaattatcacgataactactcaataatatgtgttcaatacatactgttactattactatgttgttaaatccctaattaaaagcagtcaacattaaaacaaaccacctataaattatcacgcggcttagcattacataccatctcctccaactgatatcgctcatttttacattactactcacaaacctttacctaatagctcgtgctaagctttatcaatctaaaatcaaaatccttaaccatgtaacataatttcgattgtatatttatatttaacgtggtactattaaatctacacgtccatgaccatgactggtggttttgaacttttgatttttgaaggtgggggcagtaggggcacttcagtcattcacgcacattcatcccgtgacctttgttccacgcccatcatccgtgccgaaaagcatattccaatgcacggagccaactatgcaacaaaatgctcgtaacaagtcggctgccatttgttgtgggcggcgagccggcgacaaaatttatttcacgatgagtgcagtgagacgctaccgggaatttctttttttttttcaactaaaaatcgtccggatttgtttgggaaaaagtgatttatttttgtttaggtctgcgtcagcgttatctctaaggtcaacttgctcgcctcgttccggctctatggcctctgcatccggccaaagcagttttatagtaataatatatttttttttcttacgtatgatagatgtctcagtgtgcatgtccaagaaggtatatgtattctcaactttttatcgaaaagaaattgtgactctccaactgctgctgaagaacggcaccgtaaaatgacgtattcgttcatttgatgagactcgtgaaaggctagtttggcttgttaattcggttgttcaatcttaacaaaaaaaaatcaggcagatcagacggagtagaaactgttaatggctcattaattcagttgtttaatctgaacaaaaagcagtgttgtactggcaaagtgagcgcacctagttagatttcttatggtggatccgatttacctggattcaagttctaaaatttatatgagtgtttgtatttacgactaaaatttatgtgatgtttttgtcgacatcaagatgtttatgatgactttgtgaattttaagatacaccgatccattttttagaggtgcttgtaaaaataagatgtgtgttcgtagagataagtgtgcgtttgtaacttgtttctaaataaacaaaaaaatgttggactgttggtagcctctttgtcaaatcaaacgaccacgaatttgacccacgaatgtccacaacgaatacggcccaattttccgtaaattaattacacccatgaattcaatcggcctacctattctcaattgacgaattcgaaccaccaaaagctaagaacaaattcagacctcttaattcaaatcagtccacaaatgaattaagccgacgtctgattcatcactaaatttagcccaccaaatgtcacgaattaatttggcccaccaaattcccatcaatggattcagcccaccaatgaatttggctcacttcgtatggatttggcagtatggacgtggtaaataaataaaaaaattatgaggcccacatgtaagtgagaaaaaaaatgtgaaaccacactactttttccttttcttttctcctttctttttcctcttttctactcctctccgaaggccggcggcggcggagggagcctgagagagagggggcggcgggcggagcggccgctggcgagcgcggcagtgggcggctggaggggggtgaggcggtcggtgagcctgggagggaggaaagcgggcggcggcaggcggagcagcagcgcggcggcgagcgcgagcggcaagcgagcgcgtggcgagcgagcgctgcggcgtgccgccgtgccggaactcgtgccgacgggtctcacccaggccgcaccacacgtgggagcagaggcggagctcgctgtcgctgtcggtctttgcccgctgcccgaagtcggagaggagcgggcagccaccgatggcgccgccgccagcgagggggagggcggcgaaggagcggtgtgacactgcggcggcccttgggggggagaatggcatggcgtagaggaaggtcgggatgcggcagttctgttcttgtccctggtgtgtgagtagttgctgtttcagacatgaaggcagctgtggggaacaagaaaagcaagggcactttctgcgccttctgccacccttctctgctcctgctcatcgtggcaatccagttcttgatgatttactcaccaacccttgatcagtacatggtgatgctaaccacaggttgttgattctgagtcttttttggagaaaagattctgattttgtttttgttcgatgaaattattaatgcagatgagttcatcccggagcctcacctgcgatgtgacttcagtgacaataaatccgacgtgtacgagatggagggcgccatccgcatcctcagccgcgagttggaggtattcctggtggcgcctcgcctcgcctccatctccggccgcagcggcgtgaacacgacgggcttggacgcgaacgcgacgaggtggaagatccagccgtacacccacaagggcgagtcccgcgtgatgccttccatcacggaggtgacgttgcgactggtgaccgttgacgaggcgccgccgtgcgacgagtggcacgacgtgccggtgatcgtgtactccaacggcggttactgcagcaactagccaactactaccaccacctcgcctccctccgagcggcagcagctaccttgtctccctccgtgctcgcccgtcaccgcccgcctgtggcctgctccacccgccgtcctctcaggttcggggggaagaagagaagagaagagagaacaaataaaagagaagaagaaaataaaaagaaaagaggagaggagaggacactgacatgtggatcccactatatgccatgtcagccaaaccaggaaaaaaatagatcaatactgcctaacgaacttttttttttttttacggttttgtataatttaggggcggagatttttggttttgtggttaaaagacctcaaaaaatctcgttaagttgagggaccttcggtgatcttattccttctcataaacaaattaggcccacaagtgaatttggcccacttcattctcgtcaacaaaaagtggcccacgagtgaatacatttgaccgccgctgatcagagaattcaacccataaatgaatttggcctacttaattctcatcgatgaattccgcccacacataaatctgggccaccttatttcgataaccaatttcggcccatagttgtattcggcccacttaattccccgaactgttctctccggcacgcggcggagcgggttgctgccgacagctcgacaggtgttcgatcaaattcgcgcccggagaccgagactctgagagcgacggctcgctgccggcgaacgggacgccgccatgtgccccccggg

SEQ ID NO: 80593 - DNA, 962 bp, Oryza sativa
aggcgaacgcgaagccgagccccacaccgcgccacgcggcccgctccgccgcgcgacaccgcgacgccaccaccccatcatccgctccaccgcggcgagcaccgcgcgctgctgctgctgcgtccaaagtccaagctcccaaaccaaacctgcgcgtgcccaatcgatcggcgccatggccgcggccgtcgtcctcctccgccgcctgcgcggcgtcacggcggcgccccggcgcgcggcggcggcgctgcccctgaccacgagcgtccggggtgtctccgattcgacggagccgctcaccatcgagacctcggtcccctacaagtcccacatcgtggacccgcccccgcgcgaggtggccaccacggcgcgcgagctcgccaccttcttccgcgacatgtccgccatgcgccgcgcggagatcgcggcggactcgctgtacaaggcgaagctgatccgcggcttctgccacctctacgacggacaggaggccgtcgcggtgggcatggaggcggccaccacccgcgccgacgccatcatcacggcctaccgcgaccactgcgcctacctcgcccgcggcggcgacctcgccgccctcttcgccgagctcatgggccgccgcggcgggtgctccagggggaaaggcgggtcgatgcacctgtacaagaaggacgccaacttctatggcggccatggcatcgtgggcgcgcaggtgccgctcggatgcggcctcgcgttcgcgcagaggtacaggaaggaggccgccgtcacgttcgacctctacggcgacggcgccgccaaccaggggcagctgttcgaggcgctcaacatggcggcgctctggaagctgcccgtcgtgctcgtctgcgagaacaaccactgtgagttggaattcggttcaatctttgggattgattttgctgcattgttcgttgatcgctggatgaattgcggatggtttg

SEQ ID NO: 80594 - DNA, 10498 bp, Oryza sativa
atcagattatgagaacaagaagcaattcgtggtttctcgagtataaacgaggtatatgatgacatttgcaagaatggagggagaaccaagtcaagaaggaataggtacaatcacatattttttactatacacagtacttttttactttttagtaaaatgatctttgtagaactaacttcacttctcagagaagtaaaattatataagtaacttcaccatccattgaagcaactgcattttggttcataccttccattttttgttgtgtgcatattggttctacacacgactgagcaattttttccagacaaactttctacacacccctgtgcagtaactttacatgtcatagaaagtaacttaacatgtcactgaaagtaacttaacatgtcattgaaattaatttaacatgctacagtagttgtacaaggtatactaatttgcttatttatttttttttctttttgcttttgttaaatgtagccaaaagatcattgatacaggagaatattatatttatcttagcgatcttgcgaactctgtcaaacctatgggctcactggacaataacacatgtgaattggcattaattgttctgtctgctgatatcaaggacaattcgaagagaatttttcctgccagaataggagtgagtatataaaatttacaaaaatctctttttaatgtattattactatcattgcaacaccttatgtttttttttccacatggtgcagggatatttgttggattcgaagttggacaggaatgagctcaagaaacacttcgatcaaacgagagcgaaccgtcttgaccataaagaattagtaagaaaatatatattccagctgtcaatgacatgtaaagttactttttcctgtctgcttgtagaagtaacttaaatgtctttgcaaattaactcagcatgtctgtggaagtaactttttctgttatattgacatgaaatgttattctgaatcactttttattatccttttatacttactaaattatgattatatttactgaaaaaccttttttccactcccctccctcttttcacttgaatgcaggcattttttcccattctccaggaattgggtaatgggaatcataaggctggtcactatttcgtggtgtgccttaatctgaaagctgaaagattcgaggtttatgattcgctgaggggagaagatgacgaagcgctgatttcagcatatcatcttgttgttgcatccatcaagaccatgtgggataggttttacatgaggtcttcgaagaaaaccatccagaattacccactgattttcattgatggcccaaagcaagataacatgtacgtaacatgcttttttttagttagtgattttcatttattgtttttagtcaaacttatccctgttttgtttttgcaaacaaaaacagccgggattgtggtttttatatgctgaaatttgtggagttgtgggatggcaaacagttgccagcatttgaaccaagtgacatccccaacattaagaaactacttacacacaagatgctctcgtttcaaggaaatcgtgtgcaatggatgcaagtattatggggcaaagagcctgatcctacacttaaggtaaagtaatgaaacactgcattttttttccagaaccagcacataagttatagccacataaattaggttgggtaacaaattaaaatagcatcttggttctgcaaagaactcagcatggtcttcctgagaacttacatatcactgtgaagtaactactatggaagctaaaagtaactttaatgcaactgtgcaagtaagtttcaacaatcttgtcacaacattataagttacatctcgtagctctaattcacttctcagtactagctaggcctttcctaactgatgtctttgacgcctttgcatggaccccaggcttgcgtcttgttgaaactggtctcccttgcttttgtatgatgggggggtcatttatctgtagcgttgggttagttgatgccgaggggatatctgaaattcctcttgcaggatcagctggggctggctgtgcttttttctgtttctttctactctgcttcatagctgctaagtcatcagtcattgagctcatacgctgtagagccatacggtaggctttctcgttgcttgatgcatcttttgcaatctgtgtaaattttgtgcacagattggtatacctgattagctttagagattcagggggcaattgcatttgttcaccaatgcttgtaactggaggcaattcaggctctttaaccatcgtccatctaggcaatatgtaatgttctggaatgtcactcacttggcccacaaaatcagatgtcatcacctgcatggaaaaaaacatatgttttattacctgccaaaagtgcttaatgcataagaagtaatttaatgcacattaagaagtaacttaatgtgcagtgagaagtagcttaatgcacagtgagaagtagcttactacaataacagactgttaccttcagaacatgacagcaaagaatgccatccctttcaaacttacagcattcacagttgtatgtcctatccaacacatttgcagctacaatgaatgcccttgatccataattcctaacaggacctccattcggttctactagatacatgttttcagaagttcgggtcaatttatatgatgttgaagcaatcagctctttttgaaatctgttgaatataggccttgtgtagacctccaatgcttttgtttccatgggatagttaccccacatagaagggattgtttcttctgcttcaaactcattctgatctgttgcaacagtgattttttcttgaatcttcttgtactgcaaaaagaagttgtatatgctattttggggatttacatagcgcttcagcactgcgttaaatccctcactccgtgctgtagtctggaggaaagggaagaaacagtgcataaagtatactgggacccaacactgtctcatttcccaaaggtgtcggaagtgctcattatcttgtaaatgatatgttgtcaacattgcatcccatttagcatcaaactcttgctctgtccagctattgtcaaggcagtcattgaatgcatcacacaatgctttgtcatgatctaatatatggccaatcttcttctgagcattctgcattatatgccagtggcagttgcgatgcttagcatgtgggaaaactagcgctatagctgccttcatagctaggtcttgatcagttattatgtttgtgggctctacaccttccatagcctctagaaatgcttgaaacaaccatacaaaggtttctgtcttttcattccttagaaatccacaacccagctgaatatcaaaaataatacacataaggaagtcagtacagttttgaagcaagtaagttactacaattttgcgtagtctctacagtttgtgtttgctagaagtaaatcaatacaattttgaactatagaacaaacactaaaaatgtaacttgtaaacttagttactttttcacctttttttaaaaaaacaaatgtaacttcacattctactagaagtaacttttatcaggatttgatgtaactcaatgaatgcaacaagtaacttatgatgtactataatgtacaaagttattacagattttttagaattacttttttgcaaaaaaaaggagtacctgtattgattgcccatgtttgtttaacccaatgaatggtgcacaaggcatgttatacatgtttgtcatgtatgtgcagtcaaacgagatgcaatctttgaagtctttgtaggcatttcttgctgctccatcaacccaaaatatgttctgcaccctgtcttctttatcaagttgaatcttgtagaagaaatttgggtcatccttttttatttcctcgaagtgagcaattgtttcaggaatatctctacacctatactcgctccccaactttgacttgaaattgcttatgtcttttctagtgtagggtacattcctagcccctccatacaattcagacatcaattgcataattctaccagctgagagattaactccgtgcagcattgtgatgaaatctttttcctctttcggtattgctctatgtgaccttaggaatttcttgagtgaaaactttctaactagaggatgtgtgtgttcttcaacaaactgaattacttctcacctagctcctttcctcttcactgtcatccttgctttccaggcagcctgtcttgttctacttcttttccttttctttggggggcacacttcacccgttttttcttctggaccacatttgttgcaaacaaacattactttgtcacgttctccatctttggctgacttccttgaagtgttgattttgattgaaaatccaacgcgctttgcgtacctgttgtagtgagcccttgcttcctcctctgagttgaaagtcaaggtgaggtacggcacttgtgtgctgcacggaatatcctgtgatggcgctgactgtgcttctgaatcatctgttctagagtcttcacttgaaattgtgttggcagtagcagttgttgcgccagttgcaacactagtatgcattgtgtctccacgatctgacatttcttcaaatacttgcatctcataatcgccttcaaatatttgcatctcatcattggcttcaaatacttgcatctcatcattggctacattgtgtgcttgtaaacttccagcatcaccagcagtatacatagtttcaaagtcaaaagtgtcgtccaaatttatagcaggaatctccatgctagtgtcagtcggatttatagggaagtatgtttcacttttgtctttatcatcaactagtaaatggtgtactggaggttcattttcaccagaaactaattctgggatactgttgaggtcaaagtccatttttgctgcatgtgtttcaggctattagtaacaaagttagtttatacagagcattcattgaggtaattcagtaatttggggggggggaagaagtaacttttagtttttgcagcatgtcttttttagatgttttataggaagcaattttctcaaattaagaccagtggctatactaatgattttttttttcacaatttgttttgatgcagtacaagatgaaattgagacgcaactaggtgatgcatcatgctgtatatagaaacaaggtacaaaatttgtaactaggaaatgtagattcaagtttatagggaagtaacttccatgtttctaggaagtaactaattgaattgttacaagtaactttctgttaaaactgcactgagactgttaaaattgctatgagaacctaatgcacagtgagaagtaacttaatgcgcagtgagaagtaacttaatgtttcttggaagtaactcattgaagtgttagaagtaacttttctgttaaaaatgcactgagacttctgttaaaattgctatgagatttccaacaccagcactcatgcctatgtaattagggaatacaaattcaaatttattttgggaagtaaagtaacttttctgttcatattgcactgagaggtaactagatgggatgttttcatgctgtgtaaactgtaaactagggtttgtgaattcaagtttatatggaagtaagttgcatgttactagaaattgctctgagttttttgaaacaccaggactcatgccttctctataacttttttttctcagtagcactagaaagtgaatttggggtataaaggaagacagaaatcaagaaggaagacagaaaacaagagtacagctcattactcacaaaattacagcacagattcatatcaatttgtttctcgaagaatacagagaagatctaaaagtttctaggttagttcttttttttttgtggatggatctcaaagaagacggaatttgaacttcatgtgtactttacctagatattttttcttggattttcttctcctccttcccctcttccaagatggcgatttttttctgatttttaccgccgtggcggctgtgtgtggattgatgtcaccggatgggttggagtgagggagagaggcgcattgcgctgttttaggtggggcccacgccagctagcgaggcgttgcacggtgcttgcgcgcgcaagcgcgctctttccttttttagcgatggcgcgcgcgggggccctggtttagcgagcgcagaatcaccagatgtgcgcgtcgcgcgatagccctatcgcgatttagattatacgaattaagaaggcgtaactaggggatgtaaattcaactatatgttaaagtaactttcatgctcctaggaagtaacttactgaagtgttagaagtaagtttctgttaaaattgctctgagagcctactatggaatgtaaattcaattttatgtgaaagtaacttgcaagttcctaggaagtaatttactgaagtgttagaagtaagtttctgctaaaattgctctgagatcttcgaaacatcactactcatgccttttgctccaacttttttttcctagcagcacatacaaaggaaatttgggggtacgagggaggacattaatcaagatggaagacaggaaacaacattacaactcatttcttacaaaattgcagcacagattcatagaatatgtttcttagagaagatagaaaagatctcaaagattctaggttagtttctatggattttttggatggatctcaaaaaaaacagaggatgaacttcatgtgtacctgtgattttttttttggatctactctactttcttctcctcctccgagttgatggtttcctcctcctccccctgttcgtgctttttttctgatttttttccgccgtggcggctgcgtggggattgatgccgccggctgtccgaacttgatgggttggaggggggaaggaggcgcgcagcgctctatcctagccgggcccacgccagctataccacgcgaagcgagagccgtgcgttgcacggtgcatggtgcgcgcacgtgggctttcctttttggcagggctgcgcattcacgcggttgctttttctggcaggggcgcgcgtcgcgcgatagtcctatcgcgagactggtctcggtctagtcgcgtccattaattatgaagtacggagtagtcgatttgattaagcgggatgatttgtgtcggattcgcgacacgagcgcttagaagggagcgaaacgctttgtgcgcttgcgcaaaatgtgcagtgtttttctcgatccggagtagacatattaagggaagtgctatgatagatgtgactactatctttaaatttatctattttattcactcatgaaccaagaggcaacctatacaatgtatcacctctagttcacaaataccaaaatatctaatattctcacatctttcttgaaatttgtgtggagattgtatcttgatttaggggtggctcatcatctctcttttcacttctcttctccacctcatcacttaatccaatgtatgtgacacttttaggagcaacatatagagcattatagtacttgcccttataatcctacgaaacagtttttatccagatgcatagtaaaggatatgtttcttccgattatacgttgctatattatggaatgatggagtagcagactataagctagatatatagagaaaaaatgagagagaaaaacattagttacaaatttgtaacgagcatataaactttaaaacgatatatgtgtacgagaggtaagaccagtattgagaggtgatgctctgaatttctagcgggcatgcacgaagaatgggttacgacataccccctatgtgaaaaaaggaataaacttttaccatacataaaagataaaagttgccttttttttaagagtagtacatgccctgagatctacaagattagcgcatattttcgaagtttgaaaccaataagttaaaattttagtctaagttaagattatagtatttatatggtaaaacaagtcaaaaaaaatataacatttatatatactttttgtaaataagatgaagagtatatttcactttgtttcactttttattactggtgttttattttgaaccaaactttaaatagaccgggtaattttactttcgtggtactttactattttagactactctcgattttttttatccatttgaattcaatttaccatatgtcaaagaaacagtctacgtaaaactgcgggagtttattgacaaatagaagatggcgtacccaaaatcgttcatatgcttaagaaaagagtttgggtgattcaaaataaaacaaagataaaattatcgagtctaaactgaaaacattggtaaaatggtggtttaaattaaaacacggcaataaaaaattatctaagattaaatttatcctaagacgaatgatcaaacgtcatgtcaaactttttttagggcattgtgtactaaaacaggaagtaccaagacaactgtgtttagttcacactgaaattagaagtttggttgaaattgaaatgatgtaatggtaaagttagaagtttgtgtgtgtagaaaagttttgatgtgatggaaaagttggaagtttgaagaaaaactttggaactaagggcccctttgaatcgcaggatagaaaaaacggaggaataggaaaaacataggattcttaccggaattgaagtataaaacagaagattgcaaaacacagaaaaaacacaggaatgttcgtttgattggagcgcaggaaaaacgcaggaatcggatgagagagatagactcaaagaaaattttccaagaggttggaactctcgctaaatttcctccaaaatctatatgcaatgtgccattccataggaatttcataagatttggaaagcttcaatcctttgaatcaaagggccaaatagaaaaatttcctataagatttaaatcctttgaaattcttacataaaggaaaatcctttgattcaaagaatcctaaacacgatgatagttccactgataatactagcaccgggttggcgggttaccaaaagagctgacggatatggctttggtgtaggcgtagcagagaacagcgtgacgcgatggtgacagccccaccggggcagacgtggagaacaggtggcgcgagacagcgaaacaaacgtactcccctccccctcaccaaccgagttcatttctattttaaataagtttatttttaaaataattattataaaaagaaaataatatctactgtgaatagataaagtgataaatagttacattgtgatttgataaagtaaagttatttaggtttttctgtagttttgtattaatatgtgtgagaaataaatttatttagcagcagaggtggtactcctactactgctagaaatttggctatgtttagtttatactaaatttgaaagtttggttaaaactgtaataatgtaatggaaaagttagaagtttgtgtgtatagaaatacgatggaaaagttgaaagtttaaagaaaaaacttgaaactaaacgtggcgaaaaggagaaaggaaaacaaaaactgggcctcctttgcgttgcgctcagctggagtccagctgctctgcccgctgggcgccacacgacgcctcgcttttgcgctcggcagcagaatgcagagagagcttgcattgctgacctcgcattcgcaaccggacatcaaccacttgccacccggaccaggaggggacacctgcgagcctgctgtgtgtgtgcgcgcgcgctaagagccaactactacctccaatttatctatagccaatctaataactcattgttacatactacactattaatacttggtcccacctaccatatatacactgtgtcttagagtccgtgctatagctggctacaaatctgtagcccgctgatcttctctctcctcatttatcttcttaaaatatatttgcagctggcttatagcctgctattatatctgctctaatgcgcgactagtcgcacggccccagtcactagtagcgtaccactagtactactactacactattatttattactagtactactacttctagtattactactataaaaatatatatattttatgtataaaaaaaatacacacatacaaactttatatacgatgtgtacaaactttatatacaacacgtataatctttgtatatgatgtatacagactttatatacaacgtgtacaaactttgtatacgtacatattaaaaataaaaaaaactaaaaaaaatcacgtatatccgtatacagtgtacgaagtttgtatacaaagtttgtatagacctatataaagtttatgtacgatatatacaaactttatatacaagtatacaaactttttatacgtatacgtgtatgctaaaaaaaccaaaaagaaaaaaaccgaaagaaaaaaccggaaaaaaaaccgaatggaaaatcgcaaaaaacaaaaaaaaaagaggaaaaaatcggcgggccccaccccctacccacgcggatgccgcgccccgggggagggggcgactg

SEQ ID NO: 80595 - DNA, 5316 bp, Oryza sativa
tccggcaagattcggcggcaaccagcggcgggcaggctggcggcggcggagcacgggctcggtggcggcgtgcgggctagcggcggcgcgcgggctcggcggaggcgtgcgaggtcggcagcgcgggggctggccgacggtgcgcgggctcggcggcgacgcgggggctggtcggcgggcggcggcgcaggggctagccggcagcgcgcgacctggcggcggcgcgggggctggccggcggcgcgcgggctcagcggcagcgcgtgggcttggcggcgacgcgggggctggccggctggcggcggcgcgggggctggccggctgacggcggcgtgccgcttggcggcggggattccttttttttttcttttttttttcagatctggagctagaagtttgccaaacacttttgatgggtctgtaactccaataggagctagctccaactggagtaggagtttggagctgggagttggagtttggagccctaccaaacggggccttagcttttttgtgctgtgtgtgcccatgtctcgtacggcgcgagccctgctgtgtgctgcttgctcatctactctatttcggtctcacaggaatttttgtggagggacgtaacactttttaaaattaaattatgaatctttcaacacatcggtactttcgattggaggaatgtgaccttttcatagccatataaagttttctttttcttttgacctttgttcgatcttctatcagtatataggagacacgatttttttaatctttttttattaaaaatgaaaaagaccgtccaggaccgggttgctagctactttctgcgtgatattttttagactacgaatctgaacatgctctgttacgcttgcatagaaactctccagagatgaggatcaccaaatgttttagcatcttcaccggggttatttggtatacgcaaaaggcggtaccaccattcctctaccgctgaaggtcccaactttgcaagtccaattggaggccaatccaccgctgaactttggcccagactcgtcaaaagaatatgcaatgtgcgaggagatgtattatcgtttcatgaatggtgtagcaaagtggtcatatctgttggttcaccaccttggcctatttcgtagaattaggtctggtttagtttctaactttttcttcaaacgttcaacttttttatcacatcaaattttttctgcatacacaaacttctaacttttccatcacatcgtttcaatttcaatcaaactttcaattttggtgtaaactaaacacacccttagccattgtaaagaaattacacccgtccggtcttttcacctttcatgaaaaaaatatgatgataataggagtgttagttcatataaagctacatcttctcagccaacttttccagattggtaactgagataaactgtttgtatttcgatatagtatttatttaaataaaacaaaggcaaaaggttgcaatatatattgattgagcagggcaacacagtacgctggggctaatttactagtgtgcttgagagaagtataaaggataagattggaaagatacagaaaatgaagtggggtattagtacgcaattaattaagtattaattattttaaaactaaaatgaattactattatatttacagcaatttttctaactttttaagaaaatatttttaataaatttaggaagcgtgcgtgtagaaaataagagacttttcttccagatgtgcttgtctcaaacgcagtgtataaggaagattatgttttgcgttgttctgtactgatggtggtacaatactagataaatgcattcctctcaacatctattgaagataatagtttttgtaacttagagggtgtttagattgagagatgtaaaattttatcgtgtcacatcaggtattatataggatgtcgcagaggtgttcgggtactgataaaaaaactaaatacataatccgtcagtaaaccgcgatagcaagcctaattaatctatcattagcaaatgtttactgtaacaccacattatcaaatcatggagtaattaggcttaaaagattcgtctcgtaaattagtcgcaatctgtgtaattagttattttttagtctatatttaatatttcatgcaatgttcaaacgttcgacgccatagggtgtaaaatttttgggtgtgatctaaacacccccttagaccattcccaacccaaaacactagatatagtttccataaactccacatcatcaagaaactagtactagacactaatcttccaatgcaaacaccactagtccatacttaaatttaatgttgcttatctcacatgatgtcttagatgttgtgtagaaactgtctcatgcaagatatggtttttttctctttgctcatttattcacttgccacattattttttaggcaaaatttaccacaggacatgcaaaaaacgtgtaattggctaaaagacaccgtgaaaacatgacatggccgatggacctaaaaaaacatgtaattggttgcaggacaccggtcacatttttttattatttccagatcaaaagaggtgagatatttttctacatgcctgacttgccccttctctttccttctttaaacaccggtgggtcccatgtgtcatggacagtgtatgtttaatctaatttttaataggtttttaaccaccaggccccacgcgtcatggactaatttgttcctaattagtagggtgattactatttactaaccataagtggggcccacatctctctcctatcctccttcttcctcacgcacgtggcggagcagaggaacagcgcgcggccggccgacggcctgagctgggacggctcggcatgcggcgaaaaaagcggcggcgctccgccggggtatcactgccggcgacggcgaggaccaacgccgggatctcctcattcagcgaggaccaacgccatggtgacgagcagcgccgggatctcctcgttcagtgaggaccaacggccagcctcacctccatcctcacggtgcagcagctgtccacggacatccagggtctggacggcctcattgccagctccgaccccatcggcttccaggtcggctccttcgccaagagctacctgatgcaggagctgggcgtgcccgagtcccgcctctgggagctcgccatcaccgactactcctccaccctgcagagcggcatcgtggcggccatcgtcgacgagctgccatacgtggagctcttcctctccatcaactgccagttcaggacagtggggcaggagttcacaaagagcggatggggattcgtgagttcttttccttgttggcttcttttcttcctctttttattctacactacaaccaagtactacatatgcaggctttccatcacgactcccctctggccgtggacctttcgtcggctgccgaggaggaggagggtgacgtggccgccgaggaggaggaggccggagagcgaggtaggtgcggaggcaatccgatctgatgaattggcggaggcggcgctccatggcaggggcaatcttgccatttgaaaaatattatcacctcttttgatctggaaaatataaaatattgtctctggtgttctataaccaattacacaatttttagagtgtcaatcagccgtgtcacatttttacggtgtctcttagccaattacgcgtttttttcatgtcctatagcaaattttgcctattttttatcagaggtggcagcttattttataccatagacatcatcctagtcagaaatggcctatatatatatatatatatatatgtgtgtgtgtgtgtgtgtgtgtgtgtgtgtgtgtgtgtgtgtgtgtgtgtgtgttgtgtgtgtgtgtgtgtgaccatttacattttttaaaattttgatagtattggatgtacttagtttgattttgttttttccaaaaatttacgtctctatgagaacaaagttttaaaattcccaaactttagtaaagatgtgagataatgtttagttcattatcctactagctaggctgtgtaaatctaatcaatttatacttctaacttatatttttaaaaaatatatatgttggatcacctatataaaagttataaaatatttcatttttatgaaatactccctcggtaaaaaagcctaattctggatttgaatatggacataatgtatgtttggattgtaatctaaaagtaggttttttttttttggacgggaggtaatacggcaggactaaaaaggatgataaagtgaatgcaccgtctcttctcgtgggcaccgatggaacgatcatccccgccggcggacggacctgagcaccgttgagacgaggaggatgggaggaaggacggaccgggcacgtaacgcgtttgggccacgacatcccattgaattcctcgcccaacctctcgatctctctcgccgtacgacgccttcttcttcttcttcttcttcggttaggagaagtatagtactgtactgatttgaacggcggaatggcagacgacggtggctggctagctagggctattagctgtcgctcaccaacggctactacatcgctgatcctgccgcccgttagctaagctcctcgttcgtcgtcttgcgatttgcgatgcgattccacgacgtttgtcgtgtcgctgcaccaagcacaagaaggccgttgccgctgcagcgcgagattgatgggctgcgcacgacgtgggccgtgaattctcggcctgctatttagctcatatggttgggaggcccattcccaacgctgcaatgctagatgaggaatgagtttactttagatcccttagtccacgtatagctcgagtatacagtaccagggaaacgcatcctagcttgagaacttcatggagatgcatcaaaacagcgggtcaacatataagcacaagtgcacaacgccaacattcacctgagcattgacaattttcatgacccccccaagggaatattacgtctgcatattgccgaaggtcgcactcgcagttgtgaatcacacaagacgatgaaatgacaggattaattccggcagttgattcacctatacataatttatttagtgacagaaaaaggaagattaacactaaggatgccttgacctgtattattaattatttctcctcttgtatatgtaactacagcacaaggcagccaagattctggtggccgtcggctaccctagggaagtacagttctcaccaccttcctgtccacaccaaatgactgcatcatggaatacaagattagttaggattgctgatatattctgggatatactccctccgttt

SEQ ID NO: 80596 - DNA, 7987 bp, Oryza sativa
  unsure (1)..(7987): unsure at all n locations
cagagaaatcagtaatcatacaagtcagttagcttttgcaatgattatagcatatggtaaagtgtactttaaataatcttaagacgacaaagcatcaccgcagaaatacgtccctgagagtattatcatgtgattgaaaagttgctaaagtaggtccaaaaagagggtaaagcctgtcaagctttttactgaagacgcggcggcaagtattaggctaatcagctgagaagtttgtcaaggcaaagttcacaggttaaaaaggggaaatatcttatcagaaacgctaacattttgtgtcacggcatcgtttggagcgtccttaatgcaccagtactaataagtaattagtgggaaaatgcttctcatcgaacgcccgaaccaaattgaaaaatcgaacggggagtctctgacacacatgcacctatccaacctgtatctctatctccaaacatgcacctttaacgatattcaaaacgaattttctctgaaattacttatccaatctacaatccgatcataccgttgtattcgttgtcattaaatctttacaacaagatatcgcatgattatattctgataaaaaataatcatatgtttcaatccattaacattttttatttcatatgtgatagggatatgtttcaatatatgtctttagcgtgttttacataattcacaatactaactattactactctctctcctctctccacctcatgcatacatgcatgcattttagctagtttcaaaacattttttctctcaaactaattatccaatctacgatctaatcataccgttgtattctttgtaattaaatctttacaacatgatatcgcatgattatgttttgatgaaaaaaatatatgtttcaatccattaacactggttgtttcatatgtgatagtgatatgtttcaacgtgtattttcatcatattttataaactttctgtaaaatgttatcagtctgctcgatattttattcactcccattaagtccaattggcaaatattttgcacggcaacgaattttttttattcttgtacatgctaccaatagcgcggagtggtgtgattgcaccgtgcacatcaggcgtccgaaatattcgtggaaantatcgcgacgatccgcacgcanngnagtcatcnntncctaattaaagtagcgccctagcactgtcnnagtcgnncgaaaaaggtaannacacaaatgnnnggcatnncnaccgtnnttncgaaanngtgtcaacgncgctcaccaaatgcattactagtaacgtactacanngtanntgatanntaggtacaacagctannngacntgattcgttccccacaacaatcctaaataagcaagcggaggatttaatcacgacatncgaatgagtcaaaaaaagatgacgaaacaatagagataatggatggattacctatttatatttctataaacaactcagggtaccctgcttacaaattgttcatgcaatctctccactaacaagacgcttctctctctatagtccaaatcccccaaatccgctcaccccagccaccaatatcaatcagaaacagggcgtggtgcctagcaagaatacatcacggcgctcgttcatggatatatactaatcagcgtgattagtatttaggaggtgctggaggtaaccggtttggagtgcgtcggctgccggagttggcaccggaggtcacgtcgccgttttcatagcgccctctgcgtccatcagcgcttcttgaccttgattcgctgcctgagctgggtccgttggatgcggaatcgaaggcagacctccaatcctcacctgggcggttgggtgtccgggggctctctgcaaatgattccgtttaagaaatttgtgacaaattaacagaagaaaagtaacatgcaatctacattagtcaccctatgattcaacatgtagaaatatgagttataaaaggggtgaatggtcagctgggtaactatatcaatgacaggtaatgaacaacattaacaactagttacaaaggagatgtaaaataccatacaattgtatttgctattacttctcaggcattgaaagtatagtaagcttaccagcttcagagatatcattggcataagaagcagccctgttgtcatggacactaagttgacgggtaagctttgacaagagagatgattgtttttggtatttttcccttctacgtttagcattatggtcctcttgcagaagctcttcaatttttgcattgctttgcccactggtaatgacaaaaaaagcaaaggaattaagattagataataatggcattaaaaacagcatatagtataaatagcttaggtgtaccatttaagcaagtctataatataagctaagaataaacaaactgcaaatagcatcaatgaacaacgaagtgctggaataacatgtggatcccaacacctgtcccacgaaactgtatttttgacaatcagttagaactaaaataactaaaatccctcccaaagaatacaacaaagtggtatgacaacattcttctggtgccaatatttctttttcatgtaaccagaaaaaagataatatgccagaatgattctgaggtttatacacactatagggattactaaatagcaagatcaaaatcatatgcatagaaaatagatctacaggattcccatggcacccttttgatccagatggctcatgatgacactattgcagcacaaagaatctgaaactgtcaggtggggaaaaaatgcaaaaagctagaaacagtattatagcctccagaagataagagaagtattcatcaaccttattgaactatatagctggtttagcatatcttcctttgccttctccacttggcacaacacaatagcctgataagagaaggggaaaaaacaataagaacattgccacaatgacagggtccaatgaaatgagcaatgctagcttttttttaatgtaaacctttgggacatttgctgccagactattcaaaacagcctcaacataaccacgaacttcatgggacatccatctaagttcttcttcaggatcagcaggtctccgtgccatagtatcctttgaaaagtgcagggatcagatgtcaattgaaaggtcaaatggaagtaagtaactcatgccaacaacaacaatacaacatgtttatcttaaggaacatgaaataaagttttacagtcttaacatcaaaataagaaagagtttgacaaggagaaaattagagccagagggctaaaagcgtaggaatggatatagctagaaactaccagagcaccatcggaattgctttgtctcatggaaccaccatcagtatttggacccttgaatgatccccctttgctttgaattacagcccgtatcttatttacccactcaactttgtcggccgtgctctcagctttcaatacaacagcactatgagctgtaaaaggaaatacaccatttagacaacaagggtcttataaagaaaaaaatcaagctgaggtattcagggatcttaaccttttagaactgttttgtaggcaaccctgttagttatcttaaagacgagacttgggcctttctctggcccatttgccttttttgaatccttcaaacttttaggaggttcttcctcctctacttcttcaaggttacactcctgcacaatgatgtcaaattcaagttaccaactaagttcattttacagcatttgttgatgtatatgtgatgtttcttccaatatcagatagctctttccaagggataaggcaaaaaaacaaacccaataatggtagaataaattacatgcaaatttaaggacaaggtttgcgcacacacctcaagagtgatgacaccacgaaaatgtctctcctcttgtttcttcgtgtagccaagctgataaaaatagaaggttaaccaaccacccatgcatagaagtccatcggaaaatacataaataaattatcctgatattcctcctgttagtgcaaaaagacaaacaaaactaaaagatgatgattgaactctgattaacctttccgcttttctcattgaggacaaaccacctcctactccatccatttgtttttgcacttttcttcaaaaggtaacctgaagaaaaatgtacaaaattaacgaatatttatatttgcatgtacttttttacaatgagacaaaacaaatgtttcatttcaccaaatggttcaaagggcctgtttaccagagctccaactcctggattcttacagaatgagtttttagactagaatagaagtgctttaagcctgtcttgagcctaaattcaataaaaaatttgtggttttccataatggctagcttgagcacagcatgatttgacacattcttacctgcagtaatttcaccagaagaaccagcaacctgcacagaggacccctcttttgcgtctttgtcttgctggcctgatttgtctttgtctttgtctttcgctgatttgtcttttgtgtctttctcagatcctgtctggggactggaggcctagaaccaaagcatagttatttcagccttgtaatggtgaaaagaagaaataccatgtctaataatctaaataagtgtattcctaacaaaacaagtcagtgtgaatcaaaatccatttaggctgccttaccctttttcccatgggttggtcagcatcctgtggtttcttggaggatcgattttttaattcatcctcacggcgttgcctttccattctgccagtattgttaaaaaaaattgacaaggctcaacattccatagtgtaactgtgtagccataaaattatcttatctttacaaaatataaataatggaaagattgattatcaagcaaagggcaacttgctgaatttcaacaaagagattgtatatccctggtaatcatatgttcgactgattcaagataagggggtgtttggatgctggggattgctttgacaattgttggtatagctcaatttgagcaatatcctaaagatctaactctaaaaagaggataagaatttggagataaatcatccctaccaaagcagaccctagaaaagaatagctgaagttaacctgaagttgcatgtgtccttcagtgttcatggatcacttaaagatacttctttgaaggcgtacgtaggaaacatactaagatttccatgctaaattcataacatcaaaatattacaggaaatgaatttataaatcgaatgaacacaaatattttatcaaaaagtaagtatagaaattgaacagggagaaatgttaactaactattggagacaaatgataactaaaattgaagggggaaaactagccaaaaatcaaccttctttgcactagacggatgaaatgctgaggaggaacaaaggcgcgctccatatcaacaagtgcaacaaccatcttttttgcatcatttttgaagctgtctagtgcatttgatgctattgcaatgaccttgcgaaaggaaacatagattttttactcacatcagtcaacaataaactctaccaacgtgaaactcgaaaggaaagaaactctaaaatagctaggtgatacctcgcgcttgaatggaggatatcttccaagtcctggtgtggcatttgctgaagcattgacaatgtctaacaatacacgatgtacctagtgcattaagaaagataactattacttttcctaggcaataaactaagaagttcacaattttcaatacaaagataacaatatacaccagtacataacatagaaataccacacaacaattgataacaccaaataaacaaaaatctgaccatatggaagtatggaactcaagcagataggtagtcccatgcatccgtatcttatttgttgaaacaatggaaccctaattttacctcttatctaaaaaactcaatccatagaacaaattgctacctcaatcaaatgcacccaacccagcctccaaaagtcaaatttaggataacgcttttctggtaagagaataaaaagcatcattttcttattgcagtaacttacaaacacaaacacattatttctacaacgttcttagccttgagaggaaaaaaaggaacagatctaaacatgttatatttttattggtaacaagactttatttgaataaagtagaacatacctcttcaacacagagtcgtgatggctcctttgccatatccaatactatctttatcaaggacctcaaccctttctctggagatatcaggtacggttgataaccatcggcttccaagacaatctagaatgtcagagaatactgttcagtgttcataaaagatgggaaaatgcctgatagtagcactaatcctgaaactggatccaatcttacccttttaacattgctgaggtcaaagtgcctgtccagtggcagctgtttaattctctctgggaatttcccttcaaaacttgcaacaactttccaaccagacccctatttatacaagacagtatattgttattgtaattgcttgtgcagtttaggaaggtatgattaaaatctaagtaggtttgaagctctttactaacctcgccagatgtaatatgagcaagaaacttatcctcgaattcccggcagagttccaaagcaacagcccgagtcccttcagcactttgtaccatagattctcccagccgtgccagttcatcttgaaccatctgggacttaccctgaagactgaagtagcagcatatgaagcaattgtatgtaagtttagcactagaccacacatagtagtgaattattccctccattaacagaaggcatgttagattttgcacaaggattaaaaaggtgatgaaattaagaaagatgtaagagcaaatgaattgtacactttcatgattgttctgtgtgtgagaatactttgtgtcggtggaaaagtggtagaaactaaatgcgtacgagagaggtagagggagggcgggaaatggtcggcaaacactcactaaatgacatgcagtatgtacgagggaaccaattcgaattatatgctatattatatcaacgaaatgagtaacagcactgtagcaagaacatgaattcatctaacaccatgcagcatcgataaataattaagagatgctaggtacaatatacaacagtaattgaagcataaagcacaattcttacccactcaataggttaggaagtcgcactttcatccgtttacgtatctgcttagcaatggtgtcaaccagagctattctacctagtttactttttggagctccagttaagatggatctgagggtttcagcttcagcattccatgctgtttctagtgagttttcagaacctgctgcttgagctgacgcaattgcaactgattgtcctatcagagcaacccactcgatatctggaaggttttttgggcccttattcgacagaagggcctgaacacaagctatagtttttgcatctccttctgcttgatcaactttacttatcacacctacagttctggtgcctgcaacaaatgggtaaatatcacttgcgatgaaatgaatgaatggtactatagaagatatttactcctgaaagacagaccatctgcatcaatatccttggccagcctaagagctcgagatgacgcaacatcagctgcttgcattgcaggtatcacaactagcagtattgcatcattgtgcccagcatattcattaatctgaattcagaaaacagtcagaattctgcagcataaaattggaaagcatgaaaacatcaaagaagaatgcatgtggtgttctctctatagtagatgagtatgaacgcttcaagggaaaattcaatctatgaagtaactgcacattgtgaagtttcctagatgctaccatttttcagatatatgaatgtcacggatcatacaagatattcatgttacctccccgtaaaaaaagttattccttctaccgttatactcacatagcatgtaaactgacagtaatagtgagtggttaaa

SEQ ID NO: 80597 - DNA, 1988 bp, Oryza sativa
ccgcctggcgcatcgcctccgacagctgcgcgagctcctcgacggcctccatcgtctcccgcgtccccgcccttcctctccctctccctctccccgcgccggatctcgacggatcgggggctcccgctgctgctgctgctgcgacggcggcggcggcggcggcgaccagggccgaggcgacgcgggtttgaaatctgcgtggggatgggatgggggaggaggcacgagagacgtgggggcggtggatttgggcgagacgagaacgagagaagagagagagagatgggggcagtagagactagagagagagagagagagagagagagtcgtttgctttgcttgcttggctgcgaaggtgcagagcgacgcggtgggggcatcggctatggatactggttgggccgggcctgtcgggatttcggatggtcccccccgttcggcttgggtggaattcgaaaaattttgcgggattggactgggggagaccgggcaaggcctggaggccttcctgggtgtgtttgttcggttgggatgggatgggccgagttggtgggttgagattcggactctcattctttccgtgagaattcttttgggggcattctactcatggtcctcctcatcttcttctacctctggcggttcttctccgggaagcgggtcgctgtcattgtcaacgggcgtgtcattagaggacacatcaccgctcaccgataaccttatcgaggcgttcctaaaccctaaacacaaaacccaaaaccgccagctgcgggaagaggacattgcgccgtctctgtcgtgtttgtgtactccggtgacaacactagcggcagccagggcggaaaggcggtggcaggatgcccgatatacattgtggagtttcacgacggcgacggagcatggctcctccagctgtgaggccaccaattcgacaccaactacatcggcacgtggctagaactccactccacctacacgctctgtcgcgtcatcgtgttgctcctcctcgcctccttccttgagcatgccaagaacgagcccaagatgtcgatcgatgtcgaatggatggccatgctcttgcagttgatgggctagacaagaacaactagctggatgggtggggcaccggatgagctggcgtgcgagcaggatcctgaggacgacgaggcacttgagtgccacaacggcattcctggcccgctgcatgacgctggcatgtggggcccatgtgggtctcgctcgccgcgtaagccaaaactgaccactatattgtcaagggatcaaagttgacacggtattttgagttgggggataggctataccggatattttggtttagggaagaattttaaacttggtgattgagatctaaagtgaacttcactactacaaaagcgatttttctatacaaagatctctttagattgcagatggaccgtaactggtcgcgtcggcaaaaatcgtcctcccattttcgtgtgaggccccttaagaatccgcctaaagtctaagtcccctcctcttttcccttctcaacactttaacatttttcatccttatcctctctctctccttgttatttcaaccttatccactcctcttctctctctcattcgctcatgcacaacgcccgatggtggcccggtgcacgatggtggtggcgcacgggggcggtgggctcggtgggtgccacttcaggcgcggggtggcgcgagcagctcggcggatgggagcaggcgcagcacgccacggcggcgacgggcaacgccagcacggcggccgggagcgatagcaagcgacagcgcggtggccgggagcggtggcgggcggcggcagcgcggccacacgctcccctagcagcggtgcccctcccccgtccggatccggcggtggaggggcagtggagaccacggagagaggcaacgacgacgacgagttgtggtggtgacgatggcaacgatgatgagcggggatgcagctaggttttc

SEQ ID NO: 80598 - DNA, 2419 bp, Oryza sativa
tcatgttcctcctactccttgagaattgagacctcgccgtccccccgtctccttcctgatcaacccagccacctccccacgtccatactccatcgccgttgctgcatactgctgcccacacggcgaggaatggcctcgtcgtgtttgtgcgccgtaatccaccacactatactccaccaccatgacaagactgacatcgatcactagcacgagctcgaggacaataacatcatgatgagaacaagtttaatagtagagctaactattggctatcagtttattttagatttaacatgtacttcaagattggctctatattttctctcctctctctttctcccatcttaaagtacgtgtattatagacaacacttcttatttttctttgtctctattttccatataatgttatagttgacttataatctactgttatctttgctctgagatggtatccaatggtatagcaactctttcctttaattattatcgttatttcctcatatttacggggtgctattttcctcagacaagaaagaaattaagtgaataggttcctcattatgtgtttttttacgattatttggttctttttttctaattaagggtacctgtttggtttgatatgaaaaacacatgaatcatatatctgtgtttttttagtttaatagtgtagacaaatttggttttttttaatacctacatatagaaaacaaattatgtaacaaacttaggaggacaaagtaaataaataatgtatgcaataaccccttagaaatcaagtgttatattccaattaattatgtacctattaagggcctgtttggcacaactcgaacttcaacttccacctctcgtgtagttggagctcagccaaacaatttcagcttcaccgaaaataggagcggaactaaatggagctctctcacaaaaaaatgaactagagatgtggagctgggtttaggcagctccacaactccactccaaacccaactcttgaagctaaacttaggagttggagctttaccaaacaagctctaactgtgcactacgttcctgattcctccttattttctaatgaaatctacaagactggggttgcaaaataaactctactcccatgtgtcaaatgctcacaaagtttcaggttacttgtccatttgagctcctttggaacgctaaaatctaaggctgatttcgttcacaggagataggagagactgcgactcgttttctgcgcatacacttttcaaactactaaacggtgcgtttttttgcaaaaaatttctatagaaaagttgctttaaaaaatcatattaatccatttttgaagattaaaatagttaatatactcaattaatcatgcgctaatggctcacctcgttttgcgtatcttcccaatcttctcaatcccctctccctcaaacacagcctaagaatacgggaatatgaaaaacacagaattgaaaatgttgcgttgaatcctactggtaacaaaagcatatgaattactcaaaacacaagtttggattgatacgcgggaaaaaatataggaattttgagattatatgtttacttaaacggagcgagagtggaaaggaaagagagattgcgttcgaattctcaaagtaaacaacaaaaacatgaggtttggacctcatgttcaggtctaggagtgtattccaaaggaattttgtaactccaaatcctaaaaacgaaacaacctcaaacggaaaagatcctaaggatttgaattctctatttttcctttggaaatcttccaatccaaagaagatcctgacattgcttttggcctactttgtgtgatggtgacagtttggatgtcgctttaaaaactactctagcttaattaatcatcattaacgaccgtgtctggctgcatggtacagtcgctacaactcagcgcggatgcgaaatactttgattgtgcggagtattgtgctgcagtcgtatgattgtttccaaaataaaaatactcccggcaccataaaaacaatttcgtaaaaaataaaggaaaaagtacgaattaccccccgaactatcgcggttgtccgaattaccccctgaaccacaaaatggacattcttcacccccaactatgaataccggacgaattaccccctcgacccaatccatggtggttttggtctacgtggcgtacacgtggcagtccagtcagcattctctttataaaaaaattatgggacctacctgtcatacactactctctcttctctctcttactctctctctcttctctctctcactcacgaggcacggcttcccctcctcccgtcacccacgaggcgcggcttcccccctccctcggcagcggcgggggatgaggagctcgccgccgctcgctcctgcctctgcgccgccctgccccgcctcctcca

SEQ ID NO: 80599 - DNA, 38607 bp, Oryza sativa
  unsure (1)..(38607): unsure at all n locations
aaccagctggactccacgtggagcggagatgggggtgtgggcggtggggccacggccgacagtcgcgtcagggtttcgtcgttttgtttccagagggatcgggtgtctttcagtgtttgggttttcactttttcttcttacagaaaaagaaaatgtttgtacactatttatgccgttggttttataaagtcaaagaatatcacattgctggtctatcacggtatagggcttgcacgcttgtagtgctggctgctgggcgtggctgcattttagcgatagtactaacaagtctagcataaatttttatgttgtacaatctggctcatcctcaacatatttacaaacgaaaaaataatactccctccgttttagattgtaaaactttctagtattgctcatatttatttagaagttaatgattatatatatatatatgagaaaagtgtacaggcggtccttaaacttgtaagtgtatgtcatctaggtccctaaactatcaaaatgcatatccaagtcccagaacttgttatagtgtgttatctaggtcccaaatcgacacaaccccttcaggatcctacgtggcattgatgtagcatgctacacggacatgacatggtattattttgactgataaatgggacccatttaagttttttcctttttctttttcttctcttttttcccctttcttctcctttctttgtgacccatgcagaaaaaaaaggaaaaaaagaagtatgagaagaaaccgaaaaagaaaagaagaagaagaaaaaaaaaggacacgtcacgtccatgtggcattgccacgtcagcgccacgtaggattctagaggggatgtgtcaatttgtcactttgacaagttctggatctggatatgtattttgagagtttagggacctatatgacacaaccctacaagtttaaggaccgccaatacactttactatatatatatatatatatatatatatatatatatatatatatatatatatatatatatatatatataaagtcttacattgtgaaacagaggaagtatgtgaataaaacttttctatacatgtgaaaaataaactttgattaaaaaaatcccaaatttacctttaattttaaggttgaaaatttattttttttataagcataagtataaacaaaaagataagacctttcgaagctaaggttaatattttaattagaggatgtagttactataatagtagtggtccagcaaattaagtatacatataataaattgagtgtgatccaactataaactatcgaataaattgccatgaccaaactcttgtttttagtcatgtagccttaaattcgacccgcatcatgcagatccagctgactggaacctaaggccatgtacaacgcatgaccctagcctgtggtctcgcaggtccacgtcggagctgagccgagctgtcatgagtttgggtggtctcgcaggctgtcagtgagcttgtagagaaactggtgcaagcgtcgcgcttgggctcgggagctgcaaagccacaggccgaagcttcgtgttggaggagtcggagccccgcacgttgcctcatccggtccccccgtgccgtggtcgtcgtcgcctcacaagatctgccgcagccgccgtggttgtcgtcgctgctccccgccgccgccagatccgccgtcgccgcttcgccgtcttcgctgctccctgccgacggatccgccaccgccgccgccgcttccctgccgtcggttccggcgagcccgcgcctggatccggcaagctcgccgtcgccaagcttgtgtccacgccatcgtgggtggaggaggacggcaacgtcgaggaatcaccgccgcgttgtggccaccgccgctagatccggtgagcccacgcccggatccggcgagcgcgccgtcgtggggggaggaagacggtggcgtcaagccagccgccctcaccgctgctccccgccgctgccaccgctgctccccgctgccgccgccaccgctgctcctcgctgccgctagatccgccgccgccaaagctcgagcgacgccgatctgccgccggagtggtgggtggcgaggggaggaggggagaggaaagagcgtcggtggagaagaagtcgaagagagagaggagagtggaataaaaaagagagggggatgggaagaggctgacagtgggtcccaagttgtttaggggtatacatatacttcttttggttactatagggttcaaaatataaagtttcaataggtttgataatacaagggctgacatataaatagataggggctgacatgcaaaaacgttttggagtggctttcactgtgggtagtgtgacctttgtgtggttctatcctacgtggcgtcttgagccatagttacttgtggctaccattgtacatgccctaagggaagagatccttcgagtgaaacagctaaagtgattgacagttggccgcgaaaacaacaagggagaaaatggtttaaactaaaaattagaaatagttcgcatggcttaaatgcgtgggccgaggccttatctcatctcgaagccatcagcccactccgtcgtcttcacatgggcctccgttttgctttgtgctcacgtcgtcttcaaacgggctgggcgggccgcttgtatcttgagttgctgaacaaaagagaatagggacatttacaattttaccactatttttttcacttttacaagtatgtcactcgaataacagttctggtgatattttttaatacttcggtggtagccttacaataattattcaaacttctaatagcgtcccataaatagagattacacttatactctctctgtcaaaaaaagaatccaatcttcgagatgaatctggacacaatatatgctcatatttattcttagaattggatttttatgagatagagaggagtatatttgagtggtgagaaattgtaatagcagcccataaactgacaaacagagataggggactgctaatgcgcgggtgatcgctgggaacgatcacccgcacccgctccccctatacgtacgtccctcttctccccctctcttccctactacagtaaaccacaattttttttaaaaaaaaataaaagttagaaaaatttatgtaaagaaatactatatataaaaaatttgaattcaaattcaaatttgaatcgggtatataaacttttgacttacaaactttgggtctataaactttaggtgtataaactttagatgcatagaaatactatatatagaaaatatttgaattcaaattcaaatttgaatcggatataattcaaattcaaatttgaaactggtatataaacttttgacttataaactttaggtctataaactttaggtgtataaactttagagtatagaaatactatatataaaaaaatatttgaattcaaatttaaatttgaatcggatatataaacttttgacttataaacttttggtctctaaactttatatatgtaaacttgaggtatataaactttaggtgtataaatttactaaaataggaaagtaatgcggtaccaaaaaaaggaaaccaggtggagggagggaggggggaggtgatcgccaccccatccccagggcgatcgatcgcccaacagcatttccgacagagataacatttccatctatgattgacgagagtatgaataatcattgtttctgcgcagtgacttgtaagttagactgcttcctccagttttaactacctgtcaatgttgatcaatataatttcagcttggatcatcaacaaattttgattggtcagatcataacgtgataagtatttcaacccaaaaattggtagtcctacatgttattgagatatcgatggtatatctcaaactttgcaaaattataatagcatggttccaatttaaaaaaaaaaaagctacagtacacttatttgccgtgagactacatcacgagacaaatttatagctacaattatcattgtactcaaaagttgttgcgacttgatcacatcccagatgatgtttacttgggagccaacaaggatttctagaattttaaaatccgcgcacgaggagcgcgagctgcaacgttgcaccttagaatgacgcgcgacaaagctgaaagctccttaaaattatggacgcccacgacacacacggacacgcgttgctacctcgccattggagaaccagtttgctctagctgctccggccgcgacgccgccgttgcaccggccggcacgatgggagacggcggcggcggcgggctcgacgtggtggtgttcccgtggctggcgttcgggcacatgatcccctacctcgagctgtccaagaggctggcggcgaggggccacgacgtcacgttcgtctccacgccgcggaacgtgtccaggctcccgccggtgccggcgggcttgtctgcgcgtctccggttcgtgtcgctgccgatgccgccggtggacgggctgccggagggagccgagtcgacggccgacgtgccgccggggaacgacgagctcatcaagaaggcgtgcgacggcctcgccgccccgttcgccgcgttcatggcggatctcgtcgccgccggtgggaggaagccggattggatcataatcgacttcgcctaccactggctcccgcccatcgccgccgagcacaatgtacgcacgcgcgctcgcacgtttcagtatttttgtctgagtatttgatcgaacacctggcgcgcgcgcgcatggcggtcatgcaggtgccgtgcgccgtgttcctgatcgtgcaggccgcggcgatcgcgtttctggggccgaggtgggcgaacgccgcgcacccgcgcgcgccgctggacttcaccgcgccgccgaggtggttccctccaccttccgccatggcgtaccgccgcaacgaggcgaggtgggtcgtcggcgccttccggcccaacgcctccggcgtgtccgacattgagcgcatgtggcgcaccatcgagagctgccgcttcaccatctaccggagctgcgacgaggtcgagcctggggtgctagccctcctcatcgacctcttccgtcggcccgccgtcccagccgggatccttctgacgccgccgcccgacctcgccgccgccgacgacgacgacgtcgacggcggaagctcagctgaccgtgccgagacgctccggtggctcgacgagcagccgaccaagtcggtcatctacgtggcgctggggagcgaggcgccggtgacggcaaagaacctgcaggtaggggtgcaagtaggcttgtcaacgaacccgtttaaagacaaaattagtgtatagcctatgggtttgacttgcggatgatctattaattttatatatcaacccacttatatatcttagatgtgacaagataagccactacatgaaaacctataaattattatttatttgacctataattgaattcgctggtcaacctgcttgcattgctacctgcaggagctcgcactggggctggagctcgctggcgtgcgcttcctgtgggcgctccggaaaccggcggcgggaacgctgagccacgcctccgccgccgacgccgacgagctcctccccgacgggttcgaggagcggacgcgcgggcgcggcgtggtgtggacggggtgggtgccgcaggtggaggtgctcgcgcacgccgcggtgggcgcgttcctgacgcactgcggctggggctccaccatcgagagcctcgtgttcggccacccgctggtgatgctgccgttcgtcgtcgaccagggcctcgtcgcgcgggcgatggcggagaggggcgtcggcgtggaggtcgccagggaggacgacgacgagggctcgttcggccggcacgacgtcgccgcggcggtgcggcgcgtcatggtggaggatgaacgcaaggtgttcggcgaaaacgccaggaaaatgaaggaagcggttggggatcagcgacggcaggagcagtacttcgacgagctggtggagcgcctccacaccggaggaggggagatcaatgacgaaaaatactgttaaaatgcgtgttaattctgtggtgaataataagagcctgataacattgtcaagcctaatatgagatgtttatattacactgtggacgtacacgcatgtacaccatacattggcaataataagattgtcaaagcagcaaggtttgcatgggatgttttttttttttgaattgcatggaagatgcacaagtgcacacactatatatgcaacatcacaccaaaatatcaccaaagatgtttcctaacacacactcaaagagacataaaccgctaaaatcttgttgacatcatactagcgtgtacgtaatatctgtggttaccaggatttaaatcctggtgattaaagtcaaccacccaccatttcaccattatattaatggtgtttcccctagcatgagatattttccctcttattttctcttttgtgcagatgttgccacatttaattttataaaagtaatcaaattttaaatatctgacttaacaaatgtaaaacgccttatgatataaaataaatgaagtataaagaattattttattgtatttgaaaaaaaaatcctcccaagatatgagggcctgctctgctggcccatggtatgtgaaaatggaatggagaagcattctatttcactaccgtgttttatgtagtgtcatttcttgttttcaaaaaatatggattgggaaggtgtaacagagatgcatccatggtttgaaggtgccataaaatgttggagattaaaagccaaacagaggcagaataggcaatgcatacacccttcgttctaaaaataacttctgatgataaatctagataaagtgtccctataagtagatcttttttttttacggagaagacttatattaaacgacccatgagcaaagatctgattattagacattgaatcggttatgaagtgtaatgttcaagaaatgacaaactgcagatgcgtcatcgtagcacatagtacctctgtcgcaaaaatacaagcgtaagtgattcatcataccgtagaacaaaaaagagttcagcgcaacaaagaaaaaagatacttcggcatacaaatctgaaagaacaaatcctttttagagctaaccattttgatacattggcatgataataatacaccgagacaaactcacaaacacataccccgcagaaaatcagctcaaccatgcagcccccacccaaacgtgctgtccaggcaccaaaatcttcctactgaaccaaacttataaataagataaaaaagaggtctacttcggagaaacctcagaacacggtaaacatggaaaatatagcacggtagcaaactaatcttcgtccattccaggctgagcatctctccttggccctcctgctggctttgccatgatgatctgcataattcatgtgcacaagcattagcatatgggaatgatgaaacgatttcacttcatttttaacacagccaacagtacaagattgctcttacctggtcaacccgcagtacagtacatgcagcatccgcagagtattttagagcgaataacctgatgagagaaaagaacacacatgatatgaggttggccaacttgcttaagtctcgccagtaaacatgcaaataataaaaaaaatgaatacatgggtatcacgaaaagtaaaaaacagcgtgcttcccatacagtacgtgcacctattatgccatactggaaggttatggcatatgacttactttgtaacataaaggtcccatattttcatgattgagacatccttgcaaccaccttcttccaagtcaataccaactttcgtattcccaccagcatgttcagcataaagggaagatattatctccatagcactaagcccagcattttcagccagggttcttggaaccatttcaaaactttcagcaaattttgcaatggcatactggtccaacctgcataattgttaactatcaatataggaagcaaaaagcaacaatgtatatactaaggacaatgaacatcataaaccaaggtacataaacagatgctcatgaatcaaatgtatcaggcatactgacgtataaaactctagaaaactacaagcgaattcattttttttaaaaaaaatccagatgggttaggcagtatggacacctcaatatataagtaagctgcacctggacttcagatagtttaattcaaatattacaggagaacattagcaatagggcttattatatttattgacagtcgactggaaacaacaaaagtttgtcagaccaaaagtagtaaaaaatggaacatatttttatcatcatgttccacacatgaaaattttgtctaacaaatatacttaccctgtttccttcagagaaaattccttcaatctccttgccaattctatttctgttgcagcagctccaggaataatccgactatccctgcacattgactgtataaacaccaacagtcaggtaacctgttagctaattaaataagagtagcatgtatgttccaaaacaatgacaggaagttgatttacagtcataccttgtaagtattcacaccatcatcaacagctctttcaagatcatccaatatactatcggtgctgcctcttaagacaaccgtagccactgagtttccaccttcttcattcttgacaacagttacctataaagaattaaacgtggtaagaagaatgaagtcatgtctattggaaaggaacagaggcatgaaacatactcgggcaccaccgatctcttccaccgaaacagagtctgcatatcctaattcatccgcatttggtcggctgagtttcaactgtttttgaaagagcacatgcatcagcatatacatactactgtgcaattgaacaaaagcttgagatcagaacttacaagtgcaatggaccctgtagtacggcaaaatcttctcagttcaaattttgaactgattctaagaaccattagcctgcaaataaatagaatggtaagtactactgtaaaacagaacctaatcataatcattacagtgacccaactttgagacacctttcaacatcaacattagaacttccatctgaggatttcagttgagtagagtatttataatattttcagttttgagatgtaaataagaagttgcaaaaaagaagaagagagaattatataacatatcaagcccattcacataagatgcaaagaactgacttgtaacgctcacagaaatgcagtgccatgtcgccaactgctgctccactgacaataacctttgcacccgagtcagcaacagctttgataagctcctccaccttagcttcctcagtcttagcatagttttctagctgcacaacagtacaagtatgagtgcctactctgcagaagatatttgtggaagacagtgcttttgataaactacagaagcaagaaccctgtgctggtcagaacatactaggatattgagttataattgcaactagggctcattggtattttacaacctacaaaatagattataagtggaaactagcttaatgcccatgctttgctacggataaaataaaataaaatatttttttcatgaaatgtgttaacacctttctgctattgggaatattcacttatatgtggctatccatttagatttgatgttttatcaatattaagaagttcaaggggtaatttgtatttttttaaaggcgtaaaggcacacacacggaaagaagttcaaaaaataaacaaaagaaagcaaaataataattagaagataacactgtaatggattagtctataaatgagaatgggtaatataatagaacacataacttgaaagttgaaactcgaactatactaactgcagtaaaacgttcgtgataattaggccaaaaaacgatgtttctttattaagaacatacctgctcagcagaatgtatcaaaacagttcccttggtttcagttgcagaagtatcaacaccgccagcaaatactgcaatctgattgatttagaaattagagcagatattgaccggcattgtatagagaagatcatgtaacttggattggctaagactacaatgtgcatacagtgcatgaatacatgaataggtctacaaggttgcagtttattgtaatgtaggtgtacagcttctaattgaccatgtaccatatgtaagattattgagcacatcaacaaaaaaactgtaaaaatgccacaggtattctaaagaaggtttgctactactatgccatatacaaggaaagaagaatgttatcatgcaattcctaattaagccatatgatcataactaggtggagaccaattgaagactgactaccaaattttagaaccctgctaccttcaaagcttgttagcaagatatattccattaaatgtaaccaccaagcaagccttgagaaaatcctttacatcatcagtgtgaaatgacaaagaaaaataagtatcatatctcaaatcaaaatttcaaaaagatgaattatttagttattactatcgattttatggtgggaagctacaaagaatagaataacaaatatttgatcccaagtgatgatatgcttcatccatgaaagggatgagaaaggaaaatatatgttaacaccacctaatgtatgatagtatacagtgtggaaacagccctcactataaaagcatgacagtatcatcaatcgaaaatagataatgtatcaacagactgccaaaagacacaccaccaattaagtgtaacatttagttgtcacctttgccttctccacccttttgatgctcccaacagcgtcatttttcagaaccatcccccggactacagaagagttgtgcaaaccacctccaagtagtttcgcaactctaacattgtcaacgttgaagttagcaggatttttcgggcagacttgcatacaggcctgaaaatccatggtaaaaaaccagctattagttgttaagaaatgagctccctctcacataagatggtaagaattgtcttacatcagccacaagagggcacaatatatcctcctgaccgaattgcttgctcgcaactgcagatctcatcagcaacacaacctcctccttgttcctcacatccatgttctctgaacctttctccacaagatcttccaagatctcaacagtctgcgcattgcagatgcaaatgcatgaataactagcctgccatcaggcaacaggtttttttaatcaatataaggccagctcaatcgggagggtaagtaaccttattaatggccttggtgtagccaatgatgatctcacttggatgcaaccccatcctgataagctcctcggccttctcaagcagttcaccagcaaaagatatggtgaggttagctccatcaccgatttcctcctgctgagccctgccagctagtaccaggatcttagcagcagggtgctggacctcgagctcattcacaattgttgcagcatcgttcgtgacaaagagcttgtcgagatggttaatgaccatcttattcattcctaccaaaacaaaacagcgatgctgttaagaaactagcttctgatactaacatgaatctgtcagatattatacatcacagaaaaatgtagcgcaggagcatgtttactgctggcctctaacaataaatcgctgaaaaattaactgaactcaacctaaaaccgcaagacaggcaccacaattttttagtgtccaaaagatccacaacttttctctgcaccattaaattagctaaatgtgaaacactactaacgacttcatcacaatactgtcttcaacctcattacctaagggttgaacaaacaaaagctcatcttttctgcagctaaataattaacacactgtggatgcagcaacaagggccatagcctaaccatttctaccgtaccaccacatcacgcgcgcgacactccccagatttgatatatcgatcgagtccgccgtggcacatcgctagatcccaaacttctcggatcaaaacgcgggcaacgaagacgccggagcacagagcggggaaggagagggaagggggcctcaccgttggggccgagggaggtgcgggtgatggcggagagctcgcggcaggcgtcgatgttcttgaggacggcctcatcgaggccggagaggtgcttgtgcccctccttgagcatggactggatcccgtaccccggcatcgcgcccagccccaccatcgtcggcggcggatgagatcggtgacggccgcggaggaggaggagaaggaggcggcggcggcggcggcggcgaagcggatcaaaaaccctagtgtgggcgggcgatgcgcgagtgttggggagaagggaaaagggaggagggagaagggagaggccggcgagttctagaaccagcaggttacctgtgggcctgcattttgggccaagcctactaggcccaaatatcctcgaactgtaggcccgaaagctaaatggactgaaatggaagtgatagagctgaaagttaggtaaaaataggcttaaaacagggaagacagattctaatcacccaagtggatgtctatctgtttattgcatgataaataaatagttataaaaagttaaaaataacataatagatcaatatgtaatatatcactctataaattacaacttgtagaagttgaattttaacttggatgtttatggagttacatattacatattgatcgtcatttttttcaaatttcttaataactatttagattacgtattaaacgagtggacatccacttgggtgattaaaagagtttcccttgaacaggcccaaaagtgaataatgtaggcttggagcaaagctggtttttgaaaccagtgggctaaaactagttttttaaactaggtacatggcctgtttagaagagctctagctccaaacttcactttagaggtggagctaggggctttaggttgttccacaattttactttaggttcaggttttgttcgagcgatcttttgttcgacatttgctacatgtgtatgagaattcatcaaattcgaaatgatcaaatgcacttttatttattcacgtgccaaatatatacaggcaaatatcgtatcagaatatcaaccgagaagcaacggtatttacgggaataaacatatattccacgtaggagtactatatctttgttatctaggacagctgggcaaatagaagtttcatcagccatggcggatgatcaagacttctagaacttggacttgaggagcttgatgatcttggcgtccacctggaagctcttggcgaggacggcgtcgggtatctccgggtcggagccgaacagcgtcgacccggcggccacgacgccgggcatctggctgttgaacgccgtgatgacctgggcggcgacgccgccgacgttgtactggaagtggatcatcccgcgcggcacgacgaacgtctccccctcgccgagcaccttggagtagaactcccccgccgtgctcacgaacccggcgagcaccctcccagcgacgacgtggatcagctcggtggcgcgcgggtggctgtgcagcgggttgacgccgccgggggcaaggtcgacgcggccgatggagacgccgagcgtgttcagccccgggaacgtctccgcgttcgccgccgtcacgttgaacccgaaccggttgtccgtgtcgctggcgacggcgaggccggcgaagaagaagtcgtcggagacgaccgtggacgccggcttgcacgggaagcccgggtaggccgggcacgccgccgccgcggcgtcgccggcgcgggggacgacggccacgcagaagtcctgcaccggctcagggtcggcgatgcaggtggaggctagcacggcgagcgccgccgacaggacgagcagtggcgccgacgatgtcctcgacatggctccggtgtgctccattggtggcgagtggtgtggtgcaaatgcaatgttatataggacgtgaggaaggataaatatttggaggactttgaactgtctgaatctttgaagggtaaagggtttaaactttaaaagtcctctctgttagtgcagtactactgattacagatgatgagatgagtactctgacttaccgtgcaaaaaatgactactcagcttgagagattgacaaatctttgggtggtaattccgtctataattaaccatcatttcgctgcattagttgctatcttttagagagctgtgttaagaactaactcttcaaattgtggttggtgaaatatgagaggaactatattgagaggcaaagttttcaactatggtgatttgctcatcgagtgagttccacaagctgatccatgtactgctcctgagcccacaacttgcccttcttcctccaccataacgcgctgcacggctgcaccactgcggcgacgtcagtttcggtcgagaatgagctgttgtcatagacctctacgccgacgcctctctccggcattggcgcattgctcaacgaggccctggttactttacctatcttcactcatcatggagccgcgcgtagtctaaaaatgttatttgtcgtacatacgttctagtgcacactttcatatgaaagttttttatagaacttcttcaattaaagtatttctatgaaatatatagataaatgtttttccgggtgaaacttttgcggacaaaaaatttttggatgaaagtttttagggggaaaaaagggatttgttgggaacgcaagtgcgttaaatagtagtccccatacaatcaccaaatcaccaagaccataaattgacacatcgcatgccaccagggcataataagattataagtcatcgcaacaatattcaataatctctacgatatactatattttaaaattttagactcccgctatatgtttcgtgccaagaccttcaatttctaactacgaccttatgaatcataatccgattactaggatcatccaacgcgtactgccactttccagatcggtgaaatggccatagttgagaactttgcctcttacaaaatagtttctcacacgtttcaccaatcacgatttggagagttagagttctcaacaactatctaaaagataagtaattgatgcaacgggataatgattatacacggaattaccaccgaaagggcctgtcaatctctcactctgcgtagtcgtttttttacggtaaccatgagtagtcactagtgattaatactgcgttaacagtgagtcagagactttttttttttaacccttcaaatatttttctttcattctcgaaaaaaaaaatcctttcatcacctcttgtatagcatgaaaactctactcatcccttaaggggatatcctattcttttttcatgtcacttaaaaaatcataaaaaataaaaaaatagtgatatatcacttcacaaacatacatatttaaatttaacttataaaagtagaaacaaaaataataaatttgactataaatagaacgtgtaatacacgatcaaaattgttatctttattttgaattatataagtcagattttaacttgtatgtttgcgaaaagatatatcatatattgatctatcttgataaattttttaacttttttataactttttgaacgtcatgcacacaactagagtatgtcccatcggagggacaaaaatccacttcctatatagcattgcacccgaatatcaacctcgtcaccaatggagtgcactgaagccatgtcgaggacatcatcgtcggcgccattgctcgtcctgacgcctgacggcggtgctcgccgtgctagtctccacctgcgtcgctgaccctgagccggtgcaggatttctgcgtggccgtcgtcccctgcgccggcgacgccgcagcgggctccggcctacccgggcttcccgtgaaagccagagtccacggcggtcatctccgacgacttcttcttcgccggcaacacggagaaccggttcgggttcaacgcgacgctgggcaacgtgcaggcgttcccggggctgaacacgctcggcgtgtccatcaaccgcggcgacttcgcccccggcggcctcaacgcgctgcacagccacccacgcgccgccgagctggtgcacgtatcgtcgccggtagtatactcgtcgggttcgtgagcacggcggggaagttctctccagggtgctcggcgagggggaaaccttcgtcatcccgcgcgggatgatccacttccagtacaacgtcggcgacgtcgccgcccaggtcatcacggcgttcaacagccagctgcccggcgtcgtggccgccgcgccgtcgctgttcggctccgacccggagatacccgacgccgtcctcgccgagaactaccaggtggacgtcaagatcatcaggctcctcaagtccaagttctagaagtcttgatcatctgccatagctgaagctttgacgcgcaaaagaattgcacgtcaatttctccgttttatattataagactttatagcattgtccacattcatatatatgcataaaattattagcatctatatgaatgttgacactataaagtcttgtaatatgaaacggaggggtagaaggaaatggctgaagctttatgtacatagctatcctatattatgtgctctttgcactgatagctgtcctagattacatgtacgtacatagtgcggacctatttggcatagcttctgctccaccccttatagagctggagctcagacaaacagtttcagctacataaaaaatgggagtggagctaggtggagctctctcacaaaatgaactttagttgtggagctgggtttaggtagctccataactccactccagacctaactcctagagctaaatttaggagttggagctgtaccaaacagaccctatatggatacatgtttattccagtaaatagccttgcttctcgcttgatattatactctgatacgatatttgcccatgtatatttggcacatgaatgaataaataataaagtgcatttgattatttcaattttgaatacatattttatgaattcagaaatataacttgagaataagacatcatgttagaatgtgaggatagaaaataccatattaattgaatataaagagaaaaatagctatggcaatacatgctactattggtatatatcaaatctcattcggtttgaggtagcagttcagataggaactgtagacttttttccattggtatatgattcagacttccaaatgggcgcaggctatattctgacttgcacaccaatttcggaattttcgttgcggcccatttaggggaacagcgtactattgaactttctggcaaaagtaggcccagcccgatttgttactgtcatatgcttctccttccgccggcgtcgatggctgcttcgccgcgcgctgatgggcggcctcctcatccccgccgggatacgcctccgtttcctcctcctcgaatctctccgccgtgcaagtttgcgactctaaggcagtttatgattcctcgccgcctcctcgaatctctccgccgtgcaagtttgcgactctaaggcagtttatgattctcgccgccgcccgcggcaggggaaggattccgatcaccggcggagaaccaagcatggcgccgccgcggccgcgtcatggtggaggaagatgggaagatgcgtgaagggttgggtgcaaaattagccgtggctgccgtgctgtcgtcaaattcatttggtaaattcttctctaaattgttgagaatttgatgtctttaagtgattttttccgatatttgctgcatgtataggacaattcaaatttactttattgatgtgccaaatgggcaaatatcggaccaaaatatcaaacgtgaaacaactctatttactgtatctaggacagctaaagcaaaacagatatgctgtagccatggcggatgagacgtcagtgtcacttcttgaacttggacttgagcagtttgatgatctcggcgtccacctggaagctcttggcgaggacggcgtcggggatctccgggtcggcgccgaacagcgccgtcgcggcgggcacgacgccggggagctggctgttgaacaccgtcatggcgcgggcggaggcgttcccagggttgtactggaagtgcatcagcccgcgcgggatggcgaacgtctccccctcgccgaccaccttggagtagtacttccccgccgtgctcacgaacccgacgagcatccggccggtgatgacgtgcaccagctcggcggcgcgcgggtggctgtgcagcgggttgacgccgccgggggcgaggtcgacgcggttgatggcgacgccgagcgtgttcagcgccgggaacgcctccacgttgcccggcttcaggctggccccgaacgggttgtccgtgctgccggcggcggcgagcccggcgaagaagaagtcgtcggagacgaccgcggacgccggcttgcacgggaagcccgggtatgccggcgacgcctcgccgccggcacggggcacggccacgcagaagtcttgtatcggctctgggtcggcggcgcaggtggaggctagcacggcgagcaccgccaccgtcaagacgagcaatggcgccgccgacatgtttccggtgcactccattgatgatgatgaggacatgaggtcgatagttttggtgccaatgcaatgctatataagtgcatataggaggacgtgtggaaaggacaactttgtgaaagctttgaagggatcaaacattaaatcactaaatacataaaaggctctgttagtattgtgatcatcaataagtactctttccgtcctaaaatagaaacactattaagtcaaacatttttaatttttactattaataacaagaaaagtagaaagatcaatcgtataaaattgatgttactaaatttatcattaaacaaactatcgtaacatgtagttactttttatttaaaatttttatagatattattaatcaaagtagcatatcaaagattatccaagaaaaaatgctaactatagcgagagtgagaaattgacaggccctcgggcgatttccatgcataatcatcatcaagctttgatcattactttattggagagttgttaagtatttaagttgtggttggtaaaatgtgatcaaaactagattgtgagagaagctttttcaaccatgtccgatttgtcaaggggcagcgcgtcggatgatcctggccgtcggatcgcgattagacggctgcatgataagtggagattggtaaatcgtcctcatcgttgacggactaacgagtgacgtggacaggatgtggtctggtagaatagacctggtcacggagtgcgagatgagcatattgttttacttattcttatgttaattcgaatcacttattactccctccgtttcatatacaaatcattttgtttttttactagtcaaacttctttttaaatctatagaaaaatgtagtagtatattaaacacaaaacaaatatattattaaaatatatttaataaaactaatttgatattttagatgctgatattttttatataaaacggagagagtactaaataaaagatcatttgtgactaaaacttttatatgcatatcattagcaaactcaaaataaactatgatgaaaaataaaaaataatcaaattcaaaattaagttttaaaaacaatgaagaccaaattctccaatggtaagcgaagtcctcaattccgtgcacttgggcgaacccaccactaaaaaaaataaaggcgaaagcgaccacactgtaggaagaaaggtaagcacaagtcaaattggttggcaggtagcaagcgcgtgttcagtgcatgttggcttgttgctaggctactatggtacagatgaatcttcagtttttcagagttcatcatcagcctttggaagacaatactcttttcagatgaacaatcagcacaaagtcagtctacgcgtatcaagatggtacagtatgtttccaagaagacaaactacactgggtcatacatttctcaccaaatttacaaagacacatctctgaacaaccgattcaattcaaatattttcctaaggccgcctttggaatatgcagaatcccattccatccatgagtttgggccaggattttagttcagaatcctggcctatacacatggatggactgggattgaggcccatccaaacgaggtctatatactggcatgtacaccagatggggaacaaagctaggagatactcactcctatacaagacctaaggagagaatacaacagggaaatggagaaactatttcacactcactcctatacaagacctggttactaaggctactatgtacactaggagctgccatgggatctgaccgacgatatagattgcgctgaaacggaggctgtcgggctgttcacctccctatccccattggcagttcgagggttgccactgatcctactgatagtgtcattagcaacgtcgatgaaccaatcgtcgcttggaaggacactgcagagaataaacgggtatatcatcttcagttaccaacctttatgaataaaccaggaattgcataatcactagcctattccagctatgaataaaccaggaattattatctaaaaaatgaataaaccaggaattgcataatcactagcctattccagccagtttctggtatgtgaggaatctattacaattgtaacatggagcaaaatacatgcatgcatccgattgccattacagcataacatgcatagatattaatattagcacctcctactaaatacagtcggactgaaatagatttattaaccgcaaaaggatagatgcaagtcagatagatagtaacatacctatcagggttcatccctgtagcagaaaatgctgccattgctctatcaatgattttcagtatcacttgatgtacgtgccgagataagaaacggcctcgcccggaaaggatgacaaattgcatatccaggtagaactgaaaaggaaggtgaaaataagaataatagttggtgtcataagatcaaaacaagaaaaaaagaactcacctgctgaagtccaaggggacccagagcccttggcccctcttcaatctcttcccaaaagctctggtcctctgatagccacagtatgactgtttctgtaagccgcatcagtaggaatgtagcaaacctttccctaccaacaaacaaatctgcagcaatgctcgccatcctgtttaactttgcatataattcctgcaacaatatatgagatgctgcaacaaaaggctaaagtttcttgggtagatttgcaagcagcatgactgcccaagtttcatgagttgtcatctaagctttacattaacaaaatttctgcctgacaaaatactgaagtctattatctaattcaaaattgtacctttgttatatttctcaaagtgcaaaattttctggtttcaatttctaaataaagcatttcttcgaacaaaattgcaagccagccagctgccaaaatctatttttggtgacaactcatcaggaaccaaacagagttctgtactgttggttctacaatttggttgatcttgttaatgttgggctagacataccagtataatagcacaagcaataactaggaaattatttgcaagctgaatgcaacttctttaccatatgagtgaattgcattggtggtacatgaacttgtttggtgggtgcaatctagtggatgaacttggcaaacactcgttttagtgcaaagacttgtctagtgtgtgcgaaccaaggccaaaaggacacgacaaggccaattttaccaagtttatgctgattaagacgtaatgtgtacatgtcaagtgggcatgcatgaaacatgctatatttactttatccttctatgtatctaacccttgcatcattcctcggtttttcatgtcttctatgtatataaacaagaaaggaagtgctatagagcatagattcagaaaaacaatttggtttacttattttacaacaattcatctaaaaatcaatatattttatagatcatagaagaactacctcaatgatgaatgtcataatgaacctcattcttcaaacaaatataagcagtaatgtttatccagatagttgttaagggcaaaaaatttatacggacctgaaaaattagagatggaacccattctggctcttcaacagtattatccatattgatgtacatttctgcactcagacgggtgtcatcatcttccgtgaatataagatcaagggcgtgctgtctgcagaaactatctttaagtttatccacaatacgttgcagcttctttttccattctcgctgctctgctacacggttttgcctgtctacactttttttacgaatatcattcacaccagtatggtttacagacgacaacttcatagctgctctaggtagcaactcttcagctagtaaggatgcattagcgaacaatgctagctgctgctcctcagtctctgccactcgaacaatcttatttcctaaaccttccaaattcgcttcatcatccagtgagtgtggcagagcacttatgagcagattgacatatgaattgaatattttcagaagcccgtccattgcagaaccacctaactgcaagctatgcagtgggccaacatcctcaaagaaatcctgcaaaataatacagtaaaacattaaaagaataactttatgtataaatcctcaattacaaaggctagaaacatttgtcaagcaatagaacattacctgaaccattgaactgaagcgatggccactgtttgagagcttaggttggagcaacaaactactagcagatgatctagcaaacgtccgtataccagatggaggataggtgagtacccagtcatcagctgcagctaaagcagcagtactctcttcaattctcctcaaactggactccagtgcttgctcaacagagggtttgaattgcttcatcagaacagacgaaagtgacaaaccacgagtttccagcaaggaagaatgaccaagtgagatctgaatacattcggcagcagctctcaagcccccagcagccacacaagcggctaaagcatgcctctttacaagtagtgcaaataacattgcttgttctgtagcccatgtaatcagttcagacaaataagacggttcatcaccaaacagttctaaagagtcactgagagcctgggctataacagaaaaaacttgccgtgcaagagatgcagtgtatgccccactgtgtgatgtgctagacggatgtatagtttgcatgctgcattgaagcctctggttgtgtgcactaagcaacaaactatgagcacggggtccatcaccgagtctcttgagagcagaagctgaagcacgaagttcaacgccacgagtagaagactggcaagcagcttctgctagctgatttgccaatttcagacgattatcagagatagccctcttcacggccagaatgtcagctgtggtgagtgtctgtttctgtttttcatcagcaacgacacgttctgcttcatccaaagcatccaatgcttcatccactcttctctcagctagcaaaacatcaagcatctcagggaaatctgtgcaccagttttgtatttctgagggctcctggtcttcatctgtcccctcttctgcagagccttcagaccctgtagtcaaggaatcaatatgaaccccttcagatagaccacgaattagagctgactgtgtacttagcagatttctgacagatagcagctccctttcaaggtctgatatctcctttgatgttctgaaaaccaggagattgagttatcaacattttatccgaaagttatgaactggataaaacagagaacaatcccaggaagtaactaagaaaaacagagaaataccagatgtgaaaaaaaaatacaattatgattttgcatcccacaagttttatgacatctgcatataattttgcagaaacgacaaatccgctgcctacctttcttttttcaataattctttggattgtgattcttacaaaatactaattcaaaattttatgaacttgtatggagtgcgcagcggttgagatgccaaagattagcaataaacaaagctagcaggcatactcattttagagaaacaaaaagaataaaaattggagaataatcagacacgatactctgagtccagggatatactcccttgggttagattaaaatttcaacaattgtgttcacaccttatgaatgcagcataattcgcataaacacttctacgcatctcttcagaagaagccttctttaggtcttgcagataagaacagaggtgtcttatttcctgtcacagtttttgagcatcaatcctgttagattttccaagcatgatgtgccttttactaaagtaatagttcaagctctaaaacacacacagggagcatgcaaaggaaactcaacatttgaagcctcagaaaatgcacacatgcatgatacggcacaactgcaaaataggtcttaagtgagcataactcatgcagaaaaggtagaagtgtaggatcatccattcgttgctacccaaatcctttgacaaccatgagcacaagtggtctcccgcacaaaacaataggtaaaagcaatttaaaggcaaccatttatctcatatacaataaacgccaactttctaaaacaaaaaaagaacccttacaaaatttgcgtacgattcatttcatcaccagagccgccataatatagtacaaactccggttctttgcaaatatgtgtaaatctacatgtggtcacttctctagaagataacataaaactaacaaactaacagcactctacttcagtgctccctccaagctccagacaaatgcaaattcaaggttattgacaaacttaattcgacctcaattcaactacgcaagcatgcagcgcaaccagaaatttgtcantactggccagaatcagtatttctccgcatcagagtaaaaaaaacctgtttcataactagtatctgaacatgaaaaaaatcaaaccaataaacatatctagttccatgcaaccaccgttttccctctaagggaaacaatcctaataacgctcaattcacactttcgctagttcaaatgcactgggaaactcccgacaccgtatccctcacacctctcgaacacagaacagcaaaagcgcgtgtgaacttccgaccaaaattctaccactccagtttcctccccgtttcacgagtggaccaatccctttaccttctcgttcatggcgtggcacttggactgcacgtacgcgtcggggtcgaagttgtcggtcttgaagatcttcatcttgtcggcgagaggcaccccgccgtcgccgcctccggccgtagcgttcaccggcagcacgccggagtgcccggctgggcgcgacctcgtcgacttggcggacgacatcgccgcgcgcaggcgaaccccaccgccgccgccgccgccggcttcccctctccttcctcccgcgtgattaagaagcttctagaagtggaaccgctgctcgattgagagctccgctcgcctttgcagctgcgcggattttttttttttttgggtgggggatgtttttctttgggtacgtggaataatgaggagttgagttggacggttgcgaaaggaagaaagacatatggttgttcttggaatgtctctggagactgggagtagaccggtactactccctccgtccatatatccctttaaaatcttttatattatatgattatattatatctctttaaaatcttttatattatactaacttcgttttttaatagatgacgccgttgactttttcttacatgtttgaccattcgtcttattcaaaaattttatgcaaatgtataagatataaatcacacttaaagtactatgagtgataaaacaactcataacaaaataaattataattacgtaaattttttaaataagacgaatggtcaaacatgtgagaaaaaatcaacggcgtcatgtattaaaaaacggagggagtagaacataacgatcataaaatagaatttttagtgatgagatttattttttaaaaatatacttttaacgaaagaagtgagtaggtagtttatgtttatttttaatttttttaacacgtggagggtcaaagattatctaaaaacttttcgtagaatatttgaaaactaaatttctttgttttttcagaaactagctgggtggcccgcgcaattgcgcggctagcacccaaacaaaatcatattattttttaagtatgattttacttaaatttattgaatagatatctcgttgtcttaagactttgaaagaccaaaccttatcatcctcgtgtttctaattatatagtttttaaaagtcacaccggttgctacctcttatgtcatctccttctttatttgcttgctcgatctaccactattttctatttattcttcttgaaagctttaaaaatcggattttacagtttttagagtttattgtcacgttgggtttcatttttataacttctagagtcccgtcaaatgttgtcattatactcctctgcggcccgtccactgtctcttctctttattgtcattgagaatttaaaaatcgaacataattatcgtttgggttcatttttagtttctagaagtcccgccaaaccattagcggctttgccattgtactcctctacggctcgccctttgcctcctttctttattgtcattgagattttaaaatcgaacatgattatcataggtttttttttacttttagaagttccgaacctttaaaaattggacttgtagtttcattcttttataatttttagaagtcccatcaaacgatgccactatgcccctctacaacccgtatgccgcctactctttattatcattgtgattctaaaaattaaacataactatcgttggaattcattttttattttctatagttacaggctctgcaactatactcttatacactcagcctgctgcttctcctttttattgtcattaagattttaaaatcgaatatgattatcaatggggtttttttttttaactttctagaagtcttggcaactgctttactcgtttgcttcacggcctgcctgacgtttctccttttaatcgtcattaggattctatttggtgttttattaacaatttttatatgtcgtatcaaccgccaccactctactcctttataggcatgttacttaatttatctcgtcatgtgttttagatggtcttttctttcaataatatttatttttatcacaaattttagttatttataaattgtattcctaattgaaatcttatttttctttttctaatttcatcttttttaaaaaatagttaataccgtattgtgttcttttaatgttttttattttttattttcaatttcagttgtttcaaaattgtattccttgaactctcttttattttttctaattttggatattattttattttttattctaaattttaattaatctcgtattgggttcttatatggattcttctttcaatatttcttatttttaattccgaatttcagccaaatttaaattgtattcctacttgaactcttcttttattttcttttgctaattttggatttatttatttttattccgaattttaattaatctcgtattaggttctgacatggactcttattttaatatttcttatttttaattctgaatttcagctatttttaaattgtattcctacttggactctcattttcttttctaatattagattttattttatttttatttcgaattttgattaatctagtattggattcttatatggaaacttctttcaatattgcttatttttaattccgaatttcagctatttttaaattgtatttctacttggattctcctttccttttctaattttggattttattttattttatttttatttctaattttaattaatctcgtattgagttcttatatggaaacttctttcaatattgcttatttttaattccgaatttcagctatttttagattgtatttttacttggactctcctttttttttctttttctccgattaatgtgggaatttatagcccacacagcgaacgtggtacctcattttaaggctttttaataatataatagatatataggatttttttttgcataaaatgtatcttgggaaacgtgcaaataaaaaaaatcctttttaattctagtgtgaatgatggattaatactaaccacaagatagttggacaatatcacctagctaaaagaaaaacacaattacacaagaacagttctacaactcaaagtatggttggactgttggagtaggagccggtagtctgtaaggagtaactattgaccgaactttttacattttcaacaaggtattgttaaccagagttactataaagaatcatcgagggatacaaatgggactttttccaccaacggacctgttgacccatgtcaccaccctagccacccaatcgaccttccccatcctctcaacctcgactcccgtctcctcgctcgctgcgcgcatcaatctccatcctaccaccagcaatgatgcgggtatattattccgcttccatcacacttttgtctcgaatttgaattcaccatctgcaccgatctccatcctacgagcgccggcggcaccggcatagccaaacggtttccataaaatacccactcatatagtcatatgtcttttttttaaaaaaaaagtttggtactgaaacctcaccgaatcataatcagataatcctaagttctaaccgattccgatttgaacaaatttgactattttcagttaacccttacccaacaattttaatttagtttcaattttcttttatggttcatctagaaatccctctaaacgatcttttttgtgcgatttctttttcaaagtaaaaacgcggagctgagagaagacgacctgaccgcccgcgtactccacctctaacctttgccattcccctgtcttcttccatctccaaatccttcttccctaatccccctcgccggcgaagcgcggcggcggcggcggcgccttcttccctaatcccctcgccagcggggagccgcagggcggcggaggcgtgcgtcggctgctgctgctgcgcgggcgggggaggtggggagagatgcacagatccgcgggcgccacgatggcgtggaacgtgttcaggttctgcactgcgctgagggggctgggctccatcatgatcctgctcgtcctctccatcgtcggggtcacctactacgcggtcgtggtgtacaactacggccccgcgctcttcgccggcggcgccagcaccctcctcgcgctcgtcgtcctgctcctcttccacttcctggtaactattggctcgaactcttaaggggggggggggggtttgggtgtcaaaaacggtgaaaacgattagctggttgggtcgaatctcgcaagtagacgagagattgagtgtttttggagcaatgttaggatacaggtcgaaaattttgttatctgtgttggttgtttttttttggggtacttggttggagtggctatatgcaggctggatactgatttggataaattgatctatagcgaccgtgatctagtaattgtttgcctaatatatgcttctgtacaaaatactggatttgccgataaattgatctgttgttgccatggtataagtaattattttcctaatatatgtttctggacaaaatacatgatttgcctatgatgtatgcttgctacattgttgaaatggatatgggttgcagtgatagatttaaggataaaaaagcggcagaatgagttgataaaatgcaatgttgatgctatattgattagagaaccgcaatgttaactgaagtttccttgcccgaaatagttgattataaatactagcccccgttatattggacatattcgcactgttttgattttgtttttttccacctttattttgataccaattagtactaagtagccctgataccaatcagtactaagtagccctcgttgtatttcctcagattttttgtactaagtaggagtggctacgagtgagctggatacatgttcggacaattgagctgttatgtccatggtctagtatttattttcctatcatgcttcttgacaacatattagatgtttcctgatatacactacccacattgttgaaatgcggatggattgtactgagaagttaagaaaggaaagtgcaaaatgaggtgaacaaaatgcaatattgatgctataatgattaagaatcacaatattaactcaaaaattggatgcgaagaatagttgactataaacattagccctgtaatattaaacattttcgcaccgtttcaattttttcccgcatatttgcttttgacactaattagtttatttctcattgtagcttgttatgcttttatggagctacttttctgttgtattcaccgaccctggttctgttccaccaaattggaatctcgactttgatgaggagaggggagaaactgcccccctttctggcttagatttcaatagccaggtaaactcgcaacaatctatcgctcacaatgacacaggacatccaagggctaggtattgtaggaagtgcaaccagatgaagccacctcgatgccatcattgctctgtttgtaagttgttgatttattcttcaggatcaattttttgttgttctagttattatgaattgtatagtcaacaatattgtgtatttatcactaatcatggtttcaggtggaagatgtgttcttaagatggatcatcattgtgtatgggttgttaattgtgttggggcactaaactacaaatactttcttctcttcctggtatgatattactgtaattgatatatttcttaggatgtgtttagaagggagataggctttggagttttgttatttttaacatattcacaggctgttatttattgtcatgctagtgaaatatgcagattttttttttgttattgctttaaccctatcttttgcaatgagactggtttcattttgcccagtctatttttatgcactgtgttgacaaatcaagatcttatacagcaaactatgtccatccaccccaaaccacacacacgcacgtgaaatgtataatcaatttaagccaccatgaatacttaaaatgcttcttctattcgatgttattagctagaggggtggatctatgatgcaaggacatagatgcgtcaacacgacacaataccgatctgcggattcaccattttcagaaaaataccgatacggcgacacgtctacatattttaataaaaatactttcaaattctcaattatttacaactaaaataatcaataatgtattgcaagcaagtacaatgtacctcaaggacaatccttagctcctaaaaggatggcgctttggtgggggtgtgtagggggatgtgatttatcatgtggctatgtgggccgggccatatcgcatatgtcatatgtgccggagatgaatcgaccatgtatcagaacataaaactaattatttttttctatttaattttacaatacttggtcgatacgtatcggaggcgtattgaagatgtattgatatcggacatgtcattggtcactggtgcataacgtttccatattattatgtttacaagctaataaacaagctaaccaaatattaagtactaaactaatggagacgcaatccaacaaacagttggtagctcctctgtcatgctgctgacccactgcatatgcatcttctgtggcttttgtggctttgatgcatcagagtaattagtgtgttattgttgaatattaattattgcttttctcatctacttggggattccacttatatagcagtgaagaaaataatgcaaaaaaatataaatcagagtaattagtgtgttcacttctctgataataacatattaatattggcagtataaatgctgctgccttggtggtgctttcgtttgacttattttggactactatccttttttcttccacacagctattcgatcctttgatttctgaagctgagttcatgtttttaatgattccatgcagttttacaccttccttgagacaacactggttaccctttctctattgcctcacttcatagccttctttagtgatattgatatcccaggaagtcctgcagcacttgcaaccactttcctcacctttggtaattgcattactttcattcatgagaaattattcttgggcacgtttgactgaggattggcttataatattctttttctctgcagtgttgaacctggccttttccttgagtgttctgggttttatgattatgcatgtttcacttgtttctgctaatacaacaacaattgaggcaagtatctagaatgtataattaaatactcaagtatttatcaatgtctattaaatacttacttttgatatctccaaggtgagattaatttgttacattatttttttatttaggcatatgaaaagaaaactacgccacgctggatgtatgatattggccggaagaggaatttcattcaggttaggctttcagaacatgttaaataatctgttacttcttgtaatggtgcaagcgcacgcgaaattatctttgtttaaaggcttgatacaccttgatgaggtgggattataggacatgcacaaatgcagatattttagagggaagccatacttttggcccctctactatcccttttgtttactccacctgttccaaaataaacaaacgtagtatagggtgtgacacatcccgtactaggtttgtttattttgggacagagggaggtcatattctgaatgccaatgctaattagaaaacgtccccagttatcaaaatcatgtatatgatggttagagagtggtcttggatgatatgacatcatatatatgatgcatagagtcataggctgatgtggcaaataatttacggaaggaaattaatgctcctttttttccagatgaggtaataaatgacatactgtattaaaaaaatgatgatgtggcaaccacaaaacccaaaaccagtcaagaaagctgctttggatgcattttgcaccaattccaacagttgtgtgatgtaaattaaatggtattaaagtacaggttgtaaaccagagtagttcagaaatcaaaagtggaccttttaccccctaatttagacttctgtggtagatccacccattttcactcctcattttattatcccatttcccatacaagtgccaaattttccttatccaaatagcggttctgcaaggacagataagggatgtgatcaacctccagggcaaattaagaatttacttgaacttctatttctaatttgtgaaaattgtatatattgttccaaacttctaatattttaagctgcccgtcatttagagttccatacatttcgagtgtggcattttacaggtgctcaagggccatgatatttatttaacttatggttactttggccagtattactaaaatataacccagcaaagccgctagcctggtagtacactagtactaattcaagttagtactatgtgttatcttcaacatctgaaatatgccttctttttcatttttatttctttttttgctaagcattctactgcaaggttgcaattcttatctgttaaagccctgtttggtagtgagtttagggggtggcaacttccgggttttccattagcactttctcaaactgctaaagggtgtgctttttgcaaaaaaacaactttttatataaaagtttctttaaaaaaaaaatcaaataacctatttttcaagtttgtaataattaatactcaattaaacgtgcgctaatgacttgtcttgttttgcgtgccatgaaaaaccccattccgacatcactactgaactcagtcagccacatgtgaataagtgaacataactttaacaaaaggcaaagctaactaaacagtgttctgttaccaggtttttggaaatgacaagaggtattggttcatccctgcgtactcagaagaggatttgagaagaatgccagttctacagggccttgattaccctgtcaggacagatttggatgggcaagaattgtgatgggacaatttcgcctgtgccctcacttcccatatgcaccaaatatgttccatgtaaattttacggtttccttccgatatcgtagagttaaatatttttaaaggtacaccttagtactgacagcattgctggttgggtactacatggcctccgaagagagtgttcccagaattacttttcaaaccctgtgtaattcacttgtgctgtctgattgggcaaagaacgtagaggtcttgctattgtggctaaaagaggcatgtgatgtaaattctttttagtgtgtttcagatgggtttccagatgtatgatgtacaatgatttgagctgtgcaatagacgtacagttattagagcatgacatgttgataagataacctgtgttaattagagaactggatgtttaagtgttattttattagtttgtcattttaaaatagtgcacccgttttcaaaaggaatatatgatgtattttgtttcgttacgacaaggctttggctaacaattgctctattagggtataatctttatgacgtaaaattgaatttattagatttatatttaaaagtacttatttaagattataattttggatcacataaatgttgttttaatagagccaagccagtgtaggttaaagtctagtactataacgcaacaaaataaaacagatggagttcatcggagtagaagatgaacttgatcggtacttgtttcactctagaatagaaatatttacaattgatctgtgactaatgtcccatccgactaacatgtttttttttccttgctcttctaatgtgaaaatctcttccagttatgatcattccgtgattgtttttcttctttgattgatggtgttgctctcaccacgcaagtcaccaatttcttctgtatgtaaaaaatgctccaaatttcgtctcatactgtgctcataaacttctatggcttgtaaatttttgtggagttttctgcttatgtgtgaaataatttgtccaatcatgccaccaacttggctgtttcctctttgaaaaagtccactttgactttcttacttgtgcgccgaatctaattcatatccctcaaccagaaaaccggatatgacgactcccaaaactattgaaaccagtgtaatttgactccctcagtggttttagagggtgattttgctgatgtgtcgctgacgtggcggtattgacccggtcttcgtcccacgtgatgcttacgtgacattagaatttaaaaaatatatgtgagacacatctatcattcacatacaaaaatatattgtggaacccactgacatgtggggcccacctccctctccaacccttcttcctcctccttctccctcccttctctctcttccttcgagccgcaggtcatgcagcgacgcgtctccgcgcgaccggatctcctatctctctttctctcccctttctctcccccttcgccgtctgcggggagagctggagcgacggcggcggcgggcgagggccagaactgcggcggtgcgtcccatggctggtggcggccgccgcggccgaggaggccggagacgagagcggcggcagcgggcgggcgagggccggttgcaacgccgccacccccgccggcttccgcgacctccactgcctgtccacccctatcaatctcgactcagcaggagaaagagcgcctcctagatctctcctctaggccgaccctgtccccgtccgccggtctgggctaccgcggaccagctcctcttcgtgccgccgggccacccctccgtctccgtcactcgagagggaggagtcggcctctccatctcgggatgtcggcgctgcctcccccgacgacagagacggactcaggtcagcgacgcacgcacgcgcgctttcttgccataaaaggagcaagcaagacgtcatctcctcggacatcacgattcacgaagccaaacccttctttatccgatcatcgagcatgccaaccagagtccaagactgtcaattctcggcaccagcggtcgagctttctgatccatcgacgtcgacggtggtggcctcggcgagcatggagatggagcagctcacagcccgcttcaacgatgccgtcgctgtgcacggcaacaactagctgctgctggacgctgccgccacggcgccacacgcggcggtgggcatggagatggcggcgccggggcgcggtgatgatttggaggagctcatcacccggctcgtcgacgtcaccgttgttgcgctgatgatttggcggcgctgttccactactgcggctcggcggtcgccgcgtgcggcatggcgggggcaggcgttccggctggtgcggttcgccagctggtgcagtatcacccagttttttttaatgacaaataggttccacagatttttttttaattctaatgccacatagacgccacgtgggacgaagatcgggtcaacaccgtcacgtcagcaccacattagcaaaaccgccgagggagtcaaattgcactggtttcaatagttcatagagtcgtcctatccggttttctggttgaggcctgaggggtacgacttaagattcggcgtataattaagggagtccaaatggactttttcctttcctctttcctgtggcgcgaggcagagcgtgaggcatacttggacgtggtgggccgggcgactaggcccgtgtcctagtttgtgcataaggccttggtccattgcattaagagaaaacaaaatatagaaatacacgtgtaaaacaaatgttgattaattaataaataataaaactttgggggctgcctacggctcgggcgcccgatgatttggagaaaaatcgggcactgacgtcatgctgacgtcagcgcccgatttacgtgtaaaaactaatttaaactgatttttctcttaaattacttatccaaattatgatccgattgcaccattaaattcgttgcaattaaatcttcaaaacaagaccacacgtggatatattccgacgacaatttttttaagcttattattgaattatttttaaatgttgcacgatgttccaccaagtatatcggaattgtttcactaagtagatcgaaaatgtttcactcatttaaattgggtattgtttcaccttatataaaaacaatgtttcagcaaatagcgaaagattgtttcagttcactgcaacatttgatccatacacagtgaaacattataagtgcactaggtgaaacatttttgggtggaacaaaaaataaaacgaattcccttaatagggggtttccaaaatatgtggattttttgttgcaatggaatatttcagttcactgcaacattagatatatacatagtgaaaccttgtaagtacactaggtgaaatattttttatggaacaaaaaataaaccaaaattccttaatagagggttttcaaaatatgtggttgatttgttacaggtggggacaggtattgtggtggggccagcgacatcagcgtgcgcaggggcgggggaggggggagcgaccgatttttcctcccgccgcccagtcacccgacggccatcattatccaaaactttggcctgacttcggctgtgttcttctcaatgagttgggaactcatctcccaaacacgtaaaacaaaacgactcattagcatatagttaattaagtattaatagaaaaatggattattgtgatattttaaaataacttttctatagattttttttaaaaaatatatcatttaacagtttggaaaacgtaaacacgaaaaacgtttgaggaaaaaacgactgttcttcgctccatgctcgcctgagcacaccaactcatggtttctcagtttctcacatatgctgaagagtttatccctccagcatctattttttttctctctttttaatcgtattgttgatgtgaattatttgctccacacgcctctgaaaatgtggcttctttaacaaaaacatttctttcattgaattacttaggctcatttgtttaaaggtagtatttgttaagtttgtttctaaaatgtttaattcatttatataattaagtagtcaatctatgataataatttagcgcttgttcactttgctatcattttcaaccttaccaagttttggcattgtcaaattttggtaaggttatcaaaatttggtaagattatcaaattttagcaagatttcatatgtacttactaaaatttagcaacaaactaaatgtagcaatttttttaactttacaaaaaaaatgataagattgaaaatggtaacaaagtgaacaagcccttaacgaatggtctgcttcaaacgctactagaatttcttcaaacgcttaacatgttaccatcaaagagaagttctcaaaaaggacacacgatcaacttctattacacacccttccaatctcttgaacataacccacgacaaactgacaaaagttcttttaaaaaaatgaaactgacagtacaaactcgacggtcgacgccaagct

SEQ ID NO: 80600 - DNA, 2333 bp, Oryza sativa
aaggcaaggccagttgcaagccacccggtccggctcctccgccactagtcgcccggtggcgcgggcaagctccgcatccacagtcgggcgctcgggtgagctccacctctgccgccggccgtcgagcgcatgtgcctcctcctcggcagtcgactgtccaagcgcgtgagcgtgagagagagagagagagatagcgcccgttgccgccgccgctcctaccgccatcgccaactgccaccgccgtcgccaactcggttcgaagagagagagagagctcaacaccttccccacctcaacacctcttagatcttggtggtggagggatcgatgagcgcgctgcgggcggctcaacctctacgagctcggggacgggcggtggctcgtcgtcatcaccctcatcccccgccgcagcctaccgccatgcgcgtaagagagagactgagagagtgaggatgagtgagagagagaggagagagagagagtgagtgagagagagaggggaatagtggaataggagtatgacatgtgggtcccataattttttataaagagaatgttgactgaactgtcacgtgtacgccacgtataccaaaaccaccgtggattgggtcgagggggtaattcgtccggtattcatagttgggggtgaagaatatccggttttatagttcgggggtaattcggatgaccgtgatagttcggggggtaattcgtactttttccaaaaataaataaaagggtcaaacttagacctgttggctgttgccatggcagatcagctagagtttgtttcaataaattcaagcatgcatatattggctaactaactgtgttttcagttcagcgtttggatgttatgaattttcaatggcatgtaaaatgagaaaagttattagccttagctataacaattaatcaagtattaattattatagatttaaaaatgagtttatttttaattttttttcacaaaacgtatcatttaaccgtttagaaaacgggctaatgaaaaatgagaaagttatattttagttgctacaagaactcatctaagtactcactcgcaggtacttctagccagcaaagaccatcatagctgatggggctcaacacgaggagcgagaaaaaaaaatcatcgaaaagaaacaaattatcaactccactttgagataaataaatgaacggtcggagcaaacggacaactcttaagctatcaaacgtcatcgaagctgcccaaaaataatcccctgtcaaacgctggtgatagctactgtacgttgctctatcatatgctcgcactagggcggggttaacatcagccgcgagctaccaccacggcacgcaggaaaatggcagatgcagaaaccaccagcagaggaacggctgcgacgcccggtccggaataccgcggccagccgaggttgcaagagaccagggcacacaaaacaaaacaccctatggagttcggagtattatgcatgtacatccatgacagattacatatttgcgtaacggatcttttgcattttgggacaactagtgtcatgtatatcattgtttggtccctactgttgctagttgcacttctcgcgatcacttgaaaaatagatttgacctcggtatctttgtgatataacaataaacctcatatcagtgatagatatacatggtattttaaacaaaacatggaaatgagacctttttatgaatgcaaaagttttataggattcttaccgacaatagcttaattcctaaggtttttttacgcttttcttttgtggctactttgtcaatcttacaatatattggcctaattgttcggaggggctcagtagataaaggaggtgtgtgttcgtagagatgagtgcgtgcgcgttgtgagcgtctacacttataccatgtttgtcaagatctcacttcatgttgtgagtgactgattcggctagggtttgccggtttggactttgaattgttttcttttgggccttatccagatacctgtagattgggtggtgcgcctgttctactggcctacttatcattgtgctatatccctagctcgagttggcgtgttaaaccacagctcagcttgttaagaaaatactacgagtcgacgtagtcgagccaagcgagccaacgagcgacgaacttttcgttccgcacacaaccctagtccaaatgcgctatttctcgaattcccagggtcccagtcgcaaaaccaccccccaagtcctcctccagtttccacgtccccgccgccgcagaccagactgggaaattcgccacaaatcctaggggcttcgccgcaaaaccagcaacccaacaccaccccc

SEQ ID NO: 80601 - DNA, 21266 bp, Oryza sativa
tcagcctccgcccccgccaccgccgccgccgcgccgaggttgccgccttcagccgcctgaccgtgagagaaagaggaagagtgaggagagtgagagagagaagagagaggaagagcgagagagagagtgtgtatgacaggtgggtcccacatttttaaaaatatagaatgctgactggactgccacgtgtacgccacgtagaccaaaaccaccgcggattgggtcgaggggggtaattcgtccggtttgtatagttgggggtgaagaacgtccgattttgtggttcagggggtaattcggacgatcgcgatagttcgggggataattcgtactttttccttcaattaacttttgtttgcaagacaattcagacatgaatgcagatgcagctcatggttcggtttgttcgatgctagggattttcacgctttgtgtttcaatgtacttaccactccgtactattcatcttaaaactttaaactcatcctatcttgatgttttgacttcaaggttttaactataggatattgcatgatgttacttttagaagaaaacacttttaaatgtgaaaatttgctgctggacaccacattaattataatattcatttctggtttaataggaaagaaaccgcgtgaaagttttgaaacatgtcatgtttccatctcctttgtttctcttagctctctctcgttctcggccggcgagcatgcaatacagatgaagttagctttgccagcaagcattgaggcagcgcaaatccgcaacgctaggagcgggactgggtcctagtgttgccagcaagcaccgggtcctcttgcggcaattaaagatttaaatctccggctatagctgccgctaagatatgccacttttaccgctaaataatctatgaagctaatagctgggtttagcgagagatagccgctaaattggccttgagttagcggcatgcgacagctaaactttggttgtgggttgaaattggctacgggcctaaggcccatctacctctcctataaccctaacctcactctctctcctctcctcgatagatggcgacagtagctgcgcccggagccctaaaggcagcggctatggcttcgccctaaggcgacggagttggcggcttctacagcgcgtggcggcagtttcatgcggaggctgcaacggtggcagttacgctcgtaggcggcggagttggcggctgcggcttcgcccgtaggcgacgcctacacgcggtggctgcgatggcggtggcggcggccaccgtgcccgaaggctgtgacaatggcccactcctcccccaagctggtaagtgatcctgatcttgaatatgcaactactagctagtaattgattctgatcttgaccttcctgtgataaactgatgattgatgaactatttatgtcaagaactcatgtgtcaatttatcatgtactcatgttcatgtatgaactatgaaaaaattatcatgtccatgtgatgaaatgtgttgtactatttattttgttcatgtgatgacctatttattctgtgactcctttatagtttttgcaaaacagctaaatagcttagctgcaactataccccgctatagctaatcatagctgttgaaagcccaaacagctaaaggccttagccgaagatttaattccttggcggcaactgttccagggaggcgaacacgtcaacgacgatgacgctagataggacggtattgttagtggcaggtcccccagatggatcaggttgcgcaatggcacgagctagtgccaacctaagcggcaagcttcgcagcaagcggccgcggatccagttggagagtttgcatggcgtgagcgtggatctaggcggggagctccaggtctggcgtaggccacctctgcggccaccgcctctcttctctcctccattcctcagtggctgtcttgagccttcttctctagctcacagaaggagatgtagacttgacatgtgggtctaggggtctttcagaactttcatgtggtttctctcctattgaatcggaaataaatattatattgggtatgctgtgtagcagtaattttttcatatttcgggagtgtcttccctgaaaagtcacttcgtgccatgccttacaactaaaaccgcaaatatgttttttttagcaaaatttgcctatcttaatataccccatatgtccaaaagtattaaacatattttattttctgatttttctcaaataatatattcatatttgtagtctctgtgcatttaagacttaaatacaaagatagattaaatgaacccaagtagccatcttaggtcttgtttgatggagtttaagatcctgaggagcggctagttggcttttaactcattttgtggattttgtaactacacatttttataatatagatgaaaatttggattgtttgaaggagtttttattctgaaagaaattgcagctaccaaaaactttcttaaatatacccttaatatttattggtttcatacatttatacactctttggtcttaggatgagagttggtttctccttagtttcgatgataaaagaaataaatctaagactttaatatagaagtcgtaataattggttgaaagtatgctgcataaagacaagtgaaaccttttttttagcctagcctcgtaggctaactatttttttaaactaggctaaccattaaatagaagtcaaaattgaaacaaaaattgtccatatcgacaaacatttggaaagggagccgagttcatccatatgccaaaggggttcccaaatgctgtgctaaggatgacgacagaaatgcaggataaaaggctgacacgttcgtgtgcttgccgctttggagtctgctttttcttggatctcggtctctctttagattccatacacatgcagcaacattgcaacaatcttttctgccccctctttagttcccaacttcagtggccgtgagttcacttcttattcaaccaatcctttgttgcattgtacagtactagaaatagtggcgcgctgcgctgcgccagtcaatgatgtcactgaacaattaatatataattactctaaggtccaagagaactacaaactaaacattgaattaagcataacaatcacaacacatcaaagaggcttactaattaccattaacctgtatacaacacagaaggttataaatttgctttattagttacgaaataatttcagaacattttacactggtacactccagcaatgaaatgcactcacccaacatctaaactactctcccccactgatggaaagtatattggatatgctttgtgtggcatatattactgctgaaaactccctcccaagtagtcctacaacagtaaaagaaagaagattagtctatgcttgccgatgacaatggtttgaaggttgacaaattaagtaatgaattttacaatcccataggaaagtatactacagttatcctgcattcagtcaaaattataacaccttttggggagctctgttatctctctatcatatcaagttatcaacagcggtgaaaggaacaaccacgcagttgcgatgctaaaataacttttcttgctcaaattttgaggtgctagtgctagtaaaagtgttttctgcatttaagagaagaaaatggatgggcatatggttggattggaaaactttaactatgcggtaatttactctatatatttgagaaaactaattaagtagcatatagaaagagctagtttacccaattaatgcatttaaactgactattcattgatgcaaataggtggcattaattgtatggacaaagattctttttatagttcaaggtgaatcaccaggataccacatctatcctaccatcactccttagtgggatgtaggaaatcatctctattttgaactgcaaatactttgcgactattctgagctcatagctagtaattcagttttaaaagacggatagctgaatataattatgaaaacttcaataattccatcaaaataggtattgcagaaggcctggatgagtaaaattaaaataaaaagttataactcacaatagagaaggatgatagggaaatggaagggaaaaaatatcctgcagacaaatatacaccatattagcatgcaacccaaaattgagcatattaaccattcaatgatctaccagctaagagaattaaaagtgtaaagaaggatctaatccatttggtccaatgatatatagcaatgctaggataagtatagcagtcgtacaacaaaaatactgaaaatggcatgtagatagtagagtatcgaagcaaatcggatcttcctgcatataaatcatccatttaacttaaaatctagttctattagtaccaaatctaagtcatctagaaactacattaagaactaagtgggcagagagagcaaacatacaaagaaaaatgctaatcagtaagtgactgaaagcctacctaatgcttgaaatacaaagagcatcaaaacacatattatctgtacattatctataagagctcctctgacgttacatatcatgcaatttgaaatgtcccatttgaattatatgactttatgtagaattgcaacacatttttttgctatgacttgtccacacaatagaaaaatggtaacataagcatatgctatttttatttcgatgttgaatttgaaaaatagaacatatcagtcggctagttcgtacaattgcttccatgtaggaaaatataatatgtcaaagagtagtgaagtattatcaatgcaaaacagctttaagttcagttaaccaataaatttgaaagcagcaacagtaccaaaacacataagtcctgatagtataagttggtgatctgccttagtatggatttgttccctcacacgcgctctttgcaaacacctagaacattgtccctctgtaaaaagcacattatgcatatcctccctgcagccaagtttagaaaataaattgttgattcaatattaagatgcaaaattaggatcaggggatattcatagatcgatccaggtttttatttaatgatggataaagatggtaccagtcagtagctgcatgacgtaggagacggtgatggccccagcagctgagttgatgaactcggcagactgtttgtcgaagtaatgaatgacgacttgaactatgtaactaaacaaaatggtattcatgcaaatggggaatgatggagtgaaggtgaagtagaagaaacagggttggaagggaagactgggcataggtgttcaccttgaaaggagagacggtagatcagcttgtttgaacaacagcagcgcctgacgatggagacggatacgccctggacgcttcaggagttggcatccggaaggctcaaaggattcgcatgagatggggaaataccacatctcgagctcgagctcgcagaccatcgagatgatgctatctattgatgctgcccctatggcaatcgatgtgggacgaactgccatcgatgggctgacgacgatggaggaaaaagcctgcaaggacgcgagaagagtgagaagaagagaaggggagggaaagagaggggcacgcatgccatgccctcactccgttgcgcgaggcggggaaccggtggcgtgcgcggatgcgtcgccgtccgcccgcgagagggctacgacagcgtggcggcggatgaggccatatgtgagcgggccgcgagcgctgctagggttttggctgtgtggggatatgttgggaagatcttgaccgtctgttgtcctctcgtcgatctgatggtggtggaagagccggcaccgtaggccaggtggacgactggatcgatcccaatgcggcatcgaacggcgccatggtaggtgaaactcggacgtgattaaccggaagaacagggttcgaacgcaattaaccggaagaacggggtatttttggaaaaaaaaaccgatgacatggcgccttaattttccagcactcccacgacgtttagagagattaatataatcgtattgttcagtactgtaaatatctctgaatgaataaatatacatgaatttcacaaggtatgtagttaaaaaaaaagaaaattattcgtggtaaagccattatctagatttctcggaagtctatttgggagggtagtgcttactccctctgtactcgtaaaggaagtcgtttaggacaatgtttaagtcaaaccttgggaatataaatcatgaataactctcaagttgttgagtttgaaaatgtaaaaattatatgaataaatttgtcttgaaaaatactttcataaaagtatacatatatcacttttcaataaatatttttatagaaacaagaagtcaaagttgtgttttagagactgtgtcgctgtccaaaacgacttcctttatgagtactgagggagtatttcccagtcttcctctctcttatgtttcaggagttggacttttaacaaaatagacctagctttttttaggtttccttttctgttttgttcccctgttgagatggtcggtccgatcttcgtgttgtgtaacaaactttcaaaacttcttctaatatattaacatgcatgtaaggtttttgcgcgttcgcgaaaaaagacattatttaggcttcttgaactactctcgattatttgatattgttaatagttaaattgggagcactaataataggatacaaatctgagcctctacataacacacacagcccgttctcaaggatgttcgagaacaatctttggctctagaaccgaaccattttttggtattgtacacaagcaaattaaagcattaagttctagctggtgatggatcgatgagccatgcgatgttgacgagctgttcaattagatgtcgttcattcctttctgagcaatggtgctgttctttccttacattctgttgttaataagtgcagaattaactactgatgaaatacgaatcgactaattttattaagattgcatgataaaacagataatttgagactcatatagtatttgaagcaatcgaataattcagacgtcaatgccaatcaaatgtataatttggataaaaactttcacccctaaatcccgcattgtgcttcacccctacttggtgcatttggagcttaggtggctgcagctggccaaaatattcaaccaatttggagcttggagctttgggagaagtggttcttctgttctttttttgtttaaatatgtaacttttattcaaccgatatgctcttgaaatttggccacgcccacatccaatgcctaggaggaaaagcaaatacaatgtatttaggcataaatcattgactcgagaaaggcatctctaatgatccaacttagcatgggcacaattttctttaaaacctcatcaaggtgtacttgtattaagaaggagggaacactgtacaatagccttatgggctaggagttacatgtaagaaaaaaagaaaagaagaaaaaggggattggaaggactatgggatgtccaacatgtccgagtttacagttgctttgttaagattatatgtagtgccaccttgttcgtttggcatcagggacttgatgccttttgctccacccgcatgccagaataaaatctcgtcggtcaccctatctatgatccgttgtagcggtagcttttcattcctgaattctcggttgttcctcttcctccatatttcctaggatactaggatgagaattgacttgatgcctgctcttttttttcctttgttgtcgctttgacgttttggctccaccattcctcaagggatggtgtgtcaaaccaaattctacggtttttgttggaggaggtgggtccgtgttgccactgtgtcctagactttcatggttgttggacactcattgaagaggtgatgtgccgttccgaggttcctccagaagaactgacataagtagttgttgggccattctttttgtagatcgtccaaatcatgttttgtagtagtagccatgcaaagaacttgaatttcgacggcgcccaacacttccacaccatacttgctatggccaagggggccccgccaagggattgcatctggtacgccaatttgacaatgcattatctatttctcttgactgtccatttctagcggatgctatccgcagtcccttgcgttagcgtgatgtttgcggtccatatgcattcaaacacttggaagaattcagcgacgagtgttatggactggtcgtgtctaatgtcatcaatctattcatcaccttttagggcctctgggactgcctgtttcttccttcttgagtgtttgtataggtttggggcgattgttctgagggggatactagaggctcaggttgtttttcaagagagtgcctttctgccgtctcccaaaaaacctttgtagaggctacaaatagatccatgtcttgttcgtcccctggtgtgggcatgcctatccatggtttgttcgagctaatccactcataccatagctagcgtagctggagcgctcgtccttttttattttttaacgttagagactctggatccaccatacttgatcagcatgcagacccttccaatacactttgcacttgcctccatggatctcattgcctccatcccatcccattggaattttctcctggctttgtcaatttcctaggtgagttgcttgggatcttgaacgttgtcattgatacagaccggcattgagcttaggactactaggaccagttctctctttcctaacaggtgctcaattgagttaattaatacatgaatttgtagaacaaacatactcaaaagccacctagtacaaattaaagttgactgatactatcgtactgtcaacagtgacgttgacagtgaatcatctcttgcaacgacagatgactccaatgtcactgtccaaaaatactcctgccgaaccgctgtaaacacacagtggcgatctacccctccatctccatggccgtttctgaataaatctccagacctaacaccaccatgttccattgaatgagaaaacgggcagtaagtttctgcaggagagaccaagcattgcaggcctaattctagcctccggccactacgacatcgcagccaaggtgtttagatccagcgatataaagttttggcgtattatatagggtgtcgcatggggtgtttagggaaacggatcctctattgtagagctaatactgcacaggtgctatagcgatcaaagcaagccatccgattagattaagcggctctgattccgtccttaaacaccgaaaatatttttgataatttggaagctaacaaactgattttaaggaggaaaagtcaagatcaccttgatggagggaaaatcatgaatcctccagagtacttggcgccaaattaatacaggttctccttttgctttcttcctccttgggacttggtgccaaaaggagatacagaggtttcactttgccttgttctgtccagaaactttgatgatcagataaagtaagccatcagtctccaacaaacaggtatgtatgccatgtcttgtactctttttgtgatcatgtcctcacaaaaaaaaaaaaaccaaaagcattgttgtgtgattcttatgattggagtggatacactctacactcgtgtagcgctaaacagagtatacctacagatctgaggccttatggcgaacgactcaaactccaaccatcataattcaaataggtgagatcaatttcattcaggtcaacatagttttatcatctacatttttcttttctctgactatgttgttgatctcattactgaaaaggatcttaataatgaccacatagcaatccatatttaacactgtatttctttgttgtaaaaaaaaaagagttgatccctgtttctttttacaacacaaatataattcctagttggattcctcaatttggcatgaaatttaaatctacaaaagaggcatgggaattttggacttattatggaggtcgtactggttttgatgttaggataaattatgaaaataagagtaaagttgatggagtaattacttctgcaagatatgtttgttccaatgagggataccgggcaatagacaaaagagatcacaacaccaagcgtcctcgtgctgaaacaagaacaggttgcaaagctcggatcagaatcacagtagatagagaagtgggcgattattcagtatatgatttagttcttgaacataaccatgaacttcaattgccttcaacatgccatttgatgccatcacagagaaagatatcatcattgcaagcatttgaaattgaaacaatggatgattcgggcattggaccaaaagctgcacatgagcttgctagtcggcaagttggtggttcagtaaaccttggttatacacgtcgtgttctcaagaaccatttacgaaccaagcgtcaaagggagttgatgtatggcgaagccggaagtatgttgaagtacttttaggacaaagttgcagagaacacttcatttcattatgcccttcagttggattgtgaagaacaaataacaaatattttttgggctgatgctaagatgataatcgactatgctcagtttggagatgttgttacttttgacacaacatttgggacaaacaaagaatacatgccctttggtgtctttgttggattcaaccattttagagagaccgtcatttttggagccgctcttttgtatgatgaaacatttgattctttcaaatggttgtttgagacctttttagctgtacataatcaaaaacagcctacaacaatctacacagatcaagatattgcaatgggaaaggcaattgaggtggtatttacagaagcatggcatggattgtgcacttttcatataatgcaaaatgctatcaaacacttacctcgtaccaagaaagaagacaaacattttgtctgatttcagtgcttgtatgtatgaatatgaagatgaagcaacttttgaggaaactttcagtaccatcagaagcaaggtgcacaagcagacttggctaaacagtatatataaggtaaaagagaaatgggcggaatgctacatgaggaatgtttacacattagggatgagaagcacacagttgagtgagagcttaaataatgacttgaaaaaccatctcaagtctgatcttgacattattcagtttttcaataatcttgaaagagttatcaaaggaaaacgagacaacgaattagatgcagaatatgaagcaagaaaaaaattgcctagaattaaaatgagagttcctatattggtgcaagcaagcaagatttacacaccttgtatatttgaatattttcaaaatgaatatgaaagatccatggctgcatacatcaagtcatcagaacataatgaattcattgttgcaattgaggctcctggtgaagcgtcaacatttgaagaggagtgcaaagttgtaggcaattatgcagagcaacaggcattgtgcacctgtggacaatttgaaaggactggaatattgtgcagtcatgctttgaaagtccttgatgtgatgaatattaagtctttgccaaagagatatattttgaagcgatggactcgagaagcacgagttggtgctattgaggactgttatggcaagattgtcgtataagatcccagattggaggataggtgccgcttgaagtttcttattcacaaatttcttggtatagctattcgagctgctgaatctgaagagtgcagcacactagtggacagtgttctagagagcatgaggaaagaagttgatgaaaaaacacctaatagtcaactaggtgaagttgcatctgaagaagcaaacggctctttgcacactgcacgtctgaagaaaaaagaaactcaaaagtgtagcacaaggagaaagaaaaattggcttgataagcagcatcccaccaaaaagaaggtacaagttgtacctgacaaacaaaatatctcggtatgttacttacgaactattcaattagactatatatgtactgattatatatagagtaatattttatctggatggttttgcttagcagcaagcgaaggattgttccatagcacagaaccaaattctggtggagaagactaatggaacgaatgagaagggatctgaagaatatggatggatcaatagctatgcagaactactgagggtattccacttatatatactaaaacttatatatttagtgcatactgtctagcagcatcaatattatttttctaattactctaattcattgtatagggtgatggcatggagcagaacatatttgatactacctggaattttgggttcaatgcaaattttgatgggagatagctagatgcctgggtatcaaattgagaataacaaatcaagccattgaacatttacttttgagaacatccattcattttttttcaatgccacagaaaatttatgctatgcattcttctgtcagtgtttagtactgaaactatttgcacacatgcaagtacctttgtacatgtttctatcagagcattgtgtttaatcttcctgaaaccttttcttcagagcactattttatagagggtgtaaatgaacgatgcaacttttttagtgttacacaacttttttagtgttacactttggaataagtgtagacttcatagtgaggcgatgctctgcttatgatattgtctacacagtgaggcgatgctctgcttatgatatttgtagaatatgtgaaatgggaggcatatcgttagatgaacagcacatcatatatgtataaacagagtctgaagctttcatggccttagccatgtaactgtcaagtaagtggtgggcagattgagcagaatcagagccatccaatgtaatctgatggcttcatttgatcgctacagcacctatgcagtattaactgtccagtagacgatccgtttccgggtggttaggcactaataaaaaatatttactgtagcaccacataattacaaaattcgtcagtaaaccacgagacgaatttattaagcctaattaatccgtcattagaaaatgtttgctgtaacaccacgaatcggaggcgatcgacctcgctgcgtggcagcagcgagcgacaggtgatttttactgcgggcacgtagtacgccggcggggatgcatgcacacctgaattcagtggccagcgttatggagaggtaccaatgcaaggacagtaatggcggccatattcggcgcctgtgagcatgtttaggaaagtttctgtcagctacaattttttctataatcaaaagctttcttaaatagtttagcatttttatctaaattctaggaatttgcagttactgaatttaaaaaataaactagaagctgagaaatcagcttatttagattctcagaaactggccactaataaactaattctcagaatcgagaatggtgctacagtgtgtcaagtcagtggcggatccagaaaagtttcagagtctagacaaatcttatgacattaagggtgtgtttagttctttgggtgtaaaatttttgacgtatacggacacatatttgaagtattaaacatagactaataagggcatatataaagatagagacaggtatgagctctacgctatctagagactaacatcctacaacagttggggacaatatggtctctatcattaatgtatcaaaatatttttatcaaactcttctttcctttttttcaccaccatgcaacaaaatttactctaataaatactaagagtcgactctgaaccgttgtcatgcataacaaccatatttctctttcctcctttctctttcttccatgtcatcaaatttacttgcatggtaataaaaaaaagatcattgtacatgccctaacaaaacaattgtacatgccctaacaaaacaatttacagattatgcctgtaaattacgatacgtatttattaagtctaattaattcgtcattagcaaatatttactgtagcatcacattgtcaaatcatggcgtaattaggctcaaaagattcgtctcgcaatttctatgtaaactgtacaattgattttttttcatccacatttaatgctccatgcatgtatccaaactttgatgtgacgttttttgccaaatttttttggaatctaaacaaggcctaagtgtttgcctaagtgtttgttacaaaaattttgtttccgtttataggaaaacattcaaattctattgcgcgatccgccctggtcgagcgtggctggcaaagtatagaatgatggggagagcattttgcttcagattgtatgtctgtgtagggaaattatttgtggcagtcagctatcaaattggttctcgcttataagtcgtcgggaaaaaaaaaattcgcgccaaacacccattcataaataggccaattttcctaagtagattataagttttttgaattggttggtgcgtgcaccttatttaaaaatcattgtgcggctcaattatccccacgatcttagggcaacaaatggcatcgttgcataaaaattgtaagggcaaggatattattccactcctttttaccagaaaagatattacccatttaaaacatcctcaatatctaggttcatcccttccaagcacaataaaacatctctaatactaagggtgtgctcttttcagcttataaattagattctactattttccgttagcacgcttttcaaactgctaaacggtaatttcgtgcgaaaactttctataaaaaagttgttaaaaaaatccaacaaatttattcataaaaaatatatattaatacttaattaatcatatgctaatcgtatttctcgttttacgtgcggctaaactgtccaccgccactgctgaaacgatcgcaccctaagactcgggtcctatgtaaatgtcaggttggatcctatttataatttggcacattttttaaataaaaaattgggtgttaattgtgtccatttacaaattacaacatgggagtattttgtgtcggtgtaggcaggcaggtgcatgatgcctggatgatcataaaacaacattggattctctggctaacaacatcacctaattagtagtactagtatttgcgatgacgaaaacaagcactacctgaaaatgacttatctctacaatatgcaccatcaatccatccatcatcaccaccaatttaccaatgtcaatggttggctttttcatctttcttttccatcatgctgatgttttccatgtgacatttgtgtaagagaggatatattaattaggggtagtagatgctcatcagtggacagatggaggagttcatcacacttcatgccgggggggggggtaaaaaaagaaaagaaaagcaaagtgagaaggtgaagcaagggacaaaagaaaacagacaatgatcagttgcactgcagtggtagtgcacttggcttgcagtttcaattctctagctgttcattagttggttgcctccagcctggacctgacttgtgatcctgtctttgtataaagtggatcaactttggcatataactggtcatatactactttacactaaactaggcttctcatttttgttgcttcaagccttctactatagtatgagctagcatcatctattcagctcttcatcagtagagctgattgtgtagtggcctagtagtaagtagtaggtaagttattataggcacatcctgtttagattgcaaggaacctaactaccaacccaacaaaatgattttgacttaatcaatacttaaaaggaaaactagttcagaattagaactgacctcaaattctgaatgtaccttttgtttcaaatgatttggaagcaggcgggaaaccaatgggcagatgttgtaggagaactttgaagcctcctgtcacaagtctcttgtgtggagcattgatttctgaccaaaaacttgatacaagtgaaatgaattcagagagtatgacatggattgttctcaatcaggggccgggagaagaattcagtgcatgaggacaaggttgaattgatgatggagaaggcatccaaagataggaattgtagcctcacagtttcagcaccatcaatcaccagtttcatcacatttcaatttggtgtttgcccccagttttgaattcgacagaaatgccagccagctgcattcagtttgtgctcttcagtcttcacatgatcggcatgtttggtttgaactttgggcatttcaagaataggagatccaatgtagaacttcatatctgatagaacaaaatggttctgctccaggttcaatccaattcagactcagatcatatactaatttgagatcatgaacacatcacataggaatgaaagaataatcaataattgaacaaaaattccaggtctttcctaccaaagaattgtacaccgccaatcgagcgaattgggaaccccaagaatcaccacccaaaagaatcaaaatcccccccaaataaccaatctgaattccgccgaaaagaacaagatcatcttttctctctatccattctccccccatcctcgcgcggcaatcgccgcggcctcccttcaccgccctgtacagccgatggcgaggggtggcttagctcacggcggcaacagcagcagcaatgcaatgcaatgccatggaggatcaccattgcaattgccatgaacccgcgcaaccaacaaaagaattattgtgtcccagtatggcactacagctagagatcctcaatttctaccaagagaacaccaatgcgggccacgtcgtcgacgtcgacgacaacgccggcccggacgccggcgaggaggcggcggcgccgtcgtccccggcaacgtagaggtcgtaggacttccaggtgtggtcgagcgggcacgggttgccggcgtcgaggcggtcccatggcttccccttgcctgaccagtgcatgaggctgaccggcccgtcgtggagcgggcggcagctgccgcgcacgttgtcgccgccgaggccgtgctggttccagcggtggtcgacggcctcgacctcgccggcgaagacgaggaggaagggcggcagcgagcccagctcgtagatgcgcttctccttctggatctccatccaccgctcgatgcggtggcggtagttgccggcgcgccagcggcggaggtcgatgaccatgacgccggtgttgaagtagcagggcgggcggcggcggccggcgaagacgcggcggccgaggcctgggtcggaccagaacgccggggtgaagtagcgggagaagttggcgtggcagtactcgggcgccgcgacgacggcggcggcggggaggcgcgtctcccagaggcgccgcacgtcgtcgacggcgagcacgtcggagtcgaggtagatcgcgcggggcacgcagcgcgggagcaggtcggcgaggtggttccgcgcgtagttgagcggcgactccagcgcggcgcgcacggacgccgagatgagccccgccacggcctccgccctgaacgcgtagatctcgaaccgcagcgacgggaacgacgccgccacggcgcgccgcaggtcaccaccacccccaacctcctcctcctccgccaagaagtggaagaagagcgactccgggcaggaggcgtgcttgagcagcgagtacaccgccgccatggacccgcgcaggtagtgcgcgtccagcgtcatcgagatgtgcaccagcccagcgtcacacacccccgccgccgccgtcgccgccgcgggacacccttccccgttcctgtactccggcgcctcagcgaacctcggcagcgccgccgcctgagcgcagacggccagcagcagcgccaccgcagccgccgccgccgcggcccgcgccggcatcgcggtttcttggattcttgcagcctcctcctcctcgtcccgtggtggtggtggtggtgggagcagcagcagcagcagcagtaatggtgggcagcgagtggtcggtgaggcgtcgtatgtatttctctttgtgtctgcgcgtcgcgtggatggatggatggatgacagctgagctcggtgcgcgtttctccgagggggagacgaacggtgtggtgttagcaattcggacgaggggttttaatcccttgcgtgattgggatacgcgttaattagccgctctgtccctctatctcatctcattttaaggttagcggtagatttatatgtctagtgtttaatcgtttggcttatttaaacttttatgataatatttttattactacttcttccgtttttatgatataagagattttaggtgaatatgacacatacaaatatagagtatatctaggttcgtagtattataatgtatcacatccatctaaaatctcttatattatggaataaagcgagtagataataaaatataaataatactttatgtatgacttattatatatatatatatatatatttggactattaacgtgctggttcagccatgtgttgtgctccagttgtgtgcatctttcttctttctttttttgggatttccaaggcttgattgtcttgatagctgttgcgcatttgcatgttctaaagaatatttgtgccgttgtaatttgggttgtatttattctagccgacacatgtagatggtgggtgaatttctagagcggaccatgggtgactcgagtatcataatattatatatctgagctgtggtttgattcgtgttatacattaaaaatattcgtctgactatcatatgtatgcttatgtcatttttactattttgattcacatctcttggctatggtgacatctttcaagactatcttagtttgtcttttcgtagcaactttttttttgtcgtaacgtagggttaacaacgaatatatctggtcaagacttttggttgaccgctaaagatatttcagcgagtcttccgaatataatctcgtcgcttagatttagggggtgtttggtaattaggtactaaatttagtagctctcacaaagggacttatatttttataagagggactaaaggttatcttgcacgatgaaaaattctagcggcttttctatggtggctatgcctagatatacttggtaggtatagcattttacctttagtcccttaccttttctatgagtactctcttcgtcccaaaatataagtatttttagtataatgacaagtcaaacatttttaactttgactattaatagcaaaaaaaataaaaaatatcactcatgtaaaattaatgttactagatttatcattaaacaaactatcacaatatataattctctttatttaaaacatcttgcttttatttcatagatattgttggtcaaagtagtatatcagagaccgtgtcagattctaaaagtacttatattttatattttgagacggatggattaggagtactagggtatcaagctgaatgcatgaatcacttcaataataataataataaacgctgcaataaaacaatgttttgtcattggccagagagcttgggctgcagttggcctctactctaccttggggatcttttactaagaacacttgtcctccacggtcattagcaaaacatcaactgtttctaaacaaagttaacatatcattcagcaatacaagtatctagtgtatgtatctatgtacctctactacattagaatggtcctaatctagcgacttcaacgcccgtgtgatttggcgcagagtggcaaccgaccacccaattacccctaaggcactaatcatgctgaacagttgaatggttagtataaatccattaggacgaagaaaggactttcatgtgtattaaactaattataacattcaagaaagtgattcactggggttgatcggcttccatttacaacgttgtttcgcagcttcgagccagtttgattagtttgatagatgcaagaggtagtatatatgtagtagctggctgtgtggttgggctgtaaactgcagttagacaaaccaattgtcttcaaaatataaggagaaaagcccacgcaccccgcaaaattctacatatatataaaagggagatctagagtcatgaactctaaaatttaccatctgatctgatctcttgaatttataaaagtaccgttgtataaccctttatttcgtctaatttatatgtataagtacgaaattaaatgtgtagtttaaaatttcaggatattgtgagataggctttcaagtacttcctctatttttacataggagtatatctgtaggtacacccatttgtttttataaggccctatttagttcacacgtaaaaactttttacactgtcacatcgaatgtttggatacatatatggagtattaaatatagacaaaaaaaaaattatacagattgcgtgtaaattacgagacgattcttttaagcctaattgctcaatgatttgataatgtggtgctacaataaacatttgctaatgacgaataaattcgtctcgcagtttacagacataatttataatttattttgttattaatctgcatttaatactttaaatatatgtccgtatatccaatatgacgtaagatttttcacgccttgatctaaacccagcctaaactgcccgcacgaaaaccggatatgggaagttgggaactaaactccccgcacagaaaacggagcggtccattagcacgtgattaattaagtatttgctaattttttttttcaaaaatggatcaatatgatttttttaaccaactttcgtatagaaacttttttaaaaaaacgtactgtttaatagtttaaaaagcgtgcgcgcggaaaacggggaaagggttgggaacgtgagattgcaaacacagcctaagtacaggcgtgtgaacgccagccaatcacaagacagggagccggtaggtgtaactttttcaggagtcacagcgacgacagcgagagcaagtctgaaaatgacagtggttgtcactcgtcagccggaaaattactgcggatccggggatctaaacccacggctcgccggaatccgatggtgttggtatagccccactccctccctacaactgttccacgtgggccaccggcagctcacgctggccggggcccacctgtcagcggctgatcttcggctgccgagccgtggaccacgactagccagaggggcttggtccttgggatgctaggcgtgcgtgagagtaggtacaatagcagactgtattaatacggctataacagaagaaaagaggagagagagaagaaagcgggctacagatttgtagccggctgcaatatggaatcaagatgttatgtgtgtaagaggtgggactg

SEQ ID NO: 80602 - DNA, 3723 bp, Oryza sativa
tccactactagctcgccatgcatgcagctcatctgtctcggcctagaaaccgggccggggcgcgcgccggtgaacctactacttgctggctgccgcagcgcccccgcccgcgcgcgcgcatatgcgtccgttcgcgtggcaccaaagcgcattgattccatcccttgtctcgcacaggccggagggggggccatccgcgccatgcgatgcatgcatgggcgcgcgcgtctgcctccccgcccgcccgctgcgacgtccctccaaaaaaaacggccggccgggcggcacggtgcgcaactgcacatgcccacgctgcatgcgcctgcgccgagagcgcgcagcccggccggcggcgcgtgtcagcgagggagggaggggtgatggtgggtgagcccggcctgcctgcctgcctgcatgcctcgcgcgcgcaagcgcaaaccgcacacacggcaggcaggcaacagagcgccttgttgttggccgccgggaacgagaagcccgtgaacgaccgagcgaggccgcgccctcctgcgcgcgcacagtgacgcccgccgtgccggccgggaggatctgtcgttgcgctgcccgcgcgccggcccgcgcgtttcggacgcttgtgcttgtccacacgttcgtcgctcacgaaaaacgtaccgatgcctagtccaagggctgatgttacttactactactactactacaactgatctcgaagtagccggttctggatacatgtagccgtggaccgtttgcaacgtcagatcgagtgcgtacagcgtagcgcgctatatacagtgtgtacagagtaaccgtgtatcgatccaaggacatgggtagcaggaggagcaatacagagaactgactgtaagatagagtttctttctcttcgcttctatacgcagtacaagtattagagcaagtttaatagtacatccaactacaagctccaatttatttatagctaatttaatagtcgatttgtacaatagttgcttactatactattaatacctggtcccacatgttatatacacatcacgtcttgtaatccgtgctgtagctggctacagatttgtagcccgctgatcttctctcctattttatcactttaaaatatgtttatagctggcttatagcctatacctgctcttatactgtactactattgtgttctaagattggaccatgtggtccaatttgtcaggggaatccatgtgacgagcaacgatctcgaaaaccgcgtcacagagcagtgatgggtacaaatctcgggcagcatagacacgaacaaacttgcgagtgtaggtgtgccatgcactcatgcaggcagccgtaaactttttgggacaggtcagtctcaccaaactttctacgagtactttgccagtttgcctggttgaaacgtcgggattttgtcaatttaaatgcatcgattcgtgtgaaatttaggggttgtttgttccctcccaaacattgccaaaccttcttgccaaacctagccaaatatatggcttataaattgatggacacaccttagacatggtttgactagaaaatggttgtatgacacgtgggcctttaaattagaaaactgtggcatgccacaagtttggaagtgaaacaaacatatgtcttaaaaagtgtggcaaagtttgttaaagtgagggagtgaaccaaactccctccgtctcacttacgagcaactatgagtttccgtggctaattttaatcgtttgttttattttaaaaattataattagtattttttattgttatgacatgatagaacatgaatattactttatatttgacttatgtttttaaattttttaaaaaactttttaaataagacggacgatcaaagttgagcacggaaaattatggctgcacttaaaataggatgaagggagtacaactatgtgtttaatatagtactactagtattccctctatcccataaaaattaatctagtactccctctatactcgtaaaggaagtcgtttaggataatgtttaagtcaaatcttatgaatataaattatgaatatctcttaagttgttgagtttaaaaatgtaaaaattatatgaatagatttgtcttgaaaaatactttcataaaagtatacatataccaattttcaataaataattttatagaaacaagaagtcaaaattgtgttttggagaccgtgccgctgtccaaaacgacctcctttacgagtacggagggagtactggatgtgacacattaatttggacatacctctatttagatccgttgtactagaatatgtcacacccaattctaagttcgttttttatgagacgaagggagtacttagagtgggtttagaattgtttttttcttatttttgtaagaaatgtactcgtaattgtgatgttagttttctaaaaaaactaatgggacctggttttcatatgatcctggtaaaactttataaaaagaactgctcatctcgtttggagtacaaaatcctaaaaatgcaagaaaataaaagcacaagattggaatgtcacggcatttcaaatcccatggaaaaaaatttgtaagaattattcaaagcatgtattccgatggctcatagaaaaaagagtaaattacacgcgaagatgtcatattatcatctagactcgtaaacttgaaaaattgcacattgagatccactatcttgttttaatgatccataagtggtccaaagtgtgtttgactatagccgaacgcctatgtggcgctccacatcttaacgtggtggtaattttgtaattaccccctattgctacaatagtcatcgaaatcccccaaaatattctaaatccctttgcattcccccccccccgccgcgtgcttccatgggagaggcctaagtatcacgaggatgatgtcggcagtcatcggcggtacgagatgattgaggtgttaatttgggttgtgcgacaaacgatgctcgataggcgacggacaacgcaccttcctcgtcgacacgacggttgcgatggacctcaactttaagggagaagattaatcggtgtccctaccgtcgttacctcatcgtttcctgccgcctccgaacagcatcctcatcattgcaaccctagtcgtcaggggaatgcaaagagacgaagggattcggggggatttcgatgactacattagcagtagggggtaagtacaaaattatagcctcgtcagatgcggaggaggctggatgcaaaatgctgcctacgtggagcgccatgtaggcagccaactctggtcaaacgcgctatggaccggctatgatttattaaaacaagattatggatcttaatgtgtaatttttcaagtttatagatctaagtgatatctttgtttaagtttaagaaccggtcatgtattttactctagaaaaaatatagaaattttgtgatataggttagttaccccatctgtctctaaaatacttagttcctagaatccaaatgcacattttgtaacgagagtaaattactctaatgcctctaattaatagaaaattagtttggtgagttggtagataacggggtattgaaggataaattttcttgattcgtgaaccaatattaagtaataaggtactacgtatgagttagatttattttgaacaaagtttaagctctataaatttattttttttagacgaaaggagtagattagagtgagggtaaagagagaaaaggatatt

SEQ ID NO: 80603 - DNA, 547 bp, Oryza sativa
attcctgcagcccccgggactaaagatcccagggatctttactcccggttgagaatatcaaccgggaataaagcgtacggaccagcccacgcacaagcgcatgcgtagcccctctctctctctatctcccatccttatctctttttcttctccttccttatctccatcctctccccttcctctctctcaccccctctcctcctcccctccccctcttcctcttgcagaggcagccgacggcggcgggatgggggacgggcgcgggctggcggcggccggccggcggtggcgggatggaggcggccgggcgcgggctggcggcggccaggcgcgggctggggctggcggcggccggccggcggtggcgggattgcggccgggcgcgggccagcgggatggaggacgggcggcggcggcccggcgtgggccggcgggatggaggccggtcgccggcggcctcgccctcccctcccccagatccggccggaggggaagcggcgagatgggtggctggccggcggcgggatgggaggccggcaggtgagtc

SEQ ID NO: 80604 - DNA, 13123 bp, Oryza sativa
atatatatatatataatactaagaagtgtcatatctgatattagattaggattttatatgatagaaggagacatatttagatttgtcatactagaatgtatcatatttgtactccctccgtcccataatataagggattttaagtttttgtttacactgtttgaccactcgtcttattcaaaaaagtttggaattattattttatttatttttgacttactttattatccaaagtactttaagcacaactttttattttttatatttacacaattttttttttaataagacgagtggtcaaacagtgaaagcaaaaacttaaaatctcttatattatgggacggagggagtaggttgtttttttatatggaatggaagaagtaatatggcaaattactgcagacactacacgtaccaaattaccaatcactccgcgtctccgccactccggagtcctggcttctgaacggcagagttggcaaaggcagaggatcactctcccctgcactgaactcaaatggagaaaacgtaaaagactggacaaatgtacgggatcccattgggtggattcgagtggttgttggattgatgtgcatcccaattgatagagatgaattcaacggagttaactcgaatcaatcagcgagtactcatatctactcctagtactgtttcgcagttactacagagttgagtggatgagcgcatccaggccagatcgagaggcgaagactgtgaacgatctactactgcccgcaacgccttcaatgcccctcaccaaccctaataacttcccggcgccgccccgccctatctactcacccgaccgtcctacgtttgcttccctgtctaccggccgtcgttaatcctctcctctccgatcgcttctcagtttgggattttctttttcccctttcgcttcacgtgaacggccggcacggcgtcgcgtgcgtacgcgatgccgcggcgagaaaaaaagcaacgcgcgcgggttgcatgtttgttacacgcgcgtggcgtgtgcatggtgatgttatgttacgcgggggtgagtagaagtgtgtgtaccttctcggagatggcgtcctggacgacgaggatgtcgctggtgatggcgttgatgacctcgccggtggaggcctcggtgtcgaagacggcaatgtcctggtccagcatcgaccggaggtacgcctggcgcatcttcgccgcctgccgctcccccgtgtgcatccagcacgccacctctgcacgcacacgagagccaccaatcaaccaaccaccgcgcgcattgcatcgctcgcgtctcgaaatctacgcatgcatcagggctcaccggtccacgacgagaagagtatgacgatgccgaggtacacgaagtccagcgagtactgcatgcacggggagacaaggtgagcaagcaaacagagtgtgacatgcacggtgcagtgcatgctcaatgggtggatcgggatgtgttactagctagtgtaccttggcgacgcggccggagacggtggtggggaagaggtaggcgaggccgatgatgttgatgagcttgccgaagaagatgaagaagacggggacggaggcgccgtgcgcgcacgcgcccagcgaccccaccgccatcagcacgtagtcccaccggtcggcgaacgagaacagcttcaggaacggcaccttctccaccttcgccgccgcctccttctctccctgctccgccttcttctcgccgccgccgctctgccgatgctcctgcacgccatgcaccggcgagctcatcttctccgactcgctaccaacaagatcgcgtgtgcgggtgagccaagacgctgtgtggcgcctgcgtggggggaggtggtggccggccgcgcgcgagctgaggctttaaagactaggagtacacagtggtacagctcctccagttcacttcactcgctgtcgtcgctggaatggtggcggccgtaatttagcccgcgttttagccgtggcagcagcgagcaaccggccgcgtcgcgtggtggtagtggtagagaaagcaaactgagactcatcgacgggtggggttggttggagtagatggttaatgtggtgcgcgaggtttgactcgccttgtgctggctactggctagctcaggccctcgcagtaatgggtgctgagcaagttagtgctgcagtaaagagcgtttgtccaaatgctgttgttggatttgactcgaaaaatcaatgctttggcaaatccccaaaaattaactgccgtgagtttacctgtgggatcctagtactgaatgaatggctgaacagttaatattagcggaattgttaaatcacattcgacattgattcttaggagttcatttttttttcagattactgatcttagtatttgctttacaattcgtgccctatgatcccgacaaacgacattagagttacgatctagggtgcggggaggagattactatgcttacagatctggccaggagatacgatggcttgacagtggatggtggagatggacaaaagacgaggcactagagccacagggaagaaggagggcggtgggctagcgttgacggtaaagggcaagtgagcttgtggttaattacgggtacgaacaactgcatatggctgggcggtgtgtggcacggggtggcgcccgacaggggcggtgtaggcggcgctcctttggtgaataaggacggccggatgcaggcggcgagaggtgacatcggcgctagcaacacgtgaggagaggggagtgactggcgccggcaacatgagaggagaggagaggtgacgccggcgctagcagaaaggggaagtgcggcagcggcggcggccctagcagcggcgcactcggaagtgcggatacaacagaaaggggatcgagagcagcagagagagatgcggtgtggatgcggtgaggagtttagggttttctctcctcagccgccggaggagttgggcttgggccttggctgttgtctgttgggctgggtctttactctagtctctaggagtcctagctcgttaaggctcgcaagcagctcgcgagctagctagctcgttatctctaacgagcttaaaagtcagctcggcctgttacgaaatttaaatgagccgagtcgagcgagctaacgagccatgagttttatgtccacctctaattgttagtacctctttgatttggtcaagagtagcggtgtagtcgagagcaaaattggcttgacacacaaatctgcggctatgcagttgttcgtacccatataccgtactgttataggtcacttctattgaaaaaaaacaaattgttagagtcagagatcacggccctttattccccactttcaacatgtctctccaacgcaacacaccaaagctcgtgtatgattttaccctgtagtaagatgaccaaaaggaatgaagaggtatctaggcgagatataatgatacatgtcaacggtttaggtcacgactatagtatttgcatggtatggggatcgtcggtaccagggaatatgcgagattaaggtaaaagagacaaagacaaggattttatacaggttcgagccccttatcggacatgtaatagccctactcctgttggccgaattcggtgttgctcctgttggacaagtacaatatttgggataacttatctagctgtcgtcgacttggtggcatagataaccaacacgtagtcaacgacatggtagtctttctcctcgagtacgaactcatcgagatcagaaatggcgctaaatccctcttgtcggcctccgcatgcaccatacagggtctgtctacttgtctaggcttatccctgatgttaatgtctagcggcgtgtgttggcttgtgtattgtgtgtcaatctgttgttgtgtcttgttggtctctccccctcctcctagggggtcttgtatttataccaatagatatcctcttgttcaattaaaactagagagaccaatatggatacaattcgagtagtacttgtcgtttccatatagaactctacttatcattccttatccggaactctttctatatacgagatatgattccgtataagacttaatatatggttgggcctgtcgtgcttagtcatctactattaggtatatggtatctataaccatgataatactacttggttaatccagggtgggatcagtttttgcatcacaaagccataaataatctaacatcagtacgtgggacattcttgcaaactgaaatggctggttgcagagttgcagttcgcaaacttcaaccttatcaggcgggctaaaactaaactgaatacgtacttaccctactcaacagtctatcgtatacacacatgtgaaatgcctcacatgccatggtctgtctacaagcagaagcagggcaacgccaaggaggcttttattttcacttgatctgacaccggagcagattcgtcttgtacttaatgatatgtaccgatgcgaggccttaaatggccacaagggaaaaagggggtgatttaaatgtggaaggaaaatgcagttgaggacgggatagatgggaggaggatcatggcctgatgcgatcagataattgccgaggtggacacttgtgccgcgcgcagcaaaagaatgccaagatgctgggacttttgctgagagcagcaagaataccaacatgctgatgactgatgagaaattgagaatgctttggttgctttgcttttcccatcgctgtggcgacggacacgcaattgatggtgaattgacgacaataatgtgtcgtttttgcccttgatttttttttgtcttccgttttttattttgtttagttcacatcaaaattaaaagtttgattaaaattgaaatgatacgacgtaaaaattaaaagtttgtacgtgatatgatagaaaagttggaagtttaaagataaacacggtgatgcgcgtagtgtgccaattcaggatgcgcaactaccgttgggattggtggttgcagaaaggcatactagtacttgcttctcaccgaagtacactgcccgtctgcattgcaagtttgcaacttcgcaagacaggcacagcgccggaaactgtaggcatattaagagaaaagaatatgtgtacggccatgtttccacgtcaaaataaataagaatacagcttgatgctcgtcaactttaagtatatagctgagtaaatgtgcatcagccaattgcatcctgcagaccagatacagattcttctgctgaagagaggaaaggccagggaaggaagagaacgagaaggtgatgattcttttttaatagaacgatggatttctgtgccaaaagcatactggaagttggaagcagcatttgctactaaggcccaggatcagtatgaagcccagcccatgtaatgacatggcagccagtaaaaggccggctcctcggtgttttgtttaggaataagtccatttaacctccctcatcttgtgcttgtctgaataacatcctccaaccggaaaaccggatatattacctcccccaagtgttaaaaccagtacaaaacaactccctcggtggtttttgacggtggttttgctgacgtggcagcctagtcatcgaaaaaaaattaaaatattacgtgagggcccacatgtaagtgtcatttctattcttcctcctccactctcctctctcctctcccttctctctccctggacagggcacggccaggggaggtgccgaagcgcgcgagagggatggggaccgccggaggatgcgggcgcgtgccgcgaggaaggggctcgccggccgcggcgcccgcggggagggttcgcttgccacggcaagcgcggggggcacggttcgccgggatgggtcgtcgaatcgccgccactgccgtcgccgccgacgagttggctcctctcgtcgccgttggtccaaagggaggagacggagacctcgctccccttgtcgaaatcggcggagctcaacctgggcattgctattgctgcctttggctccacctcccggatcggcaagacaacacagcggctgcgcaaatccggcagctcagcggcggtctccgccgcgggaggccgtggtagtggccagcggggtgacgagaggatctagtaggcaccggtgtctcgacatcggtggctgcaacgggagtcgtggtgggagacggcgaggcggtgatagtggccatcgtcgggcggcggcgcccgggtgtaggatcaaggaggccgactagagggggggtgaataggcggttttaaaacttagtggcacttaaacaaaactaacctaagttgctaggcaaggtaaggtgcaaggttaactaagcaactaagttaagttttgcaaacctaggtgatatgggctcaaatatgtctctatgaatgtaaatagaacaaatataaatacaacaaataaatgagacaagagacaaggaatttttcaccgaggttcgaaaacttgccggtttcctaatccccgttgaggcgagcccaactccaccgctcaaccacgaagccaccgcacgcccccttcgtcaaggggtgggcaaggcgggagctggtgtcacgcccagaaatttaacccaaatttccagactattttgcgtattaaatccctgtccaggaccagccagggtacacaaaacgacaagtaatatacagttccaaacgtaaataaagcgtaaagtacttacggaagaggcacttagtcctcacaccgaaacagaacgacagcagaggaaaaaggtgatcctagcggggcttcagctccactccacaggcaaaactcaactggggtctgagccttggtcctctaactccatcttcagctcagaagcactacacttctgaaaagggggaataatagcaagactgagtacaaccaccgtactcagcaagccacaccaacgatgcagatgtgcaaggggatacaaggatggtttgtggctatttgcataaaggcggttgtaaaatattttattgagcaaaacagtaaaactgttgagtaattaaagtaacattaaatctccactgatcaacgctacaccacgttgaacaggcccaaccaacccacctgaactacagtgtattgggtcgatttattaagatgggactaatcacggtgaatctggtcgaccgcccataaccgcgggcacggctattcgaatagctttactctgatcagaggtgtacaactgtacccacaagacacagccccacgacacgtttccgtgcgccgacatgccaccatgacataccggaaagaggtcgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttatggtaagtacgataagttcttccagggcatcccacgaaccggttcttaactgccatgggtgcgaccagcaaaaccatgcacccacagcccaccattcaatcgcattttagttggataattacgaccatgaagcatggccagatgtctcgagcacgcagctcaacaagatactagaatgtctaatactgcaattatcccatcgactgagctagtggtaattaagcatggctaagcatatagttctagctaggtcatcaaagtaacacaagctaggcgatttattacccatggttgacaaaggacatatatcaagtaaacatggcacaagcgagtagataggtaaaaccctgaccccatgtaattagcaaaacatgcatatttatttgcaaacagtaaaacatttgtaaattgggatcaacatgctcaaggggaatgtgtgacttgccttgcttcttcacttggattttctgaactcttttcctcgcgaccgcgatcttccgaaacgacggattctatacgctggcacgcaaaacgaggaaaaacctaataaaaacgaaggaaacagtacctaaaaaataaacaaacatgtagaactcaattttagatgaattttgcaatttgaatggcccaatttggagttcgaatgaattagatatgaattttagaagttttgagccactaaatgaatttctataattattaatgatttattgcgcaattattaaatattttcacaaatgaaaaggactgccgctgacgtcagcaagagagggggccggcgccgacaggcggggcccgtatgtcagcgagacgaggtggcggtccaccgtggaccgggaccacaaggacggtccaccgccggtccacgggttggacggcctagatcggccaaggccgatcggacggctggggacggccgggcggcgcgcagacggccagacaaccggcggcggcggcggcgcaacgcggcgctggcacgggaggtggccggcgaagaggaaaaggaggagggaggcggctcaccgagaggcgcggcgacggagggagcggccgcggaaggaggcggcggcgctccacggggtgaagacgacggcggcgattcggcggtctccaatgaaggtgaaggagcggccggggtatgggggaacgcggcgaacgcagtagaggcggtggtgtggcgcgaggtggcaaggaacagcggtaagaggcggccgaaggcggcaaacgcggcgacgtcctcggcttcgcggtggagatggtgttgctgcggtggaacgggaaaacgaagcagaggccggggtgctacgcgatgcggcgaagccgacggtggcggtggcgtggcttggtggtggctagggcggcggtggcgcgctgccggagtcggcaaagtggcggtggagctcgggttcacggtggaatcggtgcccgggtggtttattgcggaagcggagcggtggacgggatgcgacaaagcgcggcgaggccggcgatgcaagcggcgcggcacggggacggcggtagcggcggcagcggccggctggagtccgccggcgagcggcggcgcttgggctcacggggaggagggggttccgggcatgggggagcttgggagagaggggaaaacggaggaggggagcacgagggtgctttatatagggctcagggatggagatcgtggccgggagaggtgggatcggccggtgacgtggggaggtgaagtggagctcgtggggaggtcaaaccggcgccgtttcttgcggggtgagtgggggaaaaggtggaggacgtggacggggtcgtgtccacgtggttggatgcgagctcgggtgcgggagggcgccggattttgcggcgacgtgggcggcaatggcggttggggttggccggcgagaggtaggaggaggagctgacaggtgggaccgccagtcccacctgtcggccggatggagagagaggagggaaaccgggggacgtaaagtagactttcgcaaggcgcgggccggccgagagagagaggaggcgcgcggcctgcgggagaggaggggaaggcttgggtcaagcccaaaagggaaggatggagaattaaatttgttttctttttatttaattggttaaatgatctttgtgactttaaaattatttcttgagctccgaaaatttgcggaaaaatccggagagtattttagggcacaaagaatattacaaaatattctcggccaatgatttttaaaggaaattttaatttcctctataatttcacttgattaaattgatttaacttttaatataatttcttgaaatgcattattaattgatttttaatcccgaacgaaaatcggggcgttacagctagcccacggagaagactacccaagcctcgatcactcggggtagttcttccttcactccgaaggtggtgaactccaaaccactcacaaacggcgccgggcctcctccacaatctcctcggagaggtcaccgggcaacacctacacaagccgtctaggaggcggcaacctccaagatgaataagtctaggatgcttgccgaggatgatcaagtgccacactagctataacaatgaagcaatgcacttggattggcttaactcactctctaacactagataaactaagtgcacaagggtgtgagagctcttgcaagggttcaagataatgcaatggagtgccaaaaccttacccttgttgctggggagtgggtatatatacccccaaccaccaaaactagccgttggaaccgaaatccccaactttgtgctctgccggtcagaccgccgttgtgaggccggtcagaccggactactttgtaacggctagggcaatcattgagcccactcaacctggccggtctgaccgcagtgtagtggccggtcagaccatccacggctcggtctgaccggttgcggctctggcggctctgtatcgccaccaaaaaccagaccagtgcaacagaccagtggggccggtcagaccggctaacaggcccggtcagaccggcctaaggcccacggtcagaccgcaggtcacttttcagctcaaccgaccgttagtaaaacgacgatatctcttgactcgggtctcggaatttggcgttcttggactttatggaaagattattcaaagggctatccaacccatgaacaatccatccaagaaacacaacttttcttagggagaaagggctcacactccaaaggatactccacaggacataaccacatgaggctacccaaacctataggatttgcccacatctctctttgtttaggacttgagaaaactcaccacacttggctagacaagcccaccaaatacacctacatacatatgaactaatatggcacatgatcatccacaagctcgcttcatagacccctcttgatagtacggcgtctatctagcaaatccggtctacaccaaacaccaagaccgggaaaagactaagaaaacattcttagctacattatacctttgccttgcgccatccatcttggggtcaagtttgagtcgagatcaacacttgtgaccatttgattcaaccatgtttataccaaggtatttaccatcatttgtcaagactttcttctcatcacaagcttgatttcattcttgccaacatggcgatgtccttggcttggtgaccattaacccatggtgtcatccattagcctcatcatagtgggacctattccttttcacatctcaaaggagaacattagtctcaacaaatcggttgtcatccttcacttgatgaccaaccggttgcatatgaaagatatggatatgtttgttgagtattcattaacatcacaagtgtcatatactcgtatgcaagctcaagtgcaaagatccgatataaataataggtgaacaacatggatctaaaacatgcacaataaatgtataggatttgctccccctaagtatatgcatacaaagaaatataaaagagagacaagtgtatgcataagtaaagaagaaccaatggggtttatcctatacacatagagaaggcatatgtagtaatgatgaagataaacaaaaaaacacataccttcatgatctccatgttctcaatgtaaaggagactaaataagataagactcaagtaaacattagtctcactcttatataacaataacattgaaatcatatatatgaacctatcaaaaagtaggagataagaagtgatatatatcgctttatctccatgaatttcatccttgtcatgattaaggtccatcaccaaagaatgcatatctaccacatctcattatcgggaaataaccttgttgaaaacttatgtaaaagagaggttaatcccataaacatcggtttatcatctatcaccaaagtaacaattacacaaattgtttaatccaagatctttcaatattttctctcttttgtgatagataataatccgatataaacaatacaaagagatgagatgaaagataatttcaaatcaaggtagagatcttataatgaacaaaatatagaataagctccccctcaagatgtgtatacatatggatatgaaggaatgcatatgcacataatcaatcaagatcaatgaggaagctcacactatattttggatctacaagatagaccaagttagaatatgtgaagtttaatacatacctcctatcatttttactttcatatccaaataagactagtcaaagaaagactcataaaaatgttagtctcatataattagatttgttattaatcatcgaaaccaaattaaggcacttgaacttacaccgggcttgttgaggaaaggggaaggggcggcgtcaccacaggacccgcgtgcagccggccgacaatctcctccccacacgcgtcgtggccggctgacgagctcctccttccatgccagcaaggttgtcggcaacgtcgctaccgagcagcagcagccgtcacggctgtcctgccgttcccgccgagctcccgccgctcttccgagatcctgccaccccgccactctcgccgtcctgccgctcccgctgagctcccgctaccccgcctgtcccgccgctcccgccgagctcccgccgccccgccgctcccgctgttctatcgctctcgtcgagctcccgccgctctgtgatcccgccgatgttcctacgcgttgccccgccatcctgctgccgccgagctctctccatctcgctcgccgccgagttcatttatttttattgttttactcactgacatgtgggtcctatttaggtttgttttattttagtgccacgtaagcgccacgtcgatgccacatgggaagtcaaccgccacgtaagtgccacgtaggacaaaaccgcctccgaaaccaccgagagaggtgatttgctctggtttttagagaagaaggaggcgttatacccggttttccggctgagggatgttattcacgcaagcgcaagagatgagagaggtaaaatggacttattccttttgtttatctgagatgaatttcagtgagtgagaaccataacgcacatgacaatcgtagaaacaactcaaatactcaatttgacaatttgttccactatggtgaaaaaaatcagcacggtgatttggtaattagagatcaaacagccggaa

SEQ ID NO: 80605 - DNA, 5581 bp, Oryza sativa
gtaacttgtaacttgtgtcctggctcctggtcccctggacggggggactacgggtgcgtctgcgagcgtggctgctgtcctgtgtggtgtggactgtagaggacgccacggcccacggccacacacgagacaagggaaacgcagggagattatgggcatgtttggtgaagctttgtagcggtagcttctcctaaaattttcagaagctaacttccaaacagtttatattttcatctatattctgaaaagttacagttatagaatccagaaaatgaattagaagccaaaagttgggtttgtcagcttttctaaattctcaactagcttcttacccgctgcttctcaaaattttacactcaaacaagacctatatactcccttcggccagaaaattaatttaacgtttaaaactttataatcactaatgctaaattaattaaaaaaggtatatgtatcactaaagcctctcatgtagtgtattcttctagcattaagttagattattgcaatcttgtttagcaacagtattagacttttgatgtttactatagctaactaaatgaaaccccgcgcgttacagcaggaattatgtataatagtattaaaaaaatataagacaacatataaataactttatatgttttatataattttcatctttaatcgatcatcaaaaagttgtaaacgattaagatgaattggtttataacaacttaagtcatatataggtttatcattcaaaagtaaactaagatgatgtgtctcaatgatagaaggaaaacaagggagataattaatatagattaatcatccaaagacaaatctaaggtagtatgactttataggggaagaaatgaatggagataatttgaaccatggatcaatcatccaagtgctaggaacaattgaggtgatgtgatttaatgagatataagagaaatattattaactacacttagcgtggatgagctttatagatatataggattactctttttatctaagttgtattagtttataatattactgaatgaaaaaatatggaacaatggtgaacggcgtagccatagacgacacaatgtttgcataactttaattaaaatggtttgtgatatataatacaatgtttatgtattatattcattctaaaaaggtataaatcaccacattaatctgattaaacaaagttatgcagcgttttgatttgtggttgtatttgtctagatagaatggtgcaaattgatagatataatttgtatataaaatataagtgtgagtatataggaacataaagcaagagttgtatattaaatccaattatacttttaaaatatagcttcatgtaaaattgtacgtgaaaacggtcgggaaccatttaactatttagtgtcaacaagcaatacgatgctaaaatatttcttttaagaaaaacatattttatattggctaagataaaaaacggtatcacttaattgtatggaaataacgttcaatcagtcgggaatttccaataacgttttcatccctgccactagttgatttatgttacctaaaattatttttcttttaatatattgacgtgcaatccttctgcgtgttcgcaaaaaactagttgatttatgtttggacataaagagaaataacattagagaaaatcttgagaagaaagacagatagaaatccaggtgtaggtaaatgtttcagatggtggttattgagggaatcaattaaacatgcaatgcaacaacaaattcaagtctgagtagaatatttaaaagtccttcataacatacaaccaaaatttcaagctctgtacatttttattgcacggttaaacagtatatatatgttacatttcccatggctatattacctaggctcaagggggatagttgggaggatcctcaagagcacagaaacacagcagcacagcatttgatcactatcgctgcaaaccagccaggccggcccggccttccaatgatcgaaacaggcaaaaaggacgggacagagatcgagagaagaaaaggggaaaaaaagatccagctacatccaaaatgacccatctgggcatctcaatcaagaggctgctatctcgatcaagaatccggcccagaacacctacactattagctagctagcattggaaaagtcccatggctgacccgatcgatcaaattaaccgtacgcgcgcggttaattgagagaacctggcggctgcgtgccggcgacgaagaagcggccggaggcggcgtcctggctggcgtagtacaccgtgctggggctcacgtggttgtgcgtcccctcgtacgtcgtcaccacgtagctcgggtcgtccttgtcccgctccaccctcttcttcacgttgcacccttccgtcgagcaccggtagtagttcctgcaacgcacaatcgatcgatcgctgttagttagcgatgtccattcattcattgccaggaaagagacttgcacttgcacatatagtatatgacgatggaattcgcgtgattaattgcatcatcggtgtatttgatgatcgaagtgatggcgacgacgacgacgacgggatgatttatgatgatgatatgatcatcttgaattttgtgaaggggatatgattttggtttagttggttagttagtaccttgggttggggctgttcttgacggacttcttgccgtacttgcgccacttgtagccgtcgtcaagaatctcgatctctgacttcgtccggaacgcgatccgctccgtccgcggcctctccacggccgccggcgccggcgccggcaccgcctccgccgcgctcctgaattttcccgatcaaatgcccccaattcagaccaaatgaacaggtgattgcacacttgagagtagtactctacttgacaagtgacacacgccactagccactcaccttgttgcgtttgcggcggcgccatccggcagcgcggcggtgggcgcgccattgaacacggcggccggaggcgcgtcgtcgaagaagaactcggagatgtcgaactgcgaccccgacgggtcgggaagcggcggcgtcgttgcggcggcgagggcggcggagaagctggacgcggagctggaggtcgagcttcccccgtgggagaagtacgatgacatcgagtaggcggcgtcgcccgccggcgccgagaggcccgagaccgggtggtggtagaccgctgcgtgcgcgccgactgccgccatggccgagtacgaggccggcgcgaaagctccgtatttataaggattggcgctaaatctgcatggatatgaggggatgatgtagtggtggcggggtggatttgtactggtagtagtaggcgatcgagagggatgagatcgatcgtgatcgatcgcacgcggggcgcgggggagctggttgtgttgtgtttgtgtctctctctccgggaggattttgccggcttcgcggtgagcttcgtgaggagggagaaggttcggagcgggtgcgggagttgccgcgcgcgcgccgccgctcgaacgcacgcacgcgcgcacggcgtgcccacttattttagcagcatggcggaaatgtctccgggggaaagacttcgacggggtgcggtcttcgcctcttcgccacgtagttgccgtgggggccttctcacacacccacggtccatccggttcaagccgctttctttgtttgggttccctgcgagttggttggtgtggctaaaccaagaaattttgggagggggtgaagctaggagataggatagtcaagaaccggttaagaaaattttttagatatagtttatttattttcattaaatatgcactcacttaatttaaactcagacgcttatatcagtttaaattcgatctaaaataaaacaaattaaatgagtggcatctctctttattttattttagctccgtctactttggactgagcagcgatagcgattttacccacggatactgtgttcgataggcacgggcatgtgttcgacatgtctgacatgatgctcccaaatcatatgtgctgattcataatctctgtttagttatctagccatgcatatattatcgatgtttttaaatacgcacccgacaccgacgtgggcgttgatttttgcctgctaatactatcgtgctccgattgtccaagaggtatcgggtcttggatcaggtgtgttcctgctttgcccgagtctaatcaaacctattgacaggaaagttagagatattgtagctaccacagttaaatctggtgtatttatcctttttcgcttcagccattattagtcatgtattttatgcctgtaagatcctttttatcccttagcaaaatttcacaccctatcacattaaatgtttaacacatgcatggagtattaaatatagacgaaaaaataactaattacatagattgcatgtaaattacgagacgaatcttttaaacctaattgcgctatgatttgacaatgtggtgctacagtaaacatttgctaatgatggattaattaggcttaataaattcatctcgcggtttacaggtggatcctgtaatttattttgttattagactatatttaatacttcaaatatgtattcgtatatccgatgtgacacgtcaaaactttacatctggatttaacacaacctaagttgtttatgaaagttcaccggtcggaacatggctcattgaataattagctcaaaactcatgaatttcgtcaaattccacataatctcacatatatatatatatatatatatatatatatatatatatataacttcgctagaatttcatctaaagaatttttctcatgagacactacccacttaggtagtgttcgtttctacttaagatggagatgaagttatggaaaaaaacaacaatgtcattagctcatagttaattacattttaattattactactatagataaactttaaaaatattttatataatacattaaagcagctattatatactcactccgtcgaaaaaaaacttaacctaagaggggaatctcgacaaaggaggttgtccaaattctttatccaggatggtcccatcctcttcaaggttaagtttattttagacggaggaagtagaaagttttagtgcaaatgcaccattcaacaatttaaaaaatatgataacgaaaatttcatgcctatgcggctatgcctaccaaaactgtttcatttgatactaacaatcactgtcaataatcaatatttacttctattcgcccatgttcggccagcaggcgggcacggccaggccacggtcacgctcttaccgccgatcgccatcacccccaccgccccacagtacaaaccatccaaccccagccgccatccgatggcgtcatcagcaatacgccgagacggaagttcaagttcaatcattcgagcttttcgttgggggctcggctggtacggtcccaaaaatgacggtattctccggaaaaacatataacaggttcgtagcactacaaacgtacactatcgagcactgtggtcactttattagtattttcgctttgctgtcgctttcgtactcccgaaaaatttagagcgggctgcagga

SEQ ID NO: 80606 - DNA, 1745 bp, Oryza sativa
gcgcgggagggaggggtgggagagcacggtggcgtaaagaaaggacgcgagcgccggctcggcgtcggcgtcgcggcgcgcctcggccttgatctgggaccagacccaggactcctcgtcctccgactccggcggcgcgaacgccgggaccacctccgcggggagcgacggcggcgactggggccggcggtggctcgcgccgccgccgtcgggctcgtgcgcgtgcggctggccggccggcatcgcggcgcggtgggatcgggtttggtgggcggcgacgcgagcggaggaggaggatttgcgggccactaccactagcatcggacgccgagaggccaaggcgtatataggcgacaagtggagcgattgcctacacaactcagccatacagacacagtgatacagattatatactgggtgtcgctaatgcgcgcgcgcgcgactagtccagcccttacgtactttgtataccagttttatacgtatacgtataaaatttatatttactactccctccgtaccctaatataatgggttttaacattttgcttgcactctatttgtgtaaatataaaaaacaaaaagttatgcttaaagtactttggataataaagtaagtcacaaataaaataaataataattccaaaatttcaaacagtgaaagaaaaatgtcaaaatcccttatatcaggggggcggagggagtagaaaaaaagacccgtgcgttgcaacgggtaaatgatattttaatcgtattattgttatactatttagttaggataaaattgattgtggaaatttgcttgaatattttttttagaaaattatgagctgcaattaggagtctgactttatctcaagttagcatgcgagttttttaaaagtttcttatacaactcattttgtatttaaaaaagcaaacgagcttaaaatccaactcaaatacggatttgtatttgcaaaagcgaacgaacttaaaaaccgactcaaacacggatgatgtaccaaaataccggcaaaaacatcttcaatttttataatagtagagataaatgtaagtgtatttttatgtatgtatcaaacagaattatatgtgtaaattttatatgtatacatatgtattttggatataaaaagtttgctcgcatatatacaaactttgtatatatatgtgtataaagtatgtatatatacatatacgtgtacatatatatatgtataaaaaattttggatagcacatgaaaaaatgcaaacaagccgagttcaatacaatatgaaactttctactttatagaaactttgtatagataaatttcgtaaacaagaaatcagctgtttcagattgggccacaatttttcttaaataagcccaaaaaaagaaggtaaaagaaaagaaaaaaatcaataaaaaaggaaaagaaacgagaaaacagtgaactagttgcgcgggtggagacgcgtgcgtctagtcactgctccctccgtcccaaaataagtgcagccatgagtttccgtgtccaactttaatcgttcgttttatataaaaaatttttgaaaaaactttaaaaaataaccacgagtaaagtactattcatgttttatcatatcataacaacaaaaatactaatcataaaaaaatttcaaataagacggacgattaaagttgggcgcggaaactcatggctgcacttattttaggacggagctacctaattagcattcgcgcagatttctacatagacctt

SEQ ID NO: 80607 - DNA, 8365 bp, Oryza sativa
cagtacaaagtaattttcaggtttaggtctcacaattacccaaccgaacttaggatgatcctggcaatcacaaggcataagggagttaatttcgtctctgtactctctgacgaacgcaacaaacctgctccagaatttggagttgaaattggctttcagtagagctcctccgatgtgtgcacacaagaagcagcctcttagcactgtcgcgatctccatcgccatggatgcaagctttggatgctgctctgggtctgtggctccaaatgcaagaaccttgaagaagtaccagtaggcttcgaatggcaggaaattcagcctcagagcttgtttggctcccaacctgatgatcttctctgatcggcttgtgatcatgattttgatctcatgtgtcatttgctttctgaaagaagagtggattttcttgagtgttctttcatcaacatctcctaagagctcaatgataagcagcaatcttccatccatggcatcgtttgattcatttcgatgcttggtttgacaaatttcactgaaagtttctgccttctcatatctcagatcatctccactgtaatacaagatgagagagaagtgttcacgcactctctgatcacggcagatatgttcaacgagagtgctcttcccgacgaattccgggccaacaaccggcaaaacctgaacaatttcttctgcaactgcaagaggctctctctgcagcaggaagctgatggcattttctctctccatttgacggttgaacatgcatccatccaggtacagatgcgtgctgtaaggctggcgatacacaggaggatagctcatcaagaacacgacgaattccttggtgtcaccgatgattctctcgaggctagtgacagtctgatgcagatcgttcgtgcttcttgtctgaatttgagtgttgctgctgctgtcagagaagcggatacgcttagcccggttgaatttggacagagcaaaacgtggtgttacctcgtcctcctcctcatctctgaatctgaaggcgtcaagaacgcagtggcctctgaacatctgctccctgagcagctcgagctgacggatcatcccatggttcgtgacatgccgctgctcagcttcctcgacgacggtgcggatccgcacaaggagatggtgcagcctctgaagattttcatcgaccgatggccgctgcttcgggtacctgtcgatcatgaaggttattgatctgctgacaaaatcgccaagaattgcagataagagctccatcaagaacccttctctgaagaaagtagtgagtgccatggatgcagagatgagagcagagaagtgcagttttgcaggtggtgttgtgttgtttgcttgcacaagagtagcaggactgaccaaacgccttatctaagggcagagtcaatgccgtgaggattgggtcacgaagtgcagatgattaggcgtacagaaactgtcaggtcagattcatcagaccaaatttactaacccttcctgttccataagaaatcacaggtcttttatctctgagatatcacatctttgacaaagattgtgatttgtgagttgaagtttggtacggtgataacaggggactaggttatttgcaccatgtagctactaataataaaaaaaacagaggtgttatgcattcttgcagaaaaaaatggcacaagtcgttgctggactcactagctgttgactgaataataaaaacagcggggttatgaattctacagaaaaaattggcacaagtcgttgctggactcagactgaaagcaacatttttgttttctggaacgaatagtaccaaacaatgcgagatttcatatcgatatagcaagaaaaaaaaagattataggcctgggactatgaaagcaacggaattagcacagcacagttccgttctgttcaatgcctgaacctttttgggaatacgcgagaagcacatcattgtattaagaaggaataaatgtatgtacaaaacggtccgaaaaattaaaaccgaaagggacaagatacaagagggggaagaagaaacaaaagcctaatctcccaaagaatttggcgacccatctccattcataggaactaccatgaccagtattgcggctctagccagtcgccaaagatccgcttcacccgtcatagccctagcaatctctgtccatggtctgctattctagttgaagacccgattgtttctttcctttcaaatcgtccacgctaccagtgctgtgatggtgttgaacccccggcgatgttccttggccatctttttgcgactgtgatacaaccaagaatgaaaagattgctcgttgagtggtaaacactcagaatgcccaatagctctaagagcaatccaccacagctggcgagactccgggcatgcgaccaagagatgatcaatcgtttcgtcgtattgatcacagagaagacagcgagccgggtgcgatataccacgactccgaagacggtacactgtccaacagcggttaagggcgaccaaccaaaggaagtaccaacaacaaggggtgccaccgtgccaaagacttccagattggcttgtgttggaggcgagttcttccaaagaagaggacacgatacgccgagcgggagaagtacagtcccgaggtctcccagcgccatgaaagcgtgtcgggttcccccaagagttgcatagatcgaaggaggtcccaaagcttgaagtactccaggatcgcttgcaccttcaacaccacacagatgtctcaaatccatctcatgtcgtgcaatgcctcagccactgtacgcctgttctagaagcgggcggggacagctgcgtagaaggccggcgccagcaattgaattaaagagccctgcagccaacatcccagaacaacaccgaaatcccgtctcccaccgagaataccatagacgagatgaggttgcctttcttctgtgaaagtggaatattaaacccctgccatggcttgtccagcgaggtccgttgctgccagagccatcgcgacctcaacgcaactcccaacctctcgagatcggggatacccaaaccaccatactctttgggtgagcaaactcaacgcaactcccaacctcttgagatcggggatacccaaaccaccctactctttgggtgagcaaactcgagcccatgcgacctgacagacgctgccagtgcctgaaactgacagggcaatgcaatgactgaacaaccagagcattcgctcaactaaggaaagcaagccattactaatctcgaacttacagaaatggacaagcataatacagccaacgtatgcttctaagatcttatagttcaaatagacatcagaatatggctcagatagagtacaaggaaaatgtaggttataactaaaaaagaggagcaaataaacacacatcaaacaccaactcgtctacaacatgctgtgattcgtgaagattgtaccacacatcgtgaaataaagttatggtagggtggaatctgggatttccatactaagatttcagaattgcttctagccttagcttttccacatagcatatcttgcactgttgtatctggaacatcatcttcaagagaaccttttgggtaaggttcatacatacaaaagtgtttgataggctgagctattcccttgatataggcaggatggttcattgtaacatcatctggatattcactgtacaaattgaggttatttgggatgtgctctctggtccatgcaagaactctgtaccaaaattgagcattgaaatttgttcttagtaagccggcaaaaacgtttccatgcatgaacgatccttccatctcctttgctatctccatggctatggatgctagcttcacatgctcttcggatctatacttccgaagatgcgtaccttgaagaaataccagaatgcttcacatgtcaatggtctcagtctaagaggtcgcgtggtcccgaaacttgtgatgttctcagatcgacttgtgattatgattttagtaccatgtggcatgcgcagttctgaagagtataatctccatttctcctcatcagcatacctggagagttcaatgacaagtagcaatcttttgtggaaagcattaccccgatgcttaacgataaaattctctctcagagtggttggtgtttcatccttcatggaatttccactgtaaaagagaatcagagagaagtgatttctgactctctcatcgatgcagacatgttcaacaagagtgctctttccgatatgtcttggaccgatgattgggaggacaccaagatttgaactaccgggtggttccatctgtagcaagaactcaatggcatgttcaagttccatatgtcgattgaacatacacttgtccaaaaacaaatgcgtgctgtaaggttggcgatacataggacggtactgcacaagaaattcaatgaactccttcatgtcagctatgaggatttctagcctatgaaccatcttctgcaaatcttctacctccccaccactgaataccgtttgttgaggtttactagttgggaaacgaagacgcttagcaggattgaatctggacaaagcaaatgaatggctcacctcgtcatctttggccttgtcttgaatagctcggtatctgaagttatcgagaatgtagcagcctttcaacatctcatctctaaggatcttgagctgctggagcatcccttggtttctgacgtgccgcccttcagcctcctcgacgatggtactgatcctcataagcagctgccgtagcctctgtaggttctcctcagcagttgcctgattgcagttgcagtacttcccaactaagaaggacatggacctctgataagatccccaatagctgcagaaatgaacatctccattaactgtgacctggaaatggacatcttgatctctcctagagtcccacacacactcactgaagtctgaagatgatactaatcgagtctgaaggttcttgggagctttgtcacttgttgcagagtaaagcttcagcgcaggatttggataataaactgtgttatctgcaagactgccacttcgttatatattattcttgtgacccagctccaacgattgcggcaattgttttgttggtggttgactggctgtgtgctattcaaagcttatctgtctcgaggaaacagaaaatatttgccactgtgctccagttcgcccaggtgtgcagacgtgtgtgttgcgcttgacttccaaagtttcaagctcgataatgcctcctagttgaacctgtcaccatctgcaaaaataagagctatacctgttgccttgccagtcgccggcacaccggtatccggaccccgagaagttgctcatcgctgcaggtaggctgatgcagtgaaacggaagctgggaaaatgggcatcctttcgtgatagcagcaaatcaagttgggccaatgcaaacctgccgtcgccgtcatcgatcagcagttgggagcaccggctgctgacgagacccaagcctggagcaatctgcacctgcatctcaaagtacttgtagcatgcctgaaaatatatgcagggaattcgcaatttgggttaataagatgaacaccagttcatcagcagagtgaatgcaaccagattctctacaggtgctgaaaagaaataaataaaaaaaaaaccctccgtcccaaaaaaagaccaatcctacctacgaacctggagacatgtgtatccaggtttgtagctaggaattcgttttttttttggggggggggagggggggggacggagtagtactgttgatttatgatttgaactgttgatccaacttcagagcaaaatactgtcaaacagtgtatgatggatgtgactcatctacttgccacaagtgaaacagcatataaacacctagaagttctagaacccattgagttctatggttgtttatagctagacaagtcatggcaatacagaagattcactccttccctgaaagcaacctaccacactaaaaccaactcaagactgtttcaccaaaagggcacaactacctaatatgagcacttcctcaccacacatctcaaaacagacagaataagatacaatgggcaaaccagcaaaacaagaccaaaggtcaaaggatagcactctcaagaaaaaatggtgcccaagactgagtaaaagaatcttagctttagcgaaatatttagaaaagaattaccaaataaacatcctttcctcagatcctttgtgaggaaaaagacatttcctttcctcacatcctttgtgctagtttccgtatcagttctttaattcagatcttcgtcgaaacagggcttaatgcttacaggatgtcttaaatattaagttgctagtatggcttaaatattaagttgctagtatgtttcccaaagagcaaattcacagtatccaaacatgtccgcgtacgatcttaaggatgtcttttactttctagtagaagattgtggtccacatttgatctccaaccccagtggtttcccaataatgcagtttagcacattcacaggccttaaggcacacgaaaaatccaagtggcataaaatacaactagctccagtaagcaatgcatctgtggctagtacaccaatgatttctgcaagtaattgtaattcagaatttggttaaatcaataagttatgaactttttacaatgcaaagcaccgtgttgtcctatgcgaactgcaatgtcacacatgctattttaagcaaagtacatgagtgttaactaactgtccctagtcataatcagtagacatgcttaagaactattcaccatgtgcaagtagcgaaagacaagatatgtaaaaaaaaaaaggatggtgcaaacataagtatatgcagacaagataaagtgcaaagttgagctcatcacttatggaaattttactgaattgagaataaataggtgatgaaactgagacaaggtttactatttacctgctgttttttaaggaaagttattcaatgctcttatttagttctgttaatcaaacatatgtacaattataagtatctgcccaagagattagaagttaggaaccgaagcatatgaaaaataacagatttaaaagcaacttctgcaagcacacaagtgattcatcacaagagtttcaaggctcgacagatcctcaacagtcttgaaaaactaatggaatgcaattatcacaaaagttgatgcaaatacgacataatcaataaggataaaaaggcttgacttcaataacgtaactgcttgtacagataggcaaatcaaggtgtacacagcgaaagcgaaacaccaccacatgacgagtttccacatatcaatggataagtaaacatatggaaagtaatgaaaatgatccgtcaccagattcaacctgctagaagaagaaccttttatgtgcaaaaatgctttcagaaattctcaggagacattcatcaaccccttcaaaagcttcgaacaaattcttgcaataagagctcttgtaaactgacatttcgtttaatttacctaatgtaaagaaaatgacactggggatggggggacaatgtgacacctaaactgaataacaactccacaagttcagaatatgcattgtgacatcagtcattgtggtaaaattaaatcacgcacacagatatagcacctggagttgcatcatataaaatagcagaaacatcatatggaatctttacacaataaaaagttaaaatcgcaatctaatgtgtccttgaagcttgactcatctggcaaatgataaaatcaaaagttatacaacttttatttgactcatcatttcatcaatcaccagttatcagtacatgagcatgggcattcgactgataaaacggctgatgatacaacactacagtacagattacccaaagcacgacaagtacatcagtttttggcatatcaacactacggattatacagagaggaagagaaatagacctcggcgcgtcgccctcaaatggtgtagtccgaccactgtcgaatgaaggatgtgtgatccatggattccccgggcatgtcctcatccttctcaacctcaccgttcttcctgccaatcaacctggctggattccccaccgccgtgttcctcgccggcacatctatcagcaccactgacccggcaccaatcttggccccggctccaatcttgacgttgccaagaatcgtcgccccggcgccaatcagaacaccatccccaatcttggggtgccggtcaccgacagccttgcctgtgccacccagtgtaacgtggtggaggatggagacgttgtcgccgacgacggcggtctcgccgatgacgacgccggtggcgtggtcgaggaggatgcccttgccgacgacggcc

SEQ ID NO: 80608 - DNA, 8477 bp, Oryza sativa
  unsure (1)..(8477): unsure at all n locations
catttaacttctgttgattatctttgcagcatacctttttcacttgaagacattgcgaagtcgatgccaaccattgaggagacgacagagaatgacctgctaccttttgtccgtgaaaaccaaagctttgcgtttatattgcacaggagagattgagtggttccctcttcacagatcattcaccggctatgtgaaaaaggagcgcctctgtgtagcgtggatattacacgttattcatgttgtagactagtaacccatttaggaatcaagagcaattgcagctgagggtttctaggcctctctggtttgaatggttggttaagcaaactgtacatgttttatctgcagtgtgtataacacacgttattcatgttgtagactagtgacccatttatgaattaagagcaattggacctgacgttttctagtcttctggtttgggcggttggtcaagcaatcatacttattttctcacgtcatctagccagctgtttctttcttctttctttgggtgggataaagcaacatatgatgcaaccgttctcgcatgaaaaagctcaattcaggaaaggtgatcacaattatgttaattttactggtcatctcagccacttagctttttccaagttcaattattgtacaagggatacttcttgccagggctgaaaactgaagctgacgggatagaatggaggtaggtagatatttatccctagatggaagatacatctagcatatacatgtacaatttcttgaagcccagcaaaaaaaacagtgggtcaagtcccgtgaggaagaccgactagttgtatgaaactctttgacacacatcatggtcagctactcaagatgaacccaggccctgttatgaaatgttcttgagtttctttcgcggtttcaagtcgacaacaatgacagtgatgttatcctcgctgcctttcttcagagcgagtctcatcagataatcggcagctgcttgggcagcagggtcggtggatccttcaccctcatcagacaatggtgatgcagcgccattgttcttgtgccacagaaggatctgtcggcgtgcgactttgcatgcctcttcatttgacacaacatcccacagcccatcgcttgctagaataagacagtcatcatccttcgcccgtggaacgaccataacttccggttttggaatgacaaatggtttcagatagcgatcacctgcaacatcaggaacacggataaaattagcacaaggggcactaaatttggacatgcaatccaatgcacagggaagtcagctgaactgtcattggttcaaccaaatttcaggtgaaatggagcaacaatgttgtccaagtgtataacacaatagagttagtttatttgaatggcgcaagagatgtgaacaggtccaactaagacccatttagtcatggtccaagctgcaagtgccacttgcatgaacatgacataaggtacctttgttgcttcgataaacgatggcttttctactttggcaggtaacttcttttcctaatcaaatctgcatactcaattctataacagagatatgtttaacctcatcgcaagttcatcaacaagattagtgccaaactggcaatatccagatagtcacatgattgcagaatcttcacatatgtatgtctcgcatagaaacaagattttagggcccaaactgctgttacttgtaggtaaatatattcctaatgaataatacaacaccatggaaatatctcacagcacgtaatatattcatcactaaaaataagatctagcgtaatagttctttgggcaatacggtaacaggacattttgcctagccaatctgaaataatccactattgatatacttttcttagtgccgaaaactacaagcaatggcaaaggacttggggacttgcactaacatagtgttaacatcatcatataatatatggcaacaattaattctacagcactatgatgcagaagatctcaaaacaaggtggcaataggccaaaatcaatgtaagatcatgtaattttttacatcatgtcgcatagtttcatgtgctttgttcttgccatggccacaatttccaggcccaaagcacagtccttactatggcagtgtcacacaactcatttacagggaaaagagacagacaagtgcttcagcctagatctagcacagggatcaatatgcataccgattgatcgggacatagcaagtataccggacacccggtaaccattccattggatgaccttgcctccctgggcttcaatccttgcccgctcatccttcctgtcaggctgaaaacaaaggcataatcggattcagattaattatccccaaaaatggaccatgacctttacaggcataacaaagcttccccagtttaccttgtgatcaattgacaaggctacgggctccttcccgcggcagagcacgatgcgcgaatctccacagttggcaaccaccacatgagatgagcagacaagcgcaacgaccgccgtcgagccgacgttctctgcggtcaccggttctgaccggacctcaccgccaccattgacaaccctggtcactctccctgaaacctcatcgtccactctctggaaacatttcgtgaacacatcatcccagtgctctttcatgtccacctcgcccatctcccccaaattcttgccaagtcgcttcagctcctcgctcaagacgacgtggatcctttcacggcagtagttcgccacctgcacagcaacacgagggccacggaatcggtcaaaatcgtgagcttaggctgcgccgtgggcgaccaatccggacgccgcggatggttctcaagcacacgcgtatacctcggcgccgccgtggccgtcgaacacgccgaagaggtgcgccggcaggcggagcgcgtcggcgtcgaggcccagcgcgtcgaggtcgcgccggctggcgagcagccgcaccggcacgtccgcgaaccgcggcacggcggcgctcgcgtcctccatctccgcgctgcggccgcgcgtcgacgcgcagccccacaccggcgcgcagtccatcaggtagacgctcctcttccccgcccccgccgccgccaccgcctccttcctctccccaagatccaccctctcgatcccgcccgcccattcccccgtgcaccccacccgcgccgccgtctcatcctccccacatatcgccgccgccgccgccgccgccgccatcaccaagatcacctctccctcctccccccacaaagaaaatcacccccaacaacaccagcaacttctcctcctcctcctcctcctcctcctcctccaacaacaacaacaaaactacttcccaagaagccaacgaagccgaccacctgacctcgcaagcacaaggtggggtgggtgaagagaaccaaagagaggagcagagaggaagaagaggaggtgtgtgcttgcccaaagacgcgcgcgtgtcgagggggaggggaaaggggaggaggaggaggagaggaaggagggagaaggcgaggggaggtggtgagacgggattggacgggtgggggtgagcgggacgcgccgtatcggacaggtctccccgtctgctgctgctgctgctggagggggtccgcgtggcgttaatattcatttgttgctccgcgaacgggggtgtttgctgctaccttcacgccacttcggtacacttgttgcgctcccactcggcgccacatttattttcgccatcccttgcgctgattttgtttcgagatttggagggagagaactttttttaagaaagaaataatgaacctattgaggattggagactggacctgaagttgaaactatacatctcttgccactgtactatagatacatatcttttctgtctctagagaggagttgaaaggataaaataatcaataatacttgttttactaggtgagttgttactccatgattaattgagtattaatatatttttactccatgattaattgagtattaatatattttttacttttttatagaaaattttgtaaaaaaatatatttgtctagcagttcaagaaatgtgtatgtgtaaatacactttctatccgaaacaaatgtcgccttaaacgcctatgttgtatgcttattggtttatcagccacaaccaaactttaagcttttgaaacttaaatttaaagatgatactaagatttttttttaatatagtttcttttcaatattgattttgaaattattaagaacacatatataaaattttatttatacattataattttttttacttcgttcattctttcacgacttatgagccatggggcaaacaatgagaggcttaatttgaggtgaaaaaatattttaaattgtaaatatctcggtgtttgaattagtattactcctaccttatatgtgatgctttgacaagggtgtttagatttgattgggaattcatgattcaaaaagggtggtaactggataggataaaatatctgatagattggttaggccagatgttgatcttattaaaatatgtacaacttatatacaaatgtataagtttagacttccacttatttagggtagctttatactcatgttgcctattgttttttacttaatattgtgctacgtggccaaacttcttgtaaagtttgttgctgaaagtcgagatccccaagcaaacataatatattctaccaactaatatctggggtgcgtctatctgttctatactttactttgctcgcttatggaagcaatggtttttctagaaaataaatttgcattgttcacaattaaatcgcaacacaaaaatagtacatttcgatgtactcttttgaattaagctgttcttcctcatcccttatgcgcttctctgcttgtaaaattaaagctattttgtgatcaatgaagttcatgccgatcaacggtgatgacattcctgtggctcctttaaataattaagcaaaataataatatattttttattgctacacaaatatactgtacgtaggaagatagaagatctaacaaaatcttgccatgcccattactggaccttttagaatgggtgacctgtagtatctgcctagcaaaatgccaaagcaaaatggaagaaaacaaaatagccggagatgactggtacacatgtggtgcccccttacattttctctctccattgttttctctccagtctccactgtgcccaagcttgacacgtcgccccatttggtgagagtgttttgcccccggcaaagtctgaattcgcacctttctaggaggccgggcccactccccctccggccaatgcgagcccgccacttgtccacgtcggatgcgaacacagaaaggactagcagcagcagttgctttctgtgccgggtctcagcgggcgtttagatcggactaaaacttcctatgtcacatcggatgtttggacgctaatttagagtattaaacatagattaataaaaaaactaatttcataaatgagagctaattcgctagacgatttttttaagcctaattaatccataattatcaaaagtttactgtagcatcacattgttaaaatcatggcgtaattagactcaaaagattcgtctcgcaaattagtccaagcttatggaatgggttttgtaattagtatatgtttaatacttcaaattagtgtccaaacatccgatgtgacagggacttggaataagtccccggaaaacaaacaacccctcagccttgtaacttttgtcacgatgagaagtgagaagagtgtgacatacggctgctcgatccaaggagaaagccaagtgtcgcacacttggtagaattccgaggataacgtttgcgtgtaccaggatcgatcggtctttcagctggtagtagatggaaaggttgatcgaatccaggatttatcaaatctttcggggtggaattatcatcgttttacagtttaactgtaaccatgtaaccatgtggttactgtaaaaaccgcgtatattatcgtgtggtataccgttattttaaaaactaaaataaatattacacgtgataatcacgataaccatacagttttgtaaacgtccatcgaatgaatgagagtcacagctgttcgtgactcgtctaggaaacgagattatacggttatacgaagagaaaggattgatctagtactagtactggtgcactgtacattgtcatgatcacggtcacaggcgtgtatacttttttacgtggatgaatacgtacggagtatgagtattttcggttgagcttaggctgtgtagttggaagtttgggttaaaattggtacgatgtgactgaaaagttatgtgtgtatgacatgttgatgcgatgaaaaaaagttagaagtttggatcaaagtttgaatataaacacagccgtaattagcttgcctctacgaccctgtcgtagttcgtgtcatgtccaaatccaacagagcgttcgagaagtactacagatcagctcttcactttcccttttttttttccttcggtttcatgtgattatgtgaaacgtgatgtatttatgtctcgtacgtgctaccactactacttgaaatgtggcgggttccaccagcgagttcgcgagtaaaaatgacgaggcgatcgattaacctgcacgtacacctatatggaccaaagaaaaaaaagcagtatgggtcgccagcgcgtgggcaactcccaccgggcaaaggcacatgtacgcacgcacagtgtgggggtgggcacgtacggggccgcgacgtgcacacgatgacacggcgacatgtacaggcggccggcgccgctcgcgcggcgtctcgatcgcgggggaggggggggggggacgcatcaccgcgcgcccggcacacgtgagcactcgcgcgcgcgtacgtgcaatgcaccggtcgtttgatagccgcgcgagatcggttttgatcgccgagatctgcacgcgcgcgccgcgtcgtgccgatcgatcgtgatcccgccgcgcgctcgcgcgcgcaccggtggatgggggcgcctcgctaccgagtgattgcgccgcgtgcgcgcgtaccagccgccgtgacttggcagctgcgacgcccacccgcgcgcgaaagccagggttgctgcaccgatcgagcatcaaccacccatccgttggcgagctctctggtggttgggttttgggccttttggcgatggatcgcgcggaacctggaatatttgatcagccagctagcgcggagatgcgcccggggatcgatgatatgccgggcgttgccccggcccgccacgcgcgcacttctgcatgtacgacggttgtgttcttttagttaggtgtttggataataggaattgggggtgggattaggattaagaaatgaacgaaggtttagaattaaatggaagatggagaatgaatggttaggatttaaatatgggtggaaaattattttcatttcccatttactaaacactgtcttgaggttgacaaccttctcttctagtataaaaacagaacgacacattaacacatgattaattaagtattaatttagaaaacttaaaaataaattaatatgatttaaaaatattttttctatagaaaattcttgtaaaaacacaaagttaaataatttgaaaaacatgaaactagagagtgaagttgaaaaagtgttgtaacagagtctaggctctatttggtatccctttatcccttttcccaaccactcttctttgttttctgcggcacgcttttcaaactagcgttttttttgcaaaaaaagtttctatacgaaagttacttaaaaaaatcaaattaatcaatttttttaaaaaagctaatacttaattattcatgcactaatagactactccatttttcatcatcactcttatgggaacagatgtgcgaacagctggttcggaccgcatcatcggctcggcaacanaacggacggattatacgagacgaggcgcatttcagaggaaagtgaacgaggcactcatgataattgggtactacaccgacgtaagtgccattgagttgtaaaacggcgacaggtttaattatctcgaacgattttgacttaggtgattccaaactactaaaaatgcaaggcggaaaacatatgaaaagctacaaacctccggagaaagcagggaatgagattattggattgcagctaagctggccgggatatgccgtgcacacgtccctgtcatcgatcgttacgtgttcctccctgtggagcctcgccattggtccaactgtccatcaacgcctttaatttttatacgacgtgtgaacttagctgatgggaggaatcctatatacggatgataaagcgatcgatattagtagtagctttcacaggagcccacaaaagtggctcgtctcgtgcataataacttatttcaaggtcgagctcttgcagtggtcctcaaacgtatcgaaggttttgtatatggcgcaaaagaccgatatgaag

SEQ ID NO: 80609 - DNA, 5748 bp, Oryza sativa
taggttcaaatatcaaagtgtctagaagaactgactggaactgatccttgcaaaacatatatagagaaaatggacatggagccattcaacactcatttttgcttgttaatttgttcatgtggttgcataactagatgaccatcattatggtttctccatgaagttaaatatatttttcctatgccgtccaggttacaacatcaagcatgatagagcacatgaaaaaccttctcaaaataccaggatcaaaggtcctgtttggtggtgaacctctggagaaccattctatcccagaaatatatggtgccttcaaaccaactgctgtatttgttcctctatcggaaatccttaaaagtggcaattttgagcttgtgacaagggagatctttggtcctttccaggtaagagatttttgatgcattgtcttgccacgattagatacaattttttatttaacggtaacctggcatagctatgacatgaattttgttaacctactgcatggttaaagaataggagtacttttctttaatatggtatggtctacttgtagttaatcagtgattttgtgcatatgcatgctagctttcaatagaattgataacaacctacaagtttcaattgtcattgtgatatagtactaacctattccaagttcatatgcgcaggtggttacagagtattctgatgatgagcttgaattagtattagaagcctgtgaaaggatgaacgctcatctgacggctgcagttgtttcaaacgaccctttattcctgcaggtaagttggttttcatctctgttgtgtgttgcacccatgcccattcacttggttgaataattctaccacggtaccaccaagctagttaggctaacatttgtcaagccatcttgtagcaatactcacgcagcttttgccaccaacaattgaacacttgaatccaatcggctcagtgacttatccaacacacactcatcggttttcaggaagtacttgggcgatcagttaacgggacaacatatgccggcatccgagcaaggacaactggtgctccacagaaccactggtgagctaagactagaaactggaacctgccatcttccttttttaaccaaaataggttaacatgtcattttattatttgtaattcaggtttgggcctgctggtgatccaagaggtgcagggatcggaactccagaagccattaaactcgtttggtcttgccacagggagatcatatatgacattggccccttgcctaagaaccgggcactaccttccgctacataaatactatgtcaaggctagattagcttgtagcatgttattctgaataatttgccccgtctgggcaatcatgtgtttcattaaccccgagagcataataaaaaggcaggaaatggttgtgaaatgtgttctgaataatggttgcctgtttgctagtgtccaaactttgctcgcgcttttttttgtccatccactaggcagtacttcgttaacatcaatgacttgtttggaacgtggagattatacatgaaatcagttgcatttgaacaaaaaaaatttaatcgagttcagactagctcgtaaacatctgagatcagatgaatgtgacgaacccagttgtcacaggagcattccctcatcactcaatatttggggtgagagaggctcgaactctcgacctcaggattactcacgtttagctatgagacctacgcgctagccaactgcgccaccaccccgtttttgttgcacgttctttattttcatatatttccggtgcttcttccgccttctgggcgaacactgtagctagtagaaattttaaggcaaattttgctcccagacactctaatttggtagcgatccaaacttcaatggctctaattggatcggcattcctgtccatgacacgaactctggtgagcccagacataatgagaactctgtccatggcgcgctcagactgcagatgagaccgtgagctgcaaaagacgctaacacagatacaaacaaggcggaaaaaaagcacagttttctcagctatttgctgctgttttgtctcgccacaagaaggcgccaagatttgagcttggactcgtgtgagaataatactttggcttcttgttgcagcctgtatgacaccgcaaaatatgctgacaataaacaggtaaaaaaaattgtactcgattctgcacatctcacagccgccttgagacaaaaaacatttgcggttaaaatcgatgtttccaaacaggaatatggacaagaactcatcatagtaatcagggacgcagtgaagctcatttagccatggaatcatcaacacattgtcttgtctctactaggtgacaaactctgtcgccagccaatgcaaccagtacataaacacacctgcaggtaatggtgtctctcctggatcaaatccgcttcttttcttcagtgttgctactgttcattcagtcattcagatagctacatgctacattggaggccaagaaccaagttagtaagcagtaacaactaacaaccatggatcatagcatcatgatggtgaagaatgagattgaaaactactcaggatcatctccagcaatgatcatcaatgcgctggaaggcggcgccgaggcgggcccggttgtcaggaggagaaggagggagccgtctttgctcgcaccgatcaatggtgatggtgacaccaatggtggtggcattggcaagtcgtccttgtcaggcatcactgtcaagaggagctctaggtttcgtggagttagcaggtaaaagaagtaaaccatatatacactgaaaaattcttgtgccttgtgacagattcagagcttgtagagatgacaagaagatgttgtcatgtaggcatcggtggacaggtcgtttcgaagcacatttgtgggacaagaactcgtggaatcctacacagaggaagaagggcaagcagggtaaagtgatcttgttcttcttccttctgcttgtgtttgcaatagcatagctatgctatagatcagtttgagtaattatgcacatgttgttttgatttgcatcagtctatcttggagcatatgatgaggaggaggcagcagcaagggcttatgaccttgctgctctcaagtactggggaccaactacctatacaaattttccggtataagaatatctacttagcaagctggcccatactagaaacacagttgtgaatcataatatatgaggttcatttgatatatttcaggtaatggactatgaaaaggagttgaagataatggagaatcttactaaggaagagtatcttgcatctctaaggaggtaccatcaaagtctttagcatgttcaatctcctattctttttttacttttttttagagagaggttcagtctcctattctgttatcacctattcaactttgacaagcatctaaactgatgccaggaagagcagtggcttctcaagaggtgtgtccaagtacagaggggttgcgaggtatatttggacagaaaaatgtattgtactctatcaacagttctgaagataggtttgtcactgaatgtctactgcatactttcaggcatcatcaaaatggaagatgggaagcaagaattgggcgtgttttcggaaacaagtacctctacctaggaacctacagtgagtacaagaacagtgcttatactctattctacattgtgaattggtattccaatgcatccaaaacttcacatcttaacatcggcccatctgccattcttcctaaatctttttctccaggcactcaagaagaggctgcccgtgcctacgacatcgccgcgatcgagtacaaaggcgtaaacgccgtcacgaacttcgacctcagatcatacatcacatggctgaagccaacccctgctcatgttgccatgaaccctgcagaagctcttgcaatgcagatccctgtagatcacttcctcccaatggaaacccagatgatgatgctccctcagagcaatcctttcacctcatatcacaatgcacaatcactgggtggtggtgacggtggcagtagcagtactaataatcaagaagcctccatgataatctctcccagtggctcatctagaaagagatcatcatccactgctcttagccttcttctgaaatcgtcgatgttcaggcagctggttgagaagaattcagatgcaggtgaagaaaatggaggtgagatgagagagccgggtgcccatccaggagaaggatatgaataccacaacttcttccagggagatgctgctccggacatggacatgtgtgatctgctttcatcaggaaatgtgcatgctgcaagtggtagtgctggatttgaagaggacatcgcatgttatagtggttttggaagcatgcagtcgctgcagcaatagcatgttggtggctcaggatttgtatcttgtgtaaattgctaacactttgtgttcagctacaaatcaaccttccctttttcactgattacttttccatttgacatgtttacagacttgtgccgaacaacaaagcagaaagcttattttgctcactaacactttccaggcattgcattgaacaaaaaggagatagtgattatagtgatataatgataaacaaataacagaatagtgattatagtgatataatgataaacaaataacagaatggcatgtcgtgtgcttcaatgattactacgggctcagacctgtctaataacgaattagccaaataaatgcatcctgtgcacttataagcagcagatatatgccatcttatgatgaacaagatgaattcaaagtagcctagttagagaagaaatatggttttgaatcaaacagaagtatctgcagctggattcagagggtgaactttgaagtacgtgaccaatttcacccaagagttttgacactcagattccgggacatgttttcccatcaatatgcccgcaaatgaccaaaaagaaaccgagacagattgactggtaacagaaaccctcatgtagtctagaacaggctagaggcaaccaaagttaagccgattacaagttttgttcaatgagctgctgatatcaaaagctagcatcctaaaccaaaccagaaaaagcaggcgaccttcaaggcttgaggaccagggacagcccaaccttggagctcttgtcgatggccttggtatcaacctcagtggagatggtgacgagcgacttgggcctgaactcgtgctggatgagcgcactggccatgccaaagttgttgaagcgcgccttcacagtagtgagttcatccagggcatgctgtgtcccgaaggtgagagtgttctcgttgctcgagaagctgtgagccagctctgctccaacagcacttgttttgctcaccttgtggtagtaggaagcagcaaggctgtctcccttgttgttcctgaaatttgcaaatcactctgttactaccaaaatcaaagcatgctagaataacacatctattgcagtaacttgttgcaccaattccaaactagcatatagatgacacatgcaaagcaaactgcccaagaagtccccagaaactgctgccaaaatctaagcatgttagaaaaacacatcaactgcggtaacttgttgcactaatactagtccaaactagcatacagatgacacagaggatgctgagcaagctgccctaagaagtccccagaaaatactgccaattgattgggacttggaggagttaaacaacaggtaaagggccaaa

SEQ ID NO: 80610 - DNA, 719 bp, Oryza sativa
cctgcagcccacagggcggggtacacagtcgccgtcccatcggttattcaaccggtcagatgcgcagcacgccgcattaaatgcgacatggcgcggttgcatagaccgctttaaatgcagttaggtggcagttaggcgctcccacctaaccctgtacacgtgggctgatacatggaggggtcggggcagctcgaccccaagcgagggcggcctcctccctctagcttggaggggggcagccgccgcgccaccccaggctcaacccccctcggggggagccacgtgggtttgggggcggcccaaccccaagctgggagggggcagccgccgcaacaccccgggctcgacccccctcggggagagccacgtgagtttgagggcggcctcctccctctagttgggagggggcagccgccgcgccaccccgggcttgacccccctcggggggagccacgtgggtttgggggcggcccaaccccaagctgggaaggggcagtcgccgcaacccccgggctcgacccccctcggggagagccacgtgggtttgagggcggcctcctccctctagctgggagagggtagccaccgctccaccccgggcttgatcccccctcgcggggagccacgtgggtttgggggcgactcgaccccaagctgggagggggcagccgccacaacaccccgggctcgacccacctcggggagagccacgtgggttt

SEQ ID NO: 80611 - DNA, 2981 bp, Oryza sativa
tatgcattttctcaaacaccttgtgtgcatgccggcagcttcttctccgctccaccaacgccgccgagcttcgtcgttcctccatctctcggtaagtcctcgctcctatgtcctctcctagttccgtagaaactagagccccctttaatttcgccaattagcaaccgtagccatgccggtccggccaccgttttgccgccggtgagctcgctgtggacaggccatcccggagcccctcctctccatctagccagcaaaatggaaccctcacacgccatagatgctgacgccctcaccaattcggtcggaaaccctccttatcgccttagcacctagctacccgtgcccggccatggcggccttgcagcgccgctcgcccccgcgccgtcctgcgccatgaccgccggcaggtgtgcgccgtgaccgccggcaggtggacgccagagccttgccgctcccttccctggtcgctgtcgggtcaccctcgcccgggcctagccgcgccgtgctctgctcggccgatggctggaggtagaagacgataaagaaagaacgagagagagagagcagtcgggcgcacttgtcaatggttcataggatttgctttagaaaaataatccagtaggaaagcaaatacaatcctaaaccccacatgtcagtcacttggagttttggataaagtttaggaataaaaataatggattaggaacagtacctttttacaatttctcagatttattcaaatttgaatctttaaactagcgtaactctctcattttaactcggatttgagtgaaacttgaacctaaatttatctaaattcataagctttccaatggtatataattcactatttgataaaatacatttataattattaaataattaatactaagataatgcataatagtcaacttaaaaatgtgctaacaaataaaattagtactttacagtaaggtagatgtaagaatatttgtctttaacatgctttgtcaatgtaacaaccacacaaactaattttaaatgatgtctcaaattaatgtataggaagatactagtactattaaatggttgtataattaaaccccatgacttatagattatttaaataataaagttagccttataattaggtaaatcaaacatgaatacagatagatgagtctttaatttatttatgaggaataggtacagaattgttatgatagaaccacccaaataaggttgagtcggttagcatccaataattactcaaagagtaaaatcacttgccaacccacttaaatcacatatattgtacaatccatttaaaatcatacataataacaataacctacctttagcatatattaaaccaaggagtatatgacaaacatgtatggtggataaatactagttataaatcttgacctcatataattatagttcaactgtaagttaggattgttcattaagggataatctgtaactataatatgattaacctaaacaactctaacatacaaagcatggataattattaaccttttctaatttatcgtgacaagtaaaatattttcataattaaagcaaagcctccatcaataaaataataatacaaatggttccctgcgattaattgcttgatcccaaatccatctaacaacagaacctctggtatgtaaccgtgctatttaatagatgcatatatagccataatccttccatagccatttgatagaataaatcgccgattagccaaatatatatgtatcccataaatgctatgttggttaactcctaaatcgaccacgatgacaatagaaagattaagaagccttagccctagcatgattgaaatccattagcaaacacgaatagtatgagcaaccctaggatcgaccccaacaattatcttttgcttgtgcatatttgcttgttgtttgaatattggtttttctcgcgtattatagaccttgtgtatcggttagtcgtgaggcaacgtctacaacttccaggaggtgaaggttgatcaagattatatcaataataagaattatcctgagcaggcaagtcatcactattccttgaacatgttgatcccaattgcgaaaattattttgtttacaaataaaattgcatgcaatgatgaacatcctacttgtgattatgccatgccttgattattgtttacccttattcccttgtaaccatgattacgtatgagtccctagtcaactatgacaaatgcttagaaatgctactctagaatcatgcattctcatatttatcaaatgctatatgcttgggcaattacctttgggaaggtattgagatgcggcatgtggagacataagcgccacattgccatgatgttgatgacatgatttgtgaaaggagaaataaaattaaacaactgttttcgactggggcggacggaggatttgggtggtatccggaaaaggctagtatcgtccccggtcaattaaggaccgagccatgaagttaagcatgaaactacccccgtacaaccgcacttctcgtatgggtatagacctagcggagtagatagctgagtggaatccatgcatagtggtttcttgatgtgtgaggcaggggctctacggtggggcagccattggtagaaccgcgaggtgggtgtctacagtggtgtcgccatcggtaggactgccatgtgagaatttaaacataattataacttaatgcatgtgtgagtctttccttcccgggtgcgctagaactcctctcactgctagaaaccgtgtacgcctagagtgcatgaggatgtaaagttcatggagcgggtattgccaatgtgaggttatcgaaaagctttgccgtgacgcgtctcatgtgttgggacgggctcatgtgttgggcagtcgcgaagtgcgggtaaagtgtacatccactgcagtatgagtaaaccaaatctattcgaatagccgtgctcgcggttattgagcaccgggacgtgtatt

SEQ ID NO: 80612 - DNA, 5036 bp, Oryza sativa
tcaatcctacttgaaacacgttataaaaatatagtcaaacccacatgtcatccctatccatcttcttcctcttttcccatctccttcgccatcatagtccaacgagctaggtccacttgtcatcacctctctagggcgcccctgtctccttgcagaaacactattcaaacaataccaacgagagagagcaagagatatgagagaaagggtcattcctcaaggcgacaactttgtgagaggatgtcgtagcgaagactcgggaatgatgagatggcagtggactggatgacagaggagcttgccttgaactagctgttgaatagtcccacattggttgtggaagggtaaggatcctaatatataagtgggggagcccttcgcctcaataactagcttttggggtgggaaagaccctttacgatcctacactagctcccctattgagctctctcagtggtaccgagctcgaacaaccaccacggactcctccaagctgcaaggccatttgccacaaccaccatgtaccatagttattaagaccggacaggataatgaactggtcgagctctcggttcacctgtttgatggtccgaccaggttaggccggtccaaccgcggttcgatgtataatatgacgtaaatgtctcgtaccaacataagtgaatagatggagggttggctagcgcgtgctgctctcagccatgtgaccgaaggtcgaatccccactcccgcaccctcttctagcgatttttggtggggtttgctcagtgggcctcgcctcagcccatcaacaaaagccttacccggtctgaccactccagttcaaagcccggtttatataaaaaccgccggttcaattgcacacccgatcttttaagaggaccggacctgtcgaggctgaggttccggtttttcccggtcgggtcctaataactatgccatgtactagtccgagttgcaaggccaccatttgtaggacccccggcaaccaccaccatgggactacttcggagctccgagctgcctctaggagagcgtcatcgctatgggaagagatggtgctgccatataatttccctcctctctcaccatcctacttcccatctagctcatcatgtcagcaccaccttgcagtcatgggagtggaggttgcgaatgtgacgaaggttgttggaggagaggggagaaaaataaaaagggaggaagaagatgaggagtggttaaatggtggatctcatgccatattggacaccacataattccaaggccactgtgtgttgagtaaaggggagtaatttgtctagttttaagagttagtggatgttaaatgtccggtttcatagttgaggaggttagtcaagcttaacgcttttccttatagcctttacacctccatacttaggccccctttgaattggaggaaaaatggagaaaaaacaaaggaattgaaatcctacactattcatgcctttgattcgtaggaacaagaaaaggaaaaacgtaggaaactttcctattcctacaattctagagcaaaaacgtaggaaagttaacatccactctaacctcttggaaaactttccttaagtctatctctctcatttgattcctgcattttttctgcggtctaatcaaacagtcattcctatatttttcccgtgttttgcaatcctctgttttacattgcaatcctaccaaaatccggggttttccaattctccggtttttaattccggcgattcaaaggggcccttagagtgtggatggtaaggggctttatcaaacttgatgtagcaagaacacacccgacctaagagtcgataatcttgtctaacccgatcctgatcgccttcatgagcacaaaataaatgcctatgatgtgcccatcgagaacctaatttccaatgagtttttattgggtattccaaaccattaatagtatatccatgctcacataattaaaccaaactgacatttgaccacaagctagcaaatattaagtcatcaacattccaaaccaaagaatgcaatttacaacattctaaataagagttcccaaatcagcattaagcacaagacggaaacacatatatcaggtcagagcaaggattatccatgggcataaaacaatacccatgattgcccgtcaggatctgtcataccaaggttagaaagctactccgtttacccatttaggttcgatttgaatcgtagaaataaaaaaaaaacatagaaatagaaaaaatataggattctgacatgaatgtaagtataaaacagagaatttgcaaaacacaggaaatacatagaaatgatcgtttgattggatcatatgaaaaacaatggaatcggatgagagagatagactcaaaggaaatttttgaagagctttgagttcttgctaagtttcctctaaaatctctatagtattgtccattacatagaaatttcaaatgattagataagattcaattcttcgatttaaaggtattcatataatttttctttagtattgaaattctccaaaatttatatgtttttcttccaaattaaatggaccttacgattgtttccataactttgagacaagttgctatatgtgtttgctctaatgaaacagcaaaccctacaattaggcgagttgggatcattctgacttttcagcccatcctcccttctgacagctcgattacgcaacgaagaagagcccactcagctttctgatcatttttttgcctgttctactggatgcaggccgagagagagagagagagagacctggtgccactgaacgaagcacagctatagttttgctgctctagctctccctctctctaccgcttgcatagtttcattgcatggctgtctgggtggccgcacatcccaccactgttgctgtgcctaaaccttatcttttccccatataaccagctcacaccgctagagagaaagaaacatacgcatcccaccaacgcgacgagctcagaatctcagaagtcagcagcagcaaagaggcgataagtagccgcggctcaccgttcgttgcccaaaaccacccaaaagcgtagcgacacacgagaagccaccagccaacgtagtacgcgccgagagctgaggccatccacgacacacgaacatgagcacactagtagacgcgctgtgcgctccctgcagcgacaccgcgctcatctacgacaccttcaacgcctccgccgccgcgagcttcctcttcgacaatgccgccgccttctgcgacgctgacatcctcggcgccacggcgacaggggagaaggaggcgacgtcgtcggccgcggccgcggccgcggaagccgccccgccgaggaagaagcggcggcggcgcgcgaagagctgcaagtcgcgggaggagacggagacccagcggatgacgcacatcgccgtggagcgcaaccgccggcgccagatgaacgagtacctcgccatcctccggtcgctcatgccggagccctacgtccagagggtacgtcgtactacgcgcgccggcacacgtctctctcgccctctctgttttggttttttttagcaaaccgacatcgcttcgtgtcaagtgtttctaccctcttttgttctgtatatctgcgttgctcccatttgtcaaagagcaagaaagcgatgtcggagcaaccggcgaggagaacggcgatgagagaatgtttggccgaaagagactcccccgccatggcgccattgtccgccgttactcatggcgtatcgtctctttactgctcaatctcttttcatgaacagaagcatccattctttgcacagaaaccttctgcccattaatgtgtctcccctatcattaattcactcgtacacagagagagttgcctggatgggcctgtcatgtcaaaattaatgcgttcttgatcatttttaaatgttgtgtagggcgaccaggcgtccattgtgggaggcgcaatcgagttcgtgaaggagctcgagcagcagctgcagtcgcttgaggcgcagaagcgaacgctgctccctcaccacaaggcgagatgcgacgacgcaacgccgatgcataacgccagcggcagcaacgtcggggccggcggctgcatggagcccacgacgacaacgagcaactgcagcagcagcgtcaccgaggacgcgccgtccgccgacgcgcccccgttcgcgcagttcttcgcgtacccgcagtacgtgtggtgccactcgccgcgcgactccaccaccaccaccaccgcggcgtctgcgtcggcgtcggcttcggcgtcgtcgtcgtcgccggccacggtggcggcggcgctccagtcggagcaccgctccgggttggccgacatcgaggtgagcctggtcgagacgcacgccagcgtccgtgtcatgtcaccgcggcggccagggcagctgctcaagatgatcgccggcctgcaggccctccggctcaccgtgctgcacctcaacgtcaccacgctggactcccttgtgctctacaccctcagcgtcaaggtacgcctacgcctatcgcctgcgtctgcagccgtgcactgatttcagttcttttttcaacaaaagtgcctcaattttcggccactgcatttcacacgcatttcgcgctgaaacgcgcaccgatgcagtagctagccaggcgctcaaaccgagcgataccaccagcacaaacgtttgtgcgtgtctccatgcatggtttgggaatcatatgaggtcacttcaaccgagttaattaatcggagtaatctgggacgattattagagacggtgtttgattggtatagcgtctgaaaagaaaacgtgtcagatattctcctgcctgcactgcacagcacaggcataggtcatcgcatcaaggacgcagtcgtgcaggcccccaacagtataatgaacagaaacaagagatgagcagagatggagatcgcttcacccatcggctttcgatcaagcatcattgttcgagacgcatcaaaatttctcagaatttgatcgaatccgatggacctgactaggagcctgag

SEQ ID NO: 80613 - DNA, 2749 bp, Oryza sativa
tactccgtaggagtatttcagtaggagtaggcaggtcgggcccctgcagccaaaggacttgtcaagtccaaacggtgagtagcgcacagtactactagtggtctggtagtcctagtaagcactggcctaagctgtgcgtagtgtgacgcttcacgaaaaagctactgcatcagtcagtccagattgtgtaagaaaaacgctgccacggagaatcctttctgctgagctgagccatgctatagatttcgactggcatagagaactgagcagaaaaggctatagctacagtaggcacaagtatagcgctggtgttcagccatgacagtgtgtgacagttccccgatggaatctgtgtgggagtagtgctaatctacggcattttttttgcgacttagtggcagattccttcgctccctaaccggccattgcacatgcacgcaatctcattagttctcgtctaatcctaatcttgtctttgcgtggccgtgtgctgcacaggtggaggaaggatgcagcctgacgacggtggacgacatcgcggcggcggtgcaccacgtgctctgcatcgtcgacgcggaggcggccgcctcggagcatctcctcgcggcggggcaactggccacgacggcgacggcggtggcgaagagagaactcgcgacgtacatgtactgagccgctccaagtgccttacatgtcgtcgtttgtgtggtcgcgtgtactgtatgccgcgctcccgtttttctcccctttttaggctcgtcacgtttttgctgtgtagtggcccggcaggttagatctagttctagttgtactagtagatgcaaaatgctatgtgtccagtagtcccagcctctcgacgagggcgtacttgtctgtttctcgttctgaaaacagaatgttgtattgctgtacctgtacagtatcctgcctcgcctttctgtaataagagcgactagcgagtagcgacattggaaggaacagttcgagattcgtattatccgaacagggccttatgagggtactagcttacaatgggccatgtgagttaccactgcttcatggcaagggcgggctttagcctactcaaagtccatcaaccgtgtgatttgctcgatttgtgggccgtgataaggccgaaggccagcttgctgccaaatctccaaccagccccgccgaccaccaggagcaaatcaacccgtttgacggtttgaaaagtggtctatactgatatggcatgttgatttggtccacctgtgatgaatgaactttgtatggttatatttgtagtaccacatctatatctatacctaatataaatattcggattttttctgtcgtcacatccttttcaccagcgatttttcgtcccgcgttatccgatttcttcccaccgcacacaagtatcacgcacaaaaaataccccacaccgattcctacttcaatttgccacattaagcccacaagcccaaattaagatagatgaggcacttcaatatttaagattggaaacagtaaaattagagaaaaaaaaataaacgaaattgaaggggaaaaaaagcctaaagtaaacaacaaaatcaaaattgaaatccaataaaacacgcatggattcccagctgattcgtctcaaattcacctcatcgggcagccaattcatcacaaattcaatcacaagaaaagagtaaataaaataaaagagagggaaaaaaagatcaaacccaataaaccacccacagattcgcagtcgattcatcacagactcgccttgtcgggcaaccgattcatcacagattcaatcacaacaaaggggaaaatcaaaatcaaaaagaggaaaaaactgcccaaaaaaaaggaggggatggtggagcctcagcgagcccaccaccgccacccgcgaccgctctcgtcgccgtcgtgttcaccgctgcagcactgtcacaccctgaagttctcctcccaagcctaaaatttaatttataaatgaccctaagaaaatgctggtgcaaatcaagagaaaaccctaagaaaataatacaaataataatcgaatctggcatatggaatttttcttgagttctacatgtagaaattcattaacaggattttagtggaattttcagagccctagaaataaatttaaccaattaaaattgagcaagcaatattttaattccagggaaaatccttttcttcctttttctttttctttttccccttttcttttcgggtgggccgccggcccattctccttcctcccctcccctccactgggtcggccgaaggccaaagcccagctaggtcggccgcctccctcctcccacccgggacgccgacaggtgggccccacctgtcgggcccgtctcctacctcgcgcccgcgccgccgcgcccgcaaccgccgtcgcgcccacgcctccgcctcctccgggccacgtcggccacgcccgcgcgtgcgccgcacctcccgcgcccacttccccctctctctcgtccgctcccgcgcccgagatggccgggattcgattttcgaatcccgcctctctctcctctcccactccccgcgttggccggcggaatcttgcccctaccggccacgtccgggactcccctcccctatttaagcttcccgtcgccccctctcgctttttccctatttcgccgaactccctcgtgctccccatcgctcccgcgccgtgaaaccacccgccgccgccgcttccgttactccggtcgccgctagccgccgctag

SEQ ID NO: 80614 - DNA, 18636 bp, Oryza sativa
  unsure (1)..(18636): unsure at all n locations
cggtgaagtcgtagacgcccaacagcagcggcataataggccagccgtgtaggcggaggcaccactcggcggctacggaggcaagccggcggtgaagtcgtagacgcccaacagcggcggcataataggccagccgtgtaggcggaggcaccactcggcggcaacggaggcaagccggcggtgaagtcgtagacgcccaacagcggccgcataataggccagccgtgcaggcggaggcaccactcggcggcgacggaggcaagccggcggtgaagtcgtagacgcccaacagcggcggcgacgaaggccagccggtcggtaaagacgtggacgcccatgaacggtggtgtgaccaaccaaccgtataggcgaggacaccagtcggcggcgacggaggcaggccggcggtgaagtcgtagacacccaacagcggcggcataataggccagccgtgtaggcggaggcaccactcggcggcgacggaggcgggccggcggtgaagtcgtagacgcccaacagcagcggcataataggccagccatgtaggcggaggcaccactcggcggcaacggaggcaagccggcggtgaagtcgtagacgcccaacagcggcagcataataggccagccgtgtaggcggaggcaccactcggcggcaacggaggcaggccggcggtgaagtcgtagacgcccaacaacggcggcataataggccagccgtgtaggcggaggcaccactcggcggcaacggaggcaggccggcggtgaagtcgttgacgcccaacagcagcggcataataggccagccatgcagacgaaaacaccagtcggcaagagtagtgccgcggcgttacatgcaaacagcagaaaataccaagagagattaatctgacatttagagatcaatctaataaacaacaataagttgaaaaggaaaaaacccggcgaagtcggagattaaaaggaaaaaactcgccgagattgatctcttcgactgactccgagacggagcggaggaggcggaggtcgcagtcgcgggcggcgttggtgtccatcagcacgacgcaggacggcaggaaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagttgattccatcgcactcgtcgtcaggaaactcggcgtttacccctacctggcgcgccaactgtcgaaacatggattcggcaataataaaagggggtagcgcacgagacctaaaagtggatggatgcggagacaaaggatttagacaggttcaggccctctcaatgagaggtaataccctactcctgtttggggatttgaatccgccgggtgtgtattgatctgatgatcaggttgtctcctgcccctagagggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatctccacaaaactcaacctataattctagggacgtaaagtggactttttgctgctcagtttggtgggtgctgagtgctgactgactatgttgagctgagttgaactacttggaacaatctcatcagtaatcacatttatctaggctataacaatatgaaattggaagttccatctcaaaaaatggcatgggaattgattagccgtttggaagctttcattaatcgcggagggcgtagataaagaaaaaacacaacatgctaaatctaagcagaatctttattagaatcgaagagctcgacaaattcagtagcgcccatttgcacttcagcacttatgttcatcagcaagacagtaactgtgttctatgaagagaacgacatgcatgctcaagtctgttggtaatgtgaagtgtttattcagcaacagcactctccgcgcaagattgcagctccgctacgagctgcacacaaggtgttcgacggaatggcacaaccaaccaaaagcaaaaggcaccaacctctacggaagcttcgacgagcggcctcagtcgcggagcacgacggccgggtccttggacgtcgcgacgtcgtcttcttccccggcgtggtcaggctgggcggcggcaccggaggcggagccgtggtgggtggtgtcgtccatggcctcctgggcgcggtcgaggtagggcttgaagccgacgcggaaggagaggtagccgaaggcggcggcgcccagcaccaccaggcccgaccgcatcgcgttctgccgcgcccggctcctgccgccgagcgcgcctctcatcgcgattctttcctccctcccttctctctcgtgtgcgcttcgttggagtggcggattcgagactcactggaagtgattccgctttgtgaatcgtagctgactagctgttgctgaagggacagatcacttcgcttcgtcgatgtttttttacctgcgcggcagatgatccagcattgaaattgtagatggaaaaggaatttaaaaggcattgaaattgaaggaaaagggttagatataaaatgcagaaaaaaatggaaaaggattaaataaaatgcagaataaaaaaactgttgctgcccaggatcgaactggagaccttcagtgtgtaagactgacgtgataaccactacaccacagcaacttttaatgttatattcacttgattcattataaatacaatttatgaatttttgaaagaacaaaaactgataataccaagtggagcagagtgcaaacgtggtgttaaaacgaagaaacatgaaaaatgctaggaatatatttttaggatgtggttggaacttacacctctacacagtggctaggtcttggcagcattctgtcaaccgagctatgtactccctctctctcaaaaacttggttgtataaaggtgaagaaaaagaaaagagtaataaaaaatattatattttgaattagtagttggagcttttgttgtcttaactactcaactctacaaattaaaatgccgtaagtatactgatcgtatcagtaatttccaaatttaagatagacaaaacacaaaggaaaaagtacgaattaccctccgaacaatcgtgttagtacgaattaccccctaaaccacaaaactggacatttaaaaccctaaactacttataccggacgaattacccccctaactcactccgaagcggttttagtccgatgtgacgcacacatggtaatccagtcagtaataccaaatacaaaaatttgtagggcccacatgtcatatggctttctagttcctcaatcctcaccctatcctcgctgaagcatgtgttggcggcgagggcagtctccattagcgctcacgctaaaggaaggcagggccgggtaggtgtaggcaggaacgagctagaggtggcggcgatggtcgcgcttgacccctcaagccacgcttccacgagccggcgacgacggtggcggcaacggcggcggcttccatcagctgcaaccttctacctattttaacacataagaaattaattacatgtactaactaacaactcattaaaccatacgactactttaatatctctactaacatttaacaatgacaaatgttaacaaaccatacttactaactgtcggtgacatgggatcgggggtatcgtgactagaggcttgggcagccgcggtcacccacgtggcctgaccccctcgggggggtcgggcccgagggagacttggccaccccctcctctgtctccccgaggggtcgggccgctcctgtttcggccccgagggctggggcgccccgaccccctgtggtattggcgccacgtgtgtgggttaggtgggcacagcggcgctcacctaaccgcatttattgcgggatgaacaagcgcgccacgccgcatttaatgcggcatggcgcacgcatatccggtccgtgaccggtcgcagtgtgtgaccggtcacagaccggtcagatcgcgggttagatggcagcaggcagcctgtcatacgcctcgccccgtcccgtcggaatgatgagagcctcttggcactcatccctagctggagccggcgtggtaactcctgggattagcacgtcagtcccggctcgattcatgccaggcttcatcgcaaccattgcaaggaaggcactgtatgaagaagggcaggtgtgtggcatgccgaactgacgcgtagtggacaagaatgaccggtctgtcactggtccgacgccggtcacgtcatcagcagacaaccgtgctctcatattgcatcagcttccggcggagtggaggcaggtatgacccatcccatcggagggtcattcgaacagcggccattgcaaatctccgccggaagatgaagaaatgacagggtgatcccctgtgtctgacaagtgacggcgttgggcatcattcaaagacaggcgttgattcagcttcaaggcggaggcgcgtgtcaagatttggtcaagatagggtgggtctccacccaaaggaagagtagttagaagtggtgcatgtggtatccccttgaaatataaaaggaggaccttgcccacgagaagagggggagaaaaaaggaaagagaagaaaaagaggaggaaaaggaggaggaaaaaggaggggttctagagctggaactctcttgcttgccggctctctgtaactttttctcacacatgcccaccagaacacaggagtagggtattacgcttcccagcggcccgaacctgtctacatcgcccgtgtctcgtgcgtttgctctctcgcgtacattccacagatcgagggtgaagaacctcactcagcgcccccggccgaaccggcaaaggggggcctgcgcggtctcccggtgaggagcctcacgctccgtcatctggcgcgccaggtagggggcgcgtgtgtttttcgggccctcgtcctctttcgtgtgcgccaagtttctcccgctcagcccaatggccgaacgggtagtggcgcacaacctctctccgagcgctagcggtgacgacagggagcggaacccgcgccgtcgagctcgtactccaccgtctccctctcgccgaagtcttgggcgggaggaggcgctcgaggggatcgaaagatccgcgacttcgccacccacgggtgatggagaaggacggcgagacggggagcgtcgcctcctcgtctacggcgatggcagcacgccccagggcgcgctccaggctgcgggcgcgctcctgcgtcacccgcccgtcgtccccgatccagagactccagctcgacgttggctggatgatgtggctaacttggtcatgacggcgcagcagcgcctaggcgccggcgggcggtcctacgcccccaaggcctctggcgctgctaccaccggctccgtgtcgtcgaggcggagggcgcggcgaaaggcggccgttacccgccgttcgtctgctattccctcgtcgacgcctccgacccaagaagatgtgcgtggggggccggatgcccgcctcaatattgagcgtcgacgcaatggtcgtcgtgctgcccacgcaacggagggcgcttcctcgtccggagcgccacttcagtttgggcatgggggccagcctcccatgtccccggttggcggtgccggctgtcgagcctttgtggcgagccttcggaacgtccgttggcccccaaggttccggcccaccatcaccgaaaaatacgacggaagcgtcaaccccgccgagtttctccagatctatacgaccgggattgaggctgctgggggtgacgacagggtcatggcgaatttcttccccatggtcctaaaaggtcaggcgtggggttggctgatgaacttgtcacccgcgtcggtacactcttgggaggatttgtgccagcagttcaccatgaacttccagggcacatatccgcgcccaggtgaagaagcggacttgcacgcggtacagcgaggggatgatgagtctcttcgctcgtacattcagcggttctgtcaagtccgcaacactataccgtgcatccccgcacacgcagtgatctatgcgttaagggggggcgtgcggcacaatcgcatgctcgaaaagatcgcctccaaggagccccagaccaccgcggagctttttcagcttgcggactgtgtggctcgcaaggaggaggcctggacctggaactcctccggttccggtgtggcagctccggccgcccccgggtccgctgctcgatcagggcggcgggacaggaggaggaagaagaggtcggccctttccgacgacgaggggcacgtcctcgccgtcgagggcgcttcgcgggccacccgaaaggggaggcttgcgagcgacagaaagaaggaggccggcgctcccagcagggagcgcccgaccggcaagtggtgctccgtgcacaacacttccctccacgacctcgcggactgccgcgcggtcaaaagtttggctgagcagacgaggaagtgggaggaggagaggagacaggagcgccgtgagggcaaggccccggcggcccccgccggcaaccggcgaggtgaggccaagcagaaggcccccgccgaggatgtcgacgatggcgacgataacctggggttccaggagcctcaggccacggtcgccaccgttgatgggggagcgtgcgctcacgtttctcgccggagcctcaaggccatgaagcgagagcttctggccgcggcccctacccatgaggcgacgcggcgggcgcgatggtcggaggtggccctcaccttcgaccagacggaccacccgccgtgcgttgcccggggaggacagatcgcgatggtggtttcccccaccatttgcaatgtgaagttggggcgtgccctcattgacgggggtgcagccctcaacatcctttctcccgcagcctttgacgccatcaaggccccggggatggtgctccggccgtcccagccaatcatcggtgtgacgccggggcacacttggccgctaggtcatatcgacctcccggtcacctttggtggttccgccaatttccgcacggagcgggtgaactttgatgtggcggacctcagtctgccctacaacgcggtcctggggagacccgcgttggtgaagttcatggcggcagtccactacgcctatctccagatgaagatgccgggccctggtggccccatcaccgtccatggcgacctccaagtcgcgcttgcttgtatggagcagcgttcggaccagctcgccgcggcgtccaagcccgagggtggcgacgagaggctcagcgcccccgtcccggctgccccgaggcagcggatggtcacgtgcgacgaggtcccggtcaaggaggttgccctgggcgacggcccgtccaagaccacatgaatcggtggtcttctggacgacaaataggaagacgcgctcgtctccttcctgcgggcaaacgccgacgtctttgcctggagaccggcggacatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatctgtgaggtcatccatccggagtggctggcgaacccggtcgtcgtccccaaggcgaacggcaagcttcagatgtgcatcgactacaccgacctcaacaaggcatgtcctaaggacccttaccccttaccacgtatagatcagattgtcgactccaccgcggggtgcgaccttttgtgttttctagatgcatactctggttatcatcagattcgcatggttagggaggatgaggaaaaaactgcattcatcacccccataggaacttattgttatacgacaatgcccttcgggttaaagaatgcaggttctacttttcaacgtactactcgaatttctttgggtagccagttaggacgcaacgttgaggcttatgttgatgacttggttgtgaagacgcgcaaccaagagaccttactcttggatctagcggaaactttcgaaagtctccgctccgcccgcataaagctgaaccccgacaagtgcgtgttcggcgtgcctgcgggcaagcttctcgggtttttggtcactgcccgaggcatcgaggccaaccccgagaagatacgagctatagagcgaatgcgcccccccagcaaacttagggatgtgcaatgcgtcaccgtctgcatggccgccctaagtcggttcatatcgaggctgggagagaaggcgctacccctgtttaagctcctcaaacgttccgggccgtttacctggacggaggaggctgaacgggccctctctcagttgaaggcgtacctcagttctcccccggtcctggtcgccccgaaaccagatgaaccgttgctactttacctggcggcaaccccgcaggtggtcagcgcggcgttggtcgtggagcgcgacgaggacaaccctcgctccgcgcacccccaccctgtgtcggttcgacccgggagagagcagggaggagaggcccccgagccgaacggcggcccgaggcccccgacggccggagctggccctctgcccgcttgtccgacgttgccaggcgcccccgacccacaggatggccccggggccactgcgggaaggccgcgcccgttgccctccgaccccgaggtcgacgacacagaagccgagtgcgccccgcgcggcctctcggacgaaaagcgccctggagatgcggcccctgacgaaggggatcggccccgccgaaaggtgcagcggcccgtctatttcgttagcgaggccctccgggacgccaagacctgataccctcaggcccagaagatgctttacgctattctgatggcttcgaggaagttgcgccattattttcaggcgcatcgggtctcggtggttacgtcttaccccctcggccaaatcttgcataaccgagagggtactggacgggtggtgaaatgggcaatagaactctctgagttcgatttgcactttgaaccacgccacgcgatcaagagccaggccctcgccgactttgtggcagagtggaccccagctcccgagcccgtctccgtccccgaggccagctcgggcccctcgcagctgcctcacaccgcctactgggtgatgcagttcaacgggtccttgtctcttcagggtgccggtgcgggagtcacattgacctcaccgagcggagacgtcctcagatacctggtccgcctcgactttcgggcgaccaacaatatggcacagtacgagggactccttgcgggactcagggtggcagctggactggggatccgccgcctcctggtgttaggcgactcccaactggtcgttaaccaggtctgtaaggggtaccggtgctctgacccgcagatggacgcttacgtgcgtcaggtgcggcgtatggagcgccatttcgacgggatagagcttcggcacgttcccagacgggataacgcggtcgccgacgagctctcaaggctcgcttcctcgcgagcccagaccaccccgggcacttttgaagaaaggcttgcccagccgtcggcgcgacccgactgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaagatataaccaaaggaagctagaggttcttttgcataaagctagcatttaaaaacggtagttgaaggcagtaaaacagttgtagtaattaatcaacattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccactcctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcagtgtattttaattaactcacaccattgcggtggcaccaatccaaagctatgctcatagtcaaagtctatgtaataatgtgatccccatgtgtgtgctagttgaactaagcatggctaagtatttcctaaaccaacatctagtcattttgatacccaagttatcaatggcataaggtaaacaataaatggctgagtattaggacctatcccacatgacattgtaaaaggatgcaacatttaatagaaatgcgggatatttgtaaattgggtacaatatgatcaaacgtattgcatgacttgccttgctctcgaactgatgagacctcagcaacgtcttcgagaaaccgcggatcgacgaaacggccgaagcctacgcgacaaacaaagcacacaagcaaaacatgctataagactacagaaacaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataaagcccagggctgacgtcagcggaagggggggcggcgccgacaggcggggcccgcatgtcagcggttcaagagagaggaagggggcgccggcaagcgggccccatgggtcagcggcacaaggtggccggtccaccgtggaccgggaccacgcggggggggggggggccaccgccggtccacgggaccgacggtccggatcggccgggaggccgatcggacggcacggcggcggctaggcacggctcggctcggcttcaaaaccggccggccggccatggcaaccggcggcgacgcgcacggtcgccggcgacggcaatcggcggcgcaggaagcgacacggacggggcgaaaagcggcggcagcggctgaaggcgacggcgcacgcgcgaaggacggcggcgcacacgggagagagggaaaaaggggagcggaggggagcctcaccggtgagcacggcgaccaaagcggaggatgaaaggcggcggcgatgaccggcgacgcggaggcacggacagcggcggcgacaccctaggagaagatggagaggcgttaggagaggagacgacgaccacggcggcttgaattgccggccggagatggaggggagggaagaactcaccggctcgcgaggggagaagcgctccggtgggattccggcgacgcgaggcggcggccgggaaagctcttgcggcggcgaagctaacggcggcggcggtttggcgcggcggcgactctagcggcggcggctcgcggccgaaggcggcggcaagcggcggagctcgggtgtgacggcgcgggcgcggtagggggcgtgggagaggacggcaaatgggggaaacgagggaggggactcgggggagtgcttttatgggcgagggaggggaggacgtggccgggaaccctcccgatttggccggcgacgtggggaggagagagagagagaggtggattcaaatcgattcccgcccatttgcgggcgcgcatgcgggccgggagatgcgggggagagggcggcgacgtgggcgcgaggtgcgggcggagtggggcgcggagaatggcgggaaacggcggcggcgacgagggcggtttcgacggcagcagcagttgccggaggaaggagacgaccgacaggtggggcccacctgtcggcgtcccgagagaggagggaggggcggcttgggccggcccaacaaaggggaggccgggcgcgggagggagtgggccgacggcccaacagagaaagaaggaaaagaaaaagaaaaggaagaaaggatttttcctgggattaaaaattgcactttggtgatttttaattggtaaaaattatttccaaggctctgaaaattccactaaaaatcctgttaatatattgtgacatgtggaacccaagaaaaatcccacaatgccaattccaattattaattgcatttattaattagggaattagctctaggttaattaagataatttcttcggacgatttatttagccaatttttaaagcaaggagagggggaaacttcagggcgtgacaaacctaccccccttaaacggaatctcgaccccgagattcggaagggctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctgaatttcgatgtgatccggacttgcctgttcctcaggaactctcaaacattttttcaactgagagacgtggaacacattgtggatgccaagcatgttggagggaagttcgagctggtaagcaacttcacctctacgttccaagatcctgtatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagattgcgcgattctcaatctttccctgacagctctgactttctcttctgcctcatttaaaacttctgtaccaaacaactggcgttcccctgtctgatcccagaagagcggagtacgacaccttcgtccatacagtgcttcaaacggtgccatctgcagactagcttggtaactgttgttgtacgagaactcagcatacggtaagcttttgtcccatgctccaccaaagtcaagcgcacaggctctcaacatatcctctagtatttgattgactcgctcggtctggccatctgtttgtggatggtaagcagtgctgaagtttagacgggttcccaattcttcttgcaatttctgccagaactttgaagtgaattgacttcctcgatcagacacgatcttcttaggtacaccatgtaaacacatgattcttgccagatagagttctgctaatttcttccctgagtaggtagtgtgcaccggaatgaagtgagccattttggtgagtcggtcaacgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcgcagagtgctacgaattcagctatttcccttctcatgctgacccaccagaacttttctttgaggtcttggtacattttggtactgccgggatgaatggaatattgagtttgatgagcctcggttagtattaggtcttttaattccttgttttcgggtacacacaatctttctcccatccagattgttccttgttcgtcctcaacaaaacctcgggcttttccaaccctcatgttctttttgagctctgctatttcaggatcacttgcttgagctatgcgaacctgctccaccagtgtgggctgtgcctctagggcagccacgaatccgtgctcaactataccaaggttcaaatgtcccaaatcacgttgaacctcacagcatagttcctctacccatgcgacgttgcagtgactcttcctgctcaaggcatctgcaaccacattagccttgccgggatgataatgtattcccatatcataatccttgatcagctccaaccatcttcgctgtctaagattcaaatcaggttgagtaaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaatagcccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgaacttggcatatagttggtgctcttttaacttttcaagtaccagccgaagatgctgctcatgttcttcctcggacttggagtagataagtatgtcatcgataaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgaccgaaggtctatcttagagaacacagtagctcctttcagctgatcgaacagatcatcaatccttggcaaaggatacttgttcttgatggtgacctcattgagtgcgcggtagtcaacacacatcctcttggttttgtctttcttctccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgtggtcagatcgtccggaaaaacctctggatactctctgactatgggaatatcctccagcttcttagtggttttctccactgctacctcttgttcttcaccagcagcctggtttaaactgatccttggcttctgcggcactggggactggaaggttaccacctctccttttgcattggtcaacttgatggtgcggctggcgcaatcaatcactcctctgtgccttgtcaaccaatccattccaagtatgacatctaggtccttggattcgagaagaatgaggttggctggaaaaatcgacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctaccaacctcttgggctgttctggcagagctggctgaactgattgagctggaatctttagtgaactcggagtagggttgagactgtgctgctcactgttgttgtggctgccactatggtggttcttgaagaacctacccgggtggtagggacggtgctgncggataatcatggtggaaggtccaccgtgatgtcccatcgtgaaccgaggcttttgactcttncnctggggagtcctgaactgagctgcctttctcttacggtttattttgttacagtgctcctcctgacggatagccttatccaccaacttctcaaagtcctcataatctctagagatcaactgggtagtcaattcatcatcaagaccagacagaaacttctcctgcctctcggcatcggtacgcacgtcctcaggggcgtagcgcgcgaggcggtgaactcatgcaaatactctataactgttctggttccttgttgcagggaacgggaactactctcttacttttgtggccacaaattcccctcgggtaaccctagtgctttattggaaacctatgacaataactctagtccaagctaagcttctgctcccagcttgggacggtgtcatccatggtcagttgtacccacgcataatagtaagtcgggaactcttcgtagtctgtgtgtgctatgctaaaagctaactctttctctctgcatcgcttgtcatttgcataaagtattcatgcttgcttctacaatggtctatgaatcctagtcgtcgggctctctgattggtgttggtgtgtgcttgagtaaagttggcggtcttgacactgaagaaattctaacagtttggactgatgatgtgtatgactatactgcatgttctgctgctgcagctgtgcttgctgctgcacctgctgtcaacacctgatggaactgttgctgcatctgttgcatcatcattgtcatcatctgagtctgattgtccaacacctgagcaaattgttgggttctcgggcggtgggagacggactgttgtcaaatgcaccgttggcacgtgctccattgatcggctcttcgctgccattggcgttgttcgagtcgcgtgaaccattccttatctccatctgaaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggcggcgactctgaagctcgaggcggcgcttgcaaacgagggataggactgacatctaaagtagacaagggataggaaccaactcatgctcaaatccaaattaaacaaagcaaaagaagactcaaataaataaccgagcatgatgatttttatgcatagaacatttttcatgaactcaaataaagacactaatgcaactaaacaataaattaatgcatagactagttgcatggaaaatgatgcgcataacattgcccccatcgaatatagacacgacctaatgcataacccccaataaattcccgactgactgtcgaataaactccaactaaaatttttctaaagccctagactgagctaatttttttcttttttttaaaaaaaaaatccgatccgaaagaacgaccaagatttttcccgcaaaccaaaaaggcaaaactccaaattttcccgaaacaattccaggtgcaaaagggcatatgcatatgaaaaaggggttcagagggctcttagggtttccagttggcttgtcctacggtcaaggtcggctctgataccaacttgtcacgcccagaaattctcgaaccagaatttctaagctgaatgtgcattaaatccctgtccaggaccagccagggt

SEQ ID NO: 80615 - DNA, 13237 bp, Oryza sativa
aaaagttgtgctcaaagtgctgtagataataaagtaagtctcaaacaaaataataataatttcaaaaaaaattgaataagacgagtggttaaacgttacaagcaaaaactcaaaatcccttgtaacaggggacggagggagtaattaatgtagttacacctacgctgcatcgatgatcactgtagtctgtatcctaacagtgtctaaactctgaagaaaacctcgccatggagctcttttctgcaatcctcggtgacctcactagcaggtccatctcctacgtcatggacagatactgcagcaaccagccggcggcgatcgacgacggcgtacggcagctgcgccggctgcttctacggacacacaccatcgtcgaggaggcagaagggaggcatatcaccaaccaagggatgctcccgcagctcaaggccatgagagacgagctgttcagaggccactacgtcctcgacaccttcagacaccgggctgatctcctccagaaagaggaggagaaagaagatgaacaggtgagaagctcgtttgcaatgtcaaggctcaatcctgccaagcgaatccgtttctctcgtgctagaactagtagctttcaggatttggagtccatgattcgtagcctggaagacgccattgctgacacaaaggagttcatcgtgtttctgatgagctgccctccggttatgtaccggcaacctttcagcacgcatctttatctggacaagtgtatgttcagccgtcagatcgagcgagaacaagtcatcgatttcttgctgcggattgatcctgatcctcatggtagttgtaatgacataggtgttcttccgatcattggtcccgcgttaatcgggaagagcacactgattgagcatgtctgcagagatgagagggtgaagagccacttctctctgatcttgttctacaatggagacgagctgaagcatgagacagtggccactttcagagacagatgtatcatcaagcactaaaacaactgtacctcatcaccgaaaacactgttgctcgtcatcgaaatcttaggcgatgtggatgaagatacatggaaggagctgtattactcctccgaaaaccgcattccccgtggaagcaagatcataatcacaagccgatcagaggtacgacaggtgctcttaggctgaaatgcctgccaactgaagcctactggtactacttcaaggtgtttgtgtttggaagtgcagatcctgatgagcatccaaagttgacatcaatagctatggagattgcagcagagctgagaagatctctattttgtgctcatgttgttggtgccttgctaagggttcatcttgacgcccatttctggcgcagggttcttgaaggcaccagagagtacatgcagaagaatcttatcttggcaagcgaataccctcatgatctgaagacggacaagaaccatcctcgatacgcttggataattagtgaaccaaagcctatcaaatcccttctaatctacgacagttaccagaaaggttctgaaaacgctgaggttccaaatattacaattcaggatctgctgtttggagaagcttcaggtcgggggaaatttgatatcttgctctggaaatctcaaatgccaccatactgtagccacatctgcagctgtgttgtctagaaatttttttttccttcagatggttttgcccagataatatataccatgacaaataataggcaattaggtctttaggtagcaaataattgcagaataaatccattttcagatggttaagctccttgtctgcaaaatccctttgttttgtaccctatagaatctgcatcacagtaaagctttctgttaatcacgtcgggcttctgcagtacatatgaaccagctgtcagctgtcactttattcagaggaacctgaatctgcttgtgccagccaaacagctttacgaacaaggtaagcccaatcaaatcacaaacgaaaccaaagctggcagcacgtaggaaacgctttgctggtaacagaagggagttcaataacagcctacaaaattctgaaacgtaacaagcaactccgatatacaaattcgactgacatatcggggactcttgaccaaatgcgacaccattatttgtttgatcagatcagcacttgcacagtgatttacggatagacaaaattcaaagttgaccgcaaacataacttgatactgcaggcagtacatgcatttcacttccgaccaagagtggggaattgggattggtctttgatttctggagctggtggagctgcagagcgatggccctcaccatatccacccctgaaaccgccacgatccccgcggcccctgccacgaccacggccgccatagtacctctctccttcagctggttttaggaactcgttgatgctcacagactgaaaaaattgacccccaatcagtaaacactgagtacataattaaagcatttcttctaattgaaagcaccaaagcatgaagaatcccaaatgaacagataataggctaacagcagatcagacaaaatgtaaatgaagttgtaacagcagttcagacttcaggagtgtaaaatgaatacaatacaaaaggcaaagtaaatttaccatgaccagataaaacaggctgatggtaacaagtggttgattatgccagaatattaatagtaaaaatccattagcttgttaggggagaggtagagatatctaaggtaagatgggaacatgtaataccttcttagcacgctcatcacgttcagcattttctttcttcttcaaagcatccttgtcagatccctacagcgaaaaattatcagtccatcaatatttccatcggttgaagagaatggaaggattacaaggcgtaaatggcaaaggtaccagtttgatgaaaacttcatcattttctttcttattggaaagtggttgcatagacttcaaatccttgtcaatttcaaccttcctctcttcagtcttcaaagaaagaagtgctttcctcttctcctcccttaatttctcaaactcctcaagagtcatttcctatatcatcaaacatttgaatcataagagaggaggtatggacaaatataatacactcctagacgactgttgtaaaaggaagttataggagtaattcagaaaacaagggcacaattcacctaaaaattagtatgcaccaaaattatttgttcaaaaagtactcacatatgagcacacaagcaatcaaaagaaaacaagtaaccagccagaatggtttcagcttagagtactgttacttcatattgtggccaacctacaaaataattatgacaaacttatggccatatggctatcaaaatcaatacttcattggacagttgtttgtagtcagaaatggagagccctcaaagtctttagaagatctgctactctcatttttagccatttcctcagagaaaaaggaagtcattaagccatctcaactttgtggctgctggaaaactaaaaattgtgcaagtaccctttgggaccacagtgactaacaataaaaggaacattttcacacataaatccaactatgactaatcaggcaaggaaaagtgacatttttgaagccagcaacaagtcatgttcacaaaccttaccaattggcaagttcaaacgaattatattaacgtgtcttactttctataatactaaagatatagtataaatctaaaaatctgcattccatattgatttaagtgatcagaagtataccttatcctcttccttttcttcctcatttggagtgacatctttgttatccttgttctcatctgcctgtggagcaccctccggtgcgccttgcttctcagtaacaggggccttctcatccaatttcagggcttccccagtttccctgaccaatcaaacaacacaataagtacttatatctccatagtatggacatgaacagcttaaatgatgagccacttactgggcgagaatttcatcagtggtagttccccagttcccacgccccgaaccctcacgcttcatctcatacccacggccagtgccgctatggcgctcatatggcctccgagacatcctctcagagtcatcaccatacccacctcgtcgacctcctccctggaagggtggccgagggcccctctccctgtcctgagcgccttcttcacctccagctctgctaccaccgcctccaccatatcctccctggaagccattcatttcttcacctccaaagtctcggttttgaccatagcctcgcccacctctgcctcggccgcgttctccgcgcccataccctccgcgtgagggtgcactgccatctcgagactccctcactgaaacaaaacatgtattaaacataaccatttcactaagtaaaaagaagccttacataccagaaaatggtaaaatgaaatcaaaactcatatctttacaacctacatatccatggaatcaaaattttatgctgtacggaacaatcgttagaagaatcctatataagttgacaagacccatcatttaataatcctagagaataagaacaggaacaaaagcgaacgcgtatcccccagatctagaactccagaacctcaaccacaaaactcaccggcctgtgaagggggagccggcttggtggggaacttggaggcggccggatgcgaggagcccttcccgccgcccggagccgccgccgccgccgcggccttcttcgcctcggccttctgcgccgcgacggccgccttggccagcagctgcgcggggtcgtcgttgtcgtcgccgccgaggaggtcaaaggggttcgcggtcgccataggtgcgagttcgacggcctacaaaaaaaatcacgctacaagctcgctatcttcgtgtgtggggtgggtgactggggaactgacccctcctggctacgaggctcgcctgccggactgcatcgccatggctctccagccgccaagatcgagggcgtgggaaaggcaagagtcggcggcggcggcggcggcggagagagagaggagagagacgtagtgaggggggagagggtgtgtttgtgaggaaaggaataaaaccctagccgcaatcgcgctttcttttttttttttctttttgcccactagccgcgccgagccgagtccatatcctctcgctatcgtttcgcccgcgtgaaattacctcgctgcccctaccttcaacgcgacgtttacgcgagtttaggcgtgggttttgaagggtagttatggaatttgattttcgtgtgggccctacggatgggtgggggtgctgccatcctgggccggacccggggggtacgttggtctattgggccggaacgggatcctctgtggtgtgtccaagctgaggaaattatactccctcctttcctaaggttgttaacgattttgctatatatttgtcgacaaattttctctaacaaatttgacagatataattatagtataattgtagtgtaattacactgtaactatagtataacttgtatgtaactttcaaaaatctctttgtaatatgttatttcgataaaatggaggttgtgggaacaaatccttacatatatatgtgtgctgtgattttttttcttcctcaccaaaataaatcttgtaatagatttaacgattcaaaattacgtgaaacttatatacaagttacactctagttacatgcaagttacagtgtaattacatataagttacagtgtagtgtaattacttctgtcaaatttttaggagaaaaattgtcgtcaaatgtataggtggtcccggttgttaataggctgccttgttaatatgaacgaaagaataatgctcaagtttcacaccatccttgtatttcagtgcaatttttgatgtgccagtcagataagtttgtcaatagtttgtcaggataaaatgtactccctccgtcccataatatctattgtcaatggcaatctaggactgtttcgttatactatgaaatgttccatccggtactatgttgctatattatgggacggaaggagtatcaaataagaaaaactgcagcacgggaaaaaaaatcaggattaattgatagtacaacactgatagacatcttggacactgaaagatattatgaacagtcaaaacaacaaactagaactattggtttggttaattaagagttgaagttgacaacagactttatcttaagtaattagcctcaaacaacaaaggtagtgtccaaaatgtaaacctttaggactaactacataaggcacttgaggagaaaacacgcagacaaacaatatttggtgacctcagagctgttgaagcattttgcaatacaaggtacaaacagagtcccaaacttaccagtcagagagtaaacataaatcccatgattgcatctcacatgtattaaatttctcagacaattcccagattaatcctgtatttcgatagggaacaaaaatccccttcaacatagaactagacacgattgtcctaaaacagcttatcacaaacattaaacagcctacctagtaaacaatgatgaacatgcactatagattataacacagggtaaccacaactgctcgcagttatttctgggcctgatgacagacagtattgcaatccaaataacatcaaactatggccctgtttagttccaaagttttttttccaaacttccaactttccatcacatcaaattttttatacacacacaacttttctatcacatcgtaccaatttcaaccaaacttccaaacttcagtgtgaactaaatacagcttatatatattgttaacatctagctcaatagctagggtctttttttttcaagcgcgcaaaaggattgcacgtcaatatattagaaggaaaagagtttttgttacacagcgtaatcggcacagtagctagggtctttgtttcacccagatgagctcaaagcatccagagataacaaacctagctaaatcaacaacatgcagcaccaaatcatccaaaaaaaactaactttccaccaatcagttactccccagcagaattttttttagaaataatattattttaatgaaaaatcacaaaattagtggccatccggaggaaatcgcgaatttggggaccggtcgaatagctgcacttcgataggccacctatcgaatggcaagcgttcgactagggctagtcgaatgctggggattcaacagggcagcgtattgaacggagggagttcggctggtcccaccacctggcgccgcgcggcttgtcgaaccgggggcgttcgacaggtcctctccaccgcccctgtcgaacaatgggagttcaacaggcccttttaaaggcgcgtccgacccggtcgagctgttgtttcattgttatcaggaccacatcgccatcgccgccgcgagtcaccccttgggtcgccgtgcgtgccggagggagcgatgggagggtgtagcaggccggagagaagcttgagcaggcgtcgcccaggaggaaagggtaggcgacggtctcaaccagcaaagttaaggtataaattactaatccctaagtatgaggcctatgaaattaaaaagggcttgtgatttgttaattgtttctcattgttcaatgttagtgacggagcgtgaggctcctcaccgggagaccgcgcaggcccccctttgccggttcggccgggggcgctgagtgaggttcttcaccctcgatctgtggaatgtacgcgagagagcaaacgcacgagacacaggcgatgtagacaggttcgggccgctgggaagcgtaataccctactcctgtgttctggtgggcatgtgtgagaaaaagttacagagagccggcaagcaagagagttccagctctagaacccctcctttttcctcctccttttcctcctctttttcttctctttccttttttctccccctcttctcgtgggcaaggtcctccttttatatttcaaggggataccacatgcaccacttctaactactcttcctttgggtggagacccaccctatcttgaccaaatcttgacacgcgcctccgccttgaagctgaatcaacgcctgtctttgaatgatgcccagcgccgtcacttgtcagacacaggggatcaccctgtcatttcttcatcttccggcggagatttgcaatggccgctgttcgaatgaccctccgatgggatgggtcatacctgcctccactccgccggaagctgatgcaatatgagagcacggttgtctgctgatgacgtgaccggcgtcggaccagtgacagaccggtcattcttgtccaccacgcgtcagttcggcatgccacacacctgcccttcttcatacagtgccttccttgcaatggttgcgatgaagcctggcatgaatcgagccgggactgacgtgctaatcccaggagttaccatgctggctccagctagggatgagtgccaagaggctctcatcattccgacgggacggggcgaggcgtatgacaggctgcctgctgccatctaacccgcgatctgaccggtctgtgaccggtcacacactgcgaccggtcacggaccggatatgcgtgcgccatgccgcattaaatgcggcgtggcgcgcttgttcatcccgcaataaatgcggttaggtgagcgccgctgtgcccacctaacccacacacgtggcgccaataccacagggggtcggggcgccccagccctcggggccgaaacaggagcggcccgacccctcggggagacagaggagggggtggccaagtctccctcgggcccgacccccccgagggggtcaggccacgtgggtgaccgcggctgcccaagcctctagtcacgatacccccgatcccatgtcaccgacagtagcccccggcgttatgccagggcgatcgcccccctcgagggaagcgctcgggcgtgacgccactccttaggtctggtgaccggtgggaccggcctctacaggcgggcaggaacccagcggtcgcaaatcgcgcgcatcggctagggaaaaatgaccgataataatgagtggcctcttcgagaccgctacatttctcgaaatagcgcgcgaatcgggacgagccggttcatttcgcctggagatatgatgatgacgcttcggtcggcgagcgtagttaacgcgcgcacgatatgtcccatctcgactgccacggccgcacatccgcctcgtgcgccgcaaacgggcgagtgggattagtggaggcgtgggcgcgagaaacgagggggcgagatagtgggcgcgggaaacgaggagccaggaatagcgttggcaagggtataagggtgccaaggaagagattcgtttccttcctctcgccattattccccttgccttcgccgcttgcgccctaactcctcgtttcctgtgccctacctttgccgcactcactcgttctcaatctcctcctccgccggcgtcatggcacggggctccgcaccgctcgacggtagcgtgctgccgccttcccgcatcgtgagcgagaggcaggccgggctgccgcgccgattcatgccggcatctgccgccggccgggaggcggtcgagctgggcgagggacgcccggcaccacactacccggggcggtccgtcttcttcctccctttcgcaatggcagggctggtcccaccattctcttctttcttcatggatgttctggagttttatgatctccagatggtgcaccttacgcccaacgcagtaatgacgttggccatcttcgcgcacctgtgtgagatgtttatcggggtgcgcccatctcttcggctgttccggtggttcttcaccgtacagccagtgtcgccgccgtcggtagttggtggctgctacttctagccgcgggggccggtgctgagccgctacattccctgcgtcctccgcaagaaatgggacgactggaagagcgactggttctacatccccctcgccgacgaagcgcgcctccgacttccgagccagcccccagcgcaggtctccagctggcgggcgccggtagatctgggagacggctacgacgccgttcttgaccgcctggcgggtctgcgatcccaggggctcacgggggccatggtgtacggcgactaccttcgtcgccggattgcgccgctccagcggcgcgcccggggcgcctgggagtataccgggtctgaagactgcatgaggacccaccagggggtcagatgggactgggcccctgatgacttcaagatagtggtccaacgggtgctgaatctcagctccgtggaagcatccctcatcccccaaggagtccttcccctctgcagcgatccagatcgcaccaccatcctgaccatcatgcaggcggtcagggcgtcggaggaacgggttcctcgaggccacgatggcgcgggcgggagccacaggggggaacaatctaccccgggagggggtcgtgcttctgggccccgcgacgggggcccgggaagcagccgccctaccgacgcccgggggaagaggaagcaagaaggaaccccttccccatctcctccccgagggggcggggcggcgcgtgccagcagcaggcgcccagagggtgccgtgccgacgtcgcagtccgagggggaacgaaagaagaagcggctccgcaaggtgggggagaccgaaccacgccggggaaaccttatctcccccccaaggtggtcgtttagccgacctcctcgcaggttcgtccccgcgcccactgcggctgtattcattctcctatctcccaaggcaagttttcactcatccgtttctttttgtcttctggtttttcttctgcctcagcgagattccgtcgccccccccccccccgccattccaagtccggccagtccgaggctgaggagacggcgaccgtggaggcccggaggcgggaggctgaccggcgagaagacgcagaccgcctccgggaaaccgaggaagctgcccaggaggccgtccgggctcgccaggctgaggaagccgctcgggaggaggccaaactccgccgggccgaggagtccgtccgggaggcggaggaggcgcgcgcatgccaagcggcctgccaagcccccgacccgactccacccgaggcgacgacgacttccgaggccacccacgacgaggccacgggcgcaccgctcgggcccgacccctcgggcgacgctcgggacgtgccagcttcgggagacgctcccgagtccggcacgtcgatcggcgggccgtgccacgcggcgcccgcaccgaggcggctctcccctctgccttccgctgcccgactgaacgcggagcccctcctgcaggccttagccgccgcgaacaccacggtgctggacgggctaggtgcccagatggaggtcctgcaggcagagcggaaggagctcgacgcggcgtgggcgcgcgtcgaggaggggcggcgctcggtggaagccatggtggaggcgggccgcaaggcacaccgccggcacgcctcagagctcgaggcccgtcagagggagctggcggagatcgctagggaggtggaggaggagcgggagactgccctcatcgccaccgccgtgctcaacgaggcgcgggatgatctccgcctccaatacgggagccgggcggcggagctagagaagaaactcgacgccgcccggggagtccttgacgccgccgctgcacgggaacggcgggcggcggagaacaaggcggcgtcccagcggcgcgaagaggcccttgaagctcgcgccaaggcgctggaagagcgcgcccgcgcgagggagagggacctggcggaccgcgaggccgccgtcgccatccgggaggcaacgctggcagcgcacgaagccgcctgcgccgaagaggagtccgcactccgcctccgcgaggacgcgctcaccgagcgggagcgagctctcgaggaggccgaggccgcggcgcagcggctggcggacagcctgtccctccgcgaggcagcgcgggaggagcaggcgcgccgtaatctggaaggcgcccgcgccgagagggccgcactggatcagcgggccgctgagctcgaggcgcgggtgaaggagttggacgcgagggcgcgcagcggcggggcggccgcgggcgacggcgacctagccgcccgcctcgcagctgccgaacacaccatcgccgatctgcagggcgcgttggactcgtccgccggggaggtcgaggccctccgcctggcgaacgaggtaggtcccggcatgcttcgggacgccgtctcccgtctagaccgcgccgggcgacaggcgggcctctggggcgggcggaccgtgaagtatgccgccaaccaggggggcctcgcccagcgcctctcagagatggccgggaccctccagcggctccccgaggagcttgaggagacgatcaagtcatcctcgagggacctcgcccggggggtggtggagctcgtactggcaagctaccaggccagggacccggacttctccccgtgggcagcactagacgagtttcctcccgggaccgaggacgacgcgcgtgcgcaggtccgggacgccgccgaccacatcgtccacagcttcgagggtacggccccccggctcgcattcgccctcgattccgacgaagagggcggtgacggcggtgatgaggccggcgacccgggcgtgtcggaatgagcccccaggcccctgccaatctttatatagtttttcctttcttcttccgaggccttcgggcccccttcttgtatagactaacttaatctgcaatcaaataaagaggaaatttctgtgtcaattctatttgttgtgtgtatgagacgaggatggtctgtgccgcggtccttctgtgtcttggcttgaacaagggctcgtgcccaggtcccagcctcaaacggcacgggtcggagccagtgcctggggaaatccacatgtcgagactggccaggccgggagcgtggtgaccgagggttatggatgacccgattgtgggcctttgccgattcccccccggagttcaccacgccccggggcacggctcggttctgggccccttttggcgattttagccggcccgggccaccgtgggcaggatcgagcacgagcgtgctaattcaagccaagagttttcaaaaggaaacgatggcacagacacagtccttaggaaatcgagaatgcttttattgaaatacggaagagaaaaaagataagtatatgcatgtggtagcccccggccaaccctgcacgcccggggg

SEQ ID NO: 80616 - DNA, 10128 bp, Oryza sativa
atcgatgcaaaatgaggaaaatcaaccaagggaggagcaggctatgggcatggcggatgagggggagagagtcggtataattgttgatgaaatggagagggaagattcggataatgaggaagtggacgacgacgcatcatccgatgaggaaggtgatgtaatggccactgattgggcaaatgaggacttctctggacttgttatatcagagggtgatcatgtaccctgggagtataaggagaacgaggtaattgagggtgcaagatatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgatgcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggttagggtcgtccatcagaaatttcactcagtggaatgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcaatacaagaaaattggtccgtccatggccgatgacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaaggtaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattctatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaattattcggtgttgtatcataatgttatcgtgatgagtgttcggactaaacacttttgtttgtttgtactcttgtttaatatgtgttagtaattcgcttagttcaacatttattacttatgttgaactaattatttatatgtttctgatcaacctatttgatgcaggtatggcgtacgacacaccggcgctgttgaaccgtgggattgacaggaaccaccgctcgttcctgtcggcagtcgagggtgcacagctcggcaccttccgtccacgcacgtcgcgcgagtggttgcgtgtcgacccccgtcacgttccttggtacgcgtatgttcacatttcaactcaactttgatttgtgttgtacttatgtttgaagtttgctctatacaggttgcgtgcggcaggccttctaccactttgtaggcttgttgaggcggcggcggacgaccgtgacccagcgaagcggtgggatgcagatcggtcactccttgccgctcttgtagaccgctggagacctgagacgcacacgttccaccttccctgtggggagatggctccgacactgcaggacgtgtcgtacctgctcgggctaccgctggcgggagcagcagttggtcccgtggacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccgaatgagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtctttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggtcgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggatttaggcaggtgtttccgggcaacgtgcagccgaccgtcctccctgccgaccactcgtgagttcggattgttcatttctaaatttttatgataattacttcatcgagccatataatttacctctcttaacaggttgactcgacggggacagctagcaggcgcactttgggctccacgtgtacagcagtacgttgacgactgggtgttagctacagaggaggtgatcaacgagctcttcccacacacggaggagaactaccgtgactacctttgttggtaccttcctcgcactcgtgcgcgtgtgaccttcactccagacgccccagagccgcacgttgccgctgtcacggacgcgtatcccacgcaccgtgaccgagactacttcgtggcggtacatccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgtgtgcggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttctgtttttgtacgaaaacatcaccccgtcataacttgatgatccatcctcgcaggacctcgtttgccttcgagcgcccctagcttcggatcagtgcgacctacagcaccggtttcgcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatccctcgcccacacggtactttactttttattaatactgttaaatacctgtacgaaactgatggtccttgtccagcaggatttgcagctgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtctacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctattcattggtaatacgtaatctagatttaagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataactattgatatttatacaaaaaatatagagcacagtacaaaatcgcccttgcggagggcggcaagggggccgcctgcaaaattcgttgacggccgtcgcccgagagcgaacggccgtctgccacgtcattttcgccgccctctgggagggcgatttttaaaaatcgccttcccagagggcggtaggcgactacttccgtcaatttttaaaatggaaaattatttttgtaaaacttttaataaaaaaattaaaaataaaaaaaattccgggattcacttcccctcctcctcgccgatcacatcatcggatcatcatcatatcagcccacctcttctcgcctccataaatcgaggacacccacgctgccgctgccactgcacacgcacgcagcgagtcgcgacacgagaccgtaccgtggaaagaagagagcgaggcgaggacaccactccgctccgctccaccgccgggtcgccgcgccgcgcgcggcccgagctcgccgatcgagagccatgagcctcatcctttcccggcggcgcctcgccgccgccgtccggcggtcaggccccgccgcgctcgcctccaggtgatctgtctgaaaccccctcccctgatctgctcgcgtggagggttgtcgggaatgggcgtgcgtgcgtgcgtgcgtgcgtggatcgtgctgcggcggtttgggcgccgttggcgtttgggtgatctgatgcgagtttccggtcgagccgctcgttgcggcgctcgctttttccaccgttttttttgggagcgatccggcatcgtggttttggttgcgggcaataaatatgttcgattcttcgtttgggtgattgattggcaggtggatgcacacgccgccattcgcgacggtgtctcctcaggaaatttcaggttcgagcccggcggaagtgcagaattttggtaagagagctcccatttggggttctgcttattgtttttgtacacattgaatctggagggatattattagttagtgcttgtgatgttgcaaaaccaattcataggaatgctgtggcagtgcacaaactagttcatatggttatggtgggaagtaattttacttgagaagagtttgacattgtgtcttatttgaacgataaaatgccatgcctattatattttgaagaggaaatacgtgtttggtaattctcatactttccacaggttatgttatgactgcttatgcagttttgccgcacattactgttgatttttcaaagcaatgacatgtgcttgatctctttgcttcataaacattcagttctaacttctactgagctaataagagttaaggtgtagtttatttccgaatggttgttccagtcaaacatgtcactgtcatgtagcctttcacctatatggaagaaagaagttattttggcatggacgtagagatgcttgataaataaagttctgatcagactgctgatagggttaagttcagtgcagggcagttggacaacatctggtaactggaattggctagttgatcctttaaatggtgaaaaatttatcaaagttgctgaggttcaggaagcagaaataaaggtacgttagttactttcagatgtttcttttattatttccgtgttgcggtgatattaattgttattaaccttcctcagcttactccactaaaaaaacccacagattgatccgttaaagaaacaaactctcttacattaaaatgactgactacggttatatttagacttagttgatattactgtgaatctgttatctgctctgaagcgtatcctcaggcaacgtgcattttttttttccggtgcagccatttgtagagagtttatctaattgcccaaagcatggacttcacaacccacttaaagctccagagaggtcagtgtagttttcttgtactactaatgcattgcatggttttccaatgtttgacttttttcttttggctgtctgttgtgtttgaaccccaactttggatgcattacaaaaggcatctaacacaacagagtttattttacctgatagctaatccacttactggctcttctttctcattgataaatttttgcagctttatcaaactcctggtcactgaagtatttgtgctatgctacatgaatagttagctacagtatccttgttcttgcacagttgactccaactcccccgaaaagccaagctatacacataggggatttggtatcaaatggatgatttacccccctgtgtgtctatcacatgtgatcctagggtcacatggagttggaaaatgatgtaccactctaaggagtgacaaattatcaattttcccaaaaatatattgctgataacaacatgctttacacacagtaaacaaactttgtggagtaggaaaaattcaatacgataaaaaactgtgtactatatttaaacttgtactgtataactgacactgacagtggcagttaacaacaatgctcatgtatgctttgacgaacttcggtatctttaatatgcaggtatctcatgtatggagatatatctgccaaagctgcaaacatgcttggtcaacctgtggtatgttatcttaaaattaaatggtttgacttcctattactttcagtgagattttagatgactctagctgtgcatccattggcctgcattatgacactcctataaatgccaaattaggtcatgttgagaaggagagaataaaggatatgcttttctatctattgcttttagtttctgattgtgtcattggtgattgacaggtttcagatttctttgctaaacttatccagagggtatctccaaagagctatcagcaagctcttgcagaagttcaagtctctcaaaaattcttggagaacttttgtggagatcaggtataaaaaaagagaggaccatttcatagtatcagtgtaatctacatatcagatcagttccttcattgacatgttcacaagtactatgatataattgatactttcattagcgctgcagtttgtagtggtagacttgtaatttgttgaaagagcacatcatttccaaggaacttgcaaaatgctgcattctgcagattgaaaaaacttctccgatatattctcatcattcacatcaactatttctctggtatggtaggtacgctttctggctcgatcatttgctgtacctggcaaccatcttggacaaagcagtaatggttaccgttggccatatggtccggtgagtactctaacaatgtagttgaatgtttagccatttatttaggcaataccaggttttttttgggtatcatgttagctctaatgttatatatataattctgaacaggttgcaattatcacaccgttcaatttcccattggagattccattactgcaactaatgggagcactgtatatgggaaataaacctgtcctcaaagttgacagcaaagttagcattgtgatggaccagatgcttaggttgcttcacgcatgtgggatgccagcagaggatgtggacttcataaattctgatggtatcacgatgaacaagctgctgttagaggtttgaatagctaccctctcactcactgtaaagtaaagagattacatgctgtatcagatagcataacaaattagcacacattatcactaacaccaccttttagaagatgagagttttacagtttccccttgataattgcttttgaataatgcatttgaccatgtcaatactttgtaattactggattgaaatacctacatttctcaatatctgatcaactgagttccatattgtaacattatatgctgctcatcatgttaatataggaccaccggaccagtgtgctgcaattcatctgatctttcctttgttggggtgatacatcatttccaatggattg

SEQ ID NO: 80617 - DNA, 11371 bp, Oryza sativa
ctcccgtggctcgccgtcgccgttcgtcgtcgtcttcctccgcgccggccaccctcggtgaggcgtcgtctccccctctactcccctccctctccctcctagtgccgcgccgccgcttcaagtcatgcgccgtcgccttcggctgccgccgccgcctcccgtgccgccggtcgccgtcgccgtcggccgcgtgccgtcgccgctagccctagccggccggccagctttgatgccgagccgagcccggcggccgcctctatcgccaccgcccgatcagctcggggccgatctgggccgtcggtcccgtggaccggcggtggaccacccgcatggtcccggtccacggtggaccggccccccctttgagccgctggccagtgggacccgcctatcggcgccgccccccccttgatgacgtcaaccctgaaagttattgcgcaataaattatttaaggactttttgttatagtaataaacacagtgaatcttctaaaattcataactaattcatccgagctccgtttaagcccattcaagtctcagtaaatcaagaaaaatgtgtagactccattaaaaatggttttgttctctgtttcagtagtcttatagtctatttgcaatgtttgccttgtatgtcgctagattccggttcttccgacgctccggtgtacttcgaaatagtcgccgaggttcctctagcagcagagcaaggcaagtcatgtttgtcacttgatcatgttgatcctatattgcaaatgttctaatgttttctttcaaatactgcatttgttttgcaataacactatgggatgtttacctattgttacagccatgctattttggtaccttgctcctttgttagctcgggttataacatgaatagacgttagactaggagttgcttagccatgcttagttcaactagcacacaatggggaaatctcatttaaaatatagactgtaggttcatatgataatgttggtttagtaccaccgctttggtgttggttaattaaaatgaatcacatggtgggctgtgggtgcatggttttgcttgttgcacccagagcaattaaggaccggttcgcgggaaaccctggaagaatttatcgtgcttaccacaagccagcgtgggcaacggctgggcttgtagtgtagcttttctctagctgacgcatccaggcaagggtgggcgtgatggagtttggatgggccctgcgacggcctatgcggcttccggattcacctaggcacgtgaggggactgcccgtcgcccgctgaggacgggggtgaaacctgaggtgtgatgtgcttggctagagggggttatgcgaagggtcttgtcacgacctctttccggtatgtcgtggtggcatgtcggcgcacggaaacttgtcgtggggctgtgtcttgtgggtacagttgtacacctctgatcagagtaaaactattcgaatagccgtgcccgcggttatgggcggtcaaccagattcaccgtgatttgtctcaccctagtttagtcttttgaaattggatagtataggtggacgattaggcctgtcgcaacatggtatagcgttggacggtggatgattaatattgattaattattacgactgttttcttctttaaatttctgtttataaatgctcgctttatgcaaatgaaccacgctagctctcctttgataattccctgcatcatacccctattccggtatgacttgctgagtacagtggatagtactcagtcttgctctatttttcccaaccccagagtacgagtatgtgtcagatggaggtttctccgaggagtaggcttcgtccgtgccgtcgaggatgcctgtggagtggtgttcccgctgcagttctagtcaaggcttagctcctgttgtctttcgttttttccgctgcatttttgtaagacttttataatgtttgtaagacgtggatctgtatgtcaactttgtcgtttatgtaccccggccggtcctggacggggattttaatgcacattctgcttggaattctattcgggaatttctgggtgtgacaagttggtatcagagccgaccttgatcgtaagccaaatgggaaaaacctaagagccctctgaatccttttcattccatatgttctttgtaattggatttgttccgggaaaattgggatctgttcttgtggttcaagggaaaaatcttggtcgctcgtttaagtgagatttgtcaaaacaagtcagtctagggttttagtaaaattattgagatttattcgtcagtcagttgggatttgatgggtgaaatgcattaggtcccagctcaggaatatgggttgcaaggtatttatgctcttattgttattattagtatgtatctaatttccccatcattttatcgttatgtaagtctgtcttatttattcgccctcatgcaaaatgatctatacataaaatttcgctcttattcgatactcttatttgagtcctttattactttatttaaattggatttgagcatgcattgatcctactcctttgtcttctctagatggccggccacccacccaaccaccacggagaaggcatgattgactttgtggcagagttagcacgtatgacgctggtggtgggctaccccaacgcgccggagtacacgactgttccaccgctcagtggcgagcttccccaccgtgtccgcttggaggtccatggctacgtggggacttgcctcgctaacatggtggttgaggcgtccggaggcacagcagatcacgcctgtcaggaggcagcatacctgatgatggccagactacgggagtgccacaactacatcttccatgacacggcgtatcgatttcaccctcgtcgagccagcggtgatgatgtcagtaccttccgtccaatagccggcgagaacgacaccacctttgatcacatgtgcgccgtgatgagggggatggacaggatgcacttggacctgcacaagacgtccaaggccttgaatgatgggaagctcatgaggatcgtcgttctaaaggacgagatagcgcgcttgaagagggagaatgctcagttaaagggtcttcccgcgccaggaggagtccggatccacactacgccccgcaagtcgacaacggcacccgtgcgcatccagcttgcgcccaggaacccacctccgcccgcagttcccgcagcacctccagttccgcccgcagctccagcagttcccgcagctccagcgccagctccagctcatgttcccgtgtcagctcctgcatccgctctctccttcgcgcctgcaacagccgtcaggggccccgccagtggcaatggaggttggttgccagctactcccagtggcagtcgcgacctcagcagcagcagctccagtggctcagagctgggtagcggcgagacttatctgccaggctccaggagtcgctcagagggacgtggtgacgagcaggaggacgcctttgactccaccgaccgcaggagccgttccgagcattaggctcgttttccattagcttatcgactgtctagcttttgcttgttagtttgtgtgtttaggttgcttgcttggggtcagtcgacggtcgatatcatgtgcctatgatatggctgtctcaataaggatttttgcttgctgtttcaagtgttttaattcagatcagaacaattgcagtttaaatttctatataataaagcttagttcctgagtatctgtttttctccgtttccccgtctactcttcctccagatggtctacaccaggactggcacccgcacgacaggtgagggcagcaacggcgaagaacgcgctgatggtgtgcatcccaacagtgattccggcaatggtccgccaccacttcccaagaatccgacgctagcccaagtaatggcacatcagactcagatgatggcagccatgatgcagcagatgcagcagcagcaccagcagatgcaccagaggatgctgcatgtcacgctctaaagttcccctttccagctttaaaatttgtaaaatgaatcgtccgaagaaattgttctttttaacctagagatgaatccctaattaataaatgcaaataataatcagaatcgacatgtggaatttttcttggattcgacatgtcaaaatatgataacatgatttttagtggaattttcagagccttggaaataattttaaccaattaaaatgagcaaagggcaatattaaatccctggaaaaatcctttcttctttttctttttcttattcaccaagtttcttatcatcttgggcagtcggcccagtatattcgcttcccgcgccggccttccatcggctgggccggcccaagctaattcctccctcctccctaacccctccgggtcaccgacaggtggggcccacctgtcggccccttcttccaccttccgccgccgctccccaagccggcaaccgccgagccgcccacgccgcccgcctgccccgccttccacgccccactccgcgccccgcgcccacgtcgccgcccaccatccccactcctcccactcgcgcgtgcaccccgcaacggagggattcgaattcgaatctctctctctctctctccattccccacgtcggcgagaaatccggccgcctcccggcctcgtccgcccctctcgagcccatataaaccatccctccactcccctccaccttttcctctttccaccgctccctcccgtgccctctatcgctcccgcgccgctacaccggccgccgccgccttttccactcctccgggcaccgctcgccgccgctggagccgccgctgagccaatccgccgccgccattagcttcgccaccgccaaagctaccccggccgccgcatccccatccaatcccgtcgtcggggcccgcttctccctcgtcatggacaccctctttccctctaacctctcacacttcctctcttagcgtgtcccggagctcggccgccgttcgccgtcgccctccggttgctcaccgtcgccgtttgccatcttctcctcccgcgccagccgaaccccggtgagaactccctccccttctcttcctcccgcgcgcgccgccgctccccgcatgcgcgtcgccgcgatgcaccgtcgccgcgatgcaccgtcgcccgcgtcgccggccgccgccgtcttctcgccggccgccgccgtcggtggccgcttgccgccgccgccctcgccataaccggccggccggcttgaagccgagccgagccaggccgccttcctccttcccccaggagccgtcgcccggagggccccgcctgccagtacccctccctcccccttgagccgctgaccagtggggcccgcatgtcggcgccgccccaccccttgctgacgtcagccctgggatgaattattgcgcaataaatacattaaggctttttctttattagtaaaaacacagataatcttctaaaaatcataactaattcatccgagctccgattaagtccattcaagtctcagtaaattcataaaaatgtatagaatccattaaaaatggttttgtttcctgtttcagtagtcttatagcatgttttgcttgtgtgctttgtttgtcgcgtagatttcgcccgtttcgtcgattcgcggtttctcgaagacgttgctctggttccatcagtgcgagagcaaggcaagtcatatattataattgatcatattgtacccaatttacaaatgtcccgcatttctattaaatattgcattgttttacaatatcatgtgggatgggtcgtattactcagctatatgttgtttcccttacgccattgataacttgggtattaaaatgactagatgttggtttaggagatgcttagccatgcttagttcaactagtgcacaaaaggggatcacattaaaacatagactttgattattggcaatagctttggattagtgccaccgcaatggtgttggttaattaaaatacactacatggtgggctgtgggtgcatggttttgctagtcgtgcccatggcgattaaggaccggttcgcgggatgccctggaagaacttatcgtacttaccaaaagccagcgtgggcaacggctgggcttgtagtgtagcttttctctagccgacgtacctaggcgagggtgggcgtgatggagttgggtcggccggggtgtccggttgatcggcttccggattcaccgtggcacgaaaggggggctgcccgttgcctgctggggacgggggcgaaccctaaggtgtggtgcaatcggttagagagggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagacgtgcccgcggttatgggcggtcgaccagattcaccgtgattagtctcacccctagtttagcttaatgaactggtgtagtttaagtggttggttgggcctgttgcaacgtggtgtagcgttggacagtgattggttaatactgcttaattgctactactgttttactgcttttaacttctgcttttaaatgctagctttatgcaaaagaacctttagcccccttggatatatcctgcatcatacctcctcttccggtacgacttgctgagtacagtgggtagtactcagtcttgctcttttcccccacaccagagttgaagttcttctcagttggagatgtctcgaagaggttggtttcatcgctgccgtcaagggttgcctgtggaatggaatcgcccactgcaggagtcaagtcttcaggcttagctcgcttttatcttttttcgctgcatttgtaatcttttatatttttgtaagacgtggatctgtatgtcaacaattgtcgtttgtgtaccctggctggtcctggacaggggtttaatacacattcagcttagaaattctggttcgtgaatttctgggcgtgacactgcagcacgccgaacagcagcaccagcagtttggtccccctccccctcagtccaagttgccagagtttctacgtatcaggccacccactttctctagtaccaccaaccccatggaggcaaatgactggctccatgccatagagaagaagccgaatctcctgcagtgcaatgatcaggagaaggttgctttcgccacacaccagcttcaaggtcctgcgtcagcttggtgggacaatcacatggccacccgcccgccaggcactgaagtcacttgggcggagttctgtcgtagcttcaggaaagcgcaggtgccagacggggtcgtggcacaaaagaagagggaattccgggcactccaccagggcaacaggacagtgacggagtatctccatgattcaatcgcctcgcgtgatatgcaccggaggatgtccgtactgacgccgagaagcaggagaaattcctagcaggtctggatgatgagctaaccaaccagttgatatctggagattacgccgactttgagaggttggttgacaaggcaatccgtcaggaggatcagcgcaacaaaatggaaaggaagaggaaggcggcgcagttccggtccaaccaagggagccaccagcgaccgcgcttcactcccggacagcagggtagacctaccaccctgatcgtccgccagcaccgccctttcaatgccagcaacttccatcagggcgccagtggctgtcagaaccaccatggcggtcagcccaaccgcagtgcagctccgtgcccaccaatggcactagcacagtcagctacgtccgcgcaagctaagaaggagactgggacaaagccagggtcctgcttcaactgtggcgagcttggccacttcgctgacaaatgcccgaagcccaggcgtgccgggccaaggtttgtctaggcttgtgtcaaccacgcgtctgcagaggaggcgcaagcagcaccagaggtcgtactgggtacatttcctgttaactcaatccctgcaatagtactttttgattctggtgcaacgcgttctttcatttcaaagaaatttgtggggatgcatgggttaaggaaagaagagcttaatacaccaatgagggttcataccccgggaaatagttcaacctcggtcagttttagcccttcagtgctaatagaaatccaaagatcaccatttctagccaatctcattcttcttgaatccaaagacctagatgtcattcttgggatggattggctgaccaaattcaagggagtcattgattgtgtgaatcgcacagtcaccttgaccaacgagaagggagaaaccgtagtgtacaaatcactagtctcaccaaagcaaggggtctccttgaatcagattgaggcggaaatcccagtggtcaccgaggagaagaattcgaggaaattggaagagattcccatagtttgcgagtacccagaagtctttcctgaagacctcactaccatgccacccaagcgagagattgaattccggattgatttggcaccgggaaccgcgcccatttacaagaggccgtacaggatggcggccaacgaactagtagaggtcaagaaacaggttgatgagcagctgcagaaagggtacatttgaccaagtacttcgcattggggtgctccggtcatttttgtggagaaaaaggataagacgaagaggatgtgcgttgattatcgcgcactcaacgaggtcacaatcaagaataaatatcctttaccgcggatcgatgatttgtttgatcaactgaagggagctaaggtgttctctaagatagacctgcgatcaggctatcaccaattaagaatccgggaagaggatattccaaagatggctttcaccactcggtacgggctgtatgagtgcacagttatgtctttcggacttaccaatgcacccgcattcttcatgaatctgatgaacaaagtgttcatggaatttctcgataagttcgttgtggtcttcatcaacgacatacttatctattcaaagtctgaaaaagaacatgagcagcatctccgtctggtgctctagaagttgaaggagctccagttatacgccaagttcagcaagtgtgatttttggttgacggaagtcaaatttctaggccatgttattacagctcagggtgtggcaatcgacccatcaaacgtggagtcagttccaaatggaccccaccgaagaccgtgtcgcagatttgaagttttcttggacttgcaggttattaccgccgattcatcgagaacttctccaggatcgcccgacccatgacttagttgcttaagaaagatgagaagtttaaatggacagctgagtgcgataagagctttgaggagttcaagaagaaattagtatccgcaccagttttgattctgcccgaccagatgaaagacttccaagtctattgcgacgcatcccgccacgggcttgggtgtgttctaatgcaggagggcagagtggttgcgtatgcctcgcgacagttgcgtctacacgaagggaattacccaacccatgatctagaattggcagcagtggttcatgctttgaagatctggaggtactatctgattggcaaccgctgtgaagtatatacggaccacaaaagtctgaaatatatcttcacccaaccggacctaaatctccaacaacgaagatggttggaactaatcaaagattatgacatgagcattcactaccacccggggaaagccaatgtggtggcagacgcattaagcaggaagagttactgcactgccctatgcatcgagggcatgtgtgaggaattgcagtaggagtttgagcatctcaacgtgggaattgttgaacacgggttcgtagccgctctggaagcacggcctacgctcgtcgatcaagttagagccgctcaagtgaatgatcctgaaatagcagagctgaaaaagaacatgagtcggaaaggctcgggatttccttgaggatgagcatggcacaaactggatggggggaaagattgtgtgtacctgacgacaaggaactgaaggatatgatactcaccgaggctcatcagacacagtgttccattcacccaggcagcaccaagatgtaccaagacctcaaagaaaagttttggtgggccagcatgaggagagaaatagctgaattcgtcgcactctgcgatgtttgccagcgagtgaaggtagagcatcaaaggccagcaggtttactccaacctcttcaaatcccggaatggaaatgggaggaaattggaatggattgtataacaggactgccccggacatcatcaggtcacgattcaatctgggtagtcgtggatcgactcaccaaggttgctcacttcataccagtgcataccacctatacgggaaagaaattggcagagttgtacctggcaaggatcatgtgtttgcatggggtacccaagaagattgtatctgatcgagagagtcagttcacctcaaaattctggcagaagctgcaggaagaattggggacccgtttaaatttcagcacggcctatcacccgcaaactgatggtcagaccgagtgagtcaatcaaatcttggaagatatgttgagagcttgcgctcttgattttggtggagcttgggacaaaagcttgccatatgcggaattctcgtacaacaacagctaccaagccagtctacagatggtaccgtttgaagctttatactgccggaagtgccgcacaccactcttctgggatcagacaggcgagcgtcaactgttcgggacagaggtattagcggaagcagaagagaaagtcagaaccatcagggaaaggttgaggattgccctgtctcgacagaagagctacacggataaccgccgaagggagctcacttttgaagcaggggattacgtgtatcttcgtgtcactccgctccggggagtacaccgttttcagacgaaaggcaagttggcaccacgcttcgtgggactatacaaaatcttggaacgaaggggggaagttgcttatcagctagaacttccatccaatatgattggcatccacgacgtgttccacgtgtcccaattaaagaagtgcttaagagtacccgaagaacaagctgattcggagcatattgatatccaggaggacctgacatatgtggagaagccggttcgtatacttgataccagcgaaagaagaaccagaaacaaggtcaccaggttttgccgagttcagtggagtcaccattcagaggaggaagcaacctgggaaagggaagatgagttgaaagccgcccatccgcacctcttcgccagctcctccgaatctcagggccgagattccgtttaaggggggtaggtttgccacaccct

SEQ ID NO: 80618 - DNA, 4080 bp, Oryza sativa
tttctttattagtaaaaacacagtttatcttctaaaattcataagtaattcatccgagctccgtttaagtccattcaagtctcagtaaatcaagaaaaatgcaaagaatccattaaaaatggttttgtttcctgtttcagtagtcttataccatgttttgcttgtgtgctttgtttgtcgcgtaggtttcggccgtttcgtcgatccgcggtttctcgaagacgttgctgaggtctcatcagttcgagagcaaggcaagtcatgcaatacgtttgatcatattgtacccaatttaccaatatcccgcatttctattaaatgttgcattcttttacaatgtaatgtgggatgggtcctattcctcagccacatattggttaccttatgccattgataacttgggtatcaaaatgactagatgttggcttaggaaatgcttagccatgcttagttcaactaggacacaaatggggatcacattattacatagactctgactatgggcatagctttagattggtgccaccgcaagggtgtcagttaattaaaatattctgaatggcgggctatgagtgcatggttttgctggtcgcacccatggcagttaaggaccggttcacgggaaaccctgggagacttaccgtgcttaccacaagcgggagtcggtaactgcttgatctgaagtatagctcgaccctttcctaggcaccggtggcgagggtgggcgtgatggagttgggtcggccgaggtgttcggttgtccagttgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagtcgtgcccgcggttatgggcgatcaaccagattcaccgtgattagtctcacccctagtttagcttaatgaactggtgtagttcaggtggttggttgggcctgttgcaacgtggtgtagcgttggacagtgattggttaatattgattaattactacagctgttttactgctttcaaccactgctttgaaatgcctgctttatgcaaaagaacccctagcttccttcggttatatcatgcatcatacctcctcttccggtatgacttgctgagtacagtgggtagtactcagtcttgctctcttttcccccacaccagagttgaagttcttctcagttggagccgtctcagagaggttggtttcgtcgctgccgtcaaggtttgcctgtggagtggagtcgcccgctgctgaagtcaagcttcccggtttagctcgcttttatctttcccgctgcatttgtaatcttttatatttttgtaagacgtgggtctgtatgtcaacaattgtcgtttgtgtaccctggctggtcctggacagggatttaatgcacattcagcttagaaattctggttcgagaatttctgggtgtgacatcccctcccctccgctgggccggccgaaggccaaggcccagctaggccggccgcctccctcctcccacccgggacgccgacaggtgggccccacctgtcgggcccgtctcctacctcgcgcccgcgccgccgcgcccgcaatcgccgccgcgcccacgcctccgcctcctccgggccacgtcggccacacccgcgcgtgcgccgcacctcccacgcccacttccccctctctctcgtccgctcccgtgcccgagatggccgggattcgattttcgaatcccgcctctcctctcccactccccgcgttggccggcggaatctcgcccctaccggccacgtccgggactcccctcccctatttaagcttccccgtcgccccctctcactttttccccatttcgccgaactccctcgtgccccccatcgctcccgcgccgtgcaaccacccgccgccgccgcttccgttactccggttgccgctagccgccgctagggtcgccgccgcaccgcgccgtcaccgccgtcgggttcgcgaggccaaactccacctcgtccgccccttccccgtcgggattcgtcgccggaattcacatcccctcgcgctccggtgagttctacctctaccgccgccttcggccatggatgccggccgccgtggttcatctccctctctctaatctctctctcttccttccttagggcaccccgaagcccgtccgccggttgccgtcgtcctcccgtggctcgccgtcgccgttcgccgtcgtcttcctccgcgccggccaccctcggtgaggcgtcctctcccctctactcccctccctctccctcctagtaccgcgccgccgcttcaagtcatgcgccgtcgccttcggccgccgccgccgcctcccgtgccgccggtcgccgtcgccgctagccctggccggccggccggctttgatgccgagccgagcccggcggccgcctctatcgccaccgcccgatcggctcggggccgatctgggccgtcggtcccgtggactggcggtggaccacccacgtggtcccggtccacggtggaccggccccccctttgagccgctgaccagtgggacccgcctgtcggcgccgcccccctgatgacgtcagccctgggagttattgcgcaataaattatttaaggactttttgttatagtaataaacacagtgaatcttctaaaattcataactaattcatccgagctccgtttaagcccattcaagtctcagtaaatcaagaaaaatgtgtagaatccattaaaaatggttttgttctctgtttcagtagtcttatagtctgtttgcaatgtttgccttgtatgtcgctagattccggttcttccgacgctccgatgtacttcgaaatagtcgccgaggttcctccagcagcagagcaaggcaagtcatgcttgtcacttgatcatgttgatcctatattgcaaatgttctaatgttttctttcaaatactgcatttgttttgcaatatcactatgggatgtttacctattgttacagccatgctattttggtaccttgctcctttgttagctcgggttataacatgaatagacgttagactaggagttgcttagccatgcttagttcaactagcacacaatggggaaatctcatttaaaatatagactgtaggttcatatgataatgttggtttagtaccaccgctttggtgttggttaattaaaatgaatcacatggtgggctgtgggtgcatggttttgcttgtcgcacccatagcaattaaggaccggttcgcgggaaaccctggaagaatttatcgtgcttaccacaagccagcgtgggcaacggctgggcttgtagtgtagcttttctctagctgatgcatccaggcaagggtgggcgtgatggagtttggatgggccctgcgacggcctatgcggcttccggattcacctaggcatgagaggggattgcccgtcgcccgctggggatgggggtgaaacctgaggtgtggtgtgattggctagagagggttatgcgaagggtcctgtcacggcctctttccggtgtgtcgtggtggcatgtcggcgcacgaaaacgtgttgtggggctgtgtcttgtgggtacagttgtacacctctgatcagagtaaaactattcgaatagccatgcccgcggttatgggcggttaaccagattcaccgtgattagtctcaccctagtttagtcttttgaaattggatagtataggtggatggttgggcctgtcgcaacgtggtatagcgttggatggtggatgattaatattgattaattattacgactgttttcttctttaaatttctgtttataaatgctcgctttatgcaaatgaaccaccctagctctcctttgataattccctgcatcatacccctattccggtatgacttgctgagtacagtggatagtactcagtcttgctctatttttcccaaccccagcgtacgag

SEQ ID NO: 80619 - DNA, 37621 bp, Oryza sativa
acatgtgtgagcaaatattattaatgcaaaaaaaaagaagaacaaaatggatttttggttccacaggtttttttttctccgtgagagagggggggggggggacgtaggataagcagctttgtttcttgcttaggaatagtaatatgctgtacttaataaattgtgaattaattatcttccaagattccaactgagagtgtaaaacaaacaccttgaattattgttccgaacagtctttgcattgccaaaagcttcaaggactggattagactacatcaaagcacaattaagtatgaaggattagtccaggcaaaagtaacacatcacttttaaaagccttcacttccatttggaaggacagatatattgttcttaacaatgtgaaggactgaaaaatattaatgatccctaacttacttctaaaacttgttgttcaactgtcctccctcctgttctagaccgtccacccaaaaatgcaagatatctcataagcatctttgtggtttcagtcttgccagcaccactttcaccactcaccaatatggagttgctctttctctcattcatcatttgcctgtttccttattcaaaagaatgccagaaaagatgccatcattattggtacctccacctgttattttaaagaaatatacatcgatagcattctagggaattacctgtaagaaatgtcagcaattgcaaatacatgagggtctagctcaccgaaatttgcacctttgtacttctccatagtatggggttcagcaagatgaggcaacctttggaatggattgattgcaatcaatatattaccagtataggtctggaattcaaaaaaaaaaaagtagaatcagaaaagaaaggagagggttgcacaaagccacaaacttgtttttctttggctacttatgatgatatgtttgagtatgcaaatactcacgtaaattatattttttgcatatcgaacagatagattgtttaaaacaccaggctcatgcaagtatgatagtcttatcatatcatcaattccatcagaatgcacttctgtgtcctttggatgaatgtctgatatgctcgcaacaacctggtttcacagaattgaagtaacaaagcaagtttcatgacatgaaatatatcaatatagatcatgcgatatatgtgaataacagtagtacggatcatattattaaactatatataaacaggaacggctttgcatccttgatgcagttcaaagttcaaaccaaaagaaagaaaaaacttgaaagcgtgttcagtctgttctgataattgttatttctcaaacgattagattttattcgatgttgaaaatggatagtttataggtgtttttatggctaattagttacactcttaattgaaatagtttccagtgatttcagcactaaaatataaaggctgttactttatggatttattgacaactgtgccaattttaatttgcaataagagcataaccatgcacacactactttttcatcaatgatgatggtaataataattaatgatgaagaagttaaggtgcaaaagaaaacaaatagtatctgatatcagctacaaataccatatttccgttggtagtgcggatatgggccttttgaccctcaattcggaagacctcaccatcaatccaagctaaatctttatcttccagccatatatgggagccaagaacaatttttaatgtggcagcctgcacaagccacaagtcacaaaaatccaacatgccagggaaaaaatcaaggttaataggtaaatggatgcatagatttatatctaaagtttgtgttccaaaagatgccaaaaggaattgtaaaaacactactagaagtatactataaataactagcctcaccttgcacacttacatacaatggtatgtttgtatttgccatagaactcatgtgcttgttgatgaaatgcattgtatttcttatctacgttgttatatttaggacccactaaaatgaatattatgctggtgtaggatccttttctttttttcatcaaattaattccataatttataactactgttttaaacttttaatgatacaatagatatataacatggagtacaaagcagaatgaggcatggatcactgttgaaatggacatgcatagtttaataaatctaagaatgccgtgtcaaaccatgaaaggatacatgatcataccgacccaaaaagcatagaatcagaaaacaaattcatgagacatatgctttaaggcgtaaattctagagcaaagatattagataaactaaattcttagcaccagtgctgtactaccatgaattgaaataagagcacctagttcatcacatatttggtcacgattatacagaatctgatttcaagacaaatgtaggaagttatggactcatcaccaaactagatatgagtgaaaactaattgcagcatacacttctctaatctctattccaatatggtggcacatagaagaaagagtgtgtcctgacaaagtgggctagtgaagcaatacttatattgagcaaattcagagaacacttgaacttaaaaaaaaaaaaggcttattctcatattcatatctaaaatgagtagacggaactggcttttttaaaatttttaaaaaaatcctttccggcgtacagctttgcttcctggtcgccacaaatcaaacgcttcagctatcctacacacacgagattaaaaatggaaaacatgtccgttcatcgggagcaatgaacaactcacactaatcgagtcacccgtcgtccatcggttcctctagagccaaagtggtcattcacaaaaaattccccccaactacgcgaacacagaaacctcacatttctctccaaacccaatgctaacagagaaactaacaaaccagcatggcaaccccaatgcccgcgcaacacaccgcggccgcacggcgcgtagcgacatcggaccgaacgaaaaaacaatgaaacattagcatcacccctcatctcatcatctagcagccagacagccagtagccccagcacagacaactcaccatgggtgtcgcgcgcgatcaccgcgggaggggggaagcaacgatcgccgaccagtgcaggggtggggggtagaatcgggccgccggcgcctccgtcgtcggtatcggcggccgtggggggggggggaggcggaaggcgcggccaggccttcgatcgatccagcgcgtgcggtggcgcgcgatgccagcaccgaggtcgcgtgggggaaagggaaggggagggggaggaggaggaggaagaaaggggcgatcgaaaggtggggcgcggaaacagagaggcgaggcgcgagtgccatctatttttggcgctgcggggggtgggatggggaagagagggatgctgctcgccgcgacggcgccaccggtccagcgccgccgtggcattttcgccagaaaagcccaaaatgacgcggagagagagggaggagggtttggcgccggatggtgcggccgcgcgagcatgtagggaggaggaggggagccggagcccggggcggcgtgctctgccactgccaccagtctgcctctgtggctctgtgccgtagtaacttgtaacttgtgtcctggctcctggtcccctggacggggggactacgggtgcgtctgcgagcgtggctgctgtcctgtgtggtgtggactgtagaggacgccacggcccacggccacacacgagacaagggaaacgcagggagattatgggcatgtttggtgaagctttgtagcggtagcttctcctaaaattttcagaagctaacttccaaacagtttatattttcatctatattctgaaaagttacagttatagaatccagaaaatgaattagaagccaaaagttgggtttgtcagcttttctaaattctcaactagcttcttacccgctgcttctcaaaattttacactcaaacaagacctatatactcccttcggccagaaaattaatttaacgtttaaaactttataatcactaatgctaaattaattaaaaaaggtatatgtatcactaaagcctctcatgtagtgtattcttctagcattaagttagattattgcaatcttgtttagcaacagtattagacttttgatgtttactatagctaactaaatgaaaccccgcgcgttacagcaggaattatgtataatagtattaaaaaaatataagacaacatataaataactttatatgttttatataattttcatctttaatcgatcatcaaaaagttgtaaacgattaagatgaattggtttataacaacttaagtcatatataggtttatcattcaaaagtaaactaagatgatgtgtctcaatgatagaaggaaaacaagggagataattaatatagattaatcatccaaagacaaatctaaggtagtatgactttataggggaagaaatgaatggagataatttgaaccatggatcaatcatccaagtgctaggaacaattgaggtgatgtgatttaatgagatataagagaaatattattaactacacttagcgtggatgagctttatagatatataggattactctttttatctaagttgtattagtttataatattactgaatgaaaaaatatggaacaatggtgaacggcgtagccatagacgacacaatgtttgcataactttaattaaaatggtttgtgatatataatacaatgtttatgtattatattcattctaaaaaggtataaatcaccacattaatctgattaaacaaagttatgcagcgttttgatttgtggttgtatttgtctagatagaatggtgcaaattgatagatataatttgtatataaaatataagtgtgagtatataggaacataaagcaagagttgtatattaaatccaattatacttttaaaatatagcttcatgtaaaattgtacgtgaaaacggtcgggaaccatttaactatttagtgtcaacaagcaatacgatgctaaaatatttcttttaagaaaaacatattttatattggctaagataaaaaacggtatcacttaattgtatggaaataacgttcaatcagtcgggaatttccaataacgttttcatccctgccactagttgatttatgttacctaaaattatttttcttttaatatattgacgtgcaatccttctgcgtgttcgcaaaaaactagttgatttatgtttggacataaagagaaataacattagagaaaatcttgagaagaaagacagatagaaatccaggtgtaggtaaatgtttcagatggtggttattgagggaatcaattaaacatgcaatgcaacaacaaattcaagtctgagtagaatatttaaaagtccttcataacatacaaccaaaatttcaagctctgtacatttttattgcacggttaaacagtatatatatgttacatttcccatggctatattacctaggctcaagggggatagttgggaggatcctcaagagcacagaaacacagcagcacagcatttgatcactatcgctgcaaaccagccaggccggcccggccttccaatgatcgaaacaggcaaaaaggacgggacagagatcgagagaagaaaaggggaaaaaaagatccagctacatccaaaatgacccatctgggcatctcaatcaagaggctgctatctcgatcaagaatccggcccagaacacctacactattagctagctagcattggaaaagtcccatggctgacccgatcgatcaaattaaccgtacgcgcgcggttaattgagagaacctggcggctgcgtgccggcgacgaagaagcggccggaggcggcgtcctggctggcgtagtacaccgtgctggggctcacgtggttgtgcgtcccctcgtacgtcgtcaccacgtagctcgggtcgtccttgtcccgctccaccctcttcttcacgttgcacccttccgtcgagcaccggtagtagttcctgcaacgcacaatcgatcgatcgctgttagttagcgatgtccattcattcattgccaggaaagagacttgcacttgcacatatagtatatgacgatggaattcgcgtgattaattgcatcatcggtgtatttgatgatcgaagtgatggcgacgacgacgacgacgggatgatttatgatgatgatatgatcatcttgaattttgtgaaggggatatgattttggtttagttggttagttagtaccttgggttggggctgttcttgacggacttcttgccgtacttgcgccacttgtagccgtcgtcaagaatctcgatctctgacttcgtccggaacgcgatccgctccgtccgcggcctctccacggccgccggcgccggcgccggcaccgcctccgccgcgctcctgaattttcccgatcaaatgcccccaattcagaccaaatgaacaggtgattgcacacttgagagtagtactctacttgacaagtgacacacgccactagccactcaccttgttgcgtttgcggcggcgccatccggcagcgcggcggtgggcgcgccattgaacacggcggccggaggcgcgtcgtcgaagaagaactcggagatgtcgaactgcgaccccgacgggtcgggaagcggcggcgtcgttgcggcggcgagggcggcggagaagctggacgcggagctggaggtcgagcttcccccgtgggagaagtacgatgacatcgagtaggcggcgtcgcccgccggcgccgagaggcccgagaccgggtggtggtagaccgctgcgtgcgcgccgactgccgccatggccgagtacgaggccggcgcgaaagctccgtatttataaggattggcgctaaatctgcatggatatgaggggatgatgtagtggtggcggggtggatttgtactggtagtagtaggcgatcgagagggatgagatcgatcgtgatcgatcgcacgcggggcgcgggggagctggttgtgttgtgtttgtgtctctctctccgggaggattttgccggcttcgcggtgagcttcgtgaggagggagaaggttcggagcgggtgcgggagttgccgcgcgcgcgccgccgctcgaacgcacgcacgcgcgcacggcgtgcccacttattttagcagcatggcggaaatgtctccgggggaaagacttcgacggggtgcggtcttcgcctcttcgccacgtagttgccgtgggggccttctcacacacccacggtccatccggttcaagccgctttctttgtttgggttccctgcgagttggttggtgtggctaaaccaagaaattttgggagggggtgaagctaggagataggatagtcaagaaccggttaagaaaattttttagatatagtttatttattttcattaaatatgcactcacttaatttaaactcagacgcttatatcagtttaaattcgatctaaaataaaacaaattaaatgagtggcatctctctttattttattttagctccgtctactttggactgagcagcgatagcgattttacccacggatactgtgttcgataggcacgggcatgtgttcgacatgtctgacatgatgctcccaaatcatatgtgctgattcataatctctgtttagttatctagccatgcatatattatcgatgtttttaaatacgcacccgacaccgacgtgggcgttgatttttgcctgctaatactatcgtgctccgattgtccaagaggtatcgggtcttggatcaggtgtgttcctgctttgcccgagtctaatcaaacctattgacaggaaagttagagatattgtagctaccacagttaaatctggtgtatttatcctttttcgcttcagccattattagtcatgtattttatgcctgtaagatcctttttatcccttagcaaaatttcacaccctatcacattaaatgtttaacacatgcatggagtattaaatatagacgaaaaaataactaattacatagattgcatgtaaattacgagacgaatcttttaaacctaattgcgctatgatttgacaatgtggtgctacagtaaacatttgctaatgatggattaattaggcttaataaattcatctcgcggtttacaggtggatcctgtaatttattttgttattagactatatttaatacttcaaatatgtattcgtatatccgatgtgacacgtcaaaactttacatctggatttaacacaacctaagttgtttatgaaagttcaccggtcggaacatggctcattgaataattagctcaaaactcatgaatttcgtcaaattccacataatctcacatatatatatatatatatatatatatatatatatatatatatatatatatatatatatatatatatataacttcgctagaatttcatctaaagaatttttctcatgagacactacccacttaggtagtgttcgtttctacttaagatggagatgaagttatggaaaaaaacaacaatgtcattagctcatagttaattacattttaattattactactatagataaactttaaaaatattttatataatacattaaagcagctattatatactcactccgtcgaaaaaaaacttaacctaagaggggaatctcgacaaaggaggttgtccaaattctttatccaggatggtcccatcctcttcaaggttaagtttattttagacggaggaagtagaaagttttagtgcaaatgcaccattcaacaatttaaaaaatatgataacgaaaatttcatgcctatgcggctatgcctaccaaaactgtttcatttgatactaacaatcactgtcaataatcaatatttacttctattcgcccatgttcggccagcaggcgggcacggccaggccacggtcacgctcttaccgccgatcgccatcacccccaccgccccacagtacaaaccatccaaccccagccgccatccgatggcgtcatcagcaatacgccgagacggaagttcaagttcaatcattcgagcttttcgttgggggctcggctggtacggtcccaaaaatgacggtattctccggaaaaacatataacaggttcgtagcactacaaacgtacactatcgagcactgtggtcactttattagtattttcgctttgctgtcgctttcgtactcccgaaaaatttagagccgaacaccgtgcagaactgcaggaattaagcatttaagcgttacccgtgggctcggattcctcattcctcgcagcttcctgcctgcccgggctgcaggatgaacaagctgattattattggtcgtgtaacgacgaagcgcccggtccttgtcgccggccgctgccgaatccatctgcgtacgtggttcggcgggcacggttgacctccgctgatcgatcgctcgcttcgcggcttttgcgtggtgaccggccacgcataccacacctagtagtagtaatagtacgaagtactactccctacttcctctgtccaaaaataaaaagacaaacctgatttccgtgctcaacgtttgaccgttcgtcttatttaaaaaaatataaaaaaaataaaaagacaagttatgcataaaatattaatcatgttttatcatttaacaataataaaaatacgaattataaaaaaatttcatataagacggacagttaaagttggacacggaaactcagtgtttgccttttttttagacgtagggagtacgtatcacgcatccaatccggtgtccgatgggcgacgctgatggctcgcgcgatggtgggtggcggcgaacacatgcgtattatcggggtgcgcgtggcggggaatggatgcgtatgtgcgtgcttgtgagcgtgtccacgtcgcgcgcgggcgctggttggaatcggatagggcgtcgttgtgtcacttttttgcgtcgtccatccgtcatttttttgggggggaagggtgagccggcggacgcaaccgatcgacgggtgcgagacggtgtagtgtgtaaccgtgcgatgggagaaagtcagaaagagatagcacgtgacctcatgaagagtagcaatcggattggttttctaacgcacggagcaatcgaacgatatatgcaaacatgattcgtccgaggagaaaagaaaaaaaaaggaaaatgatgcaagcatgattgaaaatgggatattggtacaatattttcagcttctttttgtttctttgaacgagaaggcaaagagccctgccgatcaattaagaaggaaaaaaaagacaacccatttgtggaaccttaaaatgaactactcttgtttctaaatatttgacaccgttaactttttagcacatgtttgatcattcgtcttatttaaaaacttttgtaaaatatataaaactatatatatacatataagtatatttaacaatgaatcaaataataggaaaataaataattatttaattttttaataagacgaacagtcaaacatatttagaaaagtcaacggcgtcaaatatttagaaatggatggagtaattaactgtcaactattttaatgatctaatctacatgagttgatttgcgttttaaatattgttcttttattatattgttttatttaaagttagaacaatagctccgtgaatcaatcaagggaataataagggctggttaatcaaacctattaaaaatatcaaaccacgaaggctacagtaacattgagagagtagtagtagtacattatatactgcactcattagaaatgctcttctcctctcatccttgttgagagtatattatatttaccttcttaattataaatttgtcattatgtctcccatcccagtagcgcctcaacgagttagataatgatattgatgttattttaatattatttatgtatagttttcttcctgattctagttttttattaccacttttccttcttcgctagttaattaacgacgctagcgaacctagaaagaaaatgactgaaatctttcatgctcatctagctcgtgcaacgtcttttctcgggtggctagtgtaatttggtcggggtgtcccacatagatacatactcgcaccatctcataatataaatgatcttagagggatataacacttgtctagattcgtagccttaaaaagtgtcacatatctatttaaaatctcttatattatgagacggagcgagtatattataactgtaaaaaggtttaacgatatttaaggatctatgttaggccttaattagtaggtacgccctggcagcgacagcccctttttcctaatttagtttcttgtggttttcttgcgaatgtgtacggttgctacgacaccaaggcacgcctaaggttaagagatcaacgggaccactgtctggacaattgtgattgatgagatcgattatgagaaccaaaagctagcgaccaggcatgttataggaatcagcactgcaatacgtccgactcccatcttacccaacctcacctgccaatcgtttcgctccacgcagaccagcttctctccatgtggaccagggcaattagcagctaagagctggtcggataagagtcgtatgtcacagtcgtgtgtatagcattttcgtataggaatcattttttttcttttcgaaatgtaggcaatgctctaggaataatcgtacggataagcgccgtggtggctggctagtagggatggcaatgggccgggtcgggtatgggtagaggaaaaccatgcccgacccgatgcatgacattgcccacccgaacactacccattagagttagcggacaaaactccattcccgtacctatgcctagtgggccgggtacccaatggatctcatatgaataacaacttgaaagatatgtaatttatcaaagagtaataaaatcaataatttaccaaattatcggttatcaacaataatttgaattacatcacaagttgatcacaacttagtatcagttagtatcacaaatgaaccaagagaaatggtataagaattaagaaatgagttgaaattagctaatacatatgtatcgggtcgaacataggttacccacaggtaaaaaatgaaacccgtctattgcccatgacgtcttcaggtctcgggcgggcatgtccatgggtaaaaagtcacacacacgcccgtgtccattgggttgggtatccacggatacccggacccatggataaaattgccatccctactggctagcagccacttgatagcaaaatatgcgcataatacaggaacatagcatagttaggacaaaattatgcgcctcttgtttccattcccaggcgactgaaactatcaaatacttcaatactatttactccgtcccacaaaacctgacgtttaaagatttactagtgtcccacaaaacatgtcgtttaattgtcatctgttttgaatttttgaatatgctcatgattgctttgctacgtgtaatttttgtggccataggttcatagacatataggtactcttgttgaatgcactgcactcagtgaaatgacagctgattattaataagtgagagcaacatgatcatcttttcttcaagctactaatttgctttttaaaccttaaagcataatgttttatgagacagagaaaatactctggagtcgagatactaaaagagagccatatcccacatgagcactagcaacaaaaaaagctggcacaaacaccacatcccacatgtgctcccaaacgaccaaccatcctcaccctttcctgatttaagaagcttccacgcgcacccgaaccaaacacaactccatcaaaaccatcaaagccaggtgccccctcgtgatcgcgatccgatgccgatcgtctgtgacttgcccgcccgatatatatttcctctcttcttggaaggctccacaccgctcgcccgctggattggcacgcagcgcctggttggctgattcggtgccccctcgcgctcgcgcacgcctatcaattccgttgctttctgcagcgacgagccggcgcgaataggcaggtgtgtttgcttgcgtgatctgatagcggcgttcccggccgaagtggccgcgcgcgcccgccgatccgcgacaccacgagcaattagcgcctagctcgcgagagatgcatatgagagcaggtacaatagtacaatagtaggctataagccagctacaaacatattttaaagagataaaggaaaagagagaaaagcagtgggctacagatctgtagccagctacagcacgggcttcaagacgtaatgtgtgtatgacaggtaggaccagatattaatagtatagtaagcagctattatatgagttggttattatattgactataaatgatttaaagttagtagtgggctatagtattaaacttgctctgaggcgcatcaagtcagcgtcgcgatcgcgggcgccgcggaacctgccacgaacgtcgggccgtttcagttagctgttggcacagaagcggagccttttcgccggacgggcacgtggcgggatctgtgcttttttgtgagagctttggtgctcatcatcttggttacgtgtacttcgctctcgtcgtcgaaaacaatcagcaataacgacggtcgagaggtgacgttaaattcgcacgatatgtcgtagtacgtcatcagatgctagcgacgctagcttccggttaatcagaatgaaggaattttatgaggccagtataattctaccgggcatcacagaaattaatgaaatggaaaaaaaacaaaaacacatttccctgtacaatagtaatacgtagttggccatgttatatttcaacttttttcctcaaactttcaactttttcatcacatcgaactttccgaggcacacaaacttccaactttaagcaaccaaaactaattaaataacacactgcacgttttatttaattactaaagcaggacaagtacatactcactcaacttgtactaaattacacaaaataaattcccaaagttgccaaagaaacagcaaggttgcatgcccttgcgaccgtaaaagaagaaccagtcgatcatactactaccagtattatactgtacaatactagccacaaaagacgggtcgtgctttcccatgattacagttaatatagtagtattgaattattgattcttggtagtcatttatagtatagattctagaaggtctttgtctgaggtcgatgagttggcagtcagtgattgtcataaacaaaaacaatagggagtttatcttgaacttttcggaaagtaaccaagcaaatccaagctaatagtgcagggtgcctctcttttgtcttcgtctagagcctgtctgtttttgtctcgttgtttggggaattttttagtttttagtttttttttaatatttacagaaataatctatcgacaaaaaaaattgcagaaatagctcctgccgcccaaatggtgggcggcaagctgacgtggcagacggtgggtcgaccgcgccgtctgccgccgtcggccaaaattgcgattaggcccttgccgcccaggggctaattgcaattttggccgcccataaagagcttgcggccgtactttttcatctgggtcccttgccgccccagggacccagatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcgtagaaacattatatggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaagcatgacagtagaaatttcaatatgctaagttgtccgataatagctaacccctacgtgaggatccctctcctctttcaaaccgcgctttagtaaccctgtattgctctagtagttcaagctgcacaacacggctaggtggagttagaacccttctggtatctatccattctctgtattgacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaacctttgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctatgtaagtattgctcaatactttcggatgcgaaataccagcgaccttgtaaacggtggttaggtcgagaacgggattttctgtatcgacccactcgatgtatgcgcaagccgtagtgcgggtctaccgaatagagtagtgttacgaagaataaagcgattgcccatacggaatgaataagcatgtgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacaccccggcgtctagccattgacgaaagccggtcggatttgtaatgaagcaagtggggaagagagtactgaatgtgactgagttctgaaagattgtgaggcctcactcattaaggcgacttatataggcgcaaaaaatcgagtgatacccctgacatgtgaacatggtggggtatggtgggtacgcctgattggcgccgaaagatacatgcatgatcggcgccgaatgttacattggtcgtatgcgccaaatggcgggcaaatactcgtatcacacgcgaataaaggaggctgcatcggtgcggcagaaagtagtcgtgcatgcgccgaaaggtatcgtgcacatataacaacaacgtagtcattacacaagcatacagtactggaaagtgaagcaagtaaacaaagagaagactgctcaactggccctgccccgcgccgcgaccacgcttggtcctccgggcctgtgctcgcacatggtcctgggagtaggtgaaacgatccggtggcacagtacgggtagacgagtgtcccgcggaggagtggcctgcgcctggtcctgcgtctgcaccggcggtgcgcctcccagctgtgaggggccgatgacgtcctctgtcgagcctgaagcgaagtcgaagtcagtgatgtcgaagagcacggtggaagacaggaagcggtccgacgaggtcccagcatggtccaatggtggaccctgactcgacgtgccggctgcctgtgatgctgaccctgcagcctgggagaagtgggcggcctgcgtcatagcgaactgggcgaaacctacacatcgacaacgggacccttgtaagctaagacataaaatgtatgtaaattgattgtggaagtaatgttgtttttttaagtacctgtggggggcacaacagaaggcctagccgaggaaggcggggtgctgaacggtgcacgaaaccctgaagcaatcggcaagtgaaacggctcacttatatgtgcgaggcatgtatagaaatagtaataaaaatacttacctccgtgcggagggggagtcggcctaggaacgtgcgcagctggacgggaaccagacggtacgggtggccgctgtacagctgcgtctgcccgagcaacgtcgtctgcacgacaggtgagcactcggagaatcgagcgcatcgactccaccatccgcgtgtacgtcgtcaggtgctcctctacgggtaccagaatccccgcgcctaaacgttggatcgtcattgaaccgtcaacgacgacccggttgatgtcgtcgacctgcatggttaatttgttcgtaaatattcgtaaaatttgacgaagagaaagacatgaaaacataaaggaatggtgcgatgcagggtactcacaacacgagcgaagtcctggtcgtggtgcctggcgtagaggtctctagtgctcgcaacgtggggctgctgctccaagggagcgaaggtgaccctagtacgggtgcgtggctggtaccagcgtaggtaggcctggtacgactcctcagcgtgtggctctccctcgtggtccacgacctcctcggttgcgagcaaccagtcctgaacaaaagtcgccaacttggcgggccagtcgccagctgactgctgacccttgcgcgagtacctgcgaattaatgtgtaatattagtgtgaaacgacagatgttacaaattattgtgaacaagcagattttaatgcaacaacggaaagcgtagtgcaagatcttactggtgaacagcagctgggacggtggtcggaaacggtactggaaagagctgacggaagccgaactgccgcatcacgcggaaagaggcgtgaggctcaacgcagatgtcgaagaccatcggaaccgtagtcatctagtacgcctggtccctggtgcagagtgtggacagacccaacggcgcacgagcctgggtagccgcggcactgtagggctcccacacgacgtcagtcatcagaaggcggtcgaactccatagcaaactcaggatacgaccgcctaacctggacgtgagcccatcggcgctgcaatatgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaacgcggaaccccagctccactgaggcacctcgcctactgcagcatcggcgatgctcctggcgtagtgcacgagtcccttgtcgatggcgtgcccgtgaccgccacagaacatcacccagccaaaaagccagagcaagtacgcctccaaacatcggctgtacgagtactcgtcggccttcgcctgtagctgctcaacctgcaagcagtcgataaaatgttagacaccttaactgcggactaaatatgtaatacgattgtcatttcggtacaaaaacactcacggtgaactgaagcagccacctcttcgtaggtccggtgttgcggtggtgtgccaacggctcgagcgggaggtgcggtgcgcgctgtactagtgcgaaacgtgccgtcagatcgtcctcccagtccacagccgtggtcactggcccaacagcgtctcccgcgagcggtagccccaacaagtacgatacgtcctgtagggtaggggctacctcaccgcacggcaagtgaaaagtgtgcgtctctggcctccatcgatcgaccaaagctgctaggagggacctgtccacagtccatcgtctggccgggtccgcgtcgccggctgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtacgtgcccggaacgtcccaagctgagccccctgcaccgcagtaaggtgagaccggtgtcagtgatctatcgccgggtccaacaactgaggtgtatcctgacgtgccatctttgaaaaatatagtgtttcgtgttagaacaattcaaaaatagtaatgtaaaacaaaagataacttgcaaaattatgaaatagtaataaaatcatgagattaattatgtacaacaagttgctatttaaatatagcaaacattactaatggtacataacgatgacgtgcaatttaacatatatgtagagttcaataatataacataacattaccaggtagaaaacatgtatgcttggtaacgactaacactgtccaataatccttccatttccccttatacgcgtgcactctccagggacaaccatctttttccttaacacaccgaacttcatattgcgaccggttcgacttggcaaccctaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctagttgaatgcccactggagctactacgtccccgtcctctcgtgcgttgacctcctccacagaagtctcgtttactttagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctcaagcccctcattaaccatccttttatagaaggtacactcctctcagccggtctatcaattcccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttgtgtaagccaatgcaacggtaatgtattgattccaaactagcaaatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcaaggcttcgccccttcttctcttctcctcccctctcttctttttttttcactggaattgaggagagaagaatgagggctaggggctgggcagcaggccttttataggcagtgaggcctgccgcccggccagagggcggcaaggggccgcctgcaaaatagccggccccgactgacttttttttgcattcgggccacttgccgccccaccagagggcggcaagggttttcctgcaaaaaaaccctccctccgtcaccgcccgttcctcccccgtttgccacgtcagcttgccgccccagaggtgggcggcagggtctatttttgtaatttttttggccgatagattatttctataaatattaaaaaaaaaatctaaaaccgaaaaaaattcgttgtttgggtaatcaagcacgtggggattaagaagggcccaggaagctctttttagcgtaagatattgcgattgacgtccactttgttcggcccattcggataacgaaaccggacatgcatgcatgtatctaagtgcagaatatctgccggctgaaagcctgaaactaatttaaaatatattaataccatttttttcctccaaaatccttgtggataatccggatatggtgtacgtggtcgggatggatctatcgtggggaccctcgctattttttttttttgctttacatacgtgtgagaagagctctaactttagctagtttgtttaatccctttactatttctttctggattcaccacttggtgtggtaaggtctaatcttactattctttcaacaactaccatctggtgctcgttagtgtaataggtagatgttcacggtggcttagacataagaagaatacgttttggtccaccatcagaaatatccaaaatatttatacatataagtaaatatacgtagaaaagtttaatatagaaacactatatataaaaacatttgaatccaaatcagaattcaaatacaaataggaagtagacatataaatattcggcctataaatttattagaaaaggaaaccataccaaaattgaaagaaaaaaaaacataggtgttcgtgtgagttcgcggtgcacaccgttccatcaaccgataggtttgacaaaaattcaacggacacatataaaatgccaaccaattgtccacgaggccacgggaatgttaatgaagagtttgttcataggcacagtcgcgtgtttttggactctgttttagttaaaacactctacgaattaaccccttttcgcatgtcgcattcattagtggattctaacaattctaaacaacgaagctatgttcaactctgtgtgctgctatcactagtatccaactatccattattcaatcagcaacacacagtcacaaattgaacacgagaattggacctcatctcatgtacacacatacacatggcatgctgcataaactagtactccctttattcctaaatataagaatttttggttggatatgatacattacagtacaacgaatttagacagtaaacttgtctagatttgctgtgctaggatgtcacatcaatctcttgtattcaaggacgaaaggagtactagctactactctacttttattagtatgaagtatgaacccacgcgatcgttcagtgagctagctgaagaatcacaccagagatactagctctgagagaagcttttatttcctttttccggaaactgaaaagcaggtggaaggagagcgacggctgagagtcgcattcaacgagtcctctgaccttgatctcctcctgccatttttttctgaagcttctcgcctgcaacccggcaggatccgagaaggaggtcagcaaggtcccggaaccggggtcaaggttgtccggccgtcgtcgccttggtggcctatccagcccgacgacctgggggtagcgtcgttgcatggacggacggacagcaacgtctcggctcgatcggccaccaccggcagcgtacgctcgctacctgtatgtcctcatcggcgcggacagagtgacagatccctccctgcttctgctgctgcatggtttcccaacacgccgtcgtcaagtttcaggatcgccatcagggcagggtcgaaatctgaatctctgaatcagccttgtgcaatcgttagaaaagtactagtactacaacttttgaagagcctgaagtctgaacatttcggtcagcgtcactgggcacccccatctctgaacagtgtgagccatcaaatgaactatatagcacatgcgatcgcactgtttggggagaaagatgaattcataactactactgtaaactggaaagcaactgtatgttttgttacagctgacaatgaagaggtcaactgctatacaagtacttctacacagaataccgacaccgacagaacagtcagaactgctattccagttagtcttttcctacctgggctgctgggcagatgcaagcagaagctgcttattactagtatagtattctactagtagggctgtgtttagttcagcgtaaagtttagattttggttgaaattggagataatgtgactgaaaagttgtggatgtatgacaggttgatgtgatggaaaaggactgaagtttggatccaaactttggatctaaacacagcctaggttaaaaaaatggatacacaagcgagtaacagtttcttatgcgagcttattgtacactgtgagtccataacaacttataattgtataatttcattctcagccaatgaacaaaagcatccaaagtgctagcaagcacatccgctggtatgttcagtatcaggggctggttgtgcaacagtcttgaagtagctggggatagagaagaaacaggtgtaagatgactagtaaacagctaatgctagatttgtttaggcttgaagcacttcagatgcaaacaagaaactgaaggtgtttcacttacatgtcctgatcatgctcatgctccagagcaagcttggcaatgcacagaaaagcactgtcaacattgtagtcgtctttcgcagaggtttcgaaatacggaatgttgcctttggagacgcaccactcttttgctttcttctcagggatctgtggccgggaagacagtacagaaatgtcaaattgtcaatgtctgtgcactggatttcgttcagaaaaagaaaaaaaaaggaagtgtactggactgttgtacagaagtttgaatgttcaagtaacttacggcacgtctgtttccggcatctatgtcaatcttgttgccgagtaatatgaagggaaaatgtttgggatctgatgggctagcctaaaaaaggagccgaaatttttcagttgcagtcttccagtactgttaaaataggacaaaaatgctgtactacttttctttttcctctgaaatgtaaaatggacttgtcaggttcttcataactagttcaaattgattgatattaaccaagcaacattaaattttcagcctgcagcagccattttggcattttgctgtatgccttcagtttgcatatgactaacagatgatgcagacattgcttctctgaactagtacaggcatcaggcatggccacaatggaagaggtaattgcagatgctaaaaacttttaaggaaaatatcctgataaaaatgacttacttgggtgaggaactcatcatgccaggtgttgagtgcattgaaagatcttttagcattgacatcgtagactagcatacagcaatctgcacctctgtagaacgccacaccgagactctgaaacctctcctgtcctgccgtgtcccagatctacatccaagaaaactcaatactgatgacagccagatggcaactttcatgtgaaagcatccaaatttttttgagaatagaaagcatccaaattgaatgggtgtatgaggctgacctgcaaggtgacaagcctgtcttcaatgagaacctccttggtgacgaaatcggcgccgatcgtcgccttgtactgctggctaaacttcttgttcacgtatctaatcaagagttcaagaaaatccaagcaccgatatttgtggtgtgctgaagattgtttctagttaaaaatatctcttctttttttctgaatgtaattccggttaaatgaatgaaaggtagtagtagaaaatattgagatttatcttctgaggatttcactataatctacagctaactgagcaaaattgatactactaaaaagctcgatgatatgcagctatggaggagaaggatactggttcatcagggacgtcttccccaccctgcaccaaaaccaaaaccaaataaccgatccaagtcaggagtcagggaaaaaatcaaacaagcaccatgaaatcaagctgacagaagcagggctagagcgattcgaaatcaagctaggaagaaatggccgggtctgtagccaaggatgagctagcgtagcgtgctgacccgctgtcgccgaggacgatgaccttgagcagcgtccgcctccgcgacgacgccatggccagcaacaaccgatcgatcaatccgatggacgcggtgatctctctatttagtcgatctcctccttatcttgaatcacggggcgcacggggagcgagggaaaagcatagtagctgcggaaaacgggggttcgtggaagaaaattccgaacccctactcaaccagaaaattgaaaaaacaaaaagatagaaaagaaacgggcccattctgtcaaatcttaccggcccggcccatctattagcgtcggcctcggcgttgctcgaagaagagaactccgaagtccgaacccataaaaacgattttttttaaaagaaaaagagagtcgtggatagaacagaataaacgggccaattgtgtcaagcactcatatctctccgttgccgtttttaatgatctcatcgttcagcgttcacgttttcaccgttcgatctgcaggagcgatcaagttcgtggtttctctgatcgtgatgtcatagagcaagtttaaaagtacaactaattattgctctaaattatctatagtcaatttaatagctaattcatataataattacctataaacatgtactatataattaattaatgtttgatcccacctgtcgtacacacatgtattttgaagtctatgctgtagctggctaaatttatagtccgctgctcttatctttcttttatcttcttaaaatatatttatagctgatttattttctagaggcgtgcagatgtgccatgcgatcgatttgagttgatactgcttaaagctgcacgggctggggctgtagatgtcatgagcgcggtcgctttggtctactcatcgtttgagcgatcgaatcgcagatcgttggtcatttgcgaattgcggcagtggctgtgtgtttatttccctccaaacttctaatctttttatcatatcaaatatttagacatacgtatgaagcactaaatatgaacgaaaaaaaaacaaattacgcaatttacatataaattgcgagacaaatcttttaagcctaattatgtcatgatttgacaatgtggtgtactggtgctacagtaaacatttgctaatgacgaattaattaggcttaagagattcgtctcgcagtttaccggcgaaatttataatttgttttgttattagtctacgtttaatactttaaatatgtgttagtatacgttattttttttttgccaaaacaaccaaacacggccggtgtttgttttctcagaagatttccgtttcgagcctgacctgcaaggtgacaagctcacaagccttgccgacgaaatcgttgccttgtactgctggctaaacttcgtgttcactatctaatcaagagtggaagaaaatccaagcaatgatctttctttttggtgtcctgaagattgtttctgcttaaaaattttctcttttttctgaaagaaattatggttacttaagtgaatgcaagtttctaattgtaaaaaaaaaggaagataagagtctatttgtttttggaggaattttaacacatggaaataggaaaaatggaggaatgagaatgcatgcacaactcaatccataggaatttttccataaggttttgagtggatggaaaatttcctgtgctttctctctacaacttgtagaaaaggaaaattctctttggtttttctatatctacatttggcattcataagaattaattcttaggaatccaaatccatccaaatcctttgaaatttctccaaaacaaatagaccttatatgctgaaagattgcactaggatatctaaagatctctacgcaacaaactatcagtctgacacaaaggttgatgctatggatgtgaataggatactagggttttcgactttgttctctcttcggtctctgtggtcttagagtccatattttctgagggccatctctggtcgttagctggtgtcacttttttttggggtttttttagaagggtagtgtggccttgccccctcctgctaattggagttgcgtctagcagtcgtttctctcttccttttctttggtttttctgatttgtcttttttccttggcataagccgatctgtctgattgcagtgtgtaaataaactctcttttcttctaatatattgacatgtatttttttttgcgtgtttgtgaaaaaaaagatgaagaggatactagttcatcagctcttccccaccctgcaaacaccaaaaccaaacgaccaatccaattcaggaatcgctaagggcgaaattaaacaagcaccatgaagtagagctagagctatgagaatcaggctaagataaaccaggactagcgtagcgtgcgctgacccactgtcaccgaggacgatgacctttagcagcgtcctcctccatccgcgacgacgccatggccagcaacaaccgatcgaccaatcgatggacgcggtgatatctctattcagtcgatctccttcttatcttgaatcacggggtactaacaaatatcatataaaattttagtactctgaatagtattacatatatctacaaatcttaattcaaatccattatattctagctgtaacaaaaaaaaagaaaattctaagttttaagagtgaaaagtacgtcagaatttttgtctttttacaactaaaatataatgaatttgaccataaaatttcacgaatatgtgtaataaagtacatgtctaattttttaaaaatatttattagttggcgtgtatgtaaaacttgtgtgtttcttgtctaaatcgatacagagagtgtttatatctaggggtgtaaagttttggcgtatcatattgggtattatgtatggtgttacatagggtgtttgggcactaataaaaaactaatttaacctatatttattactttatgcattgttcaaacgttcgatatgatagagcgtaaaacttttatgtgaaactaaacatgcccatatttacaacggcatgaattcagttatcccttttaatcgcgtcaaaagtttatcccttttaattataccgcctgaaaacccaacccccaattccccaatcctatgctcgccggcgataggattgaagtttcctgattcacaaatttccctagccttttaattcctctgccaatccgactcgaattcctccggcggcgggcatcgtgaatccgaacccgaggaggtcgatgcggacgcctctatttaatcgccaccgcagccgcaaggccatctctactggttgcttgatccccccagcaataggaggtagatctaccatggccaggatgagcttgagaccgagaggccggcggccgcgggaggcctgcggcgacgaccgcctcagcgcactccccgacgacctgctcctcctcgtcctccgccgcctcgacacccgcgcggcgctcgccaccggcatgctctccaggcgctggacgaatctgccccacgagctcgacgccctcgatttcagggtcagcgacatactcccgccgcgctaccaccggtgcatcctccgccaccgcggcgtgatgaactggatagcgtaccggcacgccatccccaatagcctgatgcccgccatccggaggcacgagcggcgagccgcgcgcgccttggtccgctccgtcgagagcttcatcgacgccgacgacggccgacctagccggcggaaggtcagtaggctgaggctcgagttcttcggcacgcacaacaccgctggcatcaaccggttgatctccaaggccatagacgattggggcgtcgaggagctcgaggccgtcgggaagccaatgtactggcgccaacctcccacccacgaattccctagccatggcctctgcaaggatccccgcgcgtcacgcctgcgaaccctcacgctcggcggctgcgtgctcccgccgctgcacgagtacggcggcgtcaccaagctcgtcttgcacggcatggcggcctcgacgccggcggaagcctacgagggcgtcttcacctcgtgcccgcagctgcaagtgctgcacctcgaatcatgcttcctcgaccggaggaagtccttggtggtggacgctcccatatcggagatcagggagctcgtcgtcgatgcctgcgatatcatttcggtgaagctgcggtctcttccgagactccagaacctagcctccatgggcacccaggtgctgttcgaccgccgcacctcctcctcctccttcccctgcctccggcaatggcacctcgcctgcctttacggcttggcccgcaagttcagccgttggctcgaacccgacctgacgctcgacagattcttccactacaccctggacatcaccgacctgatcgtccggttcaccggaccggagagatggatcgtgccgtcgtcttgctcgccgtcgccgccgttgctgcgcagcttgaggcggctgctggtcgccgacgtgccttcctcctgggacgcgtcgtggcctcgcatcctcctcgacgcggcgccttcgctcaagacccttcacattcacatcgccccgcgcgacgcgaagaagcccaccggcggcgagttctcatggcatcatcccaccgttcctctgcacaactatcgcttggaggagttcgccatggctggctttggagggacagtgagtcaggtatactttgtgaagctcgtcgtcggagcgtgcaccgcgctgcgccatgtctccattttcaagggaggggatctgaagtacaagggaaattgggactgggagatgccgaggttgcaggagaattcgtggaatgacaaggagaaagaaaccatggagaagcagatcatggatgcggtctcttgctcaacggatcatctccaaatagttctaggttgattcacccatgtagtagttataatcagcattagccattaggccaaccgatggcagcaataatttatcatgttcacttaattttatttagagtaagtggcccggtgaaaaatttaatttgtaatctcttttactcgaataatgtatttgctgaacctcgtgttcagcagtgtgtgaagtgtgaactcggttcttatttgttttctgtaatgtgtaataatttgaaatttgtcttactaattgctgaacaactatatctatatgtgcattcctggctgcatttcttttgtaacggagggtatacatgtgtgtgagtgaacagtattttttttgtgagaactttacgtttgtggtgatatcatgctaactgaagagctcaggttgctctgcaaaatttgtttcagctcttcagtatttgttgaagttggactgttggagcaagtaagcaaggttggatagaaagaagtgatcatatatgagtaattttacagtgttgaggatgtaccataagataccaaataagtgtcactgctattcgtctatttgtatgcataatgtcaacgagcaaaattaaaaccataatgttttccagcttctttcccaatttcttctcctcctcctctctttctctccttccccttctactagctggccatctccattgcctcgatgctagagctgccctatgcgcaagatgaccaccatcagggagccaccgccgtcggagtcgtacggactgacctactgccactgacaccggcgcggcggcgtggccgcaggggtgaggaggatgggggagaaggtttcggcgaacgagggaaggataggcagggggacgacatggcggcagcacgcaacaacacgcgacgagggtcaactcgaagatacagacctcgtaggcagagagaagaggggaggatggagcaagaagatagaactgacactatgtttaggtgtattttgatctatacgataatgaaaagcatgacaatgatggtatggttttaattttgtgcaaattcgaagagcatggataccaacagataaattgtaatagcatttatctgaatcaacgtatttgcaatgacatggatccaattaacccacttaaaatgcttatgagtttgcagatatcatatgtttttgccatccagcagactagcgctaatgcgttattgcaaagtttaggctgagttctatactctccttttgccaacttccactaactcatcttttgtgcgcacacttcccaaacgactaaatagtgtgttttttgaaaaaagaaactatataggaatatgctttaaaaatcatattaatctgtttttcaagttttcttagttattacttagtcaattatatactaattagccgttgcgttttacgtgcgtgaaattggttcagtaacaaaacatcctcaatctttagatcctgtgaggctaaaattggtttgatttaatatggtccatcaaagtttcgatatggcaaattttagtagggtagtcaattaaaacggcccttacatctcatctagggatggcaatgggtcaggttgggcatgggtagagcaaaaccatgcccgacccgatgcccgacattgcccgcccaaaccctacccactagagttagcgggcaaaactccatgtccgtacccatgcccggcgggtacccaatggatctcacatgaataataacttgaaaaatatataatttaacaaagagaaataaaatcaataatttaccaaattattggttatcaacaataatttgaatgacatcacaacttagtatcaattagcatcacaaatgaaccgagagaaatggtataagaattaagaaatgagtcaaaattagctaatacatatgtatcgggtcgggcatgggttacccacgggtaaaaaataaaacccgcctattgcccctaacgtcttcgggtctcggcaggcgtgcccatgggtaaaaagtcacacccacacccgtgcccatcgggtcgggtatccacgaatacccggacccatgggtaaaattgtcatccctaagtctcatccatctagctccaatgaaatgcaggattgaattttttttatataatgtatgagcatcttttccatccttgaggaggtaccatgaggtatcaatctaatctagccgttgatttagcagggtatgatcagacaaaaaaaacatgtgtcctctcttcgtcgttcgtgccggcagggacgtcacgcatcgagcccgcgcatccagctcgtcgccaatcgaggccgccgccgccgccgtcgtgcatccagccggccgccaccgtcgcccatccagccggccgccgccgtcatcgtcgccaatcgaggctgacgtagccggccgccgccgccgcgcgtcagtctgcctgccgccgtccccctcgagcccgccgcatctagcccccttcagccgccgcacgtccagccgccgccgccgccacgcgtccgtccgcccgccgccagccccctcgagcctgtcgcgtccagccccccccagccgtcgccaccgccatgcgtctgtccgcccaccgccgtccccctcgagcgcgcgtccagtcgccgccgccgcacgtccgtccgcccgccgccgtccccctcgagcgccggtccaggcgccgatgcttacccgacgatttttttcctctcgtgaaacaggaaaggacagaaataccctcccacccatggtaccacttcaatgaggaggtgcggtaccatgaggtgcggacgatttctgaccgttggatgatgccagatcaacgatcaggatttgatactgcacaacctcaaggacaataaaaaaccttataatgtatagaaatccagtatctatatccactagcagatatacaaaatcaaagttatacaagcgtatacactccaaatctcataactgagatataaaaaaaaaacaaacaactaaaaagaaaatactagaaggctgagctttcagcttttccccaacacttcaaacttcagagcaatgcgaaactagagcccgcactttcaccgcctcactctgtcattgtcgttgcagccaccccgaaagcttatgctctcaatcataagtggaggaagggacggaactaatcctttcatccgcctatcatcgctaaacattggtcttacgttgcccgaaccatggcatcatagcgtcaacgtcatagagcactgtctctgttgagctgccgtagcttatatcgccaaaagtcatcgctgctacattttcatcgctacaaagcacaacggccggccatcttcctgcaacgcaaaccaggctgctgttgtcccaccgtcgttgttgccgcaaatgcccacctccgtcgagctgccaaaggttatctccccgaaagaccattgccaccaagttgtcattgcgcaaatcgtgacctccaccaagccgttatagcttatctcactcaagagccaccgccaccatgtcgacctccacaactgtcgttggcgtggctgctgtacccggcgtcgctcctagtgcaccatcgagctgaccagccaatgccatcaccgagctggccacctgacaccaccgttaccaccaccatcactgccagcgcctcctaagacccttggtgccgttgccgccactataggacaaatacaaataggaatacataggattgaacataggaatagaaaaacataaaattttaatagaaatataagtgaaaaatagaggattgtaatacatggatgatcatttagaaacaaacacataattttgataggggaatgcaatacaagaaaagatggtttgattggaccgcatgaaaaacacatgaatcagatgggagatagatttgtaaaggaaattttgaagaggttggagctcttgctaactttcatctaaaatctccataggattgttcattccataaaaaattgagagataagattaaatcttttatttcacatgtcttcatagaaaattttcttataggtttggaatcttccaaaagtgccatgtaattcctacaaatcaaacggagaattgggtaaatatgtgaaagttttttccccttgattttaactaatacctctgtcccaaaataattttatttctatcattcaaatcttataaaaaaggattgttttataataaagtgggctcatccaattctaccctcccatcttaccatcgccatatgattcaaccttccttttattccatacatgatgtttattgaatatactatgaaatagcaaatcatccacattaaatttgtgcatgaagtgatggattaagagtgaatttctatcattacaaacaacattaaatagggttatttgagtgtactgctaatatctttgaaattttctataaatacaaatacgattattcctctataactaatttcatccaaataatattggtactctaaaattgcacgtggtttttgagtggtgcgattggcattatcgtttttcctacgcatcatctagtttacgtagtgcgtactcgttccggcatcatcttttttgtcatgtctacacaccatctatccatgcgcttactcgtttaaacaaatgacgtgaaacaagatcaagttcatatgcgttttattttatttttttttcttctttgccatagagacaacctactactagatccggttataaatatttaacacttgcagtaaattttagtccaacttttaaaattctgaccataaattttgtattcaaatatgtttgtaaaatcttattaactttataatattatgttagtattttcatgccgaatttacctatacattttaaatttaaactattaaatgatcaaacttttcaaattttagccaaatcttgttctaagcataaaatatgtatgaccgaggattaagagtatcacctcggataattttgccaacaaccaatatatgtatgcatcgataacatgccgttggtctcgacaatcaagaaggacttctatatatatatggtatcgaaattgagtggccaagaaaacttatgtataagcaaggttccgatatcggttgctaatcagcacttaagcccaaaaaacagacttgcgaatttcttggttctggcgtcaaaggcaacaaagtacaccagaacctttagttctacatgtatactggatcgagtctgtttaaggaaggtactgatcactgtcgtcactcaaggtaggtagtcactgtcatcgctatcatcattgtcacttgaaacgttgatagagccggtctcttcatcacctggagagccttcagcattgtagaagtcagcagactttgccggctcctgttgaactggctgatcatggtcggtggcgaaccagcctgcactggtacatctggaagaggtagtggagcaggcagctcctgaactgcttgggctgcttgggccattggaggtggtgcaccagcgggtggtactagaagcagaggcgcaactacatgtagctgaagagggacatgttcttcaagtggcacaggcacccttggcgtgcgacggagctttgggtgaggcgtaagcagtgacttgagatcctgtgctggtacttggcctgaaaaagaaatttcagtttacgagtaaattatatctagaactaccgatcaagagcccgatcaaacattgaagtatgaatgctaaatttttcattcctttctattcaaataaacagagaagttatataaaagcgatgtgcttaaaagacacatctcaacttaaaactaccggatattcaatcccctcaattattaaaaccatttttactttacccattcaaacaaaactggagtggttttcgcttaacgcttactacttgacaatacaagttaacaaaaacaaatcgtaggagactcatatatcagctctgtgtgcatcttccctaaactcaagactgtttctgatcaagagataatttgaacggtttaagagtgaggggtttaatacaacaatacgcaattagatgttgatgaatcataccttcagccttttgtttttgcataccttcagcttcacttgaactaggtttagcatcagcatttaatattgtgaggagatggtcctgtaaacatacagagaatggatattactgtaaaaaaaatgattaaacaaaaatattgtagtttaaagaggaaatataccccgtcataagaaaatggagagtcatatttttcctcccaagtttgcaccatttctaccaggatatttttgatacctaatagccaaaacatacagagttttattaaacatacatatattttgcttgaaaataaacttagattctagttttaccttcagtcctctttgctagtaactcacacctcatcagctccattttgtttgtatttttgctacctttttgtagggcctcaagttgatcaactgattttctccatatttcagccctgataacaatatccgatctcctctctacttcaacttttaacatctccttttgcatctttaattcttccagaactgagagcgcattaagaggaaagcagaattagtgagtagatcacagtaagggtattaaaggggtaaaactcctcattttatggagaaaaggtagataggtggatggaaatgaacttattattggacatatgttaggctagaaataaacttattttttcgccgggccggcttgaaaaggcagccgaagtttattaagattgtaagagaagaaagtgtcggatgtacaacagccccgaaaaacagacttgctacagtatttgcaacaaataaaaaaataaatttattttaggagggagtatgtttcaagaacaagtttctggactgaaattagtccagatgttgtggttactaacagcttaactcctaaaaaacttactccctctggtctaaaaacaaattgtttggaatgcttgtagttaacatgtttttgttatatgaaaatggtatgttcaagtttgtgtcataaaagggctttcataatattattcttatgtaactgtttttaacttatgttaactagaaggtagttaaagttgtatgacattgactttgaaaagtctaaaacgacttctttttttaccggagggagtactaagattttgaaatatttgtgaaataactaaacagggcatcccaaactcatctattttacaccacaaggatgttacagtaacagattggctcacaaaggatctacaggctcgagataccaattcatcatgggtaaaaaaacttgctctgatcttattatcttacagaataacagaagcaccaaacagagtggaaacaaatacaagttcaaatacataccttccttctcaagatcaatttctacttcattccctgtcaaatgagtacacttgagaagttctcttatcttcgtctttatcctcagattcttttctttcaagcgatttgcgctgagttgttcgagttgggaaacctcgcattttatctacatttcagaacaccgtttaaatggcattgctactgataatcaatgtgacaagcgtcataaatatatagaattaccttgttaaggaatcttgatgataatgctttctcttgagttatcaaatcctctgatgcagcatcgataaaacacacaacattagcaaaatcgatttcctgatcaatcataacagaccgcagctcaatgagcctcaaccctagctccttaatctgtaaagggcacaagtagttcaggaagaagaatcaaacagacaacacaaaacaagatctagaaaagaaaatacaaaaaacacacaactataatctccctactacccagcagtcaactgttagtgttagtttagcctgggattacagcaggcaacctctttgcgctggcttgctgctgcaaactacactcatgaaaaagaatgcatcaacatttagcaagtccatctgtt

SEQ ID NO: 80620 - DNA, 51724 bp, Oryza sativa
  unsure (1)..(51724): unsure at all n locations
ttttagggcggagctatctaattagcattcgcgcaaatttttacatagaccctgtggcataactccaagtcagatatatacgtatattttaaaatttatataatactccccccgttttacaatttaagactttctagcattgcccacattcatatatatgctaatatatatatatatatatatatatatatatatatatatatatatatatatatatatatatatattatagtatctatataaatgtgtgcaatgctagaaagtcttacattgtaaaacggagggagtaattataatgatttagaattttaatattttatttgaaatgagaaaaataatttattaaaatgttatcaacgaaattaaaaatctgtttatataactagaaatacctaactctggtccgaattggagctaaacaggactttagttgagcggttgagcctgggctgtaaatattttattttattttaatttccttttgccgttgatgtaggagtaggaaaaaaaaatggactaccttacatcagttgatgctctaggagttgacacgtgggattccaactgctgcaatctttaggcaagtgttgatgagatagtgtggccatgaacctggactgaatctagggaacatacaagtgatgcaatctctggaacatggttatccatcatccatcccctagaatttgaaggtcaactgttttgttttagtatcatagtaagctattgtggatgttgcatatcattgttttaaataatgttgatcttttctggattgaagaacatggataggttcaatgaacatttgattgcgctttatgacaaaatacgaccataggtttaatttgtttggaggtagcgaagccatctacgtgttacttgatgaaggaaaactacttaccagcaaggataccagcatgtctatcctaacaatgccattaaaagtcatcaacagagaagtttgcattaacggttacttgtaatttataaggtcttgaaggctatttttttttcacaatttaataaattttgcatgttgtaggacactgtcacttattttgcacgctactatctattttgtatctagtacttctctgtaaaaaaaaaggtaaactctagctacgaatctgaatacgtgaattatgctttttcttttagacggaggggtatcttatagctttattgtcaagaaattgatttaaatgtaataacaactagagtatattcgaagagtctctatgttggtttgcccggctagaaactgaaaatcaagtattaatttgatgggggaaaaatcctacacttctcatttggatgacttatcatttggatgacttatgagttctgtttataaccattgcaactaaagaaacatcataaatacttctatagttcaatgagaagtatgactaggatttgagtttaaactaaaaattaaaatacatgttcaatagaaagagctatgaaaaccatattctttagagctatttcctctgtttcacaatgtaagtcattctagtatttcgcatatttatattgatattaatgaatctagacatatatatctatctaaattcattaacattaatatgaatgttggaaatgctagaataacttaaattgtgaaacggatgaagtacatgacaagtacaactatgctagtatcttttaagtgaaaatgctttgcatatgaccattactatcgtatatatgaccacggcgaaggcgtattggacgtccgcgagttgacctttttgggctgtgatccgaatctaaatctcattgggtcttccaaaatcctagttacaaccgtggctaattaccatgtccggccgtgcgcgtccgtggaattaacaacaaacagattccgtgtgtgcatggaatcatcgtcttacatgagattttaatgggtcttcttcagtgctaattttcaattcttttcttagtttcttctattcatcagtacattgtataagtctgttaagacaaattgtttgtatattacagctgtgagagtataagtgggttttcacatgctattggaatgcttatggtcctcaattaatcatgcatagcttaattgttgacataagcacaatcgataattgataagctagttatatgaactgatattggtggttatactacataaaagagtaaaaaaaaaagaatttgctttacctagttatgtgaattgatcttgataacatctgctacactgtaaataatactagaatgttgagatcaagttgacagtcagtggattcagaatttcagattgacctaaagcttcggcagaaacagcatgtagttgtggccatgttgacatgatatggtgggtttggacttgtagatgggcatatgtacgtactcatagaggcaccatacctttgtcactgacaggtagactcagggttcatcggacccacatgttagtgacaaagacacatatctttaaaggtagaggagcctgatccggagtgttacgggcttatggcgcaggtccgatctagagcatcacttcacaccgtcgcccttcaccgtcggatcatttcgacagacgtatagcaggtctcatttttccataactgtaattgcactggaaattcgtatagtggcactggaaaaatactaatcataaaaatttttcaaataagacgaatggttaaacgttgaatataaatagtgcaaaactgtacttattttgggacggagggagtacttattctttttcatgctgtactgtaacaggagccgttcctacggctacgagcgaatgcagcgccagacgcagacggtccatctgtcccacactcactgtcgtccgggccccactccccccccgctccgcgccaacgccggtggggcccagaccaccgccagatagccccctccgttcgtttggccctccgccttcccggattgggattatgcagtcgactgcaccgtgtgccattgtcactgacatgtgggccgcgcgcggcgcacgagacacacgccgccctcctccttccagttcactccactccgctactttttccaaccgtcgccccacgcgaaccccgacgccgcgccccccttccccagcctccgcatccgattcccatggcgtgcttggcggcgggcgccgaggcggcccctctcctcttccggcggcggctagcgccgtccccagtcgccgcgcgccgccgccttctcgtgtcgtgccgagctcgccgccgcggtctcaggttggtagcccagagcgcaggatcgcgtggttgcggcgtggtcggtgcacccggttgtgattactggtgtgttgcgtggtctcgttcgttcgttctcagtagtctgctcctgcggcgaaccgggggaatggccttttggggtttgggttgggttgggttgggttgggtgacaggggatcgaggaattcaattcccttggtggtgcgtgcttgtatgcatagaatgcttcgatcgtgaccaagtggggatcatcaacctctgaatgctgctctcctaatattgtttggcttaggttctgaaatgcttcttaatcaccggaatgttccacctatctgagaaaatatcctagcttatgttgtgtaatcatgatcattgatcaaatcatcagaaatcgatactgtcggaacgctttatatttgtacatttttgttgttttgattcatagaatatgtcaagaaattctgttaagcttagcttcatttttgcgggttctaggactgctgcagaacttcctcggaagagtacaagtaatgataaacaccataatagggtgaatatgcagagagatgaagcatctgtttccagtgataaagaacggcaagaggtaccacagcacattcattagcaatttcatatgttttccgattttgtgagattgatataatatttgggccaatttcacgatactatgtatgtggtgtagattgaagtccccaaacactcaatatcccccttttaatacaattttctgtgtttttatattatttttacataagaaactgaagtgaaacacattgtcactaaactagctaaacaatttaatatccaaaggcaatacctgatattggcaggctatcttcacagaaaaatgccgggtcggccaaaggttggccgaccaatttcttaagattggggagaaaaacaaaggaatgttacagcgacattacaatgtcgcgctagtccgggagagatcccagacacagcgtgaacaagcgaaagagaaagagacaccatggatgcagtagttatcatgaagttactgtttgcgtcaatttcgtctttatttttatgtatgctcctacttgttcactgttgcttcttttaatattttgggctttgtgtgtttcaacagaaatatggagatgaaaatggtatatcaaaccttcaattggaagatttgatacaaatgatacaaaacactgagaagagtaaggggctcctttcttttggataaatgatatttataatgttgtaggcatgcacataataatcattatcttcaaacgtatttgtttagatataatgcttctgaatcaagctcgtcttcaagcattggaacatgttgaaacagttcttaaagaaaaagaagacttacagaggaagttgaaaattttggagacgagattgtcagaaacagatgcacggcttaagctttcagctgaagggcagttcggtactgagattaatgactctctaccagtactggaattagatgatataaaggaagagaatatgctactgaaggatgacatacaatttctgaaaacaatgcttattgaggttgctgagacagagaacagtatattcacattagagaaggagcgtgctcttttagatgcttcgcttagggagctggagtctagatttatagatgcccaagcagatatgttgaagtctgatcctaggcagtatgatgcatggtgggagaaagtagaaaatttgggggacttgcttgagactgcaacaaacaaagtagagaatgctgctatggttctgggacgcaatcatgatttggaagataaggtcgacaaactagaggcatcgttggctgaagcaaatatatcaaagttctcttgttattttgttgatcttttgcaggaaaagataaaatcagtagaagagcgcttccaagtatgtaatcatgaaatgcattctcaaattgaactctatgagaattcaatagcggaatttcacgatattcttagcaagctagtggaggaaactgagaaacgatcactagagcattcagcaagtagcatgccttcagaattgtggagtaggatatctcttctgattgatggttggttgctcgagaagagaatatcctacaatgatgcaaatacattacgggaaatggtcaggaaaagggatagttgtcttcgggaagcatacttgtcatgcagaggtatgaaagatagggaaattgtggacaattttctaaagatcacattgccagggactaggtacactttctcctttgctagtaggagtaaagcctgtttataggataatactctgtctttatttagttttacaatttattgattaatgtagttctggcttgcacatcatccacatagcagcagagatggctcctgttgcaaaggtgatccttggtactcccttcaacctttcatcacgtgcatttcatttcattactactcctgacacaaatacatttctagttagtatattttgatatggttctgctgattagatgtgaaactactgatgtgatagttgactaagggtctaattggtagcctgggctgcggctgtgctgcagtcagctgctacagtcccttgcatgcagcatggcccactgctgctgctgaggctgcagctgtagttttggaatttgatttgttgttaatgctgattaattgaaatcctatcagttactctttaagtttgcttatatgcatgattctttaggttggtggtttggcggatgtgatatctggtcttggcaaggcacttcagaaaaagggccacctagtagagattattcttccaaaatatgactgcatgcagaatgaccaagttaataaccttaaggtatatagtttgtttctcaccgaagtttttggtcgcttcttttgtttgtttaagattttatttttctatcatgcaggttttagatgttgttgtacaatcctactttgaaggaaatttgttcaacaacaaaatatggactgggactgttgaaggtttgaagcatccctcagttcgacctttctgtaaaattaagtcataacattgaatcttcatcgacctgactaaatttagcatatgcaggccttccagtctattttatcgagccacaacatccagcaaaattcttttggagggcacaatactatggagaacacgatgactttaaacgttttgcatacttcagccgtgcagcactggaattactttaccaatcgcagaagaaaattgacatcatccattgccatgactggcagactgcatttgtggtacgtgtcaaatgcacttggctgtattggctaattgaccactgaaaatggatcatgctcttcttggttgatttgccaagttaaagatattaatttgctcatcttttactttgaaattccaggcacctctttattgggaagcatatgcaaatctgggcttcaactcagctagaatttgcttcacctgccataattttgaatatcaaggagctgctcctgctcaagatttagcatgctgtggccttgatgttcagcaacttgatagggaagacaggatgcgggacaattcacatggcagaataaatgttgtcaaggtactgaccattgaaaccgtgcaatagattgaattcaaatttcacctgtatgataccaacaaggttgttttgggttcattgttttcagggtgcaattgtgtattccaacattgtgacaactgtatcaccaacatatgcactagaggtgcgatcagaggtaattttcttgtaactttagttgtgtgtatttgattaactttagtttcagtagtaccttctaatggcgagattagtgtttctcaaaatttatataccagttttttttttttgtgtgtgtgcatgtgttttatgtgtgtgtgtgtgtggtggggtgggggtgggggggggggtgagagaagggaagaagaccataagttgatgcacaattcatgggaaactaccacactaccttgttgttcattatgcagtttatttattccagtggcattcctacatgaactgaaataagctgctgcatcataacatagggagttgtttaagagcttgactgcttgataaatccctttatatgtaatgctatacatatcactacatcagcatatccatagaatgcctcaactatcctggactcctggtgtttctagtttccattattcaatatgtcttataccctatattgttacaagtgttctaaaagcagtacactaggcaccaggtagctgccacgattagcatttaatggtgcattaggcgtctgcccagctttgggggctccagtgttgctatattaatgttctattgtctttcttttatgtcatatgctaattgcttggaagccccttgttaagttgatcctaggcgcacctaggcactaggcagcgtcttgccgaccatctaacgtctagtgccttctctgattagaagttcattgtagtagtttcagtttgtaagcgaagtctgttggcattctgttattgacaagctcttctggtgctcagggtggacgtggactacaagattcactcaaattacattccaggaaatttgttgggatacttaatggaatcgacacagacacatggaatccttcaacagatagacatctcaaggttcaatataatgctaatgatctccagggtaaggcagcaaacaaagcagctctcagaaagcagctaaacttatcttctacaaatgcttctcaaccactggtacgatttttaatcccctcatctactgctaaactggatacagaaattatgaccatgtacctgtacttgaattaagaattttccctcttgtcagctttgcagtttattttagctatctggttttattatattcccttttttttttcaagtatggtttacctatgtatattgataaaacagaagtgaaatatttacaaggtttattgctttctttcatttgttatagaagtttcgctttcaattcaagactaactacacactaaagtttccttgagcaggttgggtgtattacaaggctagttcctcaaaagggtgtacatctcatcaggcatgcaatatacaaaacagctgagctaggaggacagtttgttcttctgggctcaagtccagtaccacacattcaagtacattttcttctgaactatagtagggtcagctaacatgatcatatttgaatgtagagaaaaggaaataaaaaaaaaaacttaactagctcgtgaacaatctatatatctaaagctggcgggtctccccgccagctgattggtggattttgccaccatcaatctgttgacacgtgtccatttcacattggcgcgcagtaaacggatcctactaggcttcgctggtcttgcgcatcagcccacgccgattggcttgccccgcctggacgctctattgatttgctgacagatgggccatccttaaaatatcctaattattaatcctctgaaaaaacaactgagatgggccatccttaagagctacggcagcacggttagaagtcattgggaaaaatatatgcatgtaaaaacatgcatgtgaagatatatacgtgcaccaatttgaaataggaaattttaatatatatgtgtatatataagccctattttattattcgtacatatgacaaaattatactaccgtcacataataaaggatgacaatatcacaaaaataattcttattcttacgtaaaaataacaaatgtataaaaaacaatccaaaataattttaatgtaaaactgcatacctctaatcagtaaaaagaacaaagaccaaaaaatacaaactatgaaaaaagacacaaaatcaatctaaaaattatgttctaaaattttaaatttttaacaaataggctatgagagtgcttaccagtttacaacttcctttaatactattagtccaaagtatttcctccagttccataattcttgatgttttgaaaaaaaaatgagatcaaataattaatttgatgacactaaaacttggtgtggtgtacagattggttaaaatactttagtaaaattaaatattgacctatttattatttatattattatagaaattaatagtaaattatagatatatattttgaggtccatttaattgtccaggggtacagagtccccgtcaaatgtagcatttttaatgaatcttatataaaataaataaatttgggtaaaatctataaagagaaataggctaatcagccggcgtgccaaaaggcacgcctattttctagtctgtttatatggatggagcttgttttttatttgaaaaatagttgctcttgctccttttgttgaacacctctttacttattgttgctatagtgaacatgtttggtgctaatttactttgcagagagagtttgagggtattgcagaccattttcagaacaataacaatatccgactgcttttgaagtatgatgattctttatcccattggatttatgcagcatctgacatgttcattgttccatccatgtttgagccatgtggcctcacacaggtgtgcctttacatacttatattacgtagtttgtattaaatgtaaatactgaaacgtgccatttagcattatccgtaatctgtttctttatttactatgcactctatgattgtcttgataaattatattcctagatataaatatgcaatgcaagcaatttctctgatcgtacttccatcttttttttcctatttggtagaggatttattcttgccttattttttttgaggtgtatgatatatgatccaatacctcataatatgatcattgaaaacttttgaacacaattcagaagtacagagtgagaaaaataaaatgtgccaagatgtttttccaattagtcaatgaaattctgccctttacccttgaaacccacagtagaatatgttctcagatttgaagaatttcatcaacacaaaaataaacatgtttccagagctttccaaaattcatgagcacaagcttgcagttctgcaaagctgttcttggttcattcctgttgagcaattctgacatgttctgtatccacagatgattgccatgagatatggttctgtgccgattgttcggaaaaccggtggattgaatgacaggtaaatagttattaattaaccaactatctcccaatattattctccttaataatgtaaaatgcccccactcacctgctttgcagtgtcttcgatttcgacgacgaaacgatacctaaggagctgcggaatggctttacgtttgtgcatcctgatgaaaaggtggatgtcgtttcagttcatctctcctcttttggtggacacaactcatgtgggtgttccttttttgacaggctctaagtggtgcaatggagagagcgttcaactactacaatagaaagcctgaggtctggaaacagctggtgcagaaggacatgaggatagatttcagctgggcctcttcagcttcccagtacgaagatatctatcaaagagcagtggctcgagcgagggcagcagcatgaactctggcggtttagtgagacctgagcctttctctgacgcggcgcttgatgccacaggcacagattctgccttctgaagaagccgcaccatgcacctctctgatgtgcgaacatggcttcatctgcagcttcgattcttggaatggaacccaagatatttaaagacatgatccgtcagactcatgcaggaagccgagatgttccatagtgcagttatggaatggtcgaagaactaaaatcttggcacccattgtcgtgtcccagtgacagtgtggactatacagttatataacttatagtacgtgattgctcagtcgtgaaatttcactagcctcgatatatttatcatgcgctacggtgaaatgataagttttgttctttgtatcacttgcagtgtgctttgttatttgtgcaaagtcgtgtgtgttgtctatagaatattctttcgtcaaaagcaaagagatgagagacagaccctgttttttttcctgtttgaactctgaaatgtagaaaaaaatttcataggctctttgaaatttttttagagaacactacaattcatgtagaaaatttcatgtttttcttctctgatgtactcccaccgttaaggaaaggggatatttccattcggtcacaacagtagtcaaattttaaattttgaattgattggatttctcttctataagttttattggctgaaaatacctagatttctgtgcattaaatcagtatccaaaaaaaatatgtatgaaaattgaattccagaaatatttatactcctagatttaggaaccaagagaacaaaaatagaccaaaggtagcggaaccaatggtctgggcctggtcctgggcctgggcctgttcccatatgggcctcacatttcgcttcggtaaaaccgcctcatcattcatcacgtccatctatattctgccacgtggcacagacgcgagccgaccagaccagtcaactttctagtttctaggagtactgcagtgtggaggcgtgtccccgcaccgctctcctccccctcccccctctcgcctcgccgacctctccacctccccggcgactcggactcgtcgaagccgcgctcgcctacgaccacccatggcgctcctcccccgcgcggcgcggctggcggccctctccgcgccgcgcgcctactcgtccgccacggcggcggcggcgggcgcgggtggctccgcgtcgcccgcgccatacggcggggcgccgccgccggccgcgaactccaaggcggcggagttcgtgatctccaaggtggacgacctgatgaactgggcgcgccggggctcgatctggcccatgacgttcgggctcgcctgctgcgccgtggagatgatgcacacgggcgcctcccgctacgacttcgaccggttcggcgtcatcttccgcccctccccgcgccagtccgactgcatgatcgtcgccggcacgctcaccaacaagatggcccccgcgctccgcaagtccgtacacttgcgccctttaccttgcgttcttctttacatataaccatcaaatttgtgatttatttcgtatcgtctctgagagaagagtagcaattttctgttaggatgctctattttgcactttgaattggttggtgatgctgcttatatagacttcggtagaggagggcgattggattggggattttttttttgtcatgtcaagttgcatacgatgtttaatacttcattgtgcagattcttttttgccgggtcggccgaacgaggccgaccaatttcattaagaatgattctgtgcagatcaatttttttgcagattcttttttttatccttataggcgtcaatcccttgcgtgttcctcataggagtagataaatttgcgcttagtctgagcttcccatgtgttcacagcttcggttttgtatggcatatgccgttgaactatttttcctcttagattatatagagaattgtatactggtttagcatgcgtttgtaaatcagaggcacgtgcattttttagtgtcaggaatagaacagtgtcgtgcttgttcaaatatcataagggttcattgaatagaataatggttttccatatcaaaacatgagccatgtgtcttgtgaacatggttgatgtaagtacaactgctaaatatgcattcatatccacttctgttagttgaaagtagttaagttttgtacttaaagagtgatttcccttcattgtttcttttatttgtagctatgtagtaccaatattagaattggtactgtttctaatgcattattaggacttaggatatggagagtgcaattcgtttaaatacattttgaataaaattcataggtacttcgatgagtttaaacacctcatgaataaaattcataggtacacagtacaataatattttgtgtgctttatgtgttacattccaactttctatgctgaaataaaaacatgtccatttgcttactcagagaatcccatgaaagcaacaaatctaaatgtatgcatcttgtagaagaaagattgctggttccttagtggagtatggtcacatactttaattaattgtagtacttcgtccaaaaaaaacccttcaattgtagtacctttgcaaaatgtatgtatatggttatcctagggagtatagctatttttcttataggaatttggtttaacctctgcaagtgtgcctatatggttaccctacggagtaaacctattttcttatgagaatttggttctgattgccgacatgtttattgctttttgaaagaacagtgttttttgtgttgatgatctcatggttctcaaatctcaatgtgcgtgtattatgggaatcataaggaataaggaccaacagtaaaaaacataatattggttggagacctttaaaacatgcgtacatgtaatttttatgtgaactactaactgacagacacctgtgtaaacttggtgaccttctccttagtggttgtcttttattcactaccagctcaataccgatagtcgcacagctatagtttgcaatgttgctgacatttgtagctgtctgttgttctctgcagggtttacgatcagatgccagaacctcgatgggttatttcaatgggcagctgtgccaacggtggtggatactaccactactcctactccgttgtgcgcggatgcgacaggattgttcccgtggacatctacgtccctggatgccctccaactgctgaagctctactgtatggcgtcctgcagttgcagaagaagatcaacaggcgcagggatttccttcactggtggaacaagtgaaccagcacttctctgctttcctatctgctacgaatacgatcctgtcaaaatgttatcgagcttctgtgttaaataaaggaaagcgtgtgctttccgatcatcaaactctctgtagtagatgcagtgatagtgagctcctggctaccttgatcaccgttcatggacaaaaaaacaattggtgatgctgttgcggtgttgctgctttaatactatgtataatattttgtaatttgtgttgtcttctactagtgatgtaacattgggtatgacgctcaatggcgttgtgatgctgtatactttaccaacttgtgtaaatagaagtgatgataatataaaaaaaattaatagaagtgatgataaattgttaatggctgctatatgttctgatttctttactcatcagtctatataacttgtatattggagagttcagaagttaagtcatgcgtactttttgttttttttctttttatcccaatttctttctttttaactacagtaaatataaagatagaatgtacaattgctgaccttgcacgatgacgtgatatgtccacatgacgtttttatggcgtttcttttggaccgaaggactatgttaaaccaattgataaatcttgagtatttgtttggataatttaaaacatcaaagactaaattgaccatggggcaaaattccaaagcctatatcactatatgggctattcacccgcagataaagtaaaaactatccgggtaacaaacgaatagtagatagtaggaaacacctgaataaaaatactcctaaatcaaatcgtgatttacccaaactaaaccggctttgaccccttccccaagcctaaaagccccaacccttttatacctccccacaagagaggcaaaatccgctcgctctcagactcgcgacgccgccttcttcttcgatcccctctccctccgatctccccctcccccgcaggtaaatcagagaaacccccactagatttcgaatccaaatcgaggcctcttcctcacgatctcaccgcatttgctgttgcgattcccacctcggggttttgtggttcggtttggagcagatctaatggcggcgctggcgtcgaagctggcacagatgcaggcgaaggcgtgcgacgcggcgaggttcgcggcgaagcacgggtgcgcgtaccacagggcgctcatggagaagaaccagaagtacgtcgccgacccgcccaccatcgagaggtgccaggagctctccaagcagctcttctacacccgcctcgccaggtcggtccaccctcacgatctccctccaccttctccacgatctcttagtcctccacatctgaattatctctattgtttagattgcgcactccattagaacacgatctcgatcacttccacattatggaaggccgaatatgggattctaatcatctatggcgaaacctaattatgttgcctaattagatagaccagcaattttggctgattgttttaattgaataaattagcagcacatcatgtaaagtgacaatgcaggaaattggtaccattgaaagtctggaaattgcagtgttgaaaagtgtgttatttttggtgatgttctcctgctatatcggaagttagaataatgatcagcgatgtctattccatccatcctaataatggaatctatgcttcccgtctcttagaagctgagcaatgcataatgcataatggtcatgttgtgaacatagtccatagtgatgcattgcaaccgtgttttgaggatgttaagtatttttgctgaacaagttgtcacgttgcatgcaattagccatggaaaacaagttcctcctaaattctatgtaaatgaagacgcaagagatgggtagtgggtttatatggtaatgtgggttgaaagtcactgatcttggccttagcaagattgatctgatgagaagcaagctttatttgagttttttttaactgtgagaaattactttgttttgagccaatgcttttctcttggacagagtcccagggatgtaattgttcctgatcagccattttgtcttcatttgtcttttgagaagaccgatactagttatttgtttgagctgcattttgcttgtacttcatagagatagagtagtagtttgtctatttcaccattattattcatccgtgttgtgctaaaagtgcgccttcagtgcacattcctctggttgtctttgccagtgctattatgaattataatatacatctgatatggtgccataatttgatgattcattacataggtgacagaagatacttgatcattcatttgataccataatttcactcacattataaggtgcatttcgtatcttcaatctctgtgtctttactgactagtgacacatttcttgcagccttcctggtcgctatgaggcattctggaaggaagcggatcaagtgaagaacttgtggagaaacagaaaggatctgaacgttgagcatgctggcgttgctgcactttttggcattgagttgtacgcgtggttctgcgttggtgagatcgttggtagaggatttactttcactggctaccatgtctgagtgctaagcaaccacattagtcgccgactcgccgtttctcattgaagactctgctagagtgttaggatatcagttttttgagatgggatgactgattgattcagagttttgttttccgaaatttctcgatgctggtgtaacagacggctcagttaaaccaacatgacgaagttcaataattcagtgaatcgtagttgaagtatgcagtaatttttctccgatattttattgaatattgatgccattgattgttttattttgctgcgtgtttgatgccagttctcattgtcgcaagcatatagtttctctgtctctctgtatgtggacatgcacttttctccttatctttcagttcagtgaccaagtctgcttttagcaaatttcagtttagcctctgttcttgataattgtcgattaacattagcaccaagcttattggtgtgcttatacctatatacacattacattttgatggcttatctcatacttatttcttctgagttttgagttttgactgacaaggatttgcattgcaaactcggttagttgatctctccctgttttatgtaggttcttatccattaccgtgaatctgtgatgtaaatgtatgtaactgcattacacttgtccatttctcagttaaagtttgtatcattatgtctcctcttcttagtttcaaggtctaatatagtaatcaaatccagctagattctgaacgaacgactgatggtaaattttctatgaagaccatttgtaaaaccttatccaacgtagacagcttgatcaaacaccggccgcccagatcaaggatagatgtgcgggtaaatttttcaaaaaagagccttgctaaacgtaactcttcaatgtgggaccctatttggatcgctataattgacagcgaccctaccttgggccaccggacatcgcttgatcgaacaaaaacggcccagattaaaactaagttgggtccacctttcagacttatcgaggagtaaggcccacatcggaccatcacgcggtaccgatattgggctgcatttatatgggcctaaatagtagctgccatgtggacttttatgatgggcctcatttatatgggccaacgaaaattatactccgcatttgcggtataatctagtataatttcgaaggttctgaagcgaataataacgcgcaggcgaaaaatcggcagcgaagttagctaatcggcgaacagatcgccgtccggtgactgctccggcgaccggggccggcggcggcgggtggtctcatgtactccgccgctcgccgcctcctcctcgccgcccgcaccggcgccggcgccggcgccgcttcgcggttgtccgcggcggtgtttgcgctccgctcctactcctccacggcccagtcctcgtcgccgcgtcggttcccgacgcctaaggagatccgcaggggcctggacgagttcgtcgtcggccaggacaaggccaagaaggttaacgaaacctccctcctcgttggtgtggtgtgtactgtgtagctgattgggggtgtgaccagtgatgacgctatgagctcgagtttgagcatgagttactttgctttactacatatatgatctatctgctagcaatttacaattgtgcaagttcgattgaaattatggaactatgtacaaatttcgcggctaggtttaacaagggtgctttgcttatgcaggtgctctgtgttgccgtgcacaatcactacaagaggatatacagtgaatcttcaaattggttagattctggaaatttcatttggtggttcagttatgcatcacgattttgacttcaatttcatctgtggtgatatagttctatgaagagctcggcatgtggcgatgttagtatgagtggtgatgatgacattgagcttgaaaaaagtaacatccttctgattgggccgacagggtcaggtgacgcgaacacatacgtggttcatctgtactgtgaaaatgctgtttgcttatctcgttcttttgctatgaacctatggcaggtaaaacactgttagcaaaaactttagctcgatttgccgatgttccatttgtgattgctgatgcaactgcaattacacaggtaggaaaggctggttcaagcattctgaaaatttcttctatgtgtgcttactccagcgtgtcatggctatcgtggcaaaaaaagctgattgtgtatgctattttcttctttctgatgccaaaacaacttccttttcaggctgggtattcaggtgaagatgtggaatctataatctgcaatcttctggcggtatgtaacagcctatcactctctttctggccatttatgtactcttttgggctatctagtgttcctaatattttagttgaatactgttttacattattttcctaagctaccatgctactaacagttctcctgcaaattgttaataaccagttcctttttgtgtataatgaatcttggatcacctatcatctgcaagaaaatgttttggtgccaatagctacgttgggcataatctgaacaggatcaagcttatatattaaactattaaccattaaccataaaccatatattgcttttctgacatgttcttccttttaggctgctaagttcaatgtggaagccacagagcgcgggattgtttacatcgacgaagttgataaactcataaagaaggtcattgaacaaattagttttgaactacttccgtgcctagcgaatgtttctgcacttgcaataattggatacattcccacatccaggttgaatgcaatgaggacaggagggatgtctctggagagggtgtccagcatgctttgttaaaaatatttgaaggaacagtaagtgcatatattaatcttctgctctgtaaagtaaatttatctttgtatttttcatacttggtaattacactagcccttctgaagagagtgagatctgattaacaacacatgtaagtatatgtcaattaatgcatgtgtgactgatgctgaccataatttttttttctccctgaatgtacattcagtcatgttctgtctctgaaataagacccatttgttgctatcattcttaggtcatcaatgtaccaagaaaaagaaatcaagatagtatatccgatggttatgtcgaggtattgattctgaatcttttgattaagttgttaagtcagttaaattgttttgttaatagctaccttattgtttatcagcatgatagttttgctacagaacgaagttatgggttcttgatttcaaatgtaatttatcattggtgttgtcgtactctgcaaattgcatttgtggttcaaagtcgaagtaattactaagttccatctgtctctaaatataggttgttgtgggatttatataggtaaccttttactttgatcattgctgaattggaaatatatagaataactgcctgtttcttccctatcttaatgaaattggtcaggccgggcaaaaaaagaataactgcctggaaataataaaataggatttttttttcttgcaagatactttttatagttccagtatattatgatcaagaacactcaaagtaggttgttagaatttaaaaagacttattttgtgttgcaggttaataccaagaatatactcttcatctgtggaggttccttctctggcttggaaaagatagtatcagaaaggttgtgcacttacaaataatacaaacttctataattctctgaattgtccatctttatccagacttatatattgccttaaagtacttgtgctattgaagacaccgaaactgtcatatggggtttggacttccaacatctggtgatctgcgaaactgtggttggacaaatgctatcggggaatcatgctgtgttgaagctgtaagatcagttgctgacatttgtcaaacacattattttaattccacatagagataattttcaacgatttcctacttagattgaaagtgatgacctgattgcatacggcctcataccagaatttattgggaggttgccaataacagttggcttgaatgatctcagtgaagctcaattggttcaggtagcaatggttctataaatttgtaattttatgcaatttatttttgaccacatattcctaaatgaatctactttatctcttcaggttctcatggagccaaaaaatgcaataggaaaacaatacaagaagttgtttaaaatgaatgatgtgagtctggttctgttgtattgattgttttgattcaactgcaagttatgattaaaaacaccgtcttctgtggtatgttaacaacaaactattttctcattttacccatgtaaggtcaagctgcattttactgaaaatgctttgcggttaatagcaaagaaagcagcttcacgagaaacaggggctcgagaactgagatctataatggaagatattttgacagaagcaatgtttgaggtgacttgcacatgccgtaacttctatcaacatcgaccagcactaattttttcgttctatttgcagattcctgatgcaagagagggaaaagagaagataattgctgttcttgttgatgaagagtctgtagggtcagtgcattctcgaggatgtggagccaagattttccgggatgatggagccttagaactatatgtttaccagaataatattagactgccagggttaatccctgggaaccctaaacgtactcgcattgtcagcttctgccttttggtcgctttgtcagcaactaagctgtgggtttaccatacatttcactgcttctcctcgatatacgaatgggttgtgtcgatactatgtaaagccaacatttttacacaataaagcatagcattaagctttattttcgtcacggtgtcattgttgtctttttgataaatgggatgcaacaaatttgagcctggaaatatctggggctcacggttcacctataatattttgatatttttcacaactgccaaggttggtctccgtaatacagaggagaaagaattggtggcaaattgaaaaggaaagttggcaaaatatttcacactgcacaaatagaaaagggcctttaaaccgtaatgcatcaaaattttgtggccgtcattttattcgtatgcaataattgcagttacaaaagactcaaccagagttactgccgtttactcatttgacaccaaatgttgaaatcttcaggcttctgagaatttcaatttactgatcgatgctcttagaatcgatataaaatgacggggttatcagatccacaggcagactaagacatgatttcctgtggtcatcaaatgttagtgtccatctccttgtttagtttcacctcctgaagaagtgccttgaagcgcaccatctccagctgatgtgattccaaacctactctgaaacacaccatccagtgagtttgcatcaggtgcaggttctcctgttacattttcagtcttccttttatggccaaggatggcttcaatggcagcggcactagctctagctgcagcctcgtcctttgcagcagcctctgccctcctcttctccctttcttcccttgcaagagcttctgcccttgccttctcttcttctgcccgagccgctgcctcagcttttttctcctccacatcctcgtatagtttggttatgtcaccttccctccctgcttcacggagtgcgccttccaataggtccctcatttcatcgctgaacaccaccttctcatccaaaagaatatcctttgcgatgtcgattgatttatccaaactagcttcaccaatgtacgcctttagcagtgcctcatagcttgcaatgcttgggctaatttctttccccctcatcttatcgagatacccatgggcattgtccagcataccaaaaccaattaggccatcaacaatcttatgataggcagttgcgtcgggcttcaaccccaactcagccattccgtcaaagtaattaatgccttcatcgatgcgatcaaccctaaagcacccttgcatcagtagcacatatgtttcctcgtctgccttaagaccactttctcccatctccttgtatagcaactcggcctcacttaccaacccttgaagactgagatgccggatcaaattattatatgctgcaacatcagcaacaacttcccactcccccatcctcctgaaccaagaaattgcatcaccgaacctaccagcagcgcagtaagcatccacaatcacactgaagcttctcacatcaacagcaatctttagtggaggatcatgctcccgaagcattctttcaaacagctcgatcgcatcatccaaccttctgttccgcccaaacgcatcaaccacaccattataactctcagctccaaacctcacctccgactctgcaccgagaacctctttgtaacactccattgccttctcctccattcccataaggaagtaagccttcatgaggctcccatacacaatgccatcaagaatcggctcgcggccaatcttttccttcaattcttcgtacaattccacggctttggcgccatcaccggcttccacgaacccagccatgagaaggttgtagacctgtggatcgggcccgacgaacccggaggccagcatctcatccttgagctcgagggcatcagtgaggcggccatggtcgacgacgagggacttgacgacaacgcgatacgcggtcggggacgggggcacgggggatccagggcgcgagatgaggcggaggtggtggagcgcggcgtcggggaggcggcgcgcggcgagggccgagaggtagagcgcgtaggtggcggcggtgggcgggacggcggcctggagggcgaaccggtggagcgcgaagaagtcgtcgaggcggcgcgcgcggaggagcgcggcgaggacggcggcgcaggtgaaggaggaagggcggcagttggagtggagcgcgtggcgggtgaggagcgcggcctcggcgaggtcggcccccttctccccgtccttggaggagggggacaggagcgcgaggatgcggttgtggagcgcgaggcgcgacggcgcgagcgacgggaggggctccgcgaggcgcacggcgctcggggacggcggcggcgtggggggcgtcgcgacgaacgcgtcgcggcgccgcgcccggcgggacgccgcggccgaggcggcgtcggcgtgcgcgagcgggaagagcgccgggacgaggcggcgcgccgagaacggcttcgacagcgacatctcccgcggctgggccggctgcggcggcggcggcggcgagcggcgagcgaggagagggttttggggactctggggctatgggaaaatcgcaaggcggtggcccgaaggcggtgtttggaaaaaatacgccttctctacaaagaaacggattttcgagccacacttcaaaatacttctgcttttctcggggattgcgaaaaaaaaataccaccttcatttcatattataaatcactttgattcttttagtcaaatttatttaagttttatcaaatttatagaaaaatttaataacaactatataaaataccaaattagtcttattaaaataatattatttattttttgataatatgtttgtttgtgttgaaaatatttttatgttatatatatataattatttgcaagaaattcatgctggggggagaaaaacgagcaatttcgagcttcgtatcagcatatgctattccctattggaaaaaaagaatatgcttgtgggaataaatggccatacatcactcttgcatttctttgattgcaaatttccaaggcagaagaaaatatgtgccaggtggagcagtatgtcattgtcaggaacaacaaagaacacaagaaaaatttcccaaaatccatttctcacaaacagaaaaaggaaaatttccgaagctgccaccacaagccaagctcaaaaactccagtgtcgactcgagctcactgggtccaagaccccgaccgcactggccgctccggccacgcgtccgccggcgattggccgcgccggacgccgagacggcgactccgaccacccgagaatcttcgcagtaatatgccaccgtggcgaattccccaaaacaacccctgcagcatctacccctcccatgccaccaaccacggtaataacgtaataacgcgagaaaaccaggggtaattttgtccaatgtgacatcggtataaaataactgaaccacctaatcgccatggccacaccaccactctccagtctccacctccgcggcgatgcggagcagcagccatggaggtgctcagctccagccgcttctctagggttttccccagcagcctcctcagccccgtctccaagccgctcaagcccccgcgccaccgccgccgccgcgtccagacgctatcctcctcgtcctccgatgccgcggcggcgccgtccacgccgccgccagtgtggccgcccgcctcgctctcccggctcctcgccgcggcgctgcggggagggcgcgcgggaggggagctcccggacctagccgtgggggcgggggcggcggcgacggcggcggggggaggggcgaggatagggacgctgctgatgagcacgacggcggcggcggtgaccaaggcgcgggagaacccgtacatcctggcgctcgcggcgaacccgacgttcgtgtcggggctcgtggcgtgggcggtggcgcaggcggccaaggtcgtgctcacctcgttcgtggagcggcggtgggacctgcggatgctgttcagctccggcgggatgccgtcgtcgcacacggcgctctgcaccgcgctcaccgcctccgtcgcgctctgccacggcgtcagcgactcgctcttccctgtctgcctcgggttcacattgatagtcatgtatgacgccacgggcgtcaggcgccacgcggggatgcaggccgaggtgagccaatgcttcgattgcttttgtccatttctgtattgcatttagatgtatgtgatacatttttttttctgaacttttgattttgatagctaatttgtcaaaatgattcagagattgcttgttatttggggtaggatactttttgttcacattgttcaatcatcgatgaatgactgattcgatggcccttgtgaggtttgaacttgcggctggtggtatattttacatttttacccaatgttggagtgattatgggattgcatactcctatgttgttactttcaatgtggtagtatttgtggtgtacatacagattgattgcttatgttatcattgtttgggataacattggtgttcattttactctgcttttatggttttcgtctctcagcagtaagtgtaatggttaccatttgcaaatgattgtaaatttgtgatatgacttacaactgaaaatctgaagctaacattctgaactcaatggggactatgatttcgcgttggcatcattgcgatactattatgaattgtgctacatatataagattatggctgtcctgatataaaacaagccagccaaattgcaaaagttaatcatgtgcgagctgctgttatttgggctttagaagttgttatatggcagttttagtatcttttcgcataaacaaattttggctttgtcttagctttccagtggccccagatacttttttcaccatatgttgaactacaaacttgagtgtacttgttgggggcaatggaacggtgttaaatagttttgtgattgtttagtatttagcatcaaaatagatttcaggcattcaagaccaatgtcttgctccttccaaacaattgctgtagtttggtatgaaacttgtgtgctacattcaccttatttagctcattatcttttttgtaaatcataaaaccagctactcaaatatatattacttccctgattgaagcttcacatattaccttagaataacacatggcacagacctgagacctgcaatcattttgccaatatgcttttctttatcaacttactttaaggggtagtggtaacattactgttttatcacatggaaactgatagcaagcagcaaatccagttaagcttgccgtacatatcatctaaaaaaatgcagtccagatacttttttttggaaaggggaaaatcctgataattatcacgattgcattctgatgctcgagtttagattcaggaccatttggatattggttttggatagccatcacaacaacacagtagcaatagtgtgttatatatgacttgtgatagggtgcttatttcctgaatggtaatacacaataacaccagatgcaccaaatgctgtcagttttatagtactcgcttattgttacttgatatcttccttatgattgacacaggtactcaataagatcgttgaggacctgtttcaaggccatccaattagtgaaagaaaactgaaagagttgttagggcatactccatcacaggtttttgccggcgctttgctaggcatcatggtggcctggttctgttgtcagggctgtattgttcccatttgactgctgttgtacttcagaaatggaaaaatcgttttgacacgaagatttttggtgcatctggtgtaaccattgttccaggagatagctaattttatttcctggcctgtttgcctgtacatatatgtaactcaatagcagggatagccacgaatttgatattctcaattcatagttgagatttaagtccttttctgatctgattgacatcattgaatgtaggagtgttttgctcttagatctgaaaattctggagttaccctgtacaaccactgtgatcaagaagccataatttgggcatattatctctgtatcatatagtgaaaccaatgctgattgttactggcttcagtcaaacaaattctgtctggacaattaactgttactaacaactagtattggtgtattaccagcaagtacaaattggtctagctatgtttggcaaattgggtcatgctaagttgctgctttgctagggcacacgtgctgctcaatgcttttgtttttggtactactttacttggcactttggcagttcgcaccttttcaattgagggatctcgctccaaagtcgacgatggtatcgattttttatcacatgaagcatggcattgtcggttgtcaacgacgagatttccgtgaaactcaacattgacaagagcccagtggtgcgccacgaatcctgacgatgcctcagggcgtgctggttcacgaggccatattgccctattcgtgacaaggtggaggtatataacattctacaatttttttattaaaatacttttaaattgtaggataattacattgtaactactgtaatgcaactactgtataatttgctcatctaacatcaaaacgttagactaacttagcggatgaggtgcgcttttgtgaagcactgacatgtaaagcgagtgtaactgaactgattaggtgtttttttgtggaatatgttcatccagatttaagttctagatttagatcccgtttgaatcatttagtccctggattaaaattttaatcccctactatttggatccagggactaaaagggactaaagtcatgtgtaccgaagaagagaggggttgccactatagtcctataagtctcaatatgcacttttagtgctttttactcacccctgtttggattcttaaggattaaaatagagtgactagtggattagtcccacgaaccaaacagggccttagcacatgtgctcatatttacgattatttatttttttttaggggtagacaacattcatgccaataataacttaataagacgtctatagttaatttatgaacttcaagatataatgacctaatttttaagaggtgtttatagagtcctaggagtagggtatgtatgtgtgcgtttatataggtgagtttgcacacatctatatgagcgattgcgtccataccgtgttttggaaaaaaaaaacactgattttaaccagacacgttgcttaatcaggcaaagcatgacacatttttcactttggtgctttaggtaagggcgaaaacctgaaaacggctggaaagtggaaacgagtgaaaaaccatgttttgccatatatgtttatcttggttgataaaaaactgaaaatgataaagttaaaaacgaaaacgatattgggaccttataaaggtgtgttcgggaggagaggttaggaaccccttctttttaacacgtaaaaggaaacacacattagcgcatgattaactaagtattagctactacttagtctcgaaaaaagataaaccatgtgttcaaattcgtagctaggattaggtttttttaggacggatggggtatcttttaaaaaatagattaatatgattttcaaaacaactatatatacaagttaaaaaaatgtattgtttaacggtttagaaagtgtacatgttaaaaaggagaaaggtaaagttaggaacatagataagagcatactccctccgttaaaaaaaaccaaaaagtaaaaacatactctatgtctaaatttattatattaagatatgtcacgttataataataggttatgttttcagacggagggagtagccagtagtggtgatagtacattcagcccaactgaccattaatcctagtcaacataatagacaagacgtgttgctccctgcttgttcaccatctttggacgaatgactgggggcgtgactgcgtgtaataattctgtacaaaataacagatttttcaaacacaactcttaatcaggcaaagtatgacgctgattccaccttggtgctttaagaaaatagaggtcaacatggaaagaaacggaaagatggaaattctctagattcaaagaaagtgagataaagcagctccttggaatgctcatgtcatgcttgaaggtgtctgccactcattagagtatctaagataatagtgtcatcagtaacacactttagtagcggcaaacaaggccgcatgtcttgtttccagcaagtataaatgcatgtaatagtcatggctcctgccctttcgtctttttggaaaaaaaagatatcaatgttaagttgtttttgttacgcaaatgtacctggtgatagcaaaccgcacaccataattgtgatgaaaagaatataaaatgacatgctttcaggggtgtttctgttaggtacattcacgtgcatggacattcgcaatttcacacgcatattcaatcagagcataccatgatgcagtgaatggaattaaatgttagccatatcatgcacgggccattgctatcaccgtgctttgatcagttgagctgcgtcttaaaaggagagagaaacaagcaaaaattaatttataagttactccctccgtcctaatatgtagcaatctagaatgggattagatccataacccaccctaggactacgaatctggacggagagagtaaatctttatatctgtattagaagtttacatatatacaattttcgcaaaaatcatagtttagaagctcgtaaaacatgtcacgttaatctattgctatgttttcttaaaaaagagaaccaaaataaactctaaagcgtgacttgagttccaaaattcaaaggctacagttaataatatttggctttggtttttttcaaaaaaaaaatatttggctttggttaacatacggtgggaaagtcatgcatctttcaaatacataataactcaaaatcctgtgcgcacgtggtgtcgtggtgaaagtacgctgtgattggaaaaaaataatggacgttttagactggatacaataatagatggtagataatccatataggattttttatgagctaaagtagagaggggaagagagagaaggagcgagcgactaattagtcacccaactgtactctctgtccgagacgtcggcccaccaggtgtactctctgtctgagacgtcggcccaccaagaacgatgggtgcacccgcgcaagccgccgttgccacgtccgcgggcgtcgcgctccaccagattgccgctgttgcagtcctcgtccgccatggctgcccttgccatcgactacgtttatcgtgaccgtcgccgctgccctcgtccatcatggctacaatcgccatcgactgcgtccgtcgccgctaccctcatccgtgtccaccatcgccaccatcgctgtcgccatcaaccgtgtccgccgccgcctagtccgttgcggtcgtcggactgctggccttatcctccacgctcattgcctgcatccgcctcggctacaacctcatccaccgtggcagcccgtgtccggcttggccgcagccctcgtttacggcggccgccgccatcgctctcttctgctgtcgtcgtccttggtccaccatggtcgtcattgttgcgttcttccgccgcagcgggctcatccactgcgtcgtcgcgtccttctgccagtgtcgccttgtccactgtggccgcggccgtcgtgtcgccgccattgtgttgtcgccatcttccaccgcaattggcgtcttcgtccgccccagccaccgtgggcactagtacgccaccgtcatccacgtgcgtcaccgtagtccggaggactagaggagaagaggtgagaggaaaagattgggaaagatggtgggtcccatgaagataataaaatatatatatgttacagttaatctattactccctccgtcctaaaatgtagctatttctagcacagtgtcttgtcccaaaatgaagctatttcttcacctacctcctcctctcaaccaatcacaaccattcttcttcacacactttctcttttcaaccaatcacacactttctctaatcattctcacctacttttttaatacccgtgtcaaccgtaaaaatggctttattttgggatgaaggaagtatagacaataactatactgtttgttatagatgatattactatctattatagtcagcactcagcagtggactttctcttcaaacccaattcacctcttcttccgcccgccgttggctgccccgcacgcgtagctaaaagcgggtgcaccgagagcggccacgtagtactaacttctctttatcgagcgtcaacgtgagccgactgcaccaaaatcatcagtggaagcggagcacttttccccagcgaaaatcgagcgacgaatcatggcaaaaagcttgaacccggtcctgctttctctgaatttctagctatagccactcacaggattttgctcatgtgcagtcgttagtgtgactcatcttaaacagtcacgaccatccaaattgcatgtaagtatgggtgcaagcgggacgggcaagttgattttttattctcacttccagttcattttttatatcaccatacgagaaataaactagcaaacggatttttatgcgggtagtgagactacccacttgcatctctacatgtatgggttgaattctttattcttggagcactgttttacatagaaaatagtaccgtacaaccactgtagtgatggtgctatagcacttgatttacgtctttgatctaaaaataaaaaatgaatgataagataccataccgttattaacttacagttctagttgtgactgcatgtaatctcaatccacatttttctcatctttgcagaaaataaaggaagcgaaaggaaaggaaacttagtcctatttaaaatagattattaactgaattatcatagtagattaccaataaaattataattataaactaaatatttcaacgataaacttaataaacacttagagatctaactacttttgaaaaaaaaacatattttaagagacgtgaaatagttaagcgaagttctgaaaacaacgggaccttagtgacactgtagtgtagcacaggccacataggaatcaggacagggcacaaagtcagctggcgtcggcaaatgaagggtgtgttggttgccggtcacactcacactttgtcacaactaacattaggtaaattgtggcagccacaaaagtgtggtggacaaattgctagtcacaaagtgtggcaaagttagcaagaaaattaagtctatgacatatgagacatgctattgaaaaactgtggcaagccacaactgttgcagtgaaccaaacacatgcctaacaaactgtgccaaccacgagtatggtgtggcaacgtgtggccaagtctcatctcaagcgagctaaaagaaaatctcaagggagctactcctatgtgcagttgaaaccgcaagctgtggatacatagtaatactagtttagtccattttaagcggagcgatggattttcgtatctaatatttaactgttcatttttttaaaaaaatattaaatattaaataaatagtcacatataaagtactattcatattttattatataataataataataatatttttaaaaaataaattaaactattaaacgtttgatataaatagtgtaaaattgtggtctttctaggcgaacatagtactgaatactgatgtcgcacagttggggcgaaacgagttgtccattaccattagcgaagacgacgatgctgcctcgctccaagcccccaacttgcgtgcgtgtgatggcactagctctctctgattttttttgtaacgaatcagacagccgtcaatttcatttaatagagaataataaaactgtacagaaaacacagacactagctctctcatctcacagaaacttactttttaccgctcatgcatgatatcgaatggctgggagctggctaatctgaatctcgctcgcactttgacccggctcttgcatatgcatatgtaacattagtggtagattgctgaatgtactgagattattaaggcgtgatcttgttctgccgtggtcaaatcaaacactgcaacaatcttttgcccgaacgaagcaaacaattaatctttttgtgagtgtgcgaagaacgcccttatcttttttttcatggctttattcagggatttgttttatttatttgcgatatcttctgaatctggatacaagctgttattatcagaaattatcacaaaaaaatttcacatatatctgagatcgttagtagttcatgtatatactctctacattcccaattgatcgtcgtatataatttttaaattatttctaaataatcatcatattagtatttattttctaagtttattcgttatatgtgcctaaaagatactccctccatcctataatataaggcgtggtcaaacttggcactatcttagtaaataaaatttaatttataatataataattgttagctaaatatttttaaaattaaatattaaaatgtgtgcacgctctatttataggaagatggagtattcctaaatagacattgatgctgtattcatgcacataacacacataacagtgttttggtttattatcggttaattagtaaatgatacgaatgttgtatggattgagtttgttaccgagcaaagtcattatgaaagaatttattatgtactcatgcaatataatgattaactgagagggaacggatggagtattttccatgagaatctgcttgtcatgaagaaaaaaaaaaaaggcgccatgtgtgcgcacggtgaagagccagcttgatgtcggaagtaagcgaaaaggaaataaaatatccgatactgtgtgtctgtcgccggcttgccgagcaaacccatcatccgtggccgtcagccgctctcgcggcacggcgacgcgcgtacgcacgcacacaaaagctggggagcaccgccgccgccaccgccaccgccgcaccgtgcatcatcgtgtggactcggcgctcgctcacgagtcacgagcgcgatatagaagttaaaaaggtgacataagtgagctgtataagttgtcacattaaatttatacgtagagaagaaaaataaaagaaaaaaacagggattataaatttatagctaactgtaacacgaacttagataaagtactccatctgtttcttattccatctgtttcttattatgagtcgtttgtctttttttttctaatcaaatttgtgatcaagtttgtagaaaaatacagtagcattatcaatacaaaacaaacattatatcaaaactaggaaggtggcccgcacgcgcatgcgcgcacacttatattattgaaaggtaagattattatttgttcaaaattaaattgtcaaatagattaagggcaaactaaagttgggataatggcattttataataatttaagggttctatttttcttaaggtttcttaaaaaaccattcataaacatttgagtaggagatgaattaattacttaccacttttgaatcatgtttttttctcgagtaaataagaaactattgcttaattatcatacaatccatccatatacatatcatgtagtatgtccacaaatgaatagtgcgagagcaaatattcaaaattcttgtgattaaatcgcctcatgaagacgtatgatatagtaagaaagggagggaagcgtatgtaaggaaaaaaagaagaaaggggaaaatgaaaaaagggaggggaagtgtatgtacccacgtacgtaggtgcgcacctatgccgtgggaggagaggtgggacctcatagtatttagtgttttctaagatcaatttagtctaacggtttataatattggatgtgccaatttaagtgaaaatcaagtaatatatactttgcttttttttcatataatttctaatatttgctctaatttattagagcaccacgtgacagctcgagagcattttaagaaattttataggacttaacacatgtaattagaatattaaccatgtaatatatatgtatggggtatatggtaatatttgttccagcttcgtcgatgtttatatacatgtagagagaagccattagatgtctaattaatagcaattaattttgacacctatttaccgttgttcatagtagctcttacatattcatcttatgactctgagtatccattgatccccaatttactgtttacgatgactcgcatgaaaaaaatgtactacttagggtttaggacaactgaaattgatgaattatctgatttatgtgatagctatttgagggtataaacgaatgaattgacttctaaaagttaaaatgttgtttaaaaaaagacacaatttagaaacttggaaagcatgcaaatgaaattcaaactatggaatcgggaaaaaaaaagagggtcttaaactcccttgtcttagaagagttccattgatattcgttaatattgtgctcacatttataatataatgatttctttcaactgtacggacaaataatacaaaatccaaatacaacgtaacacaatacattataattattctgtaatcaactctcggttcagcttaaacggagctaagtgttccaaaaacacaacccacagtgcttaattcttctctcgctgcatcacacctctaattttcttttcatgttattaacaaaatttatcatctccatatatgatttgacatgtagcaaagcggtagcgctgcggcgatcgtgatcaccttatgcctcaaacacgacgctttgtcacgcgtgcaaaaggcaaatgtgcatacgtgcattgtgcagcgggccaaaaagggaactttggatgctttatttattagcaaataatagatttgatgatttaaataatatccactggttttaatgtaagtgtaaattagttgatatagattttaaattgttaatttaatgggtacacaatataatgtcatagactgtattttgaaacaatgcattatttgagaatgatagtccaatgtaataaaaaatagatccaatgatttaaataatgggttcatcggtttaagtgcacgtataaattagttaatatagatcttaaattatttatttgataggtacacaatataattgtgtaaactttattttaaaatagtgtattatttgaaaataatagtacaaagtaatgagtacgacggtttaattaagtggaaattatcttactccctccggtttcattctaattgaagttttggataataacacggtctacaaaatatatctttgaccttatttttctattataatatatacgataaataaatatatgtttctattataatatataagataaataaatatatgtttacttttattatagtgctttgagagataaatctatatatgttgttctagttcctttaaactaaatatttttaaagttattgatagtcaaggttataaaagtttgacctcaaccttgtccaaaaggtcaattattatagaaccggagggagtacattattaatttaatgggtaacatataatggtgtaaattttattttcaataactgtaaagctaatttagttacatgtgagttgtttgatggtagattctttgttagtaaaattatgattatttaaaaaatatatatccattatatgtttggcaacggttgaaaaaaaaagaagggatggaatgtacgtacatatacctacacatgtgcggagaagaggagaggtgggnccccatagtatttagtttgtttattcttagaatttctatgattttctctaatttattagagcgtcacgtggcggcttgagagcatttgtaggaagtttaatggacttttagtatacctacacatgcccgggagaagaggagaggtgggaccccatagtatttggtttgcttattcttagaatttttaggattttctctaatttattagagtatcacgtggcggcttgagagcatttgtagaaaatttaataaacttttagtatataatagatatatagatatattttattttttaaaaaaatataggaaatcctgtcgattttctttccaatgatggtattacgtacatatgtttctttgactttattttcttctgtatattgtataagtacatgtatatggttttttttttcttgcggcacagtaggccagctttatttttttttcctttgaatcgtacttagtacaaacagttatatatttcttgtgtgggaggaaggtattatttttttaataacagatctaatataatggtcaaaaatataggggccaccaatttaagtgaaaatcgacggtgagattagatagtgccatgtggcggtctaggagtgtttgtaggagtgccacatggcggctttagagcgtttgtaggaagtttaatggacttttagtatataataactaagaaggtagtccgcgcattcgcgcgggcatgtatcataggctgcatttgagatacctataagtaataggctgattgtgttaaaatgtcgtatttgttatatagcaaactatatataggcatatggatcttatatcgttggtttggttataaacatatcaatagttaaagattagaaatcagacgtgaaacttataattatagattatttatctttagttaaataggaacgtgagaggaatgaaaagcgtagagcttgagacagagaggggaaggagtgggtgtgtagtgatgggcgcatatggagcggatttttttttgtattttttctaagtaatttaagtgaaagcaaattatcatatgttaatttcctactatttgcaagttttttttcaagatgtgacatgtcactgatttgatagatttttttttctaaaagtagatttgatagttgaaaataatattaataggtcatcgatctaagcaaaaactgttgggtagatgttttattttttctttgaatttataagttttactaatttttaaaatgtgatacttggtagtttagcatggctctaaaaggtcatacatggtgactttgtatttttctaatttttattatgtacaatgattaagatgacataatacatgttgtcacttttttaatgtttcagtgttgtttgcttgttggtctatgttcaaattacgtattttaaattttacatagtaaaatatgagcaataaaatcaacagtgtaaataaattaaaaatcggatgttatctgggttgtcatgtaaagaatagatggcagttcaaataacatattttattttatagtaaaatattggtaatattgattttaaattatttagctgtctaattatgaaacaaccgttcaaataaactaaataaaaacatatatactacctctgtttcatattataagtcatttgtcattttgactttttcttgtcatttttttacgtttgaccaagtttatagaaaaatatagtaaaattttacaaaaaaaaacatattatggatatatattgaatgttatatctaacaaaataattttgtgtgatagatgttgttaaattttttatatgtattggtcaaacctaaagaattttaattaagaaaaaagttaaaaggacttataatatgaaatagagggagtaactttttagaattatgattattttgctatgtaactattatcttttttctaaattgttagttaaaaatagatttgttatttataaaagcatgcatctaatcattaatattttatatatttaggcatgggacacgcaatcaagagtccacagccattctcgtgagatagaagtgtagaaattaattattaagtaataaaagaaaaatcttaactaccatacataaaaaaaggaaagagatgaggagaaggagacgagaacttacgtaaggtagtaattgaggaaggatatttttttatgagataaatctaattggcccatcagtttaaattatatattttttctaatttattagagtgccacgtggcggcttagaagctgacggagctcgtggctcctcaccgggagaccgcgcaggcccccctttgccagttcggccgggggcttagggtgagatctcaagctctctctgtatgtggaaagattgcgtgcccggaagaaacgcgagacacggacgatgtatacaggttcgggccgctgggaagcgtaataccctactcctgtgttttggtggatttgtgtgtggaggagctacaaagtctgagccgacctatcccttgttctaggctctaaatctggaaaaaatcaatcctcccttccctatgggcaaggtcctccttttatactttaaggggataccacatgcactcttccctttccaaactggacttttcttctttacataaatggacggagatttgcacggttgccctccgaacgtccttctgatgggacggcacatacctacctccacttctgccgggggcaggcgcgtcgtgggaacgtggctgtgagctgacgacatgagcagtgtcagaccggtcacaaatcggtcatccttgtccaccgcgtgtcagcttagcaacgtgcatgtttgcccttcttcacacaacatcttgcctgtaatggttaggatgaagcctggtattcatctaaccagggctaacgtgtcatctctaagaggtaacacgctagctccggctggagacgcgtgcctagaggctctcgtcttgacgggacggggcgaggcgtgcgtcagaccgccagtcgccacctaaccgttgatctgaccggtctgtgactggtcacagaccggataaaagagcgcgctgcattgcgctgcatgcagcgtgacacgcttgaccagaccgcaataaatgcggttaggtgagccctaccgtgttcacccaacctatgtacatagtgcaaaccccacaaggggtcggggcacctcggccctcggggccggggcaggagcaacccgacccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcgatcatccttctcaagggaagcggtcgggcatgacgccactcataaagcctggtgacaggtgggaccggtctccgtgattgggcagaaacccaacggtctcaaaccacgcatatcggtaacggtgccatggccgtcagtcatgggcggtctcttcaagactgccgcatcacttgagcagcgctcgaatctaggcgtgcagattcgtttcgtctggagatatggtaacgtcgcttcggtcggcgagcgtaattaacgcgcacacgatacgatctatctcgactgccacaaccgcatatccacctcatgcgccgcaagcaggcgaatggaattagtggaagcgtgggcgcgagaaacgagggaacgagatagcgagtaacgagggagcgagatagtgggcacgagaaacgaggagccgggctcagcgatgggaagggtataaagccatcaaggaaaggacttgctcccttcctttcgccactattcccctttccttcgccgtttgcgccctaaactcactctttgctacgcctcaccttcgccacacacactcgttctcaaccctttctttctccgacgacatggcacggggctccgctctgctcgacggtagcgtactaccgccttcccgcattgtgagcgagaggcaggctgggctgccgcgccgcttcatgccggaatccgccaccggccgggagatagtgatgctgggcgaggcgcgcccagcaccagattacccggggcggtccatcttcttcctccccttcgcgatggccgggttggttcctcctttttcttctttctttatggatgttctggagttctacgatctccagatggcgcacctcacccccaacgcagtgatgactttggccatcttcgcgcacctgtgcgagatgttcattggggtgcgcccatctcttcggctgttccggtggttcttcaccgtgcagtcggtgtcgccgccgtcggtggtcggtggttgctacttccagccgcgggggccggtgttgaaccgctacatcccctgcgcccttcgcaagaagtgggacgattggaagagcgactggttctacaccccccttgccaacgaagcgtgcctccgactcccaagccagcccccggcgccggtctccagctggcgggcgccagtagatctgggggatgactatgacgccgtcctcgaccgcctggcgggcctgcgatctcaggggctcacaggggccatggtgtacggcgactacctccgtcgccggattgcgccgcttcagcggcgcgcccggagcgcatgggagtacaccgggtccgaggactacatgaggacccactggggagtcagatgggattgggctcccgatgacttcaagatcgtggtccaaagggtgctgaatctcagctccgtggaggcgtctcttattcctcaaggactcctccccctctgttgcgatccagaccgcgcctccattctgaccatcatgatgggggtcggggcctcagaggaggtggctcctaagggccacgacggcgccggcgggagccgccaggaagaatcaaccccaggagggggccgtgcttctgggccccgcgacgggggctcgggaagcaaccgccctgccgccgcccgggggaagaggaaacagggaggaacaccccccccatctcctccccgagggggcggggcggtgcgtgccagcagcaggcgcccggagggggccgtgccgacatcacagcccgagacggaacgcaagaagaagcggctccgcaagacgggggagacggaaccatcccggggaaacctgatttcccctccaaggtggtcgttcaaccgaccccctcgcaggttcgtttcacgcctttcacaaccatcttccctttatcccaatcagcaagttttctcttatccatcttgtttgtcttccggttttttcttctgcttcagcgatgtcccgtcgcgttcctcccgccatcccaagtccggccaatccgaggccgaagatccggcggccgcagaggaacggaggcgagaatctgaccggcgagaggccgcagatcgccttcgggaagctgaagaggccgcccgggaggccgctcgggttcggcaggcggaggataccgctcgggaggaggccgcccgggctcgccaagccgaagaagctgctcgggaggaggccgcccaggctcgtcaggctgaagaagccattcgggaggtaaccgcccgggctcgccaggctgaggcgatggcgtcttccgaggcggttcacgacaagaccgccggcgcgtcgctcgggcccactccctcgggtgacgctcaggcgacaacctccggggcggctcgcgacaaggccgcgggcgcatctcctgggcccgctccctcgggcgacgcccaggaccaagcgggtccgggggacatccccgagctcagtgcgtcttctggcgggccgagccgcgtcgcattttctccaaggcggctcttctcctcgtcttctgccgccccgctgagtgccgagccccttctgcaagccttggccgccgcaaacaccgcggtgctagatggattcagcgcccaggtggaggccttgcgagcggaacgagcggagctcgaggccgcatgagcgcgcgtcgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgccctcatcgccaccaccgcgatgattgaggcgcaggactccctccgccttcaacacgggagctgggaggcggagctaaagaaaaaactcgacgccgcccagggggtccttgacgccgccgctgcccgagagcagcgagcaacggaggctgaagcggcatcccgacggcgcgaagaggcccttgaggcccgtgccatggtgctggaagatcatgccggcgccgtggagaccagcttggcggaccgcgaggccgccgccgctatccgggaggcgacgctggcggcgcacgaggccgcctgcgccgaagaggagtccgcgctccggctccgcgaggacgcgcttgctgagcgggagcgagctcttgaggagtccgaggccgcgacacaatggctggcggacagcctgtccctccgcgaggcagcgcaggaggagcaggcgcgccgcaatctggaatgcgtccgcgccgagagagccgcgctggagcagcgggctgctaacctcgaggcgcgagaaaaggagctggacgcgagggagcgcagcggcggggcggctacgggcgaaagcgacttagtcgcccgcctcgcagctgccgaacacaccgtcgcagacatgcagcgcgccctggactcatccaccggggaagccgaggccctccgcttggcgggcgaaatagggcccggcatgctttgggatgcggtctcccggctggatcgcgccggtcgggaagcgggcctctggaaaggccagacaatttcgcgctccaccaatctggaaggcctcgccccgcaccttaggaggatggcctgggctgtccaacaactccccgaggagctcgagaagaccatcaagtcatcctcgagggacctcgcccaaggagcggtggaactcgtgttagcgagttaccaggccagggaccccggcttctccccatggacggcgctggaggagttccctcccgggaccgaggacgatgcgcgcgcgcgggtccgggatgccgccaaccacatcgtccaaagcttcgaggggtcggcccctcggctcgcgttcgcccccagctccgacgaggagggcgacgccagcggtgaggacgacggtggcgacgaggccggcgacccgggcacattggaatgagcccccaggcccccgccaatctccaattttttctttttctttcttctttttgtatagatcaacttaatctgcaatcaaaaatgatgaaaaatttcttatgttaactttattttgctatgcatatgagttgaggatgatttgtgccgtggtccttttgcattttagcttgatttaagggctcgtgctcaagtcccgatcctcaaatggctcgggtcggggctagtgcctggggagatccacatgtcgagactggccgggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattcttcagaaaaaaacggcacagatcatcctttaggaaattgaaactgcttttattgaaatgctgaaataagaaaagtaaggctgtgcatgtgtggtagcccccggctaaccctgcacacccgaggggggtgcagggttagcccgagcccgaaacctgacacccgaccccccccctcaggggtagaagcgacgaaggtgttcgatgttccacgggtttggcagttcagtgccgtcgcccgtggccagccgtacggagcccggccgggggacgccgatcactcgatacggaccctcccacattggtgagagcttgctcagtccagcacgcgtttgaacgcggcgtaggacgaggtcgtcgacgcagagtgatcgggcccggacgtggcgctgatggtagcgccgcaggctctgctggtagcgcgcggctcggagggccgcgcgccgccctcgctcttccaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggtaactcctcgatccataaatcgccgtgcttcttgagaatattgaaggtcttggttttaaggcctttgaggatttctgcattggcgcgctccacttggccattgcttctgggatgagcaggcgaggcgaagcagagtttgatgcccatgtcttcgcagtagttgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacaggggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtacgcgaggcggaatgggctccgcactcgccttcatggatgtcagcaagaagctcaacgccttgttcctgaggaatgcacttcaggaggattccgttagccgcgcgccgatagagggtcccttctaccaacacgtagcgtttggaaatgcgttgtacgcgttcactcccttcgcggtcctcaggtagagtcttatctgtgaggtatgtttggatcttagagatccaagcaatcaatctaagggagcttggagcgctcccttcgggtcccgaggcctggactccaacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgcacttggcgtacataggcgtccatttgcgggtcagagcaccggtactccttacagacctggttaacgaccagctgggaatcgcctaacaccaggagacggcggatccccagtccggctgccaccctgagtccggcaaggagtccctcgtactctgccatattattggtcgctcgaaagtcgaggcggaccagatatctaaggacgtctccggtcggggagatcaacgtgacccccgcaccggcaccctggagggacagagaaccatcgaactgcatcacccagtgggtggtgtgaggcagctgcgaggggttcgtgctggcctcggggattgagacggtctctggagccggggtccactctgccacaaaatcggcgagggcctggctcttgatagcgtggcgtggttcaaagtgcagatcgaactcagaaagctcgattgcccattttaccacccgtcctgtaccctctcgattatgcaagatttgaccgagggggtaagacgtaaccacagtgaccctatgtgcctgaaaataatggcgcagtttccttgaggccatcagaatagcgtaaagcatcttctgggcctgagggtatcgggtcttagcgtcccggagggcctcactaacaaagtagacaggccgctgcacccttcggtggggccgatcctctctgctaggggccgtatccccggggcgttcttcgttcaagtggcctttcggggcgcacttgtcttctgtgccgatgacctcggggtcggaggatgaaaggggcggccttccctcagtggcctcggggccgtcctgagggtcgggggctcctggcatcgtcggacaagcgggcaaagggccaactccggtcgtcaggggcctctggcctccgttcggctcgggggcctcttctccctgctctttcccgggtcgagtcagcacagggttagcctcggggtcagaaggcgttaagtgcggccttcccgcagtggccttggggccctcctgagggtcgggggcacctagcaccgtctgacaagcgggcagaggtccgactccggtcgtctggggccgtaggccaccgtccgactcgggggcctatgctccccgctcgctcccgggccaagttagcacagaatgggggtgcacgaaatgaggattgtcttcatcgcgctccacaaccaacgctgcactaactacttggggggtcgccgctaagtaaagtagcaggggctcatttggctccggggcgactagaaccgggggagagctgagatatgcctttaactgagtaagggcatgttcagcttcctccgtccaagtaaacggccccgagcgcttgaggagcttaaacaagggtagcgccttctctcccagccttgatatgaaacgacttagggcggccatgcaaccggtaacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcagggttcagctttatgcgggcggagcggaggttctcaaaagtttccgctagatctgaaagtaaagtttcttggttgcgcgtttttacaaccaagtcatcaacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttagggcatgccttgttaaggtcggtgtagtcgatgcacatccgaagcttgccgttcgccttgggaacgaccaccgggttcgccagccactccggatggatgacttcacggatgaatccggcctccagaagtctcaccacctcctcgcggatgaaggcttgacgttccggggcctgccgccgcactttctgccggaccggccttgcgcccggtcgcacggcgagacggcgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacaaagatggggccaccggggcccggcatcttcatctggaggtaggcgtagtggaccgccgccatgaacttcaccaacgcgggtctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgatgatcggatgagacggctggagcaccatccccggggccttgatagcatcaaaggccgcgggggaaaggatgttgagagccgctcctccatctatgaggacacgccccaacttcacattgcagatagtgggggaaaccaccatcgcaatctgccctccccgggcgacgcacggtgggtggtcggtctggtcaaaggtgagggccacctccgaccaccgcgcccgacgcgtggcctcatgagtaggggccgcggcgagaagctctcgcctcatggccttaaaactccggcgagaaacgtgagcacacgctcccccgtcgacagtggcaatggtggccccaggttcctggaaacctaggtcatcatcaccgtcatcgacgtcaacggcgggggccttctgtttggcctcacttcgccgtttaccggagggaactgccgcggacttgccctcacggcgttcctgcctcctgtcctcctcccacttcctcgttcgctcagccaagtttttgactgcgcgacagtccgcgagatcgtggagggaggtgttgtggacggagcaccacttgctggctgggcgctcccggctgggagtaccagcctctttctttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcactgcgtgtgcagggatgcaaggtatagtattgcggacttggcagaaacgctgaatgtacgagcgaagggattcatcatcccctcgctgtactgcgtgcaagtccgcttcttcacctgggcgtggataagtgccttgaaagttcatggtgaactgctggcacagatcctcccaggagtggaccgacgcgggtggcaggttcattagccaaccccgtgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccgataccaccagccgggggcacggagggctggtcctcacgtccatgtcgaggtgacactctggacgaggaggcgccctccgttgcacggggagtacgccggctattacgccggcgctcgatgttgaggcgggcatccggctccccatgctgatcctcccgagtcgaaggtgtcgacgagggagtggcagccgaatgccgtgcagccgccgccgctcgccgcgccctccgccttgatgacacggaaccggtggtggcggcgccggaggtcttggtggtggcggaccgtccaccagcacccaggcgctgctgggccgtcatgaccaagttggccacgtcgtccagccatcgctgagctggagactcagggtcatggacgacgggcgggtgacgtaggagcgcgccagcagcctgaagcgcgccctgaggcgtgctgccgtcgccgtagacgaggaggcgacgctccccatctcgccgttctcctgcatcacccgcgaccggtgatgctgcggatttatcaaccctctcgagcgcctccccctgcttaggactttggtgtggaggtgggggagtacgagctcgacggcgtgggtttggctccccgtcgtcgccgctcacactcggagagaggtcgtgcgcctttgcttgctcggccattaggcagaacaagggaaacttggcgcacacggaagagtatgagagctcagaaaacacacgctgagccccctacctggcgcgccagatgacggagctcgtggctcctcaccgggagaccgcgcaggcccccctttgccagttcggccgggggcttagggtgagatctcaagctctctctgtatgtggaaagattgcgtgcccggaagaaacgcgagacacggacgatgtatacaggttcgggccgctgggaagcgtaataccctactcctgtgttttggtggatttgtgtgtggaggagctacaaagtctgagccgacctatcccttgttctaggctctaaatctggaaaaaatcaatcctcccttccctatgggcaaggtcctccttttatactttaaggggataccacatgcactcttccctttccaaactggacttttcttctttacataaatggacggagatttgcacggttgccctccgaacgtccttctgatgggacggcacatacctacctccacttctgccgggggcaggcgcgtcgtgggaacgtggctgtgagctgacgacatgagcagtgtcagaccggtcacaaatcggtcatccttgtccaccgcgtgtcag

SEQ ID NO: 80621 - DNA, 10736 bp, Oryza sativa
tccacctgtgcaaaatttccaaatcctgatggtcaattggttaccatgcactatatatgaatcgatatggaatgatgcatgctttattgttgcagttaatttcaacagagtaaaacggaaggagcgatggattctctacgccttgcaagtgcaatatgaaatgctggggatacgacatttcagattcatgcttcaagtgatcaccatatgctgataagctgagagtatgctcaaatgctcagccagaccttctcttagaggtaattcaatcatggatactttctatttttctctgcaagttcacttgcaatatattagtaagaaaattatatatattgcaaagtataggagccattgtcatttttgttatatatggcttccatcacccccattgattactggccaagacatggtatatgttttttccatgtagattgagagggaaaatatattatgactcatgatgttttaaggtccgaattaacatttcaaattatactgtggcttctgactctgtagatcaaaattattgcagttgcattatgccattagatgatttcagaaattcctgaacattgcataattcactcaattgacttaacgttgcctctgctttagcttgtccatgccatgctttgtttggatagttccaaagatatatttgctattgatcagaatcaaaataaaactcacaaagtttagagcttgtgtgatatatgggagtcctctgtttatatctcttgagtgttcactctgatataatcatgcaaattggagggtatgtgtgtaagcgccagtttgattattgtatttacccaaaaataatgattgttgtatatttgcatattaggttgtgcaatgcatactctttgagatgttgcactgcaactgcacaaatcttgatctttttttgtgcctgtattttcaccaggtttcacttgatgaggaaatgagtttatagatgtgtagagaatctgaaaaagatatttgggaagagatggtaggtgcatttcagacaatggcaaggagccaaggaggtaatttctgttgtgcgttatgaattagaattagcgatctaatctgtactgcacgttttccatttcttgatgagaatgtgatcaaaacgactttattggaaataccaggttcagaggttgcttaacttgatgaacctattggaaagggtgacaaagatttcgacaggtttttacttgttttgagcttaatccatatgggaactgttacagtaaactgaaattcacatttgtaattcacatgtaaaccattgacatgacagtgaaaccactggccattttgctggtatagtgatattagggccatacatgaattatagttcagtctttttttataaactttggtgatgaagttcagatctcttcctgttactgtattgaagctgcaatcatttcaaaaatttcggaactcaattctttttctgatggtagcagtatacatgtcattttgctggttttttttctttttttcttttttgctttaaggggatcagggcaggacagaaagaacactatgaccatgtccccatggcccatgtccatgtacgcatcaagctcccaagtgataatctgattgcctgctctgatcctaggcgccggcggaatcaaccttgacccatcaatgatggtcatcccccattgacgatcacatggtccacagagatcatggtgtcttggacaccaccattatttctgacggtttaagctttgtctccacaattttttatctctgtttttgcttctgatggtttatacttcagagtttggaactgaatgctcatactctagatgaattggtcatgtacttgaaattttgcacatttggtactgaatctgcactcaaagtgggtttcttgatttggttaggtacattgtataagctaggttcgcattttgtacaattgattaaataatatggtttgtctatttgcgtagcttcacgctattctgtctgtaaatctacagagcaatatatttgattgaatttagcttagccttttcgtgcattgcacgtgcattgttactggccatccatggaattaaatgtgttgtagaaactggcaagtgtcaattcagagtgaccatttaggattccatggtgtgcatgctttcttgtggcatactggtcttaggagttcaaatagagttttagtgcatagattaaagtgagataaaagtttatgcctgaatatataatttggtcatcttaattcattttcaggaatgttaatatgtatttatgtttccttttttctcaaaaaataaaacccaccgcagagaatgtatggagcataaatatgttctttctaacagaagttttgagtacttaattttgtgcagctttcttaaactagctagccctagaatgatcctgtttgttgaattggctgtaaagatggagggtatctaggtaaaaccgtaaaagatagacaatttatcaaatgcatcgtctactctgattgtatattcgtaaactattgtcctttctagggagtaatttgggtaaattcagctgagggaataggaaaattctccttttccttcaaattattgtgttttacggcaatgagaaaataagatcaattgtattctcctgtaaggaattaatttgttcttctgtaagaaaagaatgctctgatagttattctctttactacttactgtatcacttctagctgacaatcatttaaatttagatcacaaatgtttgtttacggaagtagcagcagtgcaatgtatgaattttaggtggcaatttcgtaccttttgcgaatatttttttttacctttgctggtcagaaaattgtaattgaacacaaggtttttatagatatcactgaccaaattgtcatcttaggataacctataaaattttgttctccattcgtaattgtttgttagttatatattgtcaacatgtgccttgcacgtgaatgataactagtacttcgataatatatcacattttcaattaattttttacttttcaaacaaatacgagccattagacgtaaaattaaatagtgccaacagtcaatattaaaaggcaaccaagtttggatgaagaaagttattaaaagcaaaggttactgctaaatctccgtattggcaaaaaagggctgtgattcgtgacagactgatagataaagacaacaaacatgcagtgatatgtgcagagcatctggaataggagtgaaatttactccaccaagaatctttggagtttttcaagaacaagaatcaaacctagatgaccatgcaaattcatccagcaaactttttccttgcggttcatccaggtttaagttttatacttgatgtgaatgcttgtatttatggataacttttttagtggtaggcgatgtacccatttacaacgagatgtctgatgattttgtctatctcaagatatatcgaatcagctttttggaagtacttgtatatgtagggtttgcatgtgtattcatatgagtgagtatgtgcgtattaattatgaacacttgcatgtatgctgcggttcgaaaaaaaaacaatcacactctggaaaaccattaatttatttattttccgctgccgggagctcctcaccgtgacggcgtcatgacctgagcgagctcctcctttatctgtgtgcgcctgaccactcttcgagcacctgcgagcaaggcgcctaccagtcaaacactgttcaacttggcgcactgattgttcatgattgatgcagtgatccgggcagtgcgtattgacaggcaaagaacgtgctcccagataaagaattcatgtctaccaatatgatgcaaaatagtccagcagtcagtcgatgacatactatattgaattgcttagttttatactccatttcagttccgaggtgaagaagatgacaactccgatcagatctatcccagaacattgcttggtcgttttacttgcaagtgactcaacgaatgcatcgtgcggggcattttattaggctccgggttccggaattttcgataacgacgaggcaatcaaatgtatagtaatcccttcgtcccaagcaatttagaactggatgcaatatatattaatacaacgaatttagttatagccactgtctatatttattgtattgggatagatgtgtgtaaattcgttgtgttttatctagttctaggtttaggttattatgtattgcgacggagtactttgtaacataaagtcgcaacgcagagaggagttcatgattcggtagagaaacctgcaccgctgcacgcaccacggcaccaaccaatcaaccatggtcggctgcgtccacacctcgagtccccgactaccagccagcgtcaacgattttctaaactattcgcaagaagctggatcactttgcaaaacattgtatcgcaaaaaagggtctttatgggaacgtgatcctaaaaggggtctttatggaaaaatacggagtaaaaatacttaaaacagggatgtttctgcaaaagttccattatatgggccgtgtagcactgagaaaggatgggcttttcttgggcttaatgggctgcacatacttccaccgagaccgactccgtttcctcttcgcgtctccttcctcaccggcgaccatggccgccgccgctgccaccggcacaccgcgatggagctcctcctcttcttcgttcaatgcatttgcgtcaaggtcagtagcatcccctcccattcccttgaacccttgtcttctcctcgaccttcaagtcgcgtagcgccgtaaccagtaaccacccctcctctttgctccaatccaggaccccaccgccatcagagacctgcgctcttgtaatcctgtccctcttgggtctccaacccgctcacctatctccgccaccacgctccagtactgaggtataagttccaatccccccccaaacttgcaagaaaaaactgaatccggattgcttttgcttgcacattgcgatttggagagcgaacaagttatgccatatgttcaatttaaattggatgcatcattctatatggttacaaacttgctacgagttggcagatcgaatgcatgatggaagcttatgattagatctagaaacttgcacgcaccaaccacccttcaatagaaggatttaccctctttctagaaaagtggacaacattgcgtaaattccacatcacaacactataaacaaagggccttgttgtccagatacatatggataagtaagtgccagctctaaccccaaacatgtacacatttctaagcatcaatgcactaaacaaagggctttgatgtcaactttgaatgagccagaactgcccaaagaaaacctgcatcctgccaatacagcagcatatggaggtcatttggagcttaggagtacagaaaaacatcagaagcctgtgagcctgtgactaatgagatcactgggttgagtatacgtttcatggatagacagttgctcatctagctagtactgcttcaacctaaccaaactgcagtctgacatatgaaaaacgcatgttatttgaaaaccacaactgccgtctgacatatgaaaaacgcatgttatttgaagaccaggacgggcactcaaattgttgtacgtaatagaaacctgtatgattgggatgtgttaccaatgtctatacagctggcattctgagtaggatgtcactggtcacctaaactgtgcaaacatctgaagagcctgagatgagatctgggcatggatcaagctgaattggccacggttctcattcaatccccaaattgtgccacaatgacacctaggaagataaaatggtagacgcaaaagcacacaaaaatggaggtggaaaaagaactgaaagtgtcacacttctcacttggagagtctttgatctagtaatgcctaactcactaatccagagaggctgctctggagcagatcccaattgtatagagaggggtggcaacatggaagaaagaaagaaaaaggaaaacttctcaaaccctatacagttatctagtagaaacatgtaggagatctcaccactcaccatgcattgcaggagaaggatttcttcagcatgtgggcatcacgggaagtgatcaaaacaggatgaaatccccatacgcgcatcgcagatgcagccggcacattgatcatttgatctccaccggaagaacacacaaaagtttcttgtcatgtttccctgtcaaaagaaccaccttggttgcctcacattggaagaacggagtcctttcctctgccactcctgctgctgaagcatgatctcccggccggcgccaatctcttcatattcgcgccgtccggcaatgcccggccactgcggccgccgccgtccttgctgtgctccccgtgacaccgtcttgaggaccccgaagagcctgccaggaggccgctctccctggccaccatcagctcgtcttccaggctcgcctgcaggacatcggcaatggacatccggccttcacggtgcgtgtctgacaacgacgacggcgcccttgtgggcggcatcaaggcgccgtcttctctgatctcagctgtgccatttgcatcttccgacctccccggaccatccttcgcctcgtggttgcggccgccgttgccgacggcgacaccggtcaccacgttctgtggctcctcgcgcacatgctccgggttgtcaattgtcaggaccagctcgtggttgtctctcctatcctcccgtggaacgcgggcctccggctccggcgagaccatcccgacggtgacgaacgcgatgttgcagcggcagagcgggcagttggagtgggacttgagccaggtgtcgatgcacgggacgtggaaggcgtggctgcacttgggcagcagccggaggctctcgccttcgcggaactcgccgaggcagacggagcagtccgtgctgtccacgaagccgtcgccgcgcctgtacttgcacactgtgatcttgttgatcagcgtctcgtccatcccgtccgacagcgcgacgctccacggctcctggctcctggaattgtctccgccgtcggcgccgccgccgctgccgcggtgagcgctggagccaaggagtctgttccggagggagctgaaggtgccgcagtacttggatatgatggtgtagtagctgacgaggaggaaggcgctcgcgagcaccccgatgatggcgatgacgagcggcgagaaggttgggccggaggagtcgtcggagctggagccggtgatgtcgaaggccggcggcggtggcgggaagatgaagtagcaccactgcgggcagtacatgctgcagaggccctgggagcaatccctggttggctcatagggcacccatgtaggctgcgaaccgagatttggtgttgtagggggagaagaggccattgccgccatggatacacaagcacagcagcaacactagaggtctaaaggggagagtctaaagggatgaaggtgacaaagaagaaatcccaataaacaaagatgaacaaatctttactgctcaggccatacccagactgccatgttctagcaccggcagaggatcttcatgaatttccggtccaataattgtggcaagagatgagagaagcaagagaaggtaggtggctctgcttggacttcagtacaacccagttctttcgtggccctgggaaatgtgagatgagatgggaagagagcagcagccgtgaagaatcagagatcatgagatgagatgctgccacaccagctgctgctactaagagaaacgagagctaatctccaaagcagagagggagtgtgcttgcttggaaagcaaagcattttgggataggagagcctgaatgcttgatgaggaggagggaggtggcggtggttgggaattggggccttctttgcctttggtgccattgccaccactgctcctgctctctcgtccactaccccttttcttttcatttccctctgccggcgctgttatttcttttcctttgcctcgtttgtcccctttggaatataagaaaataaagtggatgtttggctgggataaagtaataaaaatatggagtgatgctggtacaaaaatgcagtgtgactgtgttccaaaatcccaagactaaacagtgaagggaataagaccattttggaaattgcttagatcgtcgaagaaactcagcaaccaagggtgtgtttagttctttgggtgtaaagtttttgaagtatacggacacacatttgaagtattaaatgtaaactaataacaaaataaattatagattccgcctgtaaactgtgacacgaatttattaagcctaattaattcgtcattagcaaatgtttactgtagcatcacattgtcaaatcatggcgtaattatgctcaaaagattcgtctcgcaatttacatacaaactgtgcaattgtttttttccccacgtttaatgccccatgcacgtgtccaaacatttgatgtgacgttttttgccaaattttttgggatctaaacaaggcccaagactattttagttccaaggtttttttagtccatggtgcactgacgatttcgttcaagttggttgtccactagtcaaaatgaaccgactaaagtgggaacccgagaatacggtctccgtcacgaaaaaaccaacttctgaatatgaacttagacggatacttgtccaaattcgtctttagaagttagttttttttttacggagatttacctcttcatatggcttgcacaataattattctacatcataagatgacatatagagtaatgctctacgtctagtttgaatgtcaatgtagtaaatattaaggggtcggtcattaaaaaaaagtaattttcttgttcctgtgaggtaaaatacatgcgacgaattatctaaaattccaaggtttagaattttccattacctgagagagtatatacggagtatatcttaacatttttgtctcccaatatcagtaggaaaacattaaatttagcttactcccaagagttattttcataaaggaaaggtatgaaagaatgcagtatgtttagtcctcctatcaacgactatatatgcacattagcgcatatctgagaatcttgagtcactctcacatcattcagctaaaatttctctggcttcaagtaagttaaaagacaacggcggccggtctaccaaaccggtcaccactcaccagcttctttctttacatttacttcttcttagacacttaatccttccttctgtcaactcaagtcattaatgtctttgcactggtacaactacacaatagcctggtcacctaatcacacttcctcttgagtaccatatacgaccatcatataccttgcttaattcagacaaagctcgcgactatagattttatttattttctgagtgcagttgataaaatggactgcattgctgtaggttgtattgcattagcactagaggcaactgtttttactcttggtaggaatcgaagtactttcagaataagagaaagaaaaaaaaagaaaaaaccttcgagattttatactggaaggcaggacaaagattcatgagcatatcaagttggcttgcgacgaaaaaataatttaatctgatggaccagatagtgaaggccgatctgttctaataggtgtgattccttttagttttggggcataaatacgtcgttgtcgtacaatggggtcggcattcggccatgtgtgacagcaacaaggtgtgtgcagttgacgatgggaaaaataagtggggaacatgcggtccaagggagctctgcagttccattcatttgaaaggtgaagaccacctaattgctgtcctctttgttggtaaaaatcggaggattaccaaatgactgtcggtgtttttatacgtactgggaataatatcttcagcaacaaacaatatgaatcaagtgaactgacaaagaaaacatatattcaactgcattggagaaatttaaaggggaacagagtaaattcatagcaggtggtttagggctttaggctaatatcatcaaaggtattatcatcatgtggaaacaacgagtgtacaactttgtagtaccacctaaaagttaatctgttggctgctcctccgattccctccatacccttttcttctttgatacctttctacaagccgaatttagttcgaagttgtcaagatttacagagatgccatgttctaatgcgggtgtgaaccatcatgagacaaaataacagaatagagcaactttaactgaactgaggctccgacggaacgaaagtagtatccaagattgatgagtgctatttcctttatattttcttatagacgaattgcgcaagtagaatcacatcacaactttcctatcccctttttgctatttctctatttcttttcatctggatacgtgtaagaaagcagattaatggaagaagatttgttggagaagaaagatgtagttagaattttggaccacaagaacatgaggcatggggtcatcctgtcttccttttctaaaagaatcagtaccactcttaccttgctaattacatagtaaagcaaaaaaaacacttgctgacatgtggatttactgaaagaaaacggcagcagagtagattaacctcatggaattcatcttggtagcaaagcttttctgctttgcattaatctggtccaccctggctcattacagtttgagggagcggccgctttacgttttgtaccagtgaacagtactgcagattt

SEQ ID NO: 80622 - DNA, 4411 bp, Oryza sativa
gtcatagggatactatttagggtttttcttctttagatgtctccaacaatactgtactacggcctatgggctatggccgtggatgaggaatacttctctgatcaattttttttgggtctgtatcaaaccaatgcttcagttccagtgttgctgtccataattcataccctgtccactgattattaagtactctcattagcacgaatctaaatcaagaatatatgaatgtaatgatgcaacagatgatttcgctcttcaatagcatctcaaagttgttgggaactaatttatggcttccaaagaaagaacaaaaacacaatctatggtacatctgatccaaagaaattaatacaactgaaccttgagtgatagactgttttctttcagaagacgatggtgtggaccgatctcaatggtttacaactttacataggatatgtcaatagcatcatggtaccgtaaggatgaaaaatagtgatcggatctacgacatgtggtatagttatatcaaagctttgctggaaaagcatggacgaggggtaactaaaattcagactttcctttgctttgatgagctgtaaaaggatggatccacttgctggacctcactttacatgataaaataaagctgggcactatgtaaagagagaaatgtggagctacatggcacatattatgccaatgcagaaactgctgggctcttctaaattatacactgtttgaaagcgaaatgagatcatgtaaatgatgttaccatgtagcagaagactggtggtgagtgtcagctaggaaatgcagatggtttgtcagaacatagacaatagtagcataaaaagatgtggcagtatgcatgaagcaaaggtccaataattacagtgaattggttgtaactagagaaatagacactgagactggattcgatgcaaacaaaggtaaagctgcaaaaagaagatcacacacacttgagttgggttatcctttcttgggcttatcggtgaagaaactgagttctgaatatcaggttggctacatcatttgcattctgcaagcacggcaatgttcctagcgcgaattacgtgtacttgggagtagtagttaacagtagttacatgggagcgttatttccacaaacactaactacgagaaagttattataccggcaaatggaggcataaatttgttgataagttgataacaaaggagcctatccttcagctgtctagtaaacattatcaggacacgtcaacaatacgctagtagcaaagctgagcaagttgtcaccccggcaaccataagcttaaagtcgttaggaacaaaagctaaaaataagtcctttaactatagagcataatcaagccacatggaagttgtgcttctggtgaagccgggcatattctgctctaaccgacaacgcgaaagaatacctctttggatggcaatatcaaaagttgctcgttgtaggacctcgtgtgtaaggaagataaacgcatgcacgcgtcgcgcagattttgttgttttattggtcaggtgatgctcgcgcttgcgccacatgtttggcaggcaagttcagcgaactgtcgaattctgaaacaatcagggcagctgcccgacggcatccatgatccatccatctgaactaataaatcaggcacacaccaccattggccggagacccggagtcccgtcctcatgccggcatcggaaatgaacgaggagaagcacaaaactcagatcgcaccgtgcgtgaagccttgggagttgggagtcagcggcgcacggcgctcggcgctccacccgcaggaggaggccgtgcgaaggaggtttgcttctcggtgcgcacggccacggagcgtaaaaagtggcgtccgtgccgccgcccgctcacgtgcactcgcgaccccgcgggcggctggcggctggctctgctcggcgtctttgcgccttgtcatactaggccgagtggaccgagtccacctccgagacgcgagcagcaaatggcccacggtttactcgggcccaaccgagaaatcctcggcaaaaatcctaggccgaaaggtgaggccccgtgaaatcaccaaacctgtcacctcaaatcgtcaatcgaaggaataagatcactgtaggttccttaatatgtcgttcagtctgatttttatcctcagtttgaaaaatgggatatgatacatccctcaacttataaaatcatataaacaagatccatcagcagtattgatcatagttttagctgatgggctcctacatggtgacgcctatgtggctcctttgactaggtcttcgtcccacgtggcattgacgtggcgcttacgcgacaattcgattacgacacacgtgggacccacatgttagttacacaaaaaaatggtggggcctatatggcccaacatgtcatctccctactccctcttctctctatatgaggacggagcaaccatctcctcgcaggcctcacgggactccccgcctcctcctgccttgcccccgttgccggcgggggaaaggagcggcgcgcggcaggtcgttgtggagcggcggagggccacatcggagctgaggggcagagcagtggcgggctgcaggtggctcttctcctcccactggccggtgccccgcaccgctccgcccggaaccgcgacttctctcccgcttggctctaccgttcctctcccgcctcgacgaggtggacgaccgcgacgatgtccttcttatccgctcgccccactccgcccgcggcccgtcgccactctgaccacccgctggccgctccgcccctctgctctgctcacgacccgccgccatgcgccgctcctttccccgccggcgataggggcgaggcagggagtccggcgaggccggcaaggaggtggctgatccgcccgcttccgcccctctgctccgggcgtatatagaggagaagagggagtagagagatgacatgtgggtcccacgtgtgttattattttttgtaaccgaattgtcacgtaagcgccacatcaatgccacgtgggatgcagacctagtcaaaggagctacataggcgccacatcaactaaaaccatggtcaacactgccgagggaatttgttcgcatgattttgtaagttgggaatgtgtcatatcggttttccgaactaaggacgaaaatcaaactagacgacaaattgagggacctagagtgaacttattcttcaatcgaatgacaggcccgtatttgggccgaaaggagaggcccggtgacacaactgcctggttgccctaccatagtctattcagtattccgtctgtctgcactctgcaggagttcatcaaaaaaaaaaaaaaaagagccgctaatgttccatcaaaaaggaaatctgttcacgcggtacttgagacatgaatgcatatggctaattggccggcatgcggcatcaattcgaagagacgctttgcagtttgaatggtgagcactgagcacggttgggaagtggatggtcaggaggatacgaagccctcttcaagacggaacagagtacggtgttaatgcagaaactctcaggtcagcctgctcttttaggtacttacggaattgtgctggttccagcatctcttagcgcaaacccgtgatggtggttgattgatttcgagcctaattctgttattctgtggggacctgattgttgtgtttgtctttgccgatatttgtagaagggaactttctgcaacttgcattttgcaatcctggggccttgtttggcttaatcccctgtgtagttgtcttttgtcgaaatcgatgatcaaacgaatcagagaaacaaaagaaaactctaagttagacttgctgggtaaagtctttcactgatttccttgaatgcctcttaaaatgcgagggtttggttccaacaagaagacctcttaggatgcgttctaaagagctcttttgctaggcttcttattcatttattaagagcacgcttaccaaactgctaaactatgaatatcgtgaataaagttttctttaaaaataaaaaaaatgtttttaaatttataatagttattaatactctgtacagattcatagtattaggatatgtcacattcatccaaaatctcttactccctccattccaaaatataaggcacaactacccttaacccaaagaccaagaaacaattattatcatctcctagtttaaatcaccctaataaatataatgcatgcatccaataaattctgatatatatatatatatatatatatatatatatatatatatatatatatatatatatatatatatatatatatatatatatatatatatatatataaaaaaaccgcacccaatccgtggtaaccgcggagaccgagaaaaaccgcacgagaccgcgcagaatttataaaaaattcaaat

SEQ ID NO: 80623 - DNA, 11712 bp, Oryza sativa
  unsure (1)..(11712): unsure at all n locations
tcaagcacatgatgcatgtaattattgagtgaatacccagataatagatcctgcgtccccaggtgccattgtatccttaaggtcaccattggatctagttgcaccgaccttaatggtatcaggctagtttgatgaaggacgaagggaaaagtgagggaagcagtaaagcaccaccctccctaaacattgctggtgcacactgagtcactgactggtcgtggttgactctatactgtggggcaccaggcaagcaacaagattgaaactaactggacggtatttggcagattgggcgatcagcggctatgggcaaagagtttaaggaggggagcatgatccctcatctacatcgtgctttgatggtcgacatgctttttgaactccacatgtgtctccgttgctaagaaagaagaggacactactagaaaaatgtttttttcaggctgccaaaaatgattttttccggcgggggaacgatccatttgtatgccgatgattttcgcagggcgacccagtcacccgcctgtgaaaatcatctcgacgaacaaaaaaaatatcgccaccaccccacccgcgcccctaccaatctccggctgatctagggttaggggaactgccgccgccgccgccgccgccctcccccagcctcactccggccggatctgggagggaggggaactgtcgccaccgccaccaccctcccccggcctccctccggccggatctgggagggaggggaggggaaccgcgccgaccccgccgcctcgctgttgccgtcgtcgacctcgcgcctcgccgtcgccgacccgccgcctccacgcgtttctaccgcccctgttgctggtcgctgagggagctgagggagaggagaggagagctgagaggagaggtgaggtgagacttagaaaaaatcgcggtgccatgtcgtgtctatttatatccatgccaatttccgcaggcggatcacataagaggtccgcttgcaaaagtaaagggtatttttgcatgcttacttttgcaggcgggcgcctgcgaaaaccggacaacgaatttcaaccaggtttgcattttttgtaggcggccatttcgctccgagggtaatgtctgcctgggaaaaaataccccatgtctgcaaaaatgttttttctagtagagggagacattagattttaaaccactagatgataaatttagggattaaaaatgcacttttagactttatcaacctagctgatagccgattgtaattttgacatcaaccagcatattttattctttgtgtttttcttttgaacaatataattaatcaaacaggaactaactatatatccctccaggcagagggtaatatgtatgcattatcgtcacaagacaaaattaagctataaccactaacaagatagggtcatgacctatggcgtactattattcatatctatctacatgatgcatcggctgcgatgatctcatcaattgaacccacccagttatacctcagccaaagggataaaatcgctccaaaaaacttggcaaggaaagccataagccccctgcgttcgcgaaagccataagcccccacccccaacttcttgcaacggaacatgcaagtacgatgcatctctgtcgctttcgttatctcgagcaaacgagacatacacgccgcgagtaatccaaatccaggatgggcaatggcatcgcgcgcgatgcaattgcaatgcacagtcacgattcacttcacccaaaagtcacgcgagaaacctaacccctacgcaaggtgaaagccggcgaatccacggcgactcgcactggccgtccgatgctgaaacggcccaccactcggcgctacgcatcacggtccatccactccagtcccgcagccctggtggcccacagggtcgggcccacgtgacggcgaggtcggtctaatccaacaggtccatgtcacggcggtgactaatcgatcaaagttagggagcaaatgacacaagggagaggattaaaaaactccaatagagagaaaagaaagtcatgggtggcatgggggcgttggatggtgggtggcaacgtcagggtggccatggcacacgctggtggaggcgttttccgtcacaatattccagcctccgatcgacgacagggcacactcgcgcgcacgaaatgctgtcgattgccgaatcgcaccggacggactggttgagcacttgtttgatctgccgggttggacaggaagcgagcagtccccccttgcaagttgcaacgacatatcaagatatcactgcatcgaccgagagcttcggtgagaaaaaaatcgcagcgaggtgcctagtgggaactcagctttgccgcgcgataaatgcgcgacgtcgattgggggggaggaacggcttcttctggacggacgggaacggctgcaccggtgcaaggaaaaaaagcagagttgggcggaggtagccgtcgccgtcgagggcggccgctttcggggacaaatggcgggtcaatcaagttaggcggcgtcgcacggcacggcacggctcagcatcggcgtccacgacggttggccgagggccgagtcgtgccaccgtatatgcccagtgactcaccgctccagcctccagaagataccgaccccctccgcgcggcatctttcacgcgcgcccgagaagtccaaacacgtgccgccctcccgtcctcccgggcgcccgtgtgaccccctcgtgcaccggcatttcaccgagcaaccacctcaccgtatcagcagcggccacggcgagcagcctcttcatgccgcgtctgtgctggggtacacctgcagaatgtcaaagacacaccgctctgcgagtgaattagtgatcgatgagtcactcgaccgaatgcagcattggaagcgatccaaccaaaaacccgtggcgattccggggtaatttggagcagcaactcttttttttttattacatgggtaatataatgcacatatgaatatcccactgtgtgactgtctcctaccccaccacaactcttgtacatctacaatatggaggttactactactgctactatatttttacacggttgcgaaacttagttgccgttaccgagtcgtaagcacccagcagtgcttggacttgactgggtactaactaggagtaactgaactgtaactaaaaccgaaactgaaaagtaacaaacaagctataatatgtatgtgacgtggcttactgctcttgcccttctccggcattacgccggccggcctccgggaagggaagcgccgggctcgccgccattccggggcacacggttattgtgtttggctatgtcatgtgtacagtacactatgttgatcaggcgcggacgcgtcgagactccctagaactcgacgatgaggctgccgaagggggaccggtgcgggacgcccttgcggcgcttgttgccggtgcggtagctggcggaggtcggcggcggggtcaacggcgtgaagctctgcacgacgctgctcttgtcgctgctgccgccgctggtgctcgtgcacgagtcctcggactcgtaccgcgcgtccttgagcgccgccctcttcttcttcttcttgccaccgtcgccgccgccgccgccgccgccgcacccgccgtgcttcttccttgggcggtatccaccggacgtacccacaatctgcagagaaaagaaaataaagacgccattgttggtgtctacgagcatgcgtcgcgccagaattgatggcgttggttggtgcgtgcgtaccttgcatccgagggagcagaagcggaaggagtcgaggaggctgcgctcgcagacctcgcaggtgttggtgacgcccttgccgggcctcggctgggggcgctcgttgaggaacaccacgcgggcgctgttgatgatgtacgtctgcacgccggtgatgtccagcaccttctgtatctccgacacccggatcacgtcgtggtacgacgacctccgtatctgctccatccacgacatggacggacaggcaacgcgtgagtctccacgatatagatcgatcgatcaagaagcacacgcattggattaacagactgacctggatggcgtggtggtcgcggtggtgggagaggcagagggagcagagcgcgccgttcatgcagtcgaggcagtacatgttgcactcgctcttgtgcgcgtcggcgtggatcctgcattgcacgaagaagctcgtcgacagcagcggcttcagccacggcggccaccgctggttctccacctcttcctcctcatacccccttcctccctgcacccccacattcaatccatcacaccccaatcaataaccaagaaacagagcaagagcaatcaatcagtcatcggcagctacttaccatgtcgcctctgttcttcagcgagaaaggggacgcatggtctatcgccattcccagtgcgaagcaatcgagagagagagaagaatgtggatggaagagacgagagaaaagagaggaagaggctcgaagcgaaagaaagcacttctgaatgtatgtagtgtgaagtcttttgtagaccaaggggggcaaaagacgaaaagtatctgcaaacaccggggttaagtaaactaatcggaggaagactcggggagagtatttgtgctcgttcttactcccaccgtctcaaaataagtacagttttacacatttgaccgttcgtcttatttgaaaattttgtatgattagtatttttattgctattagatgataaaacatagtactttatgtgtgactaaatatttttaaatttttcgcaaatttttcaaataagacggatggtctaatgttaggcatggatatccacggctgtacttattttgggacggaggtagtatcaactactcgtacatggcggatccgggccgtctcataagtcacaacccggcaagcacatatgaccgatcgaatggcagagcgtgtttccaaacagtggaatcctagcacagttcgaattgtctcctaccgcaatgtccctttcgcttgaaatttactaatcagagtgttgcattcacttgtgaaccttatcatcaacagcattatgatttactgatttctttttcgttacagtaacgattccgattgcaacttgcgacggggcgagacccaaaatccaccgtaaattgtcgtagagtaaagcagtgctatcagtttggatattttcttttcctacattttggaattatcacttgctagtgaatggatgctttctctaggagattctattgcacttgcgcatatgtttcagcttcccacatgaatggtggggaaaaaacattaggcgcacgtttctacccgaaaagtgaaaaggggaaaagttaccactaactacgccattaccaccacaaatactaatgtgcctgccacctttggcatcccacattagtcttccccaagtggatcaagagggggatcagatgcaaccttagccgtgcgtgcgtacgctgccatacactacgatatctttttggacggagcagagcacatcggcgagaagcctcgacggcctactggaatcaggatgccttttttctggtggcctactgcataatttcatttgccgttttgtaaagccatttcattttgccgttttgaaacctacaaaccggtagaaccatggcatcaataattcggcaggtgatgctacagattttctggcaatcgtagggcgttcggtttgtggtttggtcacccactcctgtaacgccatctgaaccattgtgcgtgctactgcatttcggcaattcctggctggtacttggaactgtgcacacagtcacacaccgaattgtactatatatcgattagattagcatctgagcacacgttttgtggactgttcgtccgaattttttttccaaccccagttcacctccattttcatgtgggaagaatcgtgtgtgggcccatgggatattgatgtgtgagatcatgtgaataatcagtaaccaggttaaagataaagtcagaaatacggcatattgattagtcttgcagcggttatacgtcgcatcgtctccttggagccagtcgtaatctcttagcagataatgacgaacaaattaagatttacatgttagtaagacgattacccgcagtatataatattagctgagtgggtccccaagtcgtagaaacgaacaagcaagcgttgacatgaatttttgtttcagcaatcaggtttcccatttgagttcagccagtctgctgcgatagacacagcggcgtagtacgttgcttcaacagttgaaccatcacgccgcccatgagtccatgacacatggccgtcaggttttctgttaacgattttctgcactcctggattcttggccgtccccttgattcacgggttcaagtaagcatttcgtcgagagatcgcgcataatctgcccaatgcgccaataattcagacgcagattttgacctaattatgttaccttgtacagttggccgaacttattaagacaaataaaatgagcactcctgtttctgaactgttggcagtcacctcaatccactgaatcttagtatagtgatgagcttatagaccacacacccctgatctgctttcagtgggttggcatattggcatctccagttcgggagacacctcaaaagcgagaggccagctctggcacaaaggccgaatttttcaaggcgtgccgcgtgcattgcatctcatctgctcttgatacagccattgccgcacagcgcttgtggctccagttccggagaggtgtttggataacctgactaaattttagccctatcacatcaaacactaatttagattattaaacatagactaattatacagatagaggttaatttgcgaggcgaatctattaaacctaattagtccttgatttgacaatatagtgttacggtaaatatgtactaatcatagattaattaggtttaatagatttgtctctcgaactagcctctatctatgtaattagtattgtaagtattctatatttaatattctaaattagtgacaaaagtcgggtatccaaacaccccccatattcctccggcgctaagtcattccgcaatcatctagagacaagaaaggtcttcgtcctctctctgcgtccaacccgaaggatccacctaaaaagacgagctttcatggctctaccgaattctggcacatggctgcatcagattacgttactactcctattacggacaccccgtgagagaggcaccgtgtcattgcgaagtgaaatgctgctccatttccatccccatttcgttcactagctgatcagaggctcttaacatttcggtatgtggctgtatgtgcagtgcagattctatgatatggtcatcagtttcagtactgtactgtatcgtacaggcaagggcaatcactcgatataaataggcttggaattttcaggcgttgcgtgctgctgcttcccatggcggctgccgagcaacgcggaaacggtcgcgcgaggacgacaaaaccgacgctttgttttaagcctgaaaatcattgggtggtgcaagtttatcacanatattttagtacagagtcgtaatcctagtgccggccgcattgcgttagcgtttcggcctggaggaattaaaaacaacctgggaagtggttttttctatgacatgcgcaccccgctgctgtggatggctgaggcttaaacaggcgaaccgaggtgacgggattcatgattgattgctccagaaattggtattctaccatggagttggcacctggttgacacctggattaggttggtcctgatctttggagtatctattcgttttttccctttttgggttttttaaatttattgtttttccttcctttacaggttgtaagactctttttcaatgttttgtagtgcacatttctttaatggaaatggagggtgtttgccctttgataaaaaaaaattgctgctttcttcgtggttagctgacacaatcacacaacggcgggtttgctttggttgctctcggctgcaggtaggaagaaatgaagcggatgtggtatactgatattctgagctctgccgtttgtttcagaattcatgcaacctgctgtaaacttgtgtgccgggggccttgcaggcttgcaaccacggtagatggaatgatgagtttggtcaatatttttttttcttttacaaagataacatgtcagtgatcaggtgtaaccgtgtaacacgcctaatctaaaaaagaatagagacgatacacctgatcgtgagcgatgttcacccttacggccttaccttcattaatgcctaaaaagattccgaaataagtcattcttcatgccatcggtaggctacaggttccttttatagtcgactagattcattgcagaaccaacaaacaaatctatacgacgagattgctacctggcggtcaatcgccaggggcgatcacgatcagattcggatcccctccctccacatgtttttatttttttttttcaccacattactttcctattttaataaatttatgcacctaaagtttgtacacctcaaatttacacatctaaagtttataaattaaaagtttatatatccgattcaaatttggattcaaatattttttatatatagtatttctatacatctaaagtttatagacccaaagtttataagtcaaaagtttatataccctattcaaatttgaatttgaaatgtatccgattcaaatttgaatttgaattcaaatattttttatatatagtatttctatacatctaaagtttatacacctaaagttcatagacccaaagtttataagtcaaaagtttacatgcccgattcaaatttgaatttgaattcaaatattagtttatagacccaaagtttataagttaaaagtttacatacccgtttcagttttgaatttgaattcaaatatttattgtgtaataagaagagaagaggaggagggagcgacggagcgtatagggaaggggcgggcgggtgatcacccacctattagccttaccctgtcttatatgcccatgaggcatgcccaacgcaggccataccctcggttgctatgtgggccaaagccacaaaaacgatctcatccccccaatggaagcaataccttcagatatacccttttcaaattaaagctgcacaatagattaattgcacaggtgcttcatgctacacaacgcggtgccacagcctaaacctagcctcagagcggcgcctcgcgtgagggtgcgcggagcgatcagagggttcgaacctcctcgcaggcgcgtggtcctcgccactttttggccccgcgtctgacatgtgcgcctaggggtacgctccacgtactcgcgttgggcatgccctgagttctcaaagcctcttttttcagtgttcacctctcgctaaacgctagtcggacggccacctactgactagcgactaggctgattaggtggcgactagacggattaggcgaattagacattttatctatctctttcacacaaaaatactgattctagacatttggtactcggtaaatataggcatttagacaaatatcataaatcatagttaagttcagaaatcatcaagtccatacaacgaattgacactgcacacgaagcattgggtttagtacaaatatatagggatagcgaacacatcagtatagccactgtacatgcacatcacaattcataaaccataactttatagatctgaggggctggagctaagagagaggaagaaaaaattatctagaactggaagaacagaggaggtaaggtggtggaggggagcctgatcccctgatggcctgatctagggttggcgtaggctgcttgagtggtgccgtgcttgactgcttcaatcggtgtgtttgtcaccttccattgatggcaaggatgaaggatgagatggagagcaggagcagcaaaggagggggaagaacgtggagcagcagaggaggagagggaataacgtagcggcgcggtggaaaatcgatgggcgcagcgacggagccgtctctcgtggcggtgtgaaaaaggggtaggcagggattgcgctctctctctaggctctcaaataaggcaacctaaatccccttttataccgagtcggtcccgcgtggcgcttctaaattttatcacgcccaaattttgatttctttcgcctagtcctgcctagacgcactgtcccgttgtctaattgcgcctaggcacagtcctgtccaggccgtccaggccgcctaggactgactagtaccgtctagacggtaaatcgactaattcactgcctagggtgtaaactggacaaattatcgtcgactagcgattaatcaccgtctagacatgctaggcggtcgtttaggcgaacattgcttttttcccatgtttcgccagccctggccatacatatctttttgccggttttttgctgggaataccgcgcacgtttatcattttgctggagtttaaaaaaaaaaacaggcgtcttctctaggcctcttcgacaaagccaaaagcaaatatcgcctcggtactcacacgtcctcaatccggactccacatgcgctcctgcatgctcttccttcgtgaagaaaaacaatcaattagatttctacgagtatcatctatctatctatctatctattatattattaaaacagccttaaaagaagacatcatgttcgctgtagggctataaattctcacattaatcagagaaaaagaaaagaagagtccaattagaaattcaattcaaaaatatctgaaatcggaattaaaataaagcaatattgaaagaagtgtccatataaaaacccaatacgagattaatcaaaattcaaaataaaaataaaataaaatacgaaattaggaaataaaacgagtctaaataggaatataatttaaaaataactgaaattagaaattaaaaataaggaatattgataaaagagtccatataataacccaatacgagattagttaatattcgaaataaaaataaaaataaaatctgaaaatagcaaaaataaaaggagagttcaagtaggaatacaatttaaaatcaactaaaattcagaattaaaaaaagcaatatttaaagaagaatccatataagaacccaatacgagattaattaaaattcagaataaaaaataaaataatatccaaaattagaaaaattaaaagagagtttaagtaggaatacaattttgaaacaactgaaattcaaaaatgaaaaataaaaatattaaaataacactatacggtattaaatattttttaaaaaaaattctgaaattagaaaaagaaaaagaaaaaagatttaaaatagaatacaatttataaataactaaaattggtgataaaaataaagattattaaaaaagagaccatctaaaacacacggtgagataaattaaataacaagcctataaaagagtagagtggtggcggttgattcgacatataaaaactgttagtaatacaccaaatagaatctttagaaatcccgtcaaatgctgccaatatactccttatgacccatctgccgcttaatctttattgtcattagcattttaataattgaacaaaactatcgttggaattcatattttactttcaagatgtcccaccaaccatcggtaggccgtgaagcaaacgggtaaggcggttgccgggacttttaggggctgcaggaat

SEQ ID NO: 80624 - DNA, 9648 bp, Oryza sativa
  unsure (1)..(9648): unsure at all n locations
catctttagtcccggtttttagtggaaccgagactattgtggatttcgggcgaccgaccaaagatggtttctccaccagtgtgtgtactctggttcatttttgtgccagttgtaaacgatgttggttcaaatgttcctgtcgaaaacaagatgaaatttaaagaaaacagtagtactatctatactgtgcctcatcctacatttaaagtgctgtttgtaactactactaattcacatatactaacagtactagcacttggggagtatttttcccctgaagtagctgtcgcatattctagtagctgtccctgaagtatcggtgaaaaaaaaatgagttttggtgataataatctcacaggattggcataaaacacgcaataaatgattgtcttgagccaccgtctttttggatagagcataacctgcatatggcatccaagtggttatttaagggatctgatactatgttgcctgacttgtctatcagtaacactaactttttgcgaccactccagctaatggagccagctaattcgtaaacattatactctcacaaatgctacacctagtgtttgtttgaattctaagtcatcaccgtaactggtatcgtctgagctaattaaatcatatactctaaatgaaaatgagtacacaaaggccttgtagacggcacacttaaccagttccaattcatccagatcctcactggcgtactgttcgctgctaatcagtaccaacctcttaatttcctgagcaataggtgaaaatgattgttacgattcactaaacaagaatgctgaaaacgcccttcttaagctatcattgaaggaggagtacatcgtttgattggaaaggctaagctactgtcgtagatctcgacttctctgaaatgaaccagtggagaggaacaagttgtttccatctttgcaagcatggttcttttcgtcccaactgccaactgaactgcgaaccattttctggggtctcaacatgtgaattctagtttggtctacagtaatgcaggtggggtatttgcgcaataagcatcttgcttgttctttgtacaattgtaatactattggaacatttgcacgatgtacggttgccccacacggagagatggaggatggttgctgccactggaaaaattattattccttccgttcccagaaccctccgtcttaaagacaagggatattagcttttacatggtctccaacattatacttcaaaagcttttctatattttggacaaagaaattactccctccgtttctaaatatttgtcaccgttgattttttagcacatgtttgaccattcgtcttattcaaaaacttttgtaaaatatataaaactatatgtatacatataactatatttaacaatgaattaaatgataagaaaataattaataattacttaaattttttgaataagacgaacggtcaaacatatttaaaaaagtcaacggcgtcaaatatttagaaatggagggagtactcgccaatggacactatttatatttatattacttaaagttttattgactatcttttttaaaaaaataaatacttaaaaataccgtattgttcaagtgtgttgcatcctaaccataattattattatttttatcgtagtctaaccttttttttagaagggtacaactcaggacgcacactaacacacactaggaatgtgcacgtttctaacgcacactaacacacactaggaggaaacatgcagtcccactgaacgcgcgcgcgtgtaccctatacctagtcgggaccaagcgaagtcagtccggggaaacggaaaaaacccctggtgagacacgcgatttgcgatcccaggatcaaacccgcgcgggctactcgctcacctggcgacgctagccaaccgagcaatggcgacgctagccaaccgagcaacgctcggttctccgtagtctaaccatttaaaaggtgtcgcttagctcactcctggtttggacggcccagctctctgaaaaggctgcaggactactcttgcctgtatcgtccgtacatacctcgaggcccaatataggccctttttcttaagcccagtaagcccaattccagaattccaaatcgcagtgctgcgttggaacttggaacttgaagggccgaagggggacgagcgatccagtgcgctgtcacgtgtcacgtgtgtgcttggcgctgacgagctgcgttgttcttgtgcaggtgggcaatttcatgcactacatcagccggttcctggccggcttcgccatcggcttctcgcaggtgtggcagatcagcctcgtcaccctcgccatcgtcccgctcatcgccatcgccggcggcatctacgcctacgtcaccatcggcctcatggcgcgcgtccgcaagtcctacgtcaaggccggcgagatcgccgaggaggtccgtccatcgatcgtgcccctctcaatggacttctcccagcacgaggacgtacgtacacgtactgatgacgccgccgtaggtgtggtgtgcaggtgatcggcaacgtgcggacggtgcaggcgttcgtcggcgaggagaaggcagtgaggacgtaccgggaggcgctgctgaggacgtacaagtacggcaagaggggcggcctcgccaagggtctcggcctcggctccatgcactcggtgctcttcctctcctgggcgctgctcatctggttcaccagcgtcgtcgtccacaagaacatctccaacggcggcgagtccttcaccaccatgctcaacgtcgtcatcgccggcctgtgagtctgcaaccctggcgtgtttgtgtcagcgaatgcacacgcccatggcgcccgtgcataatttggtcgcaatatgtgtcgtgcaggtcgctcgggcaggcggcgcccaacatatcgacgttcctccgggcgaggacagcggcgtacccgatcttccagatgatcgagaggaacaccgtcaacaaggcgagctccaaggccggccgcacgctgccgtcggtcgacggccacatccagttccgcgacgtgcggttcgcgtacccgtcacggccggacgtcgtcatcctcgacaggttcagcctggacttcccggcgggcaagatcgtcgcgctcgtcggcgggagtggctccggcaagagcaccgtggtctcgctcatcgagcggttctacgagcctctcacgggcgcggtactgctcgacggccacgacatcaaggacctcgacgtgaagtggctgcgccagcagattggcctcgtcaaccaggaacccgcgctgttcgccacgagcatccgggagaacatactctacggcaagggggacgccagcatggatgagatcaaccacgcggcgaagctgtcggaggcgatcaccttcatcaaccacctccccgaccggtacgagacgcaggtcggcgagcgcgggatacagctctccggcggacagaagcagcggatcgcgatctcgagggcgatactgaagaacccgtcgatactgctcctcgacgaggcgacgagcgcgctcgacgccgagtccgagaagagcgtgcaggaggcgctggaccgcgtcatggtcggccgcaccaccgtggtgatcgcgcaccggctgtccaccatccggaacgccgacacgatcgccgtcgtggacagcggcaggatcgtcgagaccggcacgcacgagcagctgatggcgaaccctcgcagcgcctacgcctcgctgatccagctgcaggaagcagctcagctccagaacaagcaatctttctccgacagcgccagcctcagccgaccactaaggtatgtgtacgtgaacgtgaacgtgacgacgtcgtgtcaagttccgaccggccaccgcgagctaacgaccatggcttttgcgtgctgctagctccaagtattcgagggagctatcgaggacgagcatgggtgggagcttccgctcagagaaggactcggttagccggtacggcaccgtggaggcgcacgacgaaggagggcacaagagcaagccggtgtcgatgaagaagctctactccatgatacggccggactggttcttcggcgtgtcgggcaccgtcagcgccttcgtcgccggctcgcagatgccgctgttcgcgctcggcgtcacacaggcgctcgtgtcctactacatggggtgggagaccacgaagcgggaggtgcgcaagatcgcggtgctcttctgctgcggggccgtgctcaccgtggtgttccacgcgatcgagcacctcagcttcggcatcatgggggagcggctcacgctgcgcgtccgggagaggatgttcgcggccatcctccggaacgagatcgggtggttcgacgacaccagccacacgagctcgatgctgtcgtcgcggctcgagacggacgccacgctcgtgcgcaccatcgtcgtcgaccgctccaccatcctgctgcagaacatcggcatgatcgtgacgtcgctcatcatcgccttcatcatcaactggcggatcactctcgtcgttctcgccacataccccctcatggtcagcggccacatcagcgaggtaagcacagaatctcgtcagatgatcctggctgattctcgatcaaattcacaatctgtgtgttgtgatgcgacagaaaatgttcatgaaaggctacgggggcaaccttggcaagtcgtatctgaaagccaacatgctggccgcggaggcagtgagcaacatccgaacggtggcggccttctgcgctgaggagaaggtgataaagctctacgccgacgagctgaaggagccagcgaagcagtcattccggcgaggccagggcgccgggctcttctacggagtttcccagttcttcctcttctcttcctacgcgttggctttatggttagtgctacacgaagtttggaacgcggtgaataattcagtccaaatttgtatcagtagtaagatttgaaagctttgatcgggattcaggtatggttcggagctgatgagcaaggagatggccagcttcaagtcggtgatgaagtcattcatggtgctgatcgtgacggcgctggccatgggggagacgctggcgatggcgccggacatcatcaaggggaaccagatggtgtcgtcggtgttcgagatcctggacaggaagaccgacgtcctgatcgacgccggcaacgacgtcaagagagtcgagggcgtgatcgagctgaggggcgtcgagttccggtacccggcgcggcccgaggtggtggtgttcaagggcctcgacctcctcatgaaggccggcaagagcatggcgctcgtcggcatgagcggctccggcaagagcaccgtgctctcgctcatcctccgcttctacgaccccatcgccgggaaagtcttgatcgacggtacgtatcgatctcacagcttccaaaatgaattgctctgcatatctcccgaacggaatccgaattctgaactcgtatggctttgatgcgattctttgcagggaaggacatcaggaaggtgaagctcaagtcgctgaggaagcacatcggcctggtgcagcaagagccggcgctgttcgcgacgaccatctacgacaacatcctctacgggaaagacggcgcgacggaggcggaggtggtcgacgcggcgaagctggcgaacgcgcactccttcatcagcgcgctgccggagggctaccggacgagagtcggggagcgcggcgtgcagcnnnnnnnnnnnnnnnnnnnnnnnnnnnnnnncgcgcgcgccatcgtgaaggacccggccatcctgctcctggacgaggcgacgagcgcgctggacgtggagtcggagcgcgtcgtgcagcaggcgctggaccgggtgatgaggaaccggaccaccgtgatggtggcgcaccggctgtcgacgatcaagaacgccgacgtcatctcggtgctgcaggacggcaagatcatcgagcagggtgctcaccaccagctcatcgagaacaggaacggcgcctaccacaagctcgtcagcttgcagcagcagcaacagcagcaggaccagatgcagaggcattgatcttgatcgatctcctgtgcttctgtatatttgctgtgtgcctccgcttcttcttggttgttaaggagtacagtacatggaatgaaacaaatcgctgcggtaagattcaattatttttccattgtaaaacgaggggttcacgattatgtacaagagaaagtattggatttgtttctctttttctgtacaagttaaataactgaatttagtagatacgcgattacatttacataagcagattcatggcaaatggtatgatatacgactcataatatagcaacatagtacggctctatttcaaaatatagcaatctaatatagaatataacaccttactagaatatcccatagtaggctcatacatttagggatagagatagttgtgatttaagaaacacaaactaacgtgccaggtcgggacagcacgaaagttccaattagaatttgggttttgctagttagctttcggggactgaaaacatttgatttttttggccgtttgatccagcgcgtgctgaaatattttgttatcggatccgaatccacttcccaaacgttgtctgcccgttggcgcagtttccgatttttgaagcggatttgtgactatcgaatcgcctcttgaactctgccaccgatgaggtaaattgatctgatctttatagttgaaggaacatttatatgtcattttacgattgaggaagaaaatcagagtggggctatagttgtgagacacataatagacttctttgttgtttaaatgtgaggtagatccggcccatataaactaccggtgatgttggggtgtactgataatggaataagttcgtctgaggtcccttaactttacaccgaatccgatttttgtccttgaaccctaaaaccagatacaaccagtccctaaactgtcaaaactagtgcaaatgaagtccctgggcggtttgaaaggcggttttagcttacgtggtgcctacgtggctagtttgactcggtcctcgtcccacgtggcattgatgtggtgtttacgtggcaattctatccccaaaaaataataaaaacggtggtcccacatgttagctgcacctaaaaaaattaaaaaggtgggcccacgtgggtcccacatgtcattcacacccccttcttcctcctctctccctagctcaccactcttcatccctctcctcgtcactgccatcggcagagctgcgtggctgcgggccgtgggtgaggcgtggctgaggggcgggaagctcactaccgccaacggtggtgatggccggcgggatcccctcctcatttttgccatccctcttgtccccattcccgcgccgactgccaccgccacacctccccgcatggccgcatctcctcctcctccagtggccaccgccgcacgccgccccttctctccatcagccgccgtaggaggagatacggggagcactgcgtcctattgctgagtggctctcccatggcgaggcgccagacgcatacggtgatgcgctggcggacggggatggcagcacggagggcggtgtcctccttggcgacaacggcggcgagctcggcgcggcggaagtcgctctgagtagtcgacgctgctgcacaggtcccaccacacgcgcgaccggtccatcacccacagcgggggagggagcagcgcgcggtggacggcctcctcctccggcggccaccgctgcacgccaccccttccccccgccagccaccgcccttctccctgccgccactgttggatctcggttgccgacgctgctttgggggggacccgccgctgcccgcgtcgatctgctccactcaccgtcgtcgccgaccccctcttattgccccggcttcctcctccagctcgccgctcttgtcggcggtggccggtctcgccgctccctctacattgcctcgttgctcgccgtgctaccagctcaacctcgccgcttcgctcctccaccccttcaccacttccaccgggcgtcctcaccatcgagaagagagaggagaagggagggggatgaagagagaggagctggggagaaaagaggaagaagaggggggtgtgaatgacatgtgggacccacttgagccccaccttttttatttctttttgggtgtagctgacatgtgggtccaccttttttattacttttccaagatataattgtcacgtagtcgccacgtcagccaaaaccgccttccaaaacgccgagggacattggttgcaccggttttgacagggtagggaccggctgtatctgattttggggtttaaggttgaaaatcggattcggtgtaaagttaagggacttttgatgaacttattctgctgataatcaataactcaagtcggcccacaattcctaaaaatgctgaggatagaaaggagggtgaaaaaggccgagggagatttccaacggaggatgagatgcttcaaaaggaataatggaatatgatgcttatagatgccactacggcaggcagcattagatgatgtatgtactgatgtttccctggttcacgactggattgcaccgctttcattttcgccttacgatagttccctactaattttacctatggcatattcctcacatgatgccgataatatgccacatagttcaacatccttagatattcacttataaaacgacgtcgcctacagggaatttgatctcgatggcaatcccagaattagcctcatccaatgagcttgtctatggactatgagcctaagaggaccaaagacaaaagaaaaaatcatttccttcgcttatttacatagaactatagaagtagcggaaattatgtggccatgaatcagatgggaagctacaacatggttgggcgtttgctcaactttgtctgcattttttttttcagaatttcaattgtggctaccgctagtaaatggcaagatcatgtcatgaactcatgatgcacagtccagttgcccattcaggctgtgtttagttcacaccaaaattgaaaatttggttgaaattggaacgatgtgacggaaaagttgaaagtttgtatgtgtaggaaagttttgatgtgatggaaaagttgaaagtttgaagaattattttagaactaaacacggcctcaatttggcagccaactcccatcgcccattagtacaatcctaacttttttttaattccaaattcaggacaataccttagtcccttctaccaattcgactaattcgcttgacatttttttcaccaagatctataataaaagcagtcccattccccacttaaactacgcgaccgatattcttatccctactttattattatattgttcaatacgttcacggagaattttatgaattttgtcaactcgaagggtcgtcattagtgtttctttactatttattttatttcggaagcaaggggggggaataatgtctagattctaaaggaaattagaagttcaatacctaattaatttaattatctcttccattccatgacaccgagaatacaaatattagagtacctatagctccttccttgtacgactcgttgaaaaacccgttgtcgaacttgattcatcgccctttgtttttcgaaacaaaggtgttaaaaca

SEQ ID NO: 80625 - DNA, 40092 bp, Oryza sativa
  unsure (1)..(40092): unsure at all n locations
acctagacacataaatcatgagttatttgtgaagaaaaaacaattataaaccctaaatcacgactgattacatttacaccagtaacaaatcacacatagctgcagactctgtaacaaagaacacacccccaacctacctgaatccttactagtaggaaactaaaccaagcgggaaccacaaaccatcgcaatcacaaacctacacagatttgcttcagaaaataaatcaagccgtaattccaccgcaacttgctcccaactcctaaagcctaacccacacccacacccactgcccaccaaagtgctcctaccaacaaacacctactcgcagcaaaccaaaaaccaaaccaaaccagatactagtaaaagaacagaacaagataacttcacaagaacaccacccaaaaaaatgaaaggcgtcgtggggaggaactcacagctccgttcgcggcgtaggtggtgagcgtgaacttctggtccgtgtggtaatccctatacaggagatctgcaaatcccaccagaaaaaaaaaacaaccagcgtcagcaaacacccaagaaaccaagaaacaaccccaagcaaaagggcaacaaaatcacaaaaccccaaccacaaaaacaccccacaaaaagaaccagcaacgacgcagcatccccgaacctctagccttcttgccgatgtcggagtagagcccggggcccgcggggggagcagcggcggccatggcgagaggaggaggaggcggcggcggctgcggcgagaagcgaggagaggaaaaatgggagaaggggatttgatttgggggtgaagcggagtggaggagagagctggtatttatcggcgggcggacggcccagatctgcgctcgcggggctctcggctcgcctgcgccgtcggatgggcttatcctggccctttttcttggggaggaagaagatgccaaaaatgatttaatttgcttaatttaattgttgcgcagggtgaacttttgggactgttcactttgatgtaaaaaaaaccttaccaaattttagcaatatagttgtcaaattttgataacttgctaaaattttagtaggatttctataagtattaaaatatggtaacaaactaaatgcagccatttttttataactttattaaaatttggtaaggttgaaaatggtatcaaaattgatgtgagatgtgaggtgagggcgccgtgttcttggagagaagggttttgcgtgattggtgaatagcgacaggatttttgccttctttcttgagtaaaaagatggtgccatgttttatttttaccgccgtgaaattatttttaccgaggtttgaggccttgagcgggacaagatcagtactaatttatctgggcactagtaatcgtgcacgtgcaatacacgtttttcataaaatatatcatagggatacattgaaagtttggaaactatatctaccaaaaataatttattcaaccaacatttataaaatatatatcctgtgtaattgtaaaaaagatataaccaacataatcggtacttgtaattatgggtatgatctgtctgttttgtacgaattttgataggagggaacaaaatagaactgaagccagaggctatacaaagttacaaactaacaaaaaaacagctctctcttcgagagaactataccagccttttttctctgtagctggtccactgcttgatctcataaaaaagaatttgtcgacaattcgctgaattgaccatccctctttctcgaagtttctattgtttcgttccgtccaaattccccagcagaccagcaagaagagggtcctgagcccttttctttgcatcttttctgatgaagtcttgtgacaccaccattccaatacnnnnnnnnnnnnnnnnnnnnnnnnnnngaaacttcagttaagcacaggcttattcctgtccggatggcttgaaactaatctactcttcatgaacaaatgatgagatgtctcaaggtttgatgcatagaggacaaaactaattgtttggccagccttaagttataaacagcaacagtccataggcgattctaagctaggagacaagcaaaagattaatttgcacctcaaagtcaaaggggcctgacttccaaacaggttgcatcaaatctgatctgatcaataccttagaatcaaattgccatgtatgctggctttgccatgtagaattgtagatgcctaattctgaccatcgccatgagttcctttggtgagtgtcaccccttctagcaagcagcgtcaaatcccaaaatattccgttaagaaccccattgataggtcatgccaaacatcatctatccaatgttgtttcaaaaatgcatgaataatgattgccctgttgtttttaaactgcacgaaaagtgtagcattatatgcagttgtaacaatgttgagtgtttctaaaaacatggtttaccagtgattcggaattggcaaagtcctgacatgtaaacaaaatacaaaggacacgaaattaccagtgatttcacccattattaaattccttatgttaaatatactatctttttataagcaaatatgcatgttgaaatcactaaaatgcagatccagaccccaaattatactataatgttgacaggcaacaccacagcgaaataataaagcttcaattagaaatcaacaaatcaagaaaaaagagtcaatatggatcaaagatatagtaggagcagtacagtaccttgtcctggcacatgcatatggagcgttagatccccctatgccaatgatgtgtgtaaactacgggaaatggaatagatggcatagcatactacgcaccagatgacattcaccataatgatggcaatggtaagtttccttttataaggcactgctcaggccaacttaagcagttgtacctggatcatcattgtcttcagcaatgttattacaactaaaaaagaaagggtgtcagaaatcgaagtcattttatagataacccaggatgctaattaatgtagtctaatacagggttcaatatttctttttcggggtttatattggagggtgccgatataccgacattttggaaactttgaacaagatattaccaaattcacaaaaaaatgaaaataaattaaaatttcggccgaaataatatcatagggggggtccgataggaccaaaacttctgaaattttggaaatttcgttcccgaattttgaaccctggtctaatattggttatcttaacaaagttacttcagcattgcagaaagttaacacacatatatatatatcaataatgaagtaatcattccaagaccgaatcatcggtgccattgttcaaatatagagatggcgtacatagagtttatacagtacaaagtgattgccagatgatcaaaatccataaaacctggttgaaaatttatattagtatgtaggtgagtactcttggcagattgtttttttatcaaacatctattgatctaattaatcaaaaatatgaaatcccaagaacacttatccttcaatgccacgtataacctatagacataaaaaaaaattctcaaggcaccagtcaccactgctaataacataaaagcaatgtaatggaatgttcttaccagcaaatcattacattatagatgcatggcctgcagaaatgagcattaataacattgttacgggaaaaagaaatagcagcacaatcttgtataatcagtaacataccaaagtaatgagagagagaaaagaaaaaatatcgacataaaggagagacttacctgatttttctatattattgacgacaagatctgtagacaaatggtaactttagtttgtatgcttgtggaaatcagatactaaactgcaaaaagaagatttttttttggtagacaaacttaccttgcctgtattcatcagtgcattctagcgcttgcatcgtccgcaattgctggtgcagaggggttcggctgaccagggcggcatagtgggagatcccgacgatggcagggagagccggctgtgggctcggaggggatcgacaaccggcggctgggctgcggagggcatgagagcaggcagaggggatgcggcggatgcatcaactgcgggtggcggcggcggcacccatgccctccactgcatcggggtatcaccaagtgagtcccctcgcgatgcggcggcagcggctaccgtggaagtgaatggcgacctgcagcaaagccgacgatggctgggggatgcgcgcagtggttggaggatgcgtcatcgggaggaataggcggcagtgttgttatcgcgagaggatggcgcggcgccggggactgcgtgatgcagcgattgggtggcgccactgtggggtcagcgcgttcgctggtggggattcagcgattcatagctagccctgggcgttctgagccgttggatgagatggacgggtgagatgatatggggtgatttggcctgtagcattggaggggggcaactcctcctttctatattagtatagatatatacaagcaaaagatgcaggtttgtccaatacatgctgtaattacgaaattatgcagtgcaagaaaaatgaaactgtgcatgttatagttctaaacttctagagcatcgaattgggaaatgaaattgtaggccacaatattaggtgaatattcagttatgatctacaggttgggtactaaaagttttactgaggtttagttatggattgacaaaatagcccacaagatttagttatggaattcatgctctttcttctttttgaccactgctcatcgattcacaattaactaatatctccaagatgagtagataaatgctagcaagggtactacaaacctctaaccgaagctaccctttcaaagtattgaccgtctgcaattatgcctgtgagaaggaaatctgccattctctacaacgaattcagataggaaaatatatgcataacaatattggttacctccaattcttccatgtccatctgttccttacctcacatatttggaaaagctaatacaacaatttgttagtcatatacacaaaaatacccctatataggaaaatgttgtgtaatcaaaagttgttttgtgattcgagatgacgaacctttgattggccaagagcatttcgtgactgagcactcgcatcttgtatcccaaaactgaaaggattatgctgttgatgcgcctacttcttccagcttgcagcgccaaacccaaatctgttgggctttgcctgctgttgttgctgttcttggtgagggctccgtaattgcaactgcacggtaaattagaaacaggcatagcaaataaaaaactaacagcgaattcctctgtagcaatcggaattaaaaactggtggccaaacgatggcaaaccaaagctttgaatgaatttcatcataaatagtcattaaaacacatctatgtatttgaagtgaatacattttcagcaataaaagttgatttgtagagaaatacaaatttacagcaagaatcaatgctgtcaggcatggaagagaattgagttagatcacagtatcttattgacggaactaaattgaaggcaattttctgtcaaccactaatcacctgcgcaactgagttatttatatattacaatacaaaattatcaagtgccaacctgcagaaagacacgttaatgcgtcacacacctatgtctaactgcatatccatgaaaatcaaggaagtccagtagaaagctacttttacacactcacagagtgtgagtaaaaccaaaggcaaaggttattagtagaatacctcaagaaccactgatctgctcattttgaaagaaccactgatctgctcattttgaaagaaccacagactattaacttgaagcacatgaatcacagtaaggaagaactattgaccgagaggtcagttgcgttcacaggggaaaaaaatatgaaatcaacctataggagcataacctcatatatgtcacctggaaaaatggaatgttcaagccaatcaatcaagctagatccagaaaatgaaataactgaaaatatgcaccaggagcttaggagccttctttgctatttggttcctcctaattactgaagcctacatatgtcactgcattcacattggcatctgctaagatacgctacattctttgagtgtaagaaggatggctggcgatggcggcgcgcggcttggacgaccggccgtgatgacagctgggcagcgaagggcaggggtcggcggcggctacccgaccgaggaggtgcaggcagctagtggaaggccggtgggagagaagatcacgtggctgtggtgggagcggaggcgagatccagaggcatttgcggcggggcgacagcgagtctcgatctgtggcggcgcgacggcgaccgcacgaccccgccgaaactcctgctcccggacggcacggaggcgggggcccaggcggcggtagagggaggcactgactgcgtcggcgaagacgggagcggcggaagcagcgacaggagccgatgcggtagcagcggagggaggcacaacgcgaagtgggaatgaggcggcgatgatggtggcggcggcggcggatggggcctccctcggcgctggccgcggcagatggtaggatccggcggcggcagaaggggacctcggctccggcgaggatgcggcggcgcggcggcagtaatccggagcgagcgagcgagcgaggaggaggagcgccggccgcgacggatggtaggatccggcagcggcggaaggggacctcggctccggcggcggacggagaagaaggcggcttcggcgaggatgcagcggcgtggcggcagtacagaggagcgagcgaggacgccgaggaggaggaggagcgaagtctccgcgcgtgaatggagagtagtcttcgcggcagtactcaatcgtgcggtggagacctcttgcgcgcggatggacggtacagattaatccggatgattttacctataagattagagaggagcaactcctcctttttatattagtatagattagtattagtattagtatagatattaggaataagcaaggtaataattgatcacataatctggcatatttggttaattgatcgcaaactagtcatactaccaaaaaactttatacatgatgatcaataatggtatcagcacattttatatttcccttttattttatgttctgggaatcaaattaaggtcatcatgcactatggcgagacacacgacacgagagcatccatacaaaaactataaaaacaacgagagtcaacgtctgaacagcgacgatttttattcccaacttaccgtgcaagttgaaaagtttggttttaaaaatttctacaaacttttcgtaatcgagcggggccgcaaccaggccgtcattgagaaatgaggaattttgcttgcgtgacgagcccatggcatgccatccttgggcttgcgatagcgcggcccagccgccgccgtgacctgacgatggcttacctcgccgtcgaatcgcccatcagacggcgagcggccacacgccggtgtcgcgggacctggggacggacggtggtgaccgacatgtcttatgcgggactcgatttcgccttgaatccttggcctccttttgaacacaatgccggaattttctagagattttgtagaattttactcctatctcaaaatgtagtaacaatctaaaatcgaattaaagttatacaaatctgaacaaatatcccatgcaattcttgtgcaaattcatgaaactaagatgtgtctaatccaattctagattgttactatattttggcccttttgaacacaaggccggaattttgccgagatttcttagaattctacttcctccatcttaaaaatatagcaatctaaaattgaattaaacatttcatatagttatactaatctgaacaaaattcttgtacagattcatagtactagaatatgtctaatctgatcctagattgttatattttgagacgaaggtagtacataattttcacaggattcaggaacatgacatccatctcacattcacagtgcaggcaaaacaactggagcgctcgacatgaaaaggaggccaagaaaagcagtaaacaaacagggtgtcatggaatggcacaactcgctagtcagttataagaagaaaacgcagaagagatgtccaaatgggataagattgttcaatccaacaagttctctctaacatcagcagctctcttgctcaacaaaagcagggtgtctcggggaggcagggaaatcaaaagcaaaccggaaacgcttcagctatacatgaacatggcagaggaaaggacgcaaaaaccctatagaaataagtcaaatcgcaccagatacaaaccacaacaaagcagctggttcactgtcacggatggggagaacatcttttttacatcggaagcaaaacaattggatcaaactgcagacgccatcatcgtcgtcatccacccgaatgttgcgcaacccaacaggaggatttggtgctcgatcgatgaactcttcagcgtttccattcagctttggcaggtctttctgtagttttttaaaaaataagtggcctgagaaattgtgacaatggctatgcaatgctactacttggtatgtgaaaagaacatctcaaacatacatcgcataaatgtgataaacaaaacaggcaggttttcttgagcccacaagtatgaaatttaaaaatgtttaagaacatgggaaacatcaagctttccaatcagcaaaacaaactaagaattgaggtcactaaattcaacaggaatattgttaagtcacaaggacagctattattgtgaagtcatatatctgttcctttacattctaaacatttggatctcaggtgacattgactgaaggctcactatatctacagatttcggtgaatattttaggactgatatgctcttaacaatcaagctaagctcatgtacatcacaacaaatctagataacaaaagggatagatggtgtcccagcgcccacctatgtgaaataatgaagaaatggatgtttcattttcattatgtaaagcaaaatgagggtgataggaagatattatgcataaaacaggaaattggtttattctatcaactttcttctagattattcaaattcctcttaatatccaaatgcattctgcgtatactggaaggtaaagttaaatgcataataatgttaggcacaatacagatactaatgcaaacaatgaatattcagatatattgtttacaacttaccacttgcgtctcttgatgatagcatagacttgtcagccttcactccctctttgccaccagcatgggttggcctttgtgtacgcggcgagtgcgagttcaacttaccattagaggatgggagggaatggcgcctggtgaagccatttttctccgcagagtcagaactaagtctgggtgaattctgtccccgcagtttcgccttcgcagattgtgttgcagccatgtagctgggaacagcaggcgaattctttgaaccattttctggatactctgtcttggttgagaatgaagacctcctcttgctgcttttaaggctctcagtagaaagaggttcttctttggatctctgttccatatcatttactaaagcattttcttcattgtggatatcttgcagcggcatagtttctaccgtagggtcagcaacagtcagttcagcaactttttcttcagtttcaacttgataagaaggaacctccggttcaggttgaagatcaggtaccaggatatccgtcttagcattttccaacagattaccattctgaggttcttggatctcaggataatttggaacttcttctgcagttcgctgtggtttctcacattggacctcttggcgttcagggatctcagttgcaggagtagatacctttgaagcctcagccatagaattagttaccttcctaaggttacgtttgaccttctcaagttcagttaactgactttcgggcactgaatcagcagtagagctagtgaatttccttgggtttcgccttgatttttcagtttccatggctatgttcgtctgagaggactcaactggtgcagcagaacttctccgagaattgcgcttcaacttccctgactctgtttccattgcataactggccttccttgtgtgtggcttggcatcagtaacagcagctctctttggatgtgaaatgggcctccagacacgacctatggtccatctctccaaccagttgaaggctgaatttggatccctctcatcatattgaaaatggagagcctctaccagaattggtgaagctaaaagctacagcatttatagaaaaaaacaattagcacaaaagaagaaaacatatacatacaggaaacaaaagagtgatatatgcctgtgagtaatgagtataacaggctaatgcatagattcaagattctcatatttgtatcaagccattagaagactaaatttagtataccttacgagcaaatgcatttgaagacaatttctccttccatgcatcccgcttaccactctgcaaaaggggaaagaatcatataactagcatatcttgctaggcgaatctgtcagttttaacaaagcttcccaaacaaactaaaagcgatgaatgcaagcatgcaaaaatatgtgtagcaatgttctatttagcatgattgtagtgctattacttgcttatgttgaaccaggagcattttgatgatagacttgcaatgttttaaaaagtggtaagcggtttcgtgcggtgaccccaccttgtagctcttatacagcataattggctgcttatgtggcttaagtgctaaaaggttggggcacatgttccttgtatgcggccttgtaggcctttttttatataacagtgaaacagattaaaaggaaaggggcatcattatgatgaatacatcaggtactgaatgaaacaggatcagcaagaaatttacccccgactgttgttgaacaagcttccagttgacttgaatggtattagtagaaagtctgacattcctaccacggactagagcttgaaacttcacaatcaaccatgttgcacgaagagttgcaacggcttgcctccttacgagatgcccacgaatcagggcttggagtcttatgattcctttcaacgcacggaatgcccgacgtgcctggaccaataccatgctaaatttaggatgcataattctaaagaagaactttacaaggtattgtcgggttctttagtggattgcagaactacacgacgcaaggaaattttataaaaggcatgcaggatcaaacaggaatcagaaaaaagaaacattaccagatagcctcggaaggcagcttgtgccttgacggccgcttgttcctctctcaacctctcggggtcgttggacgcatcggaaacgacagtattctgcttctccaggtcttgactgacatcgcgcaccaccacttcaccttgtaagctggaattctcacccctcccaacctcctggacagcctcattgttatgaggtgtaacgagcaccggctccgatatcaccggggagctctcaaacccagcatccttcccagcagcagcataccctttgttgttcgagcccttctgcgtatggaaagtaataaatttggttacaacaacagatcccttctatctaactacaattccataactggactccataatcatcaagaaatcggttgcaacaacagtatttgccgcgcaaacaaagaggtgtaaaacataccgataaatctttcgccttggtagagccggacctcgatgacttcttcccgaagagcacggatttgatccacttcgccggagacttccccattggagcctacactgccgcacgcccaagggttcggagcctgcaataccaccgcacatcagctcacagatctacacccaatacccatttttcaaaaattctatctacgaaaaggcccacaagaaacgcaagaagaagcgaaggccagtgttttttttcccagcggaatcaagcctcgtagcaaagcaatcaaaccccgcaagaacaaaactgacggttaaatatctcgcacagaaaactaactccccccgaaatgcagctccaacaaactcaaatccacgcaaccccagctcaaatccgcgcaagaaaaacccaagaaccacgcctacaccgcccagcagacgcagatctagacggcggcggcagactcaccggatctgagaacgagagagtgcagactcaccggagggacgacgaactcaaggaggcagcggcggcccaaaaaccctagctccctctctccctctctctctccctccctcctcccaacactacgcctccattgcagcgagagagaacgcgaagagagtggtagtgtagtgcagtagtagagctcagcgagaagaagaaaaagaaaacagcagcgagagcgctgaagcggataaaacaaattgggccaaaaaaaaaaaagcgagaaaaagggagaggaaaaaaaaaaggcgagtagtgtgacgaactgatgactgagccagcgtgcgggccccaccgcccaacggaaccaccaccacctcgcgtccgtcccagtacgggtaccccgcctgaccaggtgaggctgacccaccttcactgacatgtgggtcccactccccgctcctgagagtgtgacgtgtggggccttgtttgttttttttaatgagtgggtgcggctcgtcggtggggggcgaggtgaacgtggcttgggaaaaaaaatgatggggggaggagtggggccgaagcgaggtggggtccacttgtcagtgggccatgtcgaactttttgtacagctggtgtggtactggagcctttttttttttactgagaaaagcgggaagcctcgtcttttttaaccggctagctgtcaacccgagtccccacccacagtatttgcagggtgggaccacatgtcagcgggcgccgtgcatgcgcctccaatgtcaccgagagattaaagggtatgtgtggtgattaacggcttgaaccgccttttatggcctgattaggaaacggtttgacgctctgctcgttttgaaatggagtcttgtctatgcgattagggtggactgagctcgttgcaagatttatagggttttctgtcaacatatagacagctcctaattaaaaagtcggatcagcttcgtcttgttaattttacaagcaaaatgtttaatttgactcgactcatcactcgtgtactggctcataaataagttccgtcttattcctatcattttattatacataaacgtaataatggtaaagcactaaacctatagctaaaaaattaagcactactctctatcccaaaataagtttatttttcactcatcccacacatacaaatacatagccaaaattactagaatacatctatttttataattccaatgtaattagtatccactttatctattcccaatataattattctttattttaacaaaccgtgacgtaatgattactctaaaaatattttttaaaaaacacaaatgataagagctaaaaatgagcatgttatgatagggaaggagtaattagaaagtgcatatgaaaatgatctcacgagttaaaaacctagtttagctcgtctcattacgtcggatgtttctttgatgctcctgtgtgaaaattgtgcaaatctgttattttctttgaaaaaaataaattcttccgaatatcatatggaatccacttatatttcaagttggaattaatgtttcagcaacgcaaaatgcaccaatctgctttaatttctaagcaagttactccaaactccgggcgacacaaggaccgactacagaactaccggcccatcgctctgcaatctgcatgcatgcatgcagctggccttgactttgccgccctgttagttgcagtagtaatctccgagtccgatactaattgtctagttgatctgaccaccagcgaagcaattatcaatcgcgagaggtaacgtggtgctgaggcgaccgatcttcgttgacagaacggttcttcgttgtatggtgccgtgtgtttttcttgatttgatagagattatatgacttattagccctagcttaaacaaatacattttttttctagcctaccacaaaggcggagctacactataaaaggagatgcccagtaaccaggtattttttttcttttcagttatagttcatttattttcactacatgcatctctcaatgcaaacttacacgtattagcttcaactcgattcaaagtaaaataaaacgaatgagtggtactacctccgttttaggttataagactttctagcattgtccgcattctataagaagtctcttgtaacttgaaacggaggaaatactttttttttttttaagctccgcccctaaccttccaaccgagaaggttcaggtgtgcatgcttgcctccaactccccgccgatcgcgcaacggtggcggccgcgctttaacgccgccgcgcgccgcggtttctcgtacgagagagccgcaagcgcggagttacggtcgaacggcggtggagggggcaaccggcgcgcgcggcacgaccgcacgagcgacgtataaaaatcgcattcactttcaccaccgtcccctgcagcgaaaaacacgcactccattgagcagtgtggttctgtgttgtgcagtcgtagtagtactggactactggtccaccgaacgcaccgccatcaaacgcctcatgtgcttgtttttacatggacagaatggcagccgctagcaacaaaccgaccactactactggcagctaatgggaggtgaattttcttccatgcatggaggaaacattctctcgtttttcatacgttaactacttttaatttacagaaatcgaatttggtatggtatgtttctggtgtaatatgttttatactaatttatcttgtattttttattttttttaatattaaatagatggtatgcaagaaatgagaagatatccattcaggaatgaaaacacttctttacggcaaatggcgatcccatggtagatcaggtagtactttaccagtgtggattgtctgcagtactactgatacagtagcagacattgacgtgtggctccggacccacacgtcaatcaccgctactagtactgccgaggatttgtttccgtaccctgctgctccaatgatccaatcatatgccaacctaactgtgccctcctgtagtagtaaatcgggtacttgaagctgccattgccggccttcaatttcctgccagtacgactactatactcagtatccctgaagatactgctaccgagtactgaagcgggatacttacaaaggccaaagacaaatcaaacgacagcgaaacagggaacttctttggcttcttctgatcgatccacacataaaacataatccactgtccgctgtgatgattcggtgacattcaacggcagaaataatgggatttggtatcggatcgagttctgtctccttcagaaaaccaacgctagatattgctatatatacaatacaagaaggttaggtagctagagcctagagaagactgaaacacatccctgtcattgaactgaagcttcttctacttgaggaatctcatggtagtattataacacgaacctacaaaaaaacatagtgttagtgcttcgctttcgtctcttacataaaaagtgccattagctacacataaaagaccaacacgtaggttaattaattaacaaggtagacaacgcacagcagaaacttgttgctcaatgctcttcctaagaggctaagagttgaaccgtcagtgtcatccagaaacgaataaagtgcgccattgatcgatgctaatatactactactactactatccctttgtttctttaaactttattaatgcgatgtagtatgactttgggtggttgcactggcagattcatccgagcaaaggagctgtcgatcacactatcataaacgataaaaatatgacaagaccggcaagattgatgaggaagacggattgagaagaggacgaatcgaagggatatatggcagggagaaagatgagcagcgaacagcagtgtttgcttttgacaaaggaattaatggatgaagtggacgacgaattgacgatgccgtcgtcctgaatcctgatcccttttcactccccaagttttctgagcttcgtcgtcgtcgccggctgttcatcgatctcagtcggatgaagccttgaacatgatggaatcaacgtgcgatgcatgcgtcgcgtccatctcgatcgtccagaaacagaaacgtgagggcggcaggattggtgtttacgtattcttgtgatggaggcggtttttgttagaaaaaggcgtcggcaacagctaccggttaaccaacggcgaggccacacgaacacatatatgcgtgacagcgtggagtaaaaaacaaatgcgtggtgatccgatcgaatccattcgtgaaagcatatctcgacggccatggaaacaatggaatggcataattaaaggccggtaacaatcacatttcttccaataaatcacgcacatttgcagttaactatggacttgagaaacaaaagaaattgaggttccctctgtattacaaattacaaacccgattcagcacgagggttaaagtttgttttgtcagatttgctgaatcttaaccacttccagttcgcataagacactgcctcgtcgtcaaagggagcaacctcgtcgaacgaggagtctaactcagctggttgatgcttctctgaaatttggtcccggtatctttgcgccatctcttcagcctcggagaacaccttctgcaaccatacaaaaatgaaaaaatgtgacaagcctgaacattggcaagcctacattgttgacatcggtatactctccgtcccactgaataagacacacatattttaagattcaatgtttgaccaataattatttttattataaatttaattttatttgatgaaaataatatcattagattaatatttaaaatttactttcatatgattatgtttttgttgctataaacactatagaatatgagaaatttaaagtcaaaaaaatagttttgaagaccgtgctaagtttaattgcgccttatttagtgggacatatggagtagtatgtttacgatggtccagaatggagaaagaaatttagagttttctgacctccttgttagagagaaacagtccaggttcgctctcaaggtccttggtactgcagaatgaaacatcaacagtttcaaaggacaatcatagacgctgtgaacagcagatggcctatcaaacaacaaaagcaattatccggttacatgtttgggcagtgtacctgagagcaattctgcccggggctgttgatttaatcacgatagctttcacttcctcacccacttttagcacatcaccaacggatgttagctgcccccgtgttatatttgagacatgtagcaatccactgcaaaacgcaaagcattatgagttacgttgcatttggcgtgtggatttatccacttgcagacctttacaagcgtgccattagaatatggactagatatgcattctactggactgggcatgagataatgcagaccagttcacaatccaggaaaaaaagcagttcatcaaagggaagtactttttttttttaccaaaacaaagagaagtactatgaatgcacgaatttatatgagtcacgtgtaaaatgtagtagtcatctactgcattatcagtgcaaccaccctgatctaaagcatagcaagtttctgaaatcttagccagaagatgcttccgcagagagccctaatcatcagttcgcataatgtgagcatttgtaatgaaacccacaatctgagtcgattggtaaacctcaggtttcactctacttctaacaatcaagactaaggatgcttgcatcacgtaaagccaagactcctagcaatgctgctaaaattaaatacgacattttcttctaactaattgggcagatacaagcagataacaagccacactggaacatatgcttgattttttgggtgatcaatgaaattcagttgaataggaagaaatgacatatatagcaattgacaatcatgttatagatgttaccctctgttagtgtcgccaatcgtaatttgtgcaccgtatggaaacaatttgcggactgtcccttgcaaaagagttccttccctaaggtatgtcattgcctaatacaagtgataaacaaagataagcattgctgtactcatataagtataatttaatgcacagcagaaattgaattgaccaagaaccactactttaaataattagacagttctgataaatgatatgtcagtgaaaatataaaacaaaggggagcactagatgtcaatgcagtcaacttacccatgcttctttttcactaattatcaattcgttagctttttcatcaatccttgtgatgcagacatggatctgttgaccaacctgtgtagaagaaatattattattattattcatgaaagacaaccacttccttaaacagatagctgctaaaacagtcagtcatgctgctatgccataacaggaaagcagcataatgcagattccaagtgcctagggatgtaaagtgatattacatgtcatgctgtacttacagtattctttagatccgtgaagtttcttggtctagtcatcatttcaggtttagggaggaatgcccgaagcccctgaggagtgaaataagttttagtcataaaaatgaaaaaaggaccttgtaatgtagaatagtaaaattatacctcaattcttgtcagcaggcctccggcattccactcaaaaattttaaccttgataggcacatttaactgctttatctggacaatggtgtgtacataaacagtcatataagagcattcagaagaagaaaaggacagccatcactctaaaaaacatttacgcgaaactttctcattcaagtgtgttagagatgcaaattccgtaagacaaccatatccattgtcactcaaataagatatcaagaaagaaaaattttcattgtacatattcatcacacaagcttcctctagattgctcagtattcatgtaacaccttgaatttctgaagtacatgagctctacagtgtaataacttacagccggtgcatagagattgtgccaactcgtagtgcagataggagccataagctcataatcatacgattccatactaataactcctatttaacacacgtgatttcagacacttacgatctggacatcctaggtgcttgttaatctaatagcaagatgaatcactacgctttaacatttcgagctttaagagcaagcagttactttaagggtctagttgctacaaacaaggtggtcatgactcatgagctccagacctaaccgtatcggcctcatcttttcgcttatgcttatgcttatcagctaaaatttgaattttcaaccttaaatttgaagctgattttagggttttttcatcaaagtttatttttcagcctttgcttttaggtcgctaagaacacgtatataaaaattttattcacaaattacttctcgtttgcaaatatgccgaataagccaaacaatggggccgatagaattacttagtactataactgttggtttgaagtatctgggactgggactgggactgggatagcatcatgtcaagactctgtctatagattagtaatgcatcaactatgaaaaagagattgaactaccgaattatcgctaagtgatcagttcatcaaattccaactaatgtagaaaggagagacatagagaacctgcctcactctgtgccacgcgacgcgccggaacagccggcgcgcggacagcagcggccgcccgccaagtgttcgaccgaggacctcggtgaacaccaccgtgccgacgcccaaagccggcgaacctctccctctcccctttccgttcctcccgcccgtcgcctctccttgcccctccccgccgctgaccacgactcccaccttcccttccgcggcgaactgggctgcatccttcgacgccacgtcgcatgccaggtactcaaactcctccccggtcataggcaccgcctccttggccagcatcagcgccggctcgccaccggcgccgacgtcgatgtcgagcgtcctcccgtcgccgccgaccacgacgccgaccgcgaggtccccgggcttggggtcgtaatacacgaccccacgcccacccgcaccagctccggcactcccctccccttgtcctcctcgtcttcctccacatagcctccgccgccgccgccgccgcctcccgccgccgcgtcgtcctcgtcgggctcggtgctcttcccctggaagaacttgaggaacggcgcgagcgcctcctccgtggacagtgccggagcggcctcggtcgactcagactcatcctcatcggcgggggatggggaagggaacggcttctcgaggaggtgcagttcatcacctcctccgccttcgccgccaccggaggaggaggaggaggaggcgtggagcggcgacgcagctcgtgctccgcggacggggaggcggctcgcggtggggggtctccgccgcgccgctcggcggcttcgcggggagacggaggcggcggggaggagggagaggagggacgggggcggcatggcgtgcgagcgggtgggggagtggagtggagtggagtgggtgggtaggaaagccgttatctcctcgcggcgcggccaccgtgaacaggagggatatttcctattttgggtcttctcgcggaagcaggcctggatttttatgcgggaaatcgggccagagtaaagctgcagcgacggttcggcccgatactttcagcccgttttaatactttcatccgtccttataagtccagatataacatatcatattacaatgaatctagataggctctctacgcagattcattatactaagatgtgtaacatccaaccaaaaatttagagacaaatggagtactattttatttaatgttactatactggtcttagggatgatgtatatggaaaagagttgaggcataccaagagaaatattcaaggctaatatatgaatatgaatcttattaacaataaaaaccgtgttttttaaagaaaatagatagatatgaactttgatgtggagttttcaacttggtagaagtttgatttttttttctttaaaaaaatccatttgtgtatcacatcaggctagtaaattgcagtttgaaaccataaatacaatgaagtattatatttaagataacattaaatcgcactctatgcctaatcgttttacccttttcaccaaactactatgcaaataattttgcccgtgttttacccctttttttattgcatggaacaaatttcagtagggattatctgcagtactgcacatgcagtagctggctaactgccgctgacatataggatcgggtccacctgtcaaccactacgggcctgttcggcttaactcatgcggctgcggacctgcggtgcagccggccgaaacagtgatttgtgtaagcagctgcagcagcaacactgtgttataacgactactactgtgtaagtacagtactgcaaagtatccttgttaaacaaattttgagttttacttatagcaaaaccactgacatatgggcccgatgcagtcaggcaggacgagccagtcgagcccgagcagcccaagcccaagcccaaggcgccgtcgcggccagcacaacaccaaacaacggggcacgcacgcctttggcagcagggagcggcggcagaggaaggggggaagggagcaagcaaggcaagggattccgcctcgcgagaacgatggggttcatgctgcgggtgaggctggcctccttcttcgccggcgccgccgccgccggggccgccggcggcttcttcctctacaaggactacaagctcgcccacgactccatggccctccaggtctgtgcgccccctcctccctaaaacccaagatcttggatccttgatcgtcggtggtttatctggcagttcaatcgcgtcccccgcacgtcgcctgtggagagggagatttagggatacccgcttttcaagcttgcaactccggatatacgctatgcgtgtctagatcgttacctagatttttatttttatgtgtttaccaatttaatcttcgtgtctatatcatatgattgtgctgcattctcttcagtttgaccgaaaggggatttgacgctgttgttctgtcctgaaattgggctgccaataacatgcatggattaaaaaccaagcctgaacttttcctctgcccaattattttctgataatgtggagtgtctgtggtgataccgtgatagaggctactgttccatggtcctgccactttcaatttaactatcacttgtgttcaattgtataatttaactagcaacgcagttccaaagtttggcttggttgacagttccagtaccacttcatgtggaatctgagcttgccaaattgaaggttcgtgtggcagtttaattatttttagcttgtggtcatcttggtgggctctcgcgtacaatgtacattgtccacagaagcaactagcttttcaaaacgcctaaggatgagaagccacaacctgatattctgaaatactgttgcttgaatatgtttttctagacaatgccataacaccattctttatgagatttctattcactttgaatctgaaaacaatgtgtttgccattccttgcgtgcacagaaaatgctttgtgttcaagaatgtggaaaaagagagtgaattttaggatgccatttaatattaatattatggcgtggttggagttgaattgaacccagtatcctacatattatattatcatagacataggcattcattagtgcaacgtctgtgcatttaagttgcacaggaacgtcatcttgcaacataaaatttgcagctataaatggcttttcttcagagtattttaacttgaaactggtgcattcctgtcatcagcaagaaccttggtgctgttaccaataacttgtttccaatttgaaattttgttggaacttcagtgagaaatgactcttttgtgagaaaggtgaaatgatatgtatatgccaacagtgctatggaagaactttaggatagtccatatgcctgattaacctagagtcctagattagtatgcaatggtgggataacctcatgtaaaagtagaatcacgtcacgtggatgaaagctggaagctgttttgtaagatgcaatatatgtgactctgtagtttgtcagaagaggttccttaaaatgggtggatggtctacttgtgttacctccaatcaatataaccatccaggtccagctatggcatagctaaggaggctattcatatgagaagttaacttttcatatttttcttgggtccttcaaacaggccacttgtttgagctgtaagattgaggtttctatgattctctatatgtggttctaatcctgctccctttgcacaaaatttatgtgcatgttcaattccactgtgcatgatactggttgggtttcaatgtaaaagcatctgacctttcaaatgcatactcaggtcaaaggcctacaagaccatgtggatgcccgttacaaagctcttgacaaacgacttgctacattggaagaccagaaaaccagcgagactgctccagacgtgggcgtgccatctgattagtctgttcattggctggcttgagtatggatgatttacgactgtttactttaacctgtgttatcgtctcttggaggcaaaagccgatgactgactgcaaaataatttagtgaagagttttttttttgtgtgtggcaatgaagcttctgtagtgttatagatgcccatggggatacccaaccttgcaaaaccatttcacttttgatggcactgaaccttggcagtcaagctcgatcatttaccaatgtacctgtgtgaaagtttctttacctgtttgctgccaggaacttggatgttttaagatgcctgctgttattctttttcaaaactttccgtgatgcatgtgcattttatggccaggcaaaatggtagatcttggaatgaatctgatactgacaaattggccatctattgtggaaaacaatcacttaaatacataaatggataaagtatcacagatgaacattgcaaagagacttgccgtccttgttctggcaggaaagtatcaccgatgctagcttctttgcggccatggagaaccatgctgcacaatggctagctgatgactcatcgtcgtcaccagttcgtcatcactggcatagtggcatgggaattcaggattgttgcgtgtgctactgtattctctatatatgctcgtcctacttctactgaattatactgatttctgaacaattaactgtccctttctgtctactaacttcttttgagttctgggttgagacgctaattggtgctgctagagctggttgttttcttgacagatgattcgtgcaaggaatccccttcaagcagattcttccttgcccagtactgagaattaatggtagatgaaaattcttctagtgatccggtgaacttcagggtactgtactagtactgtaacttcatcatattcataggtgccaacaaatctccagcattttcaatctgttctgttcttgcaaatctgccaaacaacagacggaaactaattacggcatcaaagctccaaccatttcagtatccccaaccgtgttctttccgataatgcggttctcatattcaacctgttaagctgcaagtgcatgcacgattacctgaaaaatgcccatagagttatcagaatgagacggtggtaatgcgactgcttcaaaacaattggcaatgaaataatgattgggggaatatgctgcttgcaactgcttgcgagtctgatcagatatgatggatttggtaggtgtgaggagagaaatgagcatatagttcagatttgtgatcaacacaataaacaaagttgtttacaggaaagctgctttcatcaagatctcagcatgttctataaacatctagttaaacattttaatatattatgtaaaaaaaatctaatatccttattggttgtcagcaatctgtagagaccaaaaacattattattaattgacagcccattgtggcaacatttccaccacaattttatgtagaaaaaaataattcatgccagtagtcaaacaccagatattaaacacatgataatgactgggactcctaaccatacaaattgaaatatggtcaatttattttagagaaagtagtggagtcatcagattagcaaattgtaagaagcaaactctttcatggtgtccactgaccactatggctgtgtttgatacttggggttgggaacccaactccaccgcacggaaaacggagcggtccattagcgtgtgattaattaagtattagttaattttttttcaaaaatggattaatttgtttttttaaagcaactttcgtatagaaactttttgcaaaaaaacacaccatttagcagtttgaaaagcgtgcacgcggaaaacgagggaaaggggttgggaaacttgtggaaagaacgcagatatccaaagatagatagaacttgagagattaattttaatgcctctgagatccatgacactggagaaaacaatccatgtgctctcctttgatgcaaatgatggacgttacgcagacaccagcaaacaacaccactgaccatatgcatgctaatgtgcaagcaaattccacaaacagtaagacacaatattagcactcgtcaataattgaaccggaaaaggataaaaataaaccagaactaattaagctcactttgacttcagcaaaaggatcggagccatcagaaaaatttctttgcctgcagtctacaaaacctttctaacattgcaggatcagatgaatacaaatgcatcttcagatccctgggtaacaatttactagtacggttttgtgcatgttagatgcaacccatcattaaacagtattaatacgatcaaataagtgagctatcacccaaacaatttctatggcaatgaaaaggacagtacagtaacacaatccaaattgtacctttctgctaatccactaggcaacaaacattgtttgtactcaacattttccaggaccatattaacctcgctgaagtaacaggtgaaggatccaagtccacataaatatcagcccaaatattcagacgctgacaggaacaggaacactcacaaaacataaaactttgatctcgctgcaaggagatgatatgccaacaacacattataagaaaagacactgaagtgactgtctgattcattgattccactgaataatacggagtacacgataagtatttacaggaatgatacgaggtagcgtatcaatgcacattaatcccgatcaattggtctcatctgctgtggttttcttgtccagcgatgctcatctcggagcagctagcgaaaatgctccattgtttggatcgtttagaaatccttccaaagcagacatcgatcaaggagacccaaacagcagtacggcacctttcagcagggcatccggcaggacatctctgggagcgacagatgatgacgacgagtcgacgatgcgcttgcaagccaaacagaaaatatggtcacatatttgattggcaattgcaaaggaactcccatagatcataaaagaatacatatcttaggcacgttcttttgaaggaatgaagaattgattaatacaacacgcttctcaagttgctaaatgatatgattataaaataaatcttaaatgactatttaaatcgattctttcaattttataataattaatctattcatttctactctcgaacagtgattacaatatcattctactatttgggaaaaaaatgcatgtgcgcaatcaaagtacttcatctatttcaggtgataaagtgatttaattttagttaaagttaaactactttaagtttgactaattctgtagaaaaaagtagagtagtaacaaatcatatgaatacattatactagacactttattgtttaaaatatatgttttaggtatatgaaaataatatagtcaagtctatcttaatgaacattacataatagtacaattgtaaagtcttttgacatttataaaagagaatttgttggtgttatgttgacttttttttgggaacattactcccgcaaaataatatttagaaaaatgtacttcgtgcagtttttaggggacttagtaattaattaaaatatttagtactaataaccttcaattatatagcacattgcatttaggcggcggcccagtcagttgcccacccgctcaagaagccagcgaaaatggcgtcctcttcctcctccgcctcgtcgccgctcctacctcgccgaggccaccagctccaggagccagccatggccgcgtcccagatgcggtgcgggggcaggagggagaaccaggtaccagttcttggccggggtggagttgggttcccttgcatttttgctcgcgttcttggatcaaatcggttattattgctgttcttgttgttgctgctgtctgattctgaaaattctctcgtctgctccgggtggtggtggagaaggggcttgtgcagaggtgcgccgagacgatgatgctgtgctgcggcgtggattgctggtgcggcgcgctgcggctgtggcgcagggtggtgcttcgcaagtggctcaacgtcggctccgggtcgggcgactccgacttcagcgccgacgagtgcgacgccagcgacggcgagctcgacggcgaaggttaacctgcctcaccgagtcaccgtcccctctcctcttccttcctagctgctctgatttgatccagtttactcaagctttgctcttgtctggaggaaaaatggggggagaatttggtgtgcgaatttgtgttgttttgattgctaggcaatgaggggaatgctgaccagcatactgcaatggaagctctttcttgtacgcctttgtgatttgactctccttttttttttcagaagattaaaaaataatcccattcaaagaattggttagtttttttttctttagaactaggagatgtcatgtttaattttgtgtgtaagttgatgatcttgcaattgcaagtgccggcaatttggtatggtcattaatatctctgagaaagacttccattgtgatgtgtagctaggctagtactctctgcataccagcggctttcttttggtatattcaacctttttaaggaaaggaatgttaggtcagggagttcaaggatttggcgaaagcatgataccttttcgattcttttctaagcttgcttgagcaaaatgggtagcaaaaagtgaggataaagcaggcaacttttgcttaactcatagcctcgtttttttcttattgcttcaatgaatggtaatgtgaccatcttatctagttgactttactatctaatgacagctgctccctttgataaaagtcctgtaggtgttgtttttagttaacaacatgtccttatcaattgctcttcttgcacttaacttgcatatgttattgaatcatgcatattctgattgttctctttattatgccatttgtgcagacagggataatgaatcatatggtgaagggacgagtttagatggacttggtgcaggaacaattggtaatttcattattagctcctcatttttttttggagaggtctgctgaagatctgcacattcggttttttgataagtctatttctttctacatgttctatcttttagatgagttgtccctagttgattttcatacaagggaatggtcttgcatattggtgctaaaatactaatctgagcagtaaaggctagtttggttttgtagacagaacatatgagtccattgaccaaagaggaaagaccttatgtttggtaatcatttacatacgagagactgtagcctcgaatttcagtttccctggggtgatgatgcctctagatcggtttatcttaaactgttctacaaaatagtacatcatgcttttcttgtttttattaataaacatttgatgttatcacaatggatgaaacagaattgaatataattagcaagcattcagctttcaatattttttcaagttactctgaagtccatgtttagtacattaagtgcctatttgaaaaggcagggctgattggttgccttatgtgcagcacaagcacttgtttgataaaactgacatggcaggtttgccttatatgctaatgcaatcaactacacaatgtaggggatgaaattaaatctatgccttacaggcttagaagacgcaaatcagagacccttcgcgctcagtatattgacatcagagaactcaggtatagccgtatagaattttctccatctttgcatttttttttcctggtcctagttatgttcttccagttacagtgagtattgttcctatcatcttatgtcactatgtaattaattaatgtgatgtcagccactcatttcaccgtattcctatcacacaaatcatttcaggttaatgctacaattgaacccacttgttaccggctgaaataaataaaatatgatacttttgtatatgtttcaaactgttttctatatgcaggatttgtgtagggacatggaatcttgcaggcaagtttccacccagtgatctggacattcaagactggttggataaggaggagcaggctgatatttatgttcttgggtaaatcactattcacaatttttttccccctattttgtaaggtaaaagatttgtgccgcagattcgcatgaagcactccacttcttatctttgaaaactaaaaaaatgtttctggatcatgatttgaaattattttggcatcacagtttcttcaaaagagacagacattattttattatttagctatggtatggtggtggttctatttgtattcgtgtatgtcatgatgttggttggttgttctgttgtcagcactacaactgaagtatataaaaaatccattgtcataaatttatgtttatctttcagatttcaagaaattgttccattaaatgctggaaacatatttggttctgaggataacagtccaattgcagtatgggagcatattattcgtgaaactttgaataagatttgtccagataagccgcagtataaatgtcacagtgatcctccttcaccatcaaggtttaatccatcagattatgttatggtgatgaaagatgaattgcttagcgagtctgacagtgacaattatggtgagcttcatccattgattaaacaaaatgatgatatagctattgacaatgatgtagttcatgataaaacatatgaaaacttcagtgctgcttccaacggaagagttcataaaggcaaagatttcagcaggatggattcagtaaagacttctgatcagtcccccaacttaagttatgaaaaagacagatcaaaactggaagagacaaccaaattactctatcatccagaaaggcttggaatgatttggcctgaacagccattggatatgatggctcagtgtcttcgggctagcacttcactgaaggctctagcaactccagcatctttgaaatcaacagtgaattttccaaatgatgatttatcccatcaagttaacagtgacaatggagtgattaaaagtaaaaggccatgctttctgcgaatagtaagcaagcaaatggtgggaatatatctttcaatatgggttcggagagacttgcggaagcacattcagaatttgagagtatcaactgtcggtgtaggtgcaatgggttatatgggcaacaaggcaagtatcaactttaatccactgctcttattattcaattcaacagcactcaaaacattcgcaaatcatttagtcaagaagtcccataggttaatcagtttggtgttggtttgtacttccttctatctgctctatatgttagcataaaaatttagtttcatctactttgttattctacaaatcattggcttgacgatgcttcttcatgctgcaccttttcttttttcaaaatttagaaaataattggtgcaccgtgcacatgtgcttcttgaatgttccaggggtcaatatcagtcagcatgtctatacatcagacacatttttgctttgtatgttgccacctaacttctggagaaaaggatggcgatgaactgaaaagaaatgcagatgttgaagaaatcctccgaagaacagtatttaacccacttcctggacttagcacgcctaagggaatattgggtcatgagtaagttcacaaacttgtttttattttttttgaccaagggctgagcgcccccatttccattacaagttcacaaacttgtgtcttatgaaaaccttttactatcctcgagaggcttgcacccaaccagaatttattcttctatggtttcatctactgtttgtcgctggacactactcatgataatgccttgcttacgatataaccatcttttcccttgatttcttatggttatccatgtcatcattttcagaaggatcatatggtttggagatctcaactaccgaatcaacttatcatatgaaagagcacatgaacttatctccaagcaagattgggatggattgtttgagaatgatcaggtaatttgatggtgtgatacattcattaccattatagatttctgaatcatgcttttcctccctttgtaacagctaaaaagagaattgagtaaaggacacacttttgatggttggatcgaaggagatatcagcttccccccaacatataaatacgagtttgactcagaaaagtatgtaagtgatgagccaaaatctggaaggagaacaccagcatggtatgttagtttttcatagcactgccttctttttttttgcataattaaccttaaaagattaactcaagttcatgcttagaaatcatatctgttgcctgttcaggtgtgataggattctttcacgaggaaagggaatcaggttaatttcctacaggagaggagagcttaagctttctgatcaccgccctgtgactgcagtcttcatggcagatgttgaggttctctgccacagaaagttgcagaaagcattaacatttacggatgcagaggttgagtatcatctggtaacggaagaagatagaacttgagtgaaaatatatatatttgattgtgcaggcaagttcttcagctgaaggtcgctgaataacctgcctgattttgctgttcacaattgtaaaaaaaaaaggagttagtactaggtaaatgcatagctggatgatttactatagctataggttttcttctgaaaagtgtatagcgttttttttttttgatcataagtgtatagcgttcttgtttcttttgaaaactgtaaatgattaccacacgggtgtaccccttctctgtttgagcctaattttccattcagcaagatacagatatatcatcacgattctcaattctgtcagctgaaactgcatcttaggggcacaagttttgcacatgaacgaaatgaacgagatgaatggccaatgaagagaggccagccatttttctactagtgtggacaatgcatatacaacactacaacaacgaaaagataatgtggaaaaggttgatgagaaaattttatcagcctagtaaatccaattttcttaaaatataaggatgctttctccaaaattccgtccccatgtctgcgtgtgccacaatcacatcccaccgttctcttgtggtattttctctaccctctgcgtctgcagattcttccacctgcagccatttgaaacgtacgagttaagattcttgtggaaaacaaagcaggcagcggaaataatacaagaagtcaggcaaaatgcttcttgggaacaacaaagattaccttttgccggtaagtacatgaacccttccgaaacacagctggttcattgttgtaattcaaatgaaattgctggaaaagcaactcgttcttgtcctttgataatgttccctgcagagagcagtaagagagttatggctacagataaccaaagcatcaaacaagatcaagaggggggaaatatttaaaccgaaatgatgaaagaagacctttaatatctcacgagcttcgttttcacttttgccagatttcactagcatccaaaagcatgtgctgtattggttggtggtgtggcctgcgaaatagtacgtagcacgtgagttcactgaagatgaacaaacgaatacatactgaagttcactgaagagaatcatttaacagtgtcagaatatatgccttttaggaggaataacttacattctgcttgtctcgatgacaaataatcacaaagtatcttttgttttgggtaacatagaagttctgcctcaaagtgcggtggctccactaagtccttgttggggaaaaaatctttccacttcatcatgtaaaacaaggtgaaacgtgaggtacatgatgaaaggattaagctgcaaaagaaggtgcaatcattttgtcaatggcacctcttgaaaggacaggcataatagaaatgcataaaatcagtaattacctttcctgacgctggtatagttcagtcttatcctggaacacaaaactgcgacaacaagaagaaaataagaaagaacatttgcaaaagatgaattttctgtccatcaaatataaaaatatttgtctaagatgaaacctttgctatacaatttaatgtatggattattagtcataatatttttatcttgcgaagactaaattaaaacaaaatcaattcagttcatgacatccaggacttttttttctgtacaagcaaaggtttttctttctttcaattgtttttgctctaagacagtggataaggtcataaggaggtatatcttacctgtactcattgctaaaaccatagccaaagacaatgtcagggaatgactccatcatcaaagaagcagaagcattcatcaaccttagagctgcctcatcatttggcttgtcaaatgaatggatcaacgagaatctaacaaagaaaatttgagttctcaacaagacacaaaagagattgcatcatgctttcaaataaagaagaaacaagagggtcctaactgctcaaatttacaaatgtcgatgcgaacgacagtccaattacaaggtggaagcctatggttgatgtcaaacttcttaacattctcatacctacatttttctttaaccaaagactccagttagattgatgctgtacattttcagagttctgactgcagctgaattgctgaaagcatatagagaacaggagttaactcaactcaccttctcgaagaatatatggatgattttcccaaaactcgggtcctatgatatcgacatttgcatttgtaataactaagcgtgtcctttttatggggtttccacaacgatcagtcttcaccattgtttctacctacagtgatacaaaagctcttagcatacaaaagtgcatttaacaactattaacatttcagaaagcatgttatttcattcctggttagtcaatctcagcaaagggatgagaataatagttcacaaaaaggaaaaaggatgaagataaaattttccaagaactacgattgttccacaatcaaacccataaaagaaaggtagtatgcagtttacaatcatgttataagaatcataatctttgatcaataacttaaaaagaactggcaccggattgcataaagggtgctctgattatcactataagacaagtaccttttttacaaaatccagacaagttttaatctgtccccccctcttttttttttttttgccattccacttccatataattacgcatgaccaaacaactgaaaactgcaaatctcgccaagttcctaccaagagaactagcaaataagtctcactacaaggtcccaaatcttctttgaaatatctctgatggcaagtatggaaaaaaactaccatgggcattactagagagtagagactatgtaaatactttgttgagtattatcaaagctattaataatgatgccgttttgctttcttggcagcattaccttgtctcggtaaacgcaagacccttttcggaatatagccggttcatcatcataattgatttggaactgttgtgaaagtaactcattcttgtcctttgaaaatgtcccctagaaagaagaggaaacaaaaagaaaacaatcatttattaaaatgcaattggaagcatatataaactctctaaaacattttgattaccttcaatgcttgttgagcttctttttcagttttcccagacttcactaacgaccagaagcaggtgttatattgattgtttatatgacctaaaaaacacaacaaaggaatttgttctgagtcgatctgtttaatgaagaaataagttgtacaaatctcctaacacatagacaaatatttagtggtgctaagctgattccgtattaggtaaagatgatatacaaaacggtttcattgtacagaacatcattgcacaatgcaaaaatatgaatattgaatctgttttgctatacaagaaaaagttggtggagagaatatcttacaatccacttgtctccaggccaggtaatcacggatagtcttcaagtttggatagcatacaactcgaccatcaaaatatggaggctccttcaactccttattaggaaagaaatctttccacttcatcacgtacacagaagtgaagtaggaaacacataaagatagaattttactgcatgcaagttattagtagaaaagccaatgtcataaaacattgcacataagcacattcaagatactcagtgaaaatggtgtacatattaaatggtacctttctcgtctttgatagaattcagtttcctctctaaaaacaaaactgcaacacaaacatgagatgcaaataacttataattatactgaagacaatgcattctatgtcaacagggagtatctacagttcacgtctttgatcacctacttaagaggcattttgcacatgtaatataacagcacagctcttacataatgataacattaaccatggcaatcaagtgtagtgtttctcatttacctttggagaaagaacaaactaaggactctggaaaaattcaaactgaaaattccaagagaagatgttgtacctgtactcatcactgacgccatatgcgaagactatgtctgggaacttttcgagcatagaagtggcacaggcgttcatcaatcttaaagcacgctcatcatttggtttctcaaaggtatgtatcttggagaatctaacaaagagaatgctgaaattagtggacaggacaaacacagatcaactattccaaattgtaagcaacagtgatttcccctgtctagtatccacacacactgtggcctgcttctcatataaaccgatcatcacaaagaaaaccaagcagaaggcgttgtgcataatagcaggtttagcttctttttttttatccctaagagtctaagaccaaacagacatgttgcatcaagcaaaaagcaggagatttaaactgaaattgccatgtctgcataaactatcgcacactgcactaccaccagagaatgaactgatacagccaccggatggaaggtgagagcaactgtaccggtggaagtggcagccgtcgatgcgcacaacgatccaattagagggcgggaggaggctgtcgagctcgaactccctcttcacgtactcgtactcgctgttggccatcgccgtcaccccctcacctcaccgccacgacgaccagactacgcctgcaattctgcaaaggtgccagtagcagcagacgcggcattaacaggggcggatccaaacttttgggtgaacaaacaaactgttattatttaagagaggtttaaggctatcaaattaaggaggaggagaagatctagaagagaagcgcaagcaaattccagtcccggtggggtgggagagagagagatgaatcagaaagaggacgcaccaggatcccctcccctcccctccgctgcgatggagatcgccgcccggccctcccctgttcagccgcgactcgtcttggcggcggcgcaaggagcggagacaacgagagatttctttttcttttacgcgatactcgactactccccccttacctaacctacaattgtcagaacattttccatattgcctatccaacaaaggactgttgtgctagaattctatctaatcattttgagtcccttaattgtactctcaagcatgtactctgcttctaagtttaataaattcctggttctcaaaaaaaaaaaagactactccccccttatctcaatatttttatttaccactccctccgtccattagtatttttattgttattagatgataaaacatgaataatattttacgtgtgactaatttattttaatttttcataaactttttaaagacggacggtcaaaaattcgacacggattttcacagttacacttattttgggacaaggtagtattttaaaactagctagtgctatttctttatataactggtgacccacgtatcatcaatacttaggaaaaaattaaacgattgtgtcgacaacaaattcctcataccaccagcaaccgctaactgccactctacgtaacgctctttctccatgagccaccatcgttcctcctctttgcctttacatgcgcagccttaacctctagtaatcgatatgtctttttctcctcccctatcgtgatgcgcactattgttatggttgctattaaggtcggagatgtcgagcttgcaaggactttggaaggcaggagctgacccgacgaagagcgaaggcgctatatctaggctctttcttgctagatccatcggttatccaactgtcggatggaaaaagaaaatggagagagagagagagagttaatgtgcgaaatgattactgagtcactggacttggagatggatagaatatggtagtccaaataaaaatgtaaagttagctattgtgtaaatgaaaatggttaaagtataatattatatgaaaacttttaagaatttttaagaatacatagtatggattgtaatttactccctttgtcccataaaaaacgaatgtagaactggtgtggcacattctagtacaacaaatatgaacatatgcatgtctagattcgttttactaggatgtgtcacatccagtcctaggttggttttttatgggacgaagggagtactttttttttctctagcacaactaaagataattgtccataacccgatagtctcgtgatatgctaagtatgattatgccggtgtacctagctataactaataatctcatgatatgttgatgcatgacgatacagacttctactaacacgggctgattaactatggttagatagattccgctaaaagatgataaaaataataccatcacttttgctcaataataaagcattcggttatggtctttttttctcattgtattatatatgatgactacgttagtacgtatttccgtaattctttcatattattttttattttctacatatatgttaatttggactaatatatttctcataattaaatagataatacatcatttttctatatttctcctataaaatgagaatagggcattttatatttgaaaaattatattataagtgtatgtaatttaatgtgtaagatttggacttatagtataagatttaactttttctaaaaatgccgcatcatagtagataggtagttaactgaacaaccataaaaaacagagacaatccattgtgtgtcactaattttatccctgctctacaatatgtcattgggtttgtcaagttctaatatggcatcgcattttgcttaacttctataatataccatcgtctagttagcctccgttagcattgtacaattttatcatacagattgtaaaacttaaagagtttgagatgggcaacttctctgcctagtttataatatgatatttcggaattttcggccaaattttagaaatttttgtcctagggatatttcaatcattaggacaaaattatacagtactaacggaatctaaatggacgacgatggtatattatagaatttaagcaaaatacaatgacatactgtagaacttaacaaactcagtgtcatattacggtgaaatacggtgaagatacacgttgaaacatgtcgctatcacatatgaaacaacaaatgttaactgattgaaacatatgtttttctttcatcaaaatataatcatgcgatatcttgttgtaaatatttaattacaatgaatacaacggtgtgatatagtcatagattggataagtagtttaggaaaaaaatattttgaagatcataaaaatgtatgtatacatagatggatggaggggagagaggagagagagtagtggcgggtagttccatgatttttgtgaaacatactgaagacacacattgaatcatatcactatcacgtatgaaacattgagttttaatagtttgaaacacatgtttttattttatcataatataatcatatgatatcttgttgtaaagatttaattacaatgaatacaacggtgtgatcggatcgtagatcggatacatagtttaggagaaaaaaatatttaaagtgggaagaaaagaagaatgagaaactagttaatagcatgcatgtgagagtgtagggtccaatttttactgacccgatcgggcgctcgagcctgagcattttcaaaactattttatgaaataagttcatcagaggtctcttaatttgtcaacgaattcgattttcgtccttcaaccggaaaacgatatacaatgggtccctgaactattaaaaccggtaagtcccaaggcggtctggagcacggtttcaactgatgtggcacccacatggctaattttactcgatattcgtcttatgtggcattaacgtggcatatgaagcaaaatttaacaatttaaaaattaaaacaaaatatttggacccacatgtcagtcaaacaata

SEQ ID NO: 80626 - DNA, 7107 bp, Oryza sativa
aacctccgtttgacggaaaatatagcgagtcggagtgtccaacgatggtctaacgagtttgggtctagggtttgggacgactgatgagggaaggagaaaaggttcctaagcttagagggatggtcataggagatgacggagccataggcttgacaacaagcgatgggctggtgatggcagtagggacaatgcggggcacatggttaggaggtgagggtgaaggcattgggagggaggagccgctggagacaggaaagatgacgacgaaggcactctccgtcgccagcttgagaaggaggaggccaggtgagcaggactcgttggcaccgtcgaggacgaccggcgatgtggtggcgtagaggaggtaggggaatcttcgggcagcggcgcacgagagtgaggaggaatggtagagagttatggttattagggcatcaatcaatggtctgatattcacatgatgtgtgtagaattttctgtcacattgtataggcagtcacgtgctaaaaagggacgtcctttttgcacactgctgatctgctgggtgaaatgagatctaccaaggggacaagagccgtagtgccatacaaaagctggtccactatattaacagaggtagtcaggtttcctcttgtttctgtccaacggtcggtagagttgaggcctgtggtgtctgacggaatggagattagtactactgactaccccctccgtccaaaaaaaagtccaatcctagctacgaacctggacatgtatcctggacacatgcgtgtccaggttcatagccaggatttggttttttttgggacagatatactgagttactactgtaagtaaaagaaggggccttgtttctgctgctagccagcttctccggccaattggttcaggtgatgcttcagtctcatgcgagaggaaccacttaaaatgatacagttctttgctcggagatctccagcctcataaaccaagtgattttcgagcagttcctatcaatttttgtctgcaatctctgcatccatgctcgcaaacagcagccacagaaaccgttacgtttgtctgcttatgccgtgcaaaggaaagaaacaacagccacaacaaagacacagtacacttgctacctgaaacgaaacaagctccgtccaagcaattctttacaggttcacgttccaatataaaagaaattatttacattcagctccattttcgtacacaaacaatagcttccaacaactgccaatcatgcagcaaaggcatcttattttattgcttgcaactactgtacctgattattcgtctgaaatctccctttctgaataaaaaatcacaacacttgccgccacgactaggccaatgccaatccaacagcagttgggataaactgcaagacgaagcaacagcaaagcctttgctcgaagggataatggcaacagattaccctggaaggcaggcttgaccacttgaccgttcgagagtttgaatcagaagttcagatttcagaggcacgctcctgtgatacaaaaccccgtgagcacagacatgttgtagttgcgtgcattcagttgaagcaaacacaaccgagtattcagctacctggcgtgcgttttgtttctgcgtctttaataagagccggtgaagcaaacacaaccgagtattcagctaggggggaaaaatgagcattacgctatcgactatggaggtgaattttacgcgtattcggaggggtaatctagagagaaacttatcacaaacaattggcgtgcgtgctcaaccgctgcctcttgtatgcgagggacatctcggcgaattgttcatgactcaccaaacttttgtgggtggccacgaaaagctccatgccactgaacccaaacgagcggcagagtcacggccggtgtttggtcgcagtataagtgtaaccccaccttgcttcaacagcacgcgtccgcccgaaccgatgaaaggggaatggaaatctgctagggaattgagctaaacactaaacaaaaggaggtttcctttaatattttttctctggttgttgtgcgggaaaaaaatcattttaagtaagaattggatagttttattaaaattagcccaaaaaacttcaaaaatccttgtgtcccaaggcccttttgaaacatatatgttttactcgattaacgcaataaattaatattttgagaaataaattttatagatactcctgaataaatggtctaacatagtactatctccatatcaaaatataagaatttttaaagtttaacacgattattaagaaaatatgtaaaatcaaatggtgattggttgagaaatgatggtaggtggagaaattgaacggcaaagggttatgattggttgagaagaaaatatcggtggagatgttattatattttagaacaaattttaaaggctaatagttattatattttgggacagatggagtagaagaattatcgtacttttagaagcatcgagcaaataatccgcgacaaaaatccaaaaagaaaactgaaaagagcaggggtcaaaaaaaatccatatattattttcctagtacaaaaactaatacaaaaccaaggaggagaagaaacatactgggtgtgtgcttcaagtcaccaaattcttggtggaaaatactgggttcgctgaaactaatactagtaggaagccgattacaaccaaacaaaatctgaatctagttttgctaaaagtcaccagccatacgaaacttgcaaacctcatccaaaaggaagtagagatagaaaacggtttcaccaagaaaactcataaaaaaagaggcggacaggagagagaaaacacagtgttgtgatttgtgaagtccggattaaaagggagactactgtgcctcctccgttttcctcttcttcccttctgcagctctcctcttcttcttcctcccaaacggccagcggcgcgcagcgtcacagattttacaggggaaagagaggaggagatggggagggaggagaggttcccggtgtgggaggcggcactgctcgccggcgtcgcggccgcctttgccacgggtctcgtcggcgtctacctctccatgcctcattcggactacagcttcctcaagctgcccaagaacctccaggagctccaaatcctcacgtaattcgaccgataccgtttctaactgttcagctggtctatgcatatgctgatactgcttgttcgatagaaacttgcttctctttttttttgtctcaaaagtttgcagtttttgtgcgtttttatgttttagaacctacctgtgaagaatcctaatttactagaacttacctgtaggaagaatcctattttttgtgttcaaaacttcaaatagaatgtaagtacgtaaattgcatcgtatatgttccgtacttttgccaaatataaagattttattcatcttcactgttgataccaatttcatcctgttcttccgcttgaactgcgttggtgcgttgctggatttcggaacgtaacggattattcttggataatggacttgtagtagcaaagctgtagtttttttttcctgcttatctgaataataaatccgtccactattgtgtgttttgcgggtgttttgagacagtcttcgttttggtctgtggatttctactgatttagagaggatattttctaaaggaaatttggaaagggtctcagtgattcctttgaacaagttacctttgtctagtagtactacacgaagtgctttgttgtaactgaaaatgaagcatcggtaaaagaaaaaacttttctgacggtgacggtaggaaatttgcaagagttctacagtagggcgtccacttttagtggagtggtagaacatggatttatgacctgattatccatgtccaagtatggcccatacacattgcagcctgtggtccccttaatccattgaaaagcataattaatcgcgtaattttcgcagccggtggagtatgaaatcctttcttctcggtatttactttctgcccagctgtaactgtcgtgcgttttgaacctggccattggtcagatcgagttccatcatgtgtgcctttttggtcactgcacgccataacaatgttttgttgacatctgaactctcttcagctatggccttctgttaggttaaacaccacttgccaaatagtaccattgttcagacttcactattcagataaacagataaacttgtgttcttgaatttgtctgaaactctacacatgttcaaccttacacagttacactgtttgatgtctcagtgggcaatggatgtttcaaattaaactgcttctaatgtttgtgtacgtttaatttgcagggatcatctcgaggactacacgagcgactacaccgtgcaggtgctggtgggctattgtgccgtgtacatcttcatgcagacgttcatgatcccaggaaccatattcatgtccctccttgccggagcactctttggccagcttggtggtgttgcccttgtggtctttgccgccacggctggagcttcttcatgctacttcctgtctaagctgattgggaaaccgttggtcttctcattgtggccggacaaacttgggttctttcagaagcaggtaacttcttaacctgcatcttagtcagctgatatcgcttaggattctccctgtgttctagttcatggcaatgttttttatatgttcgatatgcgacattttgattctttgattcgatatccgtcaagattctgtaactgactgatgctgtttgcttcttcttctcaggttgcaaaaaggagagagaagctgttgaattacatgcttttccttagagtaactccaacattgcccaatactttcatcaatttagcgtcgccgatagtggatgtgccctaccatattttcttcctggcaacctttattggactaatcccagctgcctatgtgactgtcagggtaaatcacctgcttcaaattcacatactattctagtttcttctcatgcatagctcatgctttattctttcttttctgaaatacaggctggaatagctttgggagacttgagctcattgagtgacctatatgataaacaatcaatagcactgttgttcttgattggggttgtttcggtgacaccgacattgttgggcaagaacgagaagcaacaaggcaaagggccagaaatggtagctagcagtagctgatcacttgcacgcgaactccttctcacctccccttctgtgtacatatgaagatcctgcatttggttgcttccatggcctttgtttggatcggtgcaacttatggccggccaaagggcaacagaacatggcaagggcccctctttctttctccacttgtggaaccctttgtgcatggtgctgcgaaagggacacctcactgtcacaacattatgattctggggaacaagatgggccaccagagctaaaatgacccatttgttctgtttaacatcttgtttagatcgaaggaacagctgatcttatcatcattgtatatgcactgctaaccagattcagtttttcatggaaccttgtcttagtgatctgtgaatctgtccatgaaatggtctgtttgggcgcggaagtgaacagccaaattgcatgtcattttcactcgtttgtgctatgccgcgatcataacgattttgagaggcgatcctttgtgagattctgttgccaaatgccatataatggcttcggtaggtgagtggtgcgcgcaggtgcgcgctctcgattgtcgattatgtgtttcgttcttgaattgggacctctccatcgttgcgatggaccacggctgttgggtgacaaactgacggggcaatccgtcagtcgcacacacgctcctagtcctatacacggatgcgtttggtggataattcgctgtagcttggctgaacccatttcccatcgaggacactttgaagaagaacggcaccggcccacacaaaactcctcagtttttagtctcttccctttgccactgtttttcacaaatgaagtgggactccgagtgcatgttccatacatataggtgaggcattccacatcagaaggcagcaaaaatgtacctcactatcaccatctagccggtcatacaggttatgacaagcagataaaatttgttggttctggatataaaacaaaatgcatgctaaactaacatgtacagctggaaaaaaaaaggcttcggcactcggaccatgctaccatttgattggaaccgggatgccgagcttctttttgccaagagggtgactccgaggacagcttccagaatcctgctctgcattgagttggctcaagcagtccacaatgccttttctccgagtggacggcatactccttactaatcgtgttacgttcttatctatgcaagggcccttcgtcgatttagatgctgattcaaccttagccttcttagcttttgatgtgaatttaaggtttccaagcagaggggtctcatcttctgcaaatggcacaagcagaaatgtcagcctcgtcaattttcaaaggataatcagcaaagcaatgtacagtagtaccatgtaagacaatgaacccgataaattagcagaaaagaaaaactaatgtaatcagcattggcagagcacagcaacagtatgtctatcaatgaatttaaaatctctctattagtggtacaccaatgatatgataactagacaataattcagtgtgcagttatagggtagtgcgtaagaacttctgttccgctgcagagaacttggtaacaaaagaaaatggaaccaagatgtaggacttaccgtcaccgaagtcctcaaactcaaacacattaaactcattatcatcagagaagaaacgcttgcgttttggcgaaggagttgagggtctgtccaaattggtaatgtcagcagcactaccaggacacctattagccacacaatcgtgatgagatgatatgcatggcacgatttcatcttttaggtcagccttgttgataccatcaatcgggcatcccttagctggctcctcaaggaaagatgttttgcattgactagtttcatctttctctaatttatcaccagaactgttggttgcttcaccagaggggctgcaggaat

SEQ ID NO: 80627 - DNA, 8627 bp, Oryza sativa
cacatctgctcttaatatatataactactgggcaaagccctggtagtatttttaatttaaaaaaaagtaatagcaagtaacttgtgacacatacatgggagtcattcattagatgccaagtgctcggtgaagaacgaacagaacaaacataatggccatagctaggtgaaccagaatgctcaacaacgccataaagatcatatttcagctccttctgcataaggtgggacaagtaaaacatcaaaacatgcctttggtaaagctattgctaaaaatagagatagtagaaaaactcacattgatgtcaggatcacaatggaatggcttcaaatcaagttctagtgggtacaccacatgtttgtcaatcttttcaacagatctatcaaggctggtgaaacgctttaaatgaatggcaacgacatctggtgatctatcaagcataagttgcttgttcttacaaacttttgcattacaatgttcacagttcagcttgtcctcagcatccccaattcgctccaacttggtaaaagattccaaggcatcaataaggttatcagcctgatcaatctccaggctaagatccaagaagggctcatatgtctccgagcagtgtccacactcacagcaagtcaactagatagacaggatgaattcagttgcaacttttaagtgccaagacaacaagcatgatgacaaagtaaaataccttgctttttagtcggcctccaaaaacctgcttaacaatactttcttcatcaaaagatgagggcttatcctttggcttgggatcagtggtgcacttatccaggttgtccagcaaacaacgtaggaactcatgtgcatcctcctgttgtcctggtctaaaatctgatgataattctgggtaatcttgtcaaggaactccaccactaatttgaagtaccagagacagatacaatagaagatatatatctcagcacaatattcagtgaatattaagatgtattgaaattgaaacagaactgaggaagcatataaatagaagttatgaaatcatataaggggtaaccttgaaattttcaggcataaacacccaatgattgtcaaaaatgcaagtcatattactgagcatgtgtgcacaaatgtggtaaaattaaactgcaaggaaaaatcgagagcaaaggatactccttaaattatctctgaacctcactggccttataacagatccagaccttcggattgattcatcaatatgttctttaagagcacagaatgaacagaaaccatctttatcatctgcaggagaccaacagttttttttttatcatgaaacaaaaatggcatgagataacacatttttcaggtagcaaaacattactgtcagaaactatccatacatgagcatggagcacagtgatcagtggaacgaagcctgagaaaaagtgggactgtatgggtgacacactgaagaattgagtttaggaagcatgtgttccccatattgccaagaccagatccctgcatatgaagaaattttaaaaataacaaaattattgaatatgtcattagcatacgtaagtcttagggttgaagatattgcataaaacataccaccaattgagattgagtgttgcgggaaaaggacaaagaaaattgttggccctccatgttgcaaggttcagcgccgctctgttaaacatttttatcaatccaatttgttcagtttaagaaagattaaaataatggcattagcataactgttttgaacataacagtctctaaaacataactttggctgttaatttggttataaacttataatataattttaagccatggtataagcatagtttctaaaatactgctggagacacattagcagctaatatttacaaagtttgactgcacgaaccccaaaacaattcattttattgtagggagtaataggtgtgattgtgaagccacttacgccggagttgcacagcttgctgtcaagaagggatgatgagtcttgcttagttttcccatcccagatatctatttcatcctgcagcaccaccaacaataatattagggagctctaggcacctggttatcacagtttatgtagaatagttggataagatatttcagttcaaggcttattgtgtgcaccattaaacatataactgggtcacatgcctacaaagggccagagaagatcaaatagatagaaaattacattggagctaggctgctctgtgctgaggggttcagactgcatatttgtatccccatctaacaaatccatgtcattctgaaaaaaaggaacaagaaaaaaaacagccaaaattagcaaatttttagatacaaccgactgtatagggatgtcatggtaatacatagctagctgcaacataaaaatcacttgggcacccaatcttttaatctaaaaaattagattacattaactttttatagtctaagctaacaattgaactcctgcagtccaaaaaattagggctgcacgatatcacacaacaaaacggtgccctacatgcaagtcttcaaattaagatagtaaaatggcaaaatactaagtaattagagtaccaattgtatttttcatgaagaaacataagagcacggagcacaaaatacaacaggcacgtagttccctagggatgatcagggaaacaaaccaccaaggcttatgcttcataccattgattgttattttccatgagatgttgcactaaagtgggttcattacctattaaaggacatgaacataacttgctttcttatctactgtatcagaaatgctctgagtgaaaattaataaacagtacttggtgaaaatcagcattaaggaacccaaacagactgactgggacaatcatattcttagaaaggttagcaaatacctcagactggggctgctcattttcaggccaaggtgcactcagcatgtatttatcatccatcgaatccaagttgctctgcgtatgagaagaagcatattaaattaactatgccaaaagcagagcgacaacaagctaatcgcaaaaaagaatagataagagtatacattgtgttcgttactcttaattgtgggggcacaaaccatatcccaggaatttgaatagctctgcaggcaaaaccaggaaaccgacaaagttaaaaaattagcagccacaaaaaaggcatgtaatgttgtttcaaagagaaatgataacacatgtaatcaaatatttgtacaaggaagtcaggttaacatcttacaacagagcgaatcggctggcacatggagaaaaatggttggtactgctcactttcagcatccccactttcagcaccagtttcaacctaagaactcaattgtcagaaataagccatgtatcgatgatccaaaactacagaccatttccttttgtaacaagtactagcagaaattggacaaaacagaaggtaaaaggcaggtcgaaattaccatcgtttcagtttgttgaactacactgcggaacgttgcacacaaacaaaatgggaaagcagcatgatagtcaccacgatttctgtcgtctactagccatgaatgaatgtcactagtgttgcccaataattatgtactaataaaaagtggtggtgaggcgctactcctacctgctaccagattcccagcacacgaatgccatgtaccctgcttaatattggggtagaaccacagcaataacccaatcgaaacgcaccacaaaactccaaaaccatctaaatcaaacacgtttggctaagatcgcatcctgagttgcaaaaatgagcagtaaacacaagtaatcgccacacgacaagccagcccgccgactaaaaccgcgttctgagtaaacccaaaaaaaaaaaacagcgaccagtcttaccacgcaaggtaccactggcaacggccgtaccagacgaaaccccaccccaagcaccccccccctccccccagaaactgcagaaaaacaagcaagcagaccggaggatctcacctgaacaggggcggcctccgcttcgctcacggccgcggcgccgttctggtccgccatgcgagggcgagggcgcgctagggttttcgctcgcggggaggggcggtaggtggcggtttggtgcgtgctcgcgcgcggctgctgaatcgatggagaggggaaggctttggttggtcgattggttgagatcggagactaatcgcagcagcggcgggggaaagcaaaaaaagtagggcaaatcgttgggtgggaaggaggaggaggaaggagggaaaggaagatttgggaggtgaggagggggcggaaatattttgggtttgaaacggaggcggggcggggtgcgcgttaaaactgacgacgcggcgggtgggagggaggaccggaggagaggagacggggaaaatgtgaaaaaacagaaactgagtagacggaggaaggaggcgggatggggagagtgtggttttcgcgtttcccgcctgtgggggggctagtgggggcctggattttcggcgcgctcccgcgtttccgtttcctgcgtcgcgtgggtcaacacactgcggatgcggcttccctgttccgaatccgatctgtgtcaaccaatcaacggcatgtgtcattttagtggtgggtcccacagtttcatattacagtcctttcgacttctctttagtcaaattattttatgtttccccgagtttattgaaaaatatattactctctcctttctaaattgatcatcctgtaataaaatccaaaacttctcaaattgatcaccatgtaattgcatgggcacgaattttattggaatacaattaatgcagtatgggataatgtgtgcatgttagggtgtaattggtatgggattttaatcgatgcatgcattatgggagaatgtgtgtacggtgtcttgattgatatgatttaaattatccttggtcttagtgtataaacttatatgatgatcaatttaggaacaagagagtagtatttttaaaaaaatataaacatattatcaaaatatattcaatactagatttaacaaaactaatttaagtttagtaggttgctaattttttttataaatttaattaaagttaagaaagtttaactagaaaataagtcaaaacgacgacttgggatatgaagtttagttttcctcttctctattttcgttgttcgagttaatatatcagtacctgtctctcttatggggctaaaggaaggggaaaaatcataatagattaaactcaatgaacattgtttcgtgaaaaaaaaacatgttgtttttaggtggagctcaaggtagctaatctcccatggggctagaagtccgccacgaatccatgatcaaccccgcatgttaagtggagtgttaaggattcgattagatggatatgtcttttaccttaaaagcagagttgttttccttttgttccctcttctaaccgtgcaccacattcgcacgcgtagtgtgcttaggtaaccaccggatgcaagtttttttcactaatattttttatagcctattactacttatatcgatctaacccgacacaagctatgaaacatatttctagtatggttctccaaactcaaataagtttagatctaaaattttctatgctaccttcaaatgaggggtgttctccttccaatccattccctactctcatcacgcaccgcactcgcacgcgtagtatacttaggtaatcattggatggatccaaagtttcatcactaatcttcttatagtcaatcaggcctgatctgttataacatactacctctgtttcataatgtaaatctttctaacattgtccatattcatatagatgttaatgatatataaatgtgggcaatactagaaagtcttacattatgaaatgggggaataccggtgatatgggcccgggggtatcacgtctagagggaggaggccgtcctcaaacccacgtggctctccgcgaggggggatcaagccctgggtggagcggtggctacccccacccagctagagggaggaggccgccctcaaacccacgtggctctccccgaggtgggtcgagcccggggtgttgtggcggctgccccctcccagcttggggtcgagtcgcccccaaacccacgtggctccccgcgaggggggatcaagcccggggtggagcggtggctaccctctcccagctagagggaggaggccgccctcaaacccacgtggctctccccgaggggggtcgagcccgggggttgcggcgactgccccttcccagcttggggttgggccgcccccaaacccacgtggctccccccgaggggggtcaagcccggggtggcgcggcggctgcccccctccaagctagagggaggaggccgccctcgcttggggtcgagctgccccgacccctccatgtatcagcccacgtgtacagggttaggtgggagcgcctaactgccacctaactgcatttaaagcggtctatgcaaccgcgccatgtcgcatttaatgcggcgtgctgcgcatctgaccggttgaataaccgatgggacggcgactgtgtacccccgccctgtcagtgtgtcaggcggtgagcggcgtgctctgtcccgtcccatcataatgatgaggggcttcacagcctcttaccccggtcagagttggtccaaccactctgaactgaccgggttcccgttttctggtgtgaacgagaacccggaagtcctcatccattaaatgacgaatgacaagggcgccctgcatgatttgatgggccccgcgcagcaaccgacgtgcagatagcttctgagctaaggcacaagacatgtaattaatatagagaatattttcccttctccctaggtagcactcgtagcacatgtggtatccccttagagtataaaaggaggaccatgcctagcgaggaagggggatcggacggaggatccctgagccaaagcttgtctaaccatagcttgcataccagagattcagggactttctaagcacagaagaatcatacacacaggagtagggtattacgcttcatagcggcccgaacctgtataaacctcttttgtctcatcgtcttggaggagcctccgagatcaagatcacacacagtttcgctcaccaaattctctaatctcaccagttgcccccggccgaactctcaaaggggggcctcacagcctctcgctaaagagggtcacccctcgacagggagtatgagtgtattactagtatggtataaaaagatgccggttcttcaaactttcaaaattttcgattcaaaagccagctgtaccagtcctaggtgacatttttttaattgaaaatatttgattaagttttgtggcatttcgatccggtatatagaatagcatcattttaccttgcataacgcttcaatacattttgcataacgcttcaatagcatcatattaatccatggcatttgttaggactcatgcgacagtttgctcatagttgcttttgcttgtatattatgatcgttagcatatataaatgaagatgttttcttcttcccattacatgacactcttcgaacagttttcttccttccagtttgaaagagaaaaacatcctgaaagcatcaccagcagcttcataaaattattggagccatcgttttgcggaataagcaaaacgacatatttgcaaataaacaaattgtgaataaaagatttatatactcgttcttagtgatctaaatacaaatgctgaaaaataaacttcaataaaaaacctcgaaagaagctccaactttaagtttgaaaattcaaattttgactgataagtgtaagtataagcgaaaagatgagaccctttcctcctggaagctgtgtttgttttagagggttggaaacccttccctcccgacacacaaaacaaaacgatacattaacacataattaattaagtagcattagctatttttttttgaaaaatatactaatatgattttagaagcaactacaattatgtataatgtttttccgaataacatactattacgagtatcatttagtagtttgatgtgcgtgtgaaagatacgaaaatagaagttagaaagcgccaaacaaatgtggcttcttactcccttcgtccctaaatatttgacgttattgacttttttaaatatgtttgaccgttcgtcttaatcaaaaacttttgtgaaatacgtaaaactatatgtatacatgaaagtatatttaacgatgaatcaaatgataggaaaaagaattaataattacttaaattttttgaataagatgaacggtcaaacatgtttaaaaaagtcaacagcgtcaaatatttagggacagaggaagtatttggtaatctcaggaacttaaggaataaaaaaacttatttaatacgccatccgtcccacgatataaaaagttttagagttaaagtaggtagatgtgaatgatagagagttgtgattagacgagtagtgaaggtaggtggaaaaaataaatggtggatggttgtgattggttggaaagagaatgttgatgaagaagttgttatattttgggataaatcctaagagataaaagttgttatattttggaacggagtgagtatatatctaactctctcaaatgggctgcaggaat

SEQ ID NO: 80628 - DNA, 18901 bp, Oryza sativa
cctgcaccccttttagcaaagttattaaaaaattatatacgtttagtttgttgctaaatttgttaaatatataaaaaatcctgcaaaaattttggcaataataccatcttgctaaaatttaataaggttattttgctacgatctgaaaatgccctactccctcggatcagaagtaaaccgagcaaatacagtgttgagctaattccttcttgcatgttttcatgggcctggttgccaattactagcagcatatactgcagattgcagatttgcagtaggccagaacggcccatgaataattccctgtggaccaggcccattgcatcggagccccacactctttccggtcacgggggtgacgccgcgagacgagcgggcgctcccaatgacacgaaaggacaggtgtccgggtcggatacacgtcatctcctccccctattatccatcaccaaagttgcaaaaaaattcaggggaatagaaaagcataggaaataaagtaaagggaggagaggacaaggaactccttccggctccgatcccacccactccggcggcctctcgctcggcctcgccctcgcctccgatcgattcgcccctcgtcttcctcctcccggatcccccaagccaagcccggggagccgggccgccgccaacgcgcgcggcggacacgaggaagggaaacaggcgacgacgagaagagaggatcagctgggggtgatgaattgttacgctgcatggacggagcaagcgagaagcctccccacaaggtacgcgtccccccgcgattccggttgtattattcccgcgcgcgcgcgagagagagagatcgagtgtttgagcttcagttcgtcagtctatggctggatttggttttggtcgtgccgcttgtatagaaggataagagagctgtgctgcggctgcgcgaaccagttgttttctattattggagtggccgatgacttgtatcttcgttcactgtggccaggaaaaaggtggataggccttcccaataatttgttggttggttctggaccaaaccttttttttctcctggggcattttgatactgtgattgatggctacaaatagtactggagctactgtggtattgctttgcccgcggtctcgctagtggacagcatatgattgtttggctggtggccagatttagtcatggtcaactgtgccgagtggccgaattccgtatggtggatttaggttcatcttcctcgcgcaaatgtttctaggttcttgattaatgcagcagcacaggatcgacatttaacctatggtctgtaatcggtgaattgagccttttagtacaaccctctcactgagggtttgagacgaagactggtgtttaggttcaatctgtggcaccattgtattgtaacggcccgtcaggtctccttgtcgaacaccaccctacaatattataggagtcctgttagctgtttcttttttaacctgaacttttgcagccatttggaaaatgctgatcaatgcattgctgatgtttgtttttgcttaaaccaatttccttaccttgatgtcctttattcatctaagacaaatgctgtgaattgcacaaactaggttctactttcttggcagatgcgttgctttgtctgtactattcttcacagcaaatgttatctactgacgaagtgaaggaattattattcaagcataaaacatctattaatagagtgtggccttgtgggtggttaaagggtgcaaaacaaccaaacaacttattactcagcatgcgatttagtgtatctttatttacaagacatcggggttgctaggcaattcaagcctgtatattgccacttgtatgcttcgctatggtatgaactcaatatgtgttattatatggtttttacaactctgttaatatgcaactcacctgcgctgtgagctatcatttgggcacttaatcttaataagtcatgctaatccaaaataaactcactttaccgcctatgtactcgtgacgtggactaccgtgccattcatattctgaaaagtgtccataatcaattatactatttcttgcacaggtacacttttttttaatacgtcttattcattatattcatttggaatagcaggactattacaaagttctggaggttgattacgatgcatccgatgacaccatcaaattgagttatagaagattagctttggtatgctgttattggacttctttcggggtacgcaaataataatacattaacacactgtaactgataattcatccacagatgtggcatccagacaagcataagggggataatgatgtcacagctaaatttcaggagatcaatgaagcctacacaggtattttccactctccattatgtaggcacagatgatcttattatcctcatttacttcctagagataaatttgggatctcaatatggatgtacttcctagagataaatgttatcgtcattgcctgattcacttttttttatgttccgttttttcagttctaagtgatccagctaagcgccttgaatacgacctttccggatgttatgagttaaatcgatatactttgcgtgtaaggtgtcttctataattggccttccatattcctcttctacacgctttgtgttgatttttcttgctgtctttccctcgcttttaggagtaccttacaaggtttaagggtatgatacttacctgcaatggtcttggcatagaccattcttcaaaatggtaaagcatttcatttgagcctgatgctaaatttgttttgcatattggttaagacttaagacttcatggcatgattcctaatagtagtgtgaacacttcgaatacagtatttatgatttcattttctagggcccggcatttgagggaattggagccccattgatctataggtacatcttatttgtccatgagcttcttcagtactttctttgaggccaattggatgcttagctgtttcttttaacacaactatggatacggcagggcatctctctgttctttgtaacacaacaatggattctgtcgtatactaatgtatttttgctgcaagaaatgcatgcacgcagtttccagatgtagttcttggcttctcaccgaaaaaagagcaacagtttcgtggtgtttaacttgacacaaatacaaattaagcctatcctttctcatgaacgcctgacagaagtagatgacagtaaaacataacctcacatattctgtacatttagtccatgcagtaatatagcatagaagagttctggtgttatcagttttatcacagatctgccatgatgaacatatgctgagattaaaatgtgcttagttcggatcactagttccagtttggtgtttgatctcgaaatctccattcaagtatgtgttactcgtatcaagggagcactggagaaattcttttgatgcatgttttgattatatagctagcaattttagcggtacgccctccattcaggcacatgggacaacgtccttatatctgagttgcagtatatattttgttgctggacatggttggctgcctgttattataaactggtaggattagcacggagggttgaagaactcaggattctttactccgttgttattttgggatggagtacttgtttgccatcagtggaaggaatgcaggatgaagctagaaagagatgcaaaattttttcccaacggaaagttctaccagttgagttttcctggccagtctttccttgctgtgctgaccttgcaatcatcctctctctctctctctctctctctcaagaaaaaaaaaatgcaatcatcaagcggttcctttctgatttaaagttctggcctgtaaagcgagttagcgtgtgacgctggtgtttataccgtaccagcatttggaattttttttatttttattttttttattaaaagttttacaaaaataatttttcattttgaaaattgacagaagtggtcgcctaccgccctctgggagggcgatttttaaaaatcgccatcccagagggcggcgaaagtgacgtggcagacggccgttcgctctcgggcgacggccttcaacgaaatttgcaggcggcccccttgccgccctccgctagggcgattttgtactgtgcggagggccgcctgcaaatgggcggcggggggcctggaattttgcaggcggcccccttgccgccctgggggagggcgattttatactgtgctttatatttttgtataaatataaatagttatcaaatctttttatattgaaaactatacaagattaaaatctccaagacaggtaaaatacaattttattattttttagggcctatttggaatgttaccgtacaaatattttgttagtgccaaaatataagcaagttttggcactaccaaatatttggtaaggtaaaattgtatttgatcatatttggtttgctgccaaaatgtaaaattgtagtgaagaatgttctacataatctcaaatctagattacgtattaccaatgaataggttttaatcgaaatcaaacacaagtactattcaaattaccaaaatattggtagggcatgtttttggtagcaatccaaataggcccttagtcttacgcatacaaaaaatcaccatcataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctacacccacactttggacgctcggaccatttaggtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatctattgtacgaattgacatttccttacatcttcctatgtacatccattttgggatagttaagttaatgatagtactgaggagtgatgaaaagaatagttataattaccacggaatcatcgtcgacaatgtttggacacacgaaacacctttgtcctcgagttcggtgccttacggaccttatgacctgacaacggtcaccacaacgacactccggacgctcacgccacgtggggagtcctaggggatttacgtgccattctaaagcctcagcagcaattcgacgttcatgctcatccttccgccttaggtagtccgatcttgtttcactacgtgggtaagcacgggttccgtcgttttgtgggttctccatgtctacccactcgatgaagttgcacattggacgatatgtctgcgtaagatgttacaattgtgtacgaagaagttagttttttttatccatttgaacttcgaatagatgaagcatatctgatcaaagttcgcgcattggaagaatctcctgccccgagtttgtatcatgagggaagacttgagtatgcatccatccccacaatcgcacaaaggacggtcacaccatggtggaaaccaaccagcaaaaggatcgcttcgctagttgagacgctcaaggaatggcgcttccattttcgtgtgttgtgtgctagtggggaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgacaactcgagctgccgcttttcatgtgtactgttgtggactgtgcgcgctactggatctgacactaccgtgaagcgccgaaagtgtgttgtcgtgagcataagttgttctagcacgatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagagtgtgcctctggagctcctccaagctgagagaagcctagtacgtcgtggtggtgtgcaccgtgcaagtcgtcgtcgtagaactggctagtaggaccagtcctaccggcgtgagacgaagaggccccagtatcgaagatcccggctgcaaatcctactgaacaaggaccatcagtttcatacaggtatttaatagtattaataaaaagtaaagtaccgtgtgggcgagggatcgacgctccgtgagaggaagaggtggcgaacgcccctgcggagctcgcggaagcgccggtcgtgcctgtgaacgcgctcgaaggcagacgaggtcctgcgatgaggaaacgtgccgttaaaacatggtgacatattcgtgcaaaagctgaaacaaaaatgaactaatctctgggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctctgggctgagcagtaccgtgcgaaacaggtaccgtaggtcgaggtcctgctccgacggtaggcgcacgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtcacagcggcaacgtgcggctctggggcgtctggagtgaaggtcacacgcgcatgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacatgctgcgggcagtgaggctcaacgaaaatgtcgaacaccatcggcaggatggtgagccagtaagcctggtcgcgtgtgcacaacgacgaaagtcctagcggtgctctcgcagcgacggcctcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcgtgggaccgtcctctggccactgcgcgctgcgaccaaccccgtatggtgcgctgtccaccactggtcgacctatggcaaacctctcggctgtccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatcgaccgtgcgtagtggaccagccggaagtccacagcgtgcccgtgggtgctagtgaacatcacccacccgaacaaccacaacaggtacgcctcaagggagcgtcggaccgagttatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtgctgcagtgtcggagctatctccccacagggaaggtggaacgtgtgcgtctcaggtctccagcggtctaccagagcggtaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaatagattgatcagaaacatataaataattagttcaacataagtaataaatgttcataagcgaattactaacacatattaaacaagagtacaaacaaataaaagtgtcaccatacggaatatttctgattacaacaataactgcagttacacgatatgagtacttagtccgaacactcatcacgataacattatgatacaacaccgaatagttcgcaatactactagtacaacaatagtcggaggtactcattacaacaacattcaattgaaattacacgatagaagtatttagtccgaacactcatcacatcacaacatcattttatttcctaaatcgatagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatgggtttgcgatgtaaaaaacttgggcactcagcgttgtgtaagatcctgagatcccgaacccatatatctcctcactccatgtatgaaagattgcttctttcctgaaataatttgagacgtacacattggaagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgtgtgaaatttctgatggacgaccctgacctccttctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttttggattttgagtgaatataatgaaatttcagagaggggggactgggctttataggggggaggcaaaaatcgccctccccagggcggcaagggggccgcctgcaaaattccatgccccctcgccgcccatttgcaggcggccccccgcacagtacaaaatcgccttagcggagggcggcaagggggccgcctgcaaattttgttgacggccatcgcccgagagcgaacggccgtctgccacgtcattttcgccgccctctgggatggcgatttttaaaaatcgccctcccagagggcggtaggcgactacttccgtcaatttttaaaatggaaaattatttttgtaaaacttttaataaaaaaaattaaaaataaaaaaaattcccagcttttgtctcccagctgaaataaatcgcactgttctatttagtcatggcacatgatctgcactagtagaccactagtgggcaatggtacctgctccacgcttggcccatggtttgtagggccttcgatatcgagtggaaacggaaggctgataggatcggacggtgcccgtgggctttttgccgtaccaccacagccttggatgagcaaggcaaatagctaaatactacgggggtggctaatgggcgatcgatcgctcgatccctatccccatatggcctatacactcctctcccccttcctccttcccttctcttcctactacaccataattttttttaaaaaaaacaaagttggaaaaatttatatatagaaatactatatataaaaaatatttgaattcaaattcaaatttgaaacgggtacgtaaacttttgacttataaactttgggtctataaactaatatttgaatttaaattcaaatttaaaacgggtatgtaaactttttgacttatgaactttgggtttataaactttatatgtatagaaatactatatataaaaaatatttgaattcaagttcaaatttgaaccagatataatttaaattcaaatttgaatcaggtatataaacttttgacttataaactttgggtctataaactttaggtgtataaatttactaaaattaaaaagtaatgcggtgaaaaaaaaaagaaaccacgtggaggacgggggataggactttcgaaatactactacctttgctcaacgtgttttctcctctctagtactcctggaaggagggtgtgcgtcgcgtgcacaaaagctgcatcggtccattttgcttgcagggagggatccaggaccagacgcccccggctgcggtcagtggtcactcgatgcatctaccgtggagcgtcagacatctatcgtggttctgtataatgtcgctgacacaatcatgcctttgtaccggattaacgaaaagaaaaaaaaaggagaaaaaataaagaacttaggagtatgagggtcagaagccactgtttccaccgaaacaaaacgcagccgcgtcgcgtcgatcaccccgcaagaatccagccgcggtgaggggagcgtcacttagccacatggacaatcggacacgcttgagatgacggggcgcctaccgatcgggagaggaggtggccggcggccgcgtcgttcgggatccagagggttccaaatctcggacgcttgcgccattgcaggggcgagaccgagccgagcgtgcgtgtcccacaagcgactgattggcgaacagctaccaacagtaacactactgctagcggtggcgatcgagcattcgagccctcgcattcgcgagaaatcacaatcttttcccagagattccacggacaaagcttcacctgttgcttaatgattaccgcatcagtactaacagttaccccgatttagacggggaatttttgaagcctcgacatatagagtagacactagagtagtatgctctactgatcaaacctcacgctaatactgctatttcttccaaggtagtcctactagtacgcttagtaccagactaatactagcgctgtcatgcttaattgctgcaggcaaacaagggatgggcctcacctgtcagtcagtacacggggtttccaccgtcactccaacctgaaagaaaaacaaagcacaaactacacattccgtcaatgtcgaaaaagagataaaaaaagaacgcctggtgcagtgcggatcaaatcagcgaccttaaaattcccaatttgatgtacacaggctacaacgttttcaagcacgctaaaaaggagcaaaagcaacgaagagaacaccactggcaggagcatatgcacacattacgcccaaatcacaggctttggagtttggtctaatttaatcataagattagcacgcgaagccacaaaaaggccaaaaggaaaaatctcctgtaatctcccccgtctagttaattaattaatttagtcctctaaagcagcacacatccctactgatcgctttttccggccatgccgagccatctcactcatcctcgctccggcatgctcgccgacgatctccggtgccggaacgccttgagcgggctcgggaagtgccacccccaccgcgccttcgccgccgcggccgccgcttttgcctccactaccgtcgcggagaccgagctcgacctcgcgagccccatccccccctcctcctcctcgtcctcctccgccgcagcagcaacgccgtccttggccgcgggcttccagaacggcggccacccccagaccctcgccttccgcctccccccgaccgcgccggcagtggctgatgcggtggaggccgccgcgagggaggaggacgcggcgacggaccgtgaccgcgcaatccggtgctcccgctcgatgagggtgtggacccggccgaccgcttcgccggacgccgacgaggaggaggacggggacgcgcacgtgcaggggcagggtcgcacgtgcgcgcagttggggcagaggcggaggagcctgtcgcggaggcagtgcgggcacaccccgccgccggatctcgccaccgggtgcttccggcaccgccactcgtcgccgccgccgccgccgccgacggcgaccgctgccttctcggccttcatccccctcagccccgcgcgtgctgttggttgctgcgtctctccctctcttaactccgctccgcgcttctcagagagagagaggaggcgttactcacaacgtcgctgtagaacggaatggaaatggaatagagcgagacggaggccataatgaaggcgccaccaccggagcttactactaacggcttgtggtttcgcgagcgcaccaaaccggcacgtactcccgagttatttacgagtgtgccatccgtagagctggcggctagcagctgaggaatatgaaaaagatcttctgcgaacaccgcactcgtacaaaacaatgtactcccataaaaaaccctactttgaggtactccctccggattcggatcctctgcagtaatgtagagggtcactatagctacactaatatgtgaggggaacagtgttctaatgcacaccacagtcacgatttactgtagctacaggggatgaatgtactgtagcacctctggttagtgctgtagcagatttactgtagcatctcatctgatccatccatcttctatcggacgcttcacagtactcctaatgccgggcactgtagctacctctgaaatttctcctctacagtagaggatccgaattgactccctccgtctcacgatataagagcaagtataatagtaggctataagccggctaaatgctgagatggaggagaaaagagaggagagagaggacaagcaggctataaacttacagccggcttgaacataagaactaataaactctgtgagaaagacaagtgggccctgtattaatcgtaaagagctaactattatatgagtaggctaagagaaggctacaaagaaccttatagccaacaggttggctatattattatctttgctctaagagattttgagtttttgcttccaacgtttgaccacttgtcttatttaattttttttgcaaatataaaaaacgaaaagttgtgcttaaaatactgtggataataaagtaagtcacaaataaaataaataataattttaaaaaaaattaaataagacgagtgatcaaacattgtaagcaaaaacacaaaattccttatattatgggacggagggagtatgacatgcttggagtaatactatgaattcgaagatttatgaaaattatatatgatgaattcgaagatttataaagtgtactactaatatgcaaatccattcacagtgtcgctggacgcagagaatcctggccaccgcgctgagagataaggctgccggcgcacgtgcggggtgggaatgaggcgtgtcggggtcagttacatgggccccgcatgtcggtcttttgtgacgggaccgaggctgtttgttcttttttctctttctccattctccatgcccgcccgtgtggtggactggtggacggacgactcgcggctttgcgaggcgcgcacgcgcggacctggcctcaccgcgccggtttttgcctggttgcagccgtacgggacgacgaggcatcgtgtccgtcgtacacggacgtacacgccgttgctagtcgcgtactactcgcgtggattgactagcgggcgtggcgcggtgtccactaccgcctggccctcggttgtggttgtacttgcacgtgtggctgacaacctccacggtgtggtgtagcgtgcgcgcgtcgttggctctgcgtctggggctttcgctagacgtcggccactcgtgcaaaccgtgcacgtttgcgacgagcgcgtgtacacgtacggtgcgcggttgcgtttcgaccagatattccatcgttccgcatcgtacatggaacatggaaaacgacgagagcaatttggctatcgacggcaacgggaacgggcacggacaaaattttgccatgttatttaattacagacccgggggaggaagcgcattgtttttctcccccataggaaggtaaaaaatgcaccgcctgcttcgacacctgtagtatatatttttcaccgtattgccaagttcgcaaggagtagaagcaaacatctttcgttctcagataatggcctatatatcgacttgctcttcagtgctggatcttgcctccaaaactatccagtttgctccgaaagggaataatcccaaatcttctcccgcaacacagtacaccggtacaccaccaaagagagtgtacactgtcgttgatgcggagggttcagtccaaaacgtcggcagagcggaagccacaaaatcttccctgcaatccgtcgtgccagaagcgcagattcagacttcacaaagaacaagaatgcgtccccaattaagccactcatcctttgtcacgactcaggagtcacgacaatttaagtaggaaaacggattcccttgttgacagcacatgagccactaggtcgatcaattcacatcatcagcaacgacactcattctatccttggaaaggaattctgccagttcaaagagacaagcatgcaaatccttaacatgttgcaggtaggcacagcaccagcaactaccaactaattaatcagccaaccaaacacaggcaaccaccggtggaggggtaggcacagtagcgcgcaggtgtcagcccatgggctgacgccgcggtatcatctgctattgtagagagcggcggcgtaggcacggtccccgcggtaatcctcgacgagggtaggtgcccggtgcaccgcgcggcacatggcgacagcgctatattcaaatccgcctagacggcgcagcgtccaggcgtcccggccgcggccggtcggcgtcaaatatccacgcgacggcgacggggatcgactagtcgaatccccggctggccggctccccatcattcccgatagttaatcaatcccctaatctccgcgtcacgttgctgcgtgttactaggtggtttaattagccggttaactaccgggggattccataattaggtagcgattagacaatcctttaattgttatcctctcgacattcctaacggtggctgatcatccttgatcaagttgcagacaaagaggccacaggccagggacaatctagcatattgggctggtataccctggatagcgaacgggaaaatttatcgacgagattctctgccgctgctaatccatgcctatgagcttcaagcacggatcgacgaaactgaagatgccgtattttacaagacgattttctgttgccaccgtggtctccagagttcaggtccctgtacagcaatagttccaaacacaggtccctgttaccctatacaacaatcgtcccaaacacatgccatttcgcgtgggtgttttgttacactagttaggtgtcggtgcgttgcaacggacaaaaacatatatcaattttaaattacaccacgtgaaattatgttaataatcattgcgtgcaattttgttgtaacaaaaaccttaatataaaatgaacaattttatatcacttttggtttcttctgtctggggatttatatttacctcttttagttctcggagcgcggaagattgttctaaaggaaggaactacaaccaggaaatagtgaaattaatcataatttgaaacacaatattttcacgttgccattcaacaaaatcagcagtgctgctctaatcgaaccttcacattctaggagtacacgcacgcttttccaattaacatttactccctccgtcctaaaataaaatataagaagttttagagttgaatatgattattaagaaagtaggtagaagtaagtggtggagggttgtaattggatgagtagtggaggtaggtgggaaaagtgaatagtgaaggtttgtaattgtttgggaagagaaagttgatggagaagttatgatattttggaacaggtcacgtttgtttaacggtagttccgagttcctcaaaaatttgaggatggaaaacttttagtaaagtggcatatacaggctcataagaaacatacctagcttttttttttgtcttcttataactagaaaaaataaagtgtatgacacccatagtagaaaaataaagtgctggacctccgtgtcgacgagttcgattgctgaaccggaaagactatatgtcttaaatagttgccttggtggtgaggttgatgtgctttcatgccatcggccagggatcgatccctatgcaccgcaccattttctccttttaggcattaaattgcaattgggccacaacaatccaagtgggccttacaaggccagcccatctgcctcttgaaccgccggttcaaaatagcccgcgtcaccggttttcgttcatccggtttgtaccggttcaactgcatgtgtggtctttgagttaaaccgaaccgatgagggtgctggttctggcttttttccggttcaaccgccggtctggttcggtttttttactaagatgacacctacacggcggtaggaattggattgctatctgctatgatcaccacctgtgaaagaaatgtagtgtaaaccacttagcgaaatggttcataggtgaacttaacaacacattcaacagaagtgcacatgtgaaagtgaaacatctaacgcatgagtaaaaatttcagacattatacagtatagtattttaagcacaataaatattttaaaacaatatgtgactttccatgttgtatcaatagtagcggcatcagaaataaaacacctaagagcataatgagcaggagatgcttccaggttgaagcactccctttcctaaaccacatattagatccttcccaatcctggtaatcatggacgaacataaaatcaaaattccataacgacagcgcctcatcaacccagaaatctccatgataatttgcacttggaagatgatagtattatggcaatccacaatatcagcacttgaaccataatatgaaaaaaaatattttaagtgcagtgttatcctgtgctatactgcacttaaatatggaaaaagaaatagcagaaccaaccaaccaacaaatccatatattttcttgtttgctatcgtcttcctgctcaatctagagatctcattttcagttttgacaagtaaaactaaaaaaaaacatatcatgtaatgttacgtgaacaa

SEQ ID NO: 80629 - DNA, 1935 bp, Oryza sativa
cagtagcgcatcatcgtcaacggagttgggcagcgcgagggggtggcggttagtggaatcggcagccggtgatggtgaggggatggatggtgtcggtggtggcggctgacgaatttgaaggtcgggtcggcgagggtggatagaggaggcagcgacgcataggcggagcagatcgaggcgacagtggtccggcggcggagaacggtggcgatgtggggtgccggtggcgcttgaggcagagtggatagcagcgcatcattgatggaggaggttgcgacgcgtgggctgaggtggtctggtgacggagtacaataacggcgaggaggagatcgggcgtggagcggagacgcacgacgaggcggagatcaggggttgagcggaggagacgtcctcccctcgatctgacaacgatggcgttgagagggcttccttgatccgacgacggtgacgctcgatccgatgatgcatgggcacggagaaggggagttggcgacatgcattgcaagccactgcaaaatgcgggtggtggggagctcggaatttggggagggggacgcgtggtgagagcgagtacaagagcaggctataagtcagttgtaaacacatgcggaagagagaagaaaagagatagaaggaaaacaggctgcagatttgtagccagctgcagcgtggaatccaatacgttgtgtgtgtatgagaggtgggaccatatattaatggtgtagtatatacttatatgtaactattgtataaatgagctattagattggctacagataaattggagttggtacttggctatactattaaacttgctctgagtgagaggtgagcggggcggtgcggttgtaacgccccgcaatgattagaggaaaaagaaaaggagagaaagaaaaggagcaagctagctagcagcccacaacagcaagcagcaggccggctagcccagcccaacagcagcccacaacaacagcagcagagtagtagtagcagcgcagcaggcagagcagcggctcgctacagtaccttcgcggtactgtagcaagtttaataccactcgctagtttgagaaggcagagagcagcttataaaggaggatagcccggggactgtgaactccgattccggaacgattgtgattgtgcaggtctatcagggtcggcttcaccatcatcattatagatttttttaagtagtaaatatacacagggtatctatctatctatccaagtgaaaagtgaatcctgctttgatcatataataagccacgtcatatgttgaataatgaccgtccgatgcaacacaaattcaatatgtaccgttagatatagtcatgctctgtaaaaaagatgggtcaacaatagccttccaagaatcaccgtcaaatccacatctcgctagaaacacctggagcaaagagtgaggtcttgactcttgacgagcacttcccgagaaaaaaatatgaattactccctccgtcccataatataagggattttaagtttttgcttgcactcatcttatttaaaaaattttggaattattatttatttttttttgacttactttatcatctaaagtactttaagcacaaaatttcatttttttatatttgcacaaattttttaataagacgagtggtcaaatagtgcagacaaacactcaaaatcccttatattatgggacggagggagtagctaggaaattagaaaaacatattccctccagacacaatcaatcatcctattatcaaaatgtcgatatggggtacccgtaaaccggatatagagggtattggggtacgctggtacgaggatctacgtagtacgacatcaagcaaataaaagacaatgattatactggttcaggtcccttgataggtaatagccctaatccagttgatataggattatatggtggaagtcacagattaca

SEQ ID NO: 80630 - DNA, 54305 bp, Oryza sativa
agtgtagggtccaatttttactgacccgatcgggcgctcgagcctgagcattttcaaaactattttatgaaataagttcatcagaggtctcttaatttgtcaacgaattcgattttcgtccttcaaccggaaaacgatatacaatgggtccctgaactattaaaaccggtaagtccaaggcggtctggagcacggtttcaactgatgtggcacccacatggctaattttactcgatattcgtcttatgtggcattaacgtggcatatgaagcaaaatttaacaatttaaaaattaaaacaaaatatttggacccacatgtcagtcaaacaataaaataaaagatagtggggcccacatgtcagtgggcccacttcctcctccctcctctccctcttgcttttctcctcctccctttccatacgcgcgcacctcggcgacagcgaccgtccgggaaagggtgtggcggtggctcgtcgaccaccatggcattgtggccacgctcatcaccttcgccgacattgatgccactgacgcgcgcggcggccggcgggagaggaggcagcggcgcataggatatatgataggtaagttgacatatcagaacatcagcaatatcaatatagcagcaactttaatatggcttgagagaacatcctctcgttatttacatgtaatcttaatagttagaaaagaaatttaaaaaaataataagaagataaattaatatgtgatatattattttacaaacatacaagttaaaattcaacttttacaaattacaataaaaaaattaaactgcaactagttagtttgtttttttcgttataccatgtagaacatatttctgaagtgatctatcacatattaatctatcttattgatctttttttaatattctttataatcatttaaatgacatacaaacaaggaggatacatcccttgagagtttgtagtaagatttattaatttgtctcccatccagactatgaacaacccaacagctatacaaggacaacagaagcctggatctcactgatctctggttaagcctttcacatcccctatgtataaacaagctatgtgcagcggccggtggatatccatcaaggtagaacctggtgatgttatgcaggtgcttattcaacgacctgacatgttaggattgcaggcttcttgagccagtactgctcgaacctctgcctcgcataccccatgtagtcgaagtcaatatcgttgacatgctcctgcaaaagatgtaaattggatgtttacatggtgttcagtcttacacagttggaggcaagtgaaactgaggagaaaccaaaccgaaattattccccagagggcccaaatgagatggcttgccaaggtgtacttctcgatactttttatcagattattgaccttctctgcgtcaggttcctcgcctattatggatattcggttattgtttttatggaatagagaagggagaatgagatgttaatgacaaacttcatgcttacctgaagagctcaggtagctctgcacaaattgcttctgctcatcagtatctgttgcagataagcaagaacgaacagagaaaatatagggtgaccaaaatggataaaagggagaacaataatgtacaaattaataactttgacagctaatatgaaatacctggatatttagtgtagtccagtatgtgaggcttttctgaatggtagtctgcagccatctcgcagaaatggtttgcaatgtcataagcaactggaccaaaacttgcatactcatagtcctgtgtaggcatgatgaggaaccagtaagatcaagacgatatgtttgttaatttcgcctggctacatataaaacttcaggttcataaacagacatgacatacatgaaggctaataaggaaaatatgcataatctttcataaagtatgtcgtttcagaagtgaaatctttattcctggagatagtaacatacaactcaatgtatgataaggttatacggagtaccaagacgcatcaatgtgtgtgatgtgaaataacaaagcagatggtttaactctcctttttccttgtggtcggtctgatgtctctagacgaaattgagctttcttcttaatataaagatgtccaagtctcttgctcgttcccccaaaaaatagtaatggaacagatgaatcaaacatacacaatggagcaagaacttacaatgatggtcagcaatttggtctcttcatcaatcatgatgtttccatactggagatcgttgtggcaaaatcctacgcactggtaatcctctgaaagctcattttccaacgcagtgatctcgttctccatgctatccaagcagaactctttggcttcgtcagaggggcacaaattcttggcagttttgagccagttcctgatgaagatgtgcataggcattgtcagttagtaacttagtgttttacttcgatgatgtgtttcattttacaagtatgcaatgctaaaaaacagtgtaaacacaaattaagtaataccttagtctgtcccaaatgagtacagattttggaccaggcatatcaaggttgtggaattccctcagctttgaggctataatggctgaaatctctggatcacgcagatcaacagctgagagtgtctgaaaggaatatttgcatcagtccttttgttcttttgaacattaatggacccaccatcctatataaacatatttatagtcatcatatcgtaatgctttgtgtttttgaatcgtccttcttcggttcttcccagcaacacaaacagaacatgatgctttcttttgaaagtgaagaaacaaattgagaaaaaagattaacattcccatcctactttgttttgtccatgccatattttccccctatatattatattaataaagtaatcgggctgatgccttattctgaagctcagacgccgtgttctgtgacctttagcaactcggtcatcagtcttactaatcaaaagatttcttgcatgattaaaccagtgctcattgaggtgttcagacaccaaattgattccttatggctgtgctcaccaaaattaactatgtcttctcttttttttattcacggctgtgttcagcgaggtagattcgtttcagtaagcaggtagaacggtagatacgttatacaatacacacacttgttctttcatgtggatatttggatcgttgaactataagcaattaaatatgataaaccataaaacaatttcatagacaaccatcattaaacatagtagctgaactgtatgacatcttcagcaagcataattgctaactaacgacagcattctgccaggctcagaagctatcactaaagccgtcaagaagttatgaaggaaaaagaaaatgattcatgttgtacaatttattcagcaagagaacagtttcatatgtcctaacaaaacaaaatagtacagctattagtcatctccaagaagcagaaatgtctttcttttcagggcccaagaaacagaaatgtcaactaatgacaacaccctcccatgcttacaagttactaggacaagtaatttatatgctttctgccaaaagtaatactcatcaggctctctggtctgattcgtaatactataatgtgtccaatccattcaaaatcatttatattttgagacggatagagtatctcagtctctcggaagctattaagaaaagttttttgttttaatttttagatataatattaggcaggcacagtgtagtcaacaagagaacaaaaacaatggctgccacaattaaaattgggtgatgacttcattgagtacggatttgaatgaacatcccggataagtttctgaaggtcaatgttgaaatttcgacagtacaactgcagagtacatctactacatcatcaagaggaaattttcaaagaaaggcaactgattaatattcatatgacgctacctactacacgattcccacgatgcaggctgaaaacgattgcaaacagtgaaacaactctgaatttctcgccgaaaaataaaaaagctctgaattcgcaaacaaaatttatgcgtcagattccccagtcacccatccaaagttccaaactcaatacgaataactgaagaacactaccttccaagtacgaaatcaagagcagcaagaaattttgtcgcaagcagacaagaaagaagaagaagaaaaaaaaacagagaaggccaaaaaaaaatgctcaccctggcgtggatgaactcctcgacgcggccgttggggaagcgaccgaggaggcgcgggccgtggccgtgccgcgacatggactcgaacgtgcgcacctcggcctcccggtcgaagaacaactccacgccctcgccgtacaccctcaccagcaccctcctccccgccgcctccgcctccgccgccggcggccaccgcgcctggtagacctcgttggtcatggcccccctgagcggcaccacctccagcgcccggcagtccgccacgtcgccccaccccgccgccagctcgtgcagcagctgccgcgccccctccgggatgctgctccccgccgccgccgccttctggttcgtctcgctcgccaccatcccttccgctccgccgcctcggaatcttccttccttttccggaaatgggagggggatctgggcgtgggagcgcgacccagaaatggtttgtttcttcttcggggatccaagagttcggtttatggcggtttatatttgcttggggcgctttttgtagattcacccttgaagttgggattattcggtaggaggtactttactactccctgtttatcataggataagttgtttgacttttttttaagtcaaacttaagttttatcaagtttataaaaaaattttagcaacatctaaaatattaaattagttttattaaatataatattgaatatattttgataatatgtttgttttgtattgaaaatactacttcctctgtcccacaaagcatgacgctttaaggtttcaaaagcaaattagcggaagggaaaatgaccaagttgccctcacttaataataatcggatgccatttcattgagtgcaaggcattcaataggaatacttaggccatcaccaatgcgtgtctccagcccgtagcctcgcaaacaacaaccaacttccttcgccgggtcgtctccggtagatggagtaaatatggggaagagagagggagtatgggagaagagaggattgtacagtaaaataactacgtaggctttttgggttagggatactcattgggtcaccagggtattctccattgtaagaggtgtttcccacacagtgtcttcagttagtgaaggcgcccatgtagtatccttgattgtagatgcccttatatatctctgcacactgaagctatggccacaaaaaatacacgtggcaaagcaatcatgagcatattcaaaaattcaaaacagatggccattaaattgctcaaacgacatgttttgtgggacactggtataacctttaaacgtcaggttttatgggacgaaggtagtactatatttttttataaacttgatcaaacttaaaagaaaatttgaacaatataaaagtcaaatgacttatagttttaagggagggagtatccttttaaagtagatttaaaaaaccccacctgtttgttttagtttcataaaaacacaataactttgtcacgtgacacataatcctagatattatggtttcaacgttttacaaaaccacattactaatcattttgcgctatcacaattttgaattcaacaatcacgagcattttatccatcatacaaatgttacattcactttctctattttgatataggagtatgtcaaaatggttaatggtgtggttttgtgaaattttaaaaccataatacatgttatgtggcacatgtcaaaacatgtagttttatgcaaattggatcataataggtggggtttaatgaaatttactcttttttaagcatattatagctcatataaatgcgcgcacggcgcgcaatcacatctatatacgcggacacacacacctacccctacaaacacctccaaagacgaatagtggatatttaaaataaaagaatctcctgcctcgatcaatggaattgaagagaggatagaggatgttaaattcagttgtaaatccagttacccatgacaagcaagccaactgcggaacttgtaaatctggacaaatgaaagaatggttttgataatagtataattgaaccagcccatgtaatgacaatcacagaacaatgacacttgtgacaacttaagaaacaaagcacaatacccatgaaaaataatacaaaactcaaaacaacgggtagattcagtagctcaagaaaaagccacacctaagcaacagctcacgattaaatattggacaatccgtatcactcaacacttgaatttgtatggcaccagctgcagggttttagaacatccagcttcactgtagaggggactttcccgacgatgtatctctcgatagccaagagcgcgtttttggcttccatgaccatagggctatgtatgcggccacaacgaccaacttcgtgaacagatagcctatctgcaggattattatttccatcaaatattgtgtctagtgtaagaccttcaagtgatgttgcattctcaagaatatgacaagttagctcgaccatgatcttcacattcttgatggtgtcatgatggtgtcctggcatctgccttagatgtgatgaatcttcagaaatcacgtcatgctccatgcgagtctgtgatacctgcatatgaaccagcagagaatatttcaacaaatagttccactatatatgatagatatatatttccgcatattaaaatttacttacacgtgaaaactttacttaccttcaaagtgaaagtctccaaggcaggagatgcatcaagaaaataagctaaagaaagataatcatatgttggggaaacgaccctagggactgtgtgaagaaaaacagtaaggtgcttgaggtggagaaatcttaaaggtgcgatcggcgtattgataatctgcataaattgtcgagattaatcacatttcaaggtatgactattgctatatgcataatgctggaatctaatgatataatcttaagttgcgtaatgtacctcgctaactgaaaatacagtgagagtttcaatagtgggcacaatggatggaagatttgcacaggcataataaatagcattatgccaacgaatggaagctatggttaggttcttcacatacggtagacctccatctgatagtcgtgctagattaccctcataatggaagtttaaaagatttggagctttaatttccatcacttgtgatgcttcccatccatacattgccagcttgctgagccgttgaagcaggcaaggtatcttgaggtaactaagctctttgcaatctgtgagttccaactgctctaacacaaaggaattggaaaaaaggcaccctaattcgtgcccagtaatgcgcacctcatacagaaacagacttcgcaagcaattaagtccaccagtaggacggaagacacaatagctgagataaagatgcttaatcgagcttccacctctattgaataaaagtgagaatgggaagtcgtagtagtttgccttgtcctctggaaacagcaaaaggatgagttcttcaattgccggtgtaacagctatctggagccaacaatcaagataacaggcgtcgaccaaattataggatctaagcccaaaagtcttcaagccaacaccggagtggttttcataatgtggtcaacttttccattgagttctcctattactttattcctttccaaccaattgtcattcaatcccaatgttttcgcactgaagatgagattgggacggcatctccaagaacgtagaaatatctgagacacgcatgcggtacgtgcagcatcttgtagtggcaataaggagtgtatatgataccagatgtcctaaaaacaccatagtgggagagaagttcaacattgtgcttgtaaaggtaagtgaaccaggatgtatcggaattttatacctcaggaaggaaggcccatggatttctcattgttttgacaccttggtaatcatcgccttgttgacagggtgagccatttcgtttagccagtgaagcaaccgactcatctgcaacacatcatggtgacaataggtaccgatgataatggagtataaaacatgcatacatctaatttgtttctgttatgcaacttttgggcacgaacgcatattcttctgttaaagactgcaaattgaaatactcaatcagaaaaagaaagcaacagtcttatatctactatccaagcttttttttcttccagagaaccaaagaaagattttaagctatttaacctaaacgaatcaaacttagccactaacagtagtaaagaacctccagttcagtcccaaagcagcagtataatacaccctcctctttttgtctcggtgcagcagtataatactccgtttcattaaaactaaaattttaatatattttcataatatgtttattttgtgttggaaacattgctgtatttttctaaaatttagtcgaaacgacctaaacctataatatgaaccgaatggagtatactctaaaaaagaatagcggtatactaaacaagctatggacgccagggcattaacacagaaacactaaacacgatgcaatgcgacgaagaggccgatggggcgatggatcaaagagacgagctcactacaggattggaccagccgacgtggccgcgtctgctcctgctgcatcgacatgagccgccgccgccgcttcacctcccctcttcttccccgccgccctctctgctcctcttcgattccgaaaccagcagggcggcgcgcgcgcgcggggagaccagatcaccccgatacgccgcgctctctctcgatcttgctccggtgtcagcggcaaggcgcggcgtggcgcggctgcgcgaggagaggaggggaggggagtggaatccgcagaggtgacggccaaaaatacggcagaaaattaggaaacgaaaacctgctggtccatgctgtgggccgatatttgaagcccaccaaacgaggccttaatgggcttttgtaggtatgtttgggatgtacctaggggtagtaatgggcccaattttttaggtttaaaatagagtgggttgaatttttaaacatttttaacctataaatatttgacaactacttcctccgtttcacaatgtaagactttctagcattgcctatatccatatggatgttaatgaatctagacacatgtaaatatttagattcattcacatctttacgaatatagacaatgctagaaagtcttacattgtggaacagagggagtagttagggttgtgaaagaaactatggttatagtattttactgagtaattatattctaattacactgtagttacatctaatttttttcactcaaaaacttatggcatatttttagatagtccattttaaataggtctaactataatttaggcgaatggatatttggcaaatcagttaaaattgtcatgttcttcgactccattgagccatactatgttatttttttccccaaaaaaaaattgacttactgtcttcaaccaagacatgatcaggtacatgaaaaatcaaaccaatatctaactttttttggatgaaagatcattatattgcataatgaccttgtttttaaagaaagcaagacaagacaagccacagcttcagctggacaatttaagaatggtattggttatagtatactccaactgagaacatgacacaacactgacaacttcagagacaaatctccatcccaggttaaacaagatttaaaacaagccaacacctcacttaaggaacattggaacattaattcactataaagttcacttaaggaacattaaatcactataaagtcgaacagtaatggtcttttaacacctgcagcatggcatcacctgcagggcaaggaaggccttcactggtgtgcttgggctgaaggataatttgtacggattatgttgtttgaaatgcttcttgattgtggtagtttaggtgacaaataattcggaaaagcagacaattttgttgcccaaacacgtgcgtcagaatgaatgattgcttctcttcttgttcaactctggtgagcattagctattatcttttccagggaaattgtctcgtggacttccactaggacactgatgatcaaatatgaaaatgccaaaccaaaatataagcaaaacataatagcgttgatctctagagagagaagcagtttcaaaataatacactttgtgcgagtgtaagatacaatgcatttcgtccaaaaaaaagttgcaatgcattcataacccatcatgaaaaataggtcatacccattgatagctaaatattctattagtggtaaatgacacgcccgtcgataatgaggtagacttcgtgaatctcaatatatattagtccagtcttcagagatgcttatgggtttgtatgcaggtgtttatacgagcgtttgtactgtgtttgcagtaaactattaaacatgatatactttttgcaggaagtaatattaggatattattgggctgtcatgtaacagaaatatcaatgaaattacaagagcgaacagaacatgtacatgtcgcatgaatacaatcgtagatcatatgtagcatcccagcttcaggtggatttcaattgataaagcagagatagccagaagaaagaatgcttcttgattataatataactgaacatgtaacatgacattagaacactgacaaagcacaacccatgcaataataccacaggacctaaaacagcaggtacatcctatagctaaagaaacaagccacacctagcttaagcaacaccacataattcaacatcgccacaatttaacacctaaacttcaaaggcatggcaccagctgcagggcttcagaacatctaacctgactgtagaggggactttccccacaatgtatctttcgatagccaagagcgcgtttttggcctccatgatcatttgcctacatatggggctgcactcaccaatttcgtgaacagatagcctatcaggattttcataatcatcacatattgtgtctagagtaagggattctagtgatgttgcattctcaataatatggcaagtcagctctaccatgctctttgcagagcaaaacccaatgatcttcacattcttgaggttgacatggcggtgtcctggcatctgcctcagatatgaggaatcttcagaaatcacgtgatgcttcatacgagtctgtgatacctgcataggaacaagcaaacaatacttacaaatgattccattatagacaacggattaataggtattttttgccacatcaaaatttaattgtatcaaacaggagaaaaaacatgaaaaaagaaatgcttacggtcaaagtgaaaatctccaagacaggagacgcatcaagaaaataagctagagaaagataatcatttgatggggaaaagcccccacggtatatgctaagagaaatcgtcaagcacttgagatgaaggaatctgaatggtgaaatttgtgtattgaacctctgcaataatattcagaattccatattaatcagaactcttgctatgtgcacggcccagccaaaaaaaaaaaaaactcttgctatgtgcataatgctggtatctaatgatataatcttaagtttcataacatacctcgctttctgaaaatatggtgagagtttcgatagtcggcgcaacagatggaagcttggcacatgtgtattgaatagtatgatgctgataaaaggaagataagtgtaggttcttcactggcagcaaacctccatctgatagtcctgctaaattaccatcataatcaaaggttgaaaggtttggagctttaatttcaatcacttgcaatgttgtgcatccaaacactgtcagcttgctgagcctctgtagcacgcaaggtatcttgaggtaattgagctctttacaatgtgtgagtttcaactgctctaaagcaaaagagttggaaagaaggcaccccaattcatccccagtaatacgcacttcaaacagatgcagtctttgcaagaaattaagactagtggtaggacggaaggcacagtagctgaggcgaagatgcttaatcgagtttccacccctatcaaataaaagtgagaatgggaagtcgtagtactttgccttgatctctggaaaaaacataaggatgagttcttctattgctggtgtaacagcaatctggagccaacggtcaagataagaggcatcgaccaaattataatattcgagcccgaatgtcctcaagccaatgcctgagtggtttttcataatgaggtcaactttttcgttgagttccttggttacttcatcactttccgacaagccactcagccccagttttgcatcactaaagacaaggttggggcggtatctccatgaacgtagaaatgtgtgagacacgcatgcagtacgagcggcatcttttagtggcaataaggagtgtatatgataccagatgtcctgaaaacacaagagtcagagaacagttcaacatcgcatttgtaaaggtaagtgaacaatgatgcatgcaaaatttatacctctggaaggaaggtccatggatttgtcatagttttggcaccttcataatcatcttcctgttggcagggtgagcccgttcgtttagccaatgaagcaaccgacccatctgcaatacatcatgtgatcatggttatggcaggtaccgatgataatggagcgtaaaattgagagtacaatgcacacataaaatttgtttctcttatgcaaattttgggcaagaaccctcccaagttattcttctgtggtagagtgcaaattgaagtgcgcaatcagaaaaaagaaagcaacattcgttccgaggtactcagattttaagctagctaatctaatcgaatcacttagctactactgtctcagtcaggaaaaaccaaactttttcttctgtctcagtctctcggaacaataggaataatgcagtatacttcatctcaaaagaataaaagatatcttcctcaaaaaaaaagaaaaaaaaagaggatagcagtatcctgattactgatttaactgaacaagctatatgtcaggacaatgtacacaatacagtgcaacgaagagggccatggaagcacggagcaaagaagcggcttaccacgggcttggacctgccgccgaggcatggacgtgatccgctccaccgaccccatggccagcttcttctctgctcctctccgatctcccggctccgccctgccctgcccgctcgttccaaaaccaacagggcgcgcgcgcggcggcgcagggagagcaccacctgatccgccgcgctcgctcgattttgctccggagtcagcagcaacgcgcgacggcgcgaggggaggaggaggcgagcttgaggaggggaaccgagcggactccggagtccgtggaggtgccgaccaaccaaaaaatatggcggaaaattagggacaaaacagtcttgtccacgccgtgggccgagaatgaggcccatctgagaaggccttgtaggcttaataggtgtgcttaggctgtatgacccacaattgaaatgctactcttagggcggtttagattgatgccaaaatgaaccttaccaaaatttagcaatgttaaaattttggtaaaattagtaacattgctaaaattttggtaggattggtttaataatgttgccaaaattctatacgcattgctaatatttggtaacaaactaaagtagccacatacttgtcaattttaccaaatatggtatggttgaaaatgtcatcaatctgaacaagcccttaattgtagattagtgatgaaggaatagtctaacatagaaggctgagtgctttccacgcacacttctttctttacttaaaatacatacaggaaaaactacaaaaagcaccccaaacatcacccggaatttgatattacccatataagacctttttttttcaattacatccctcctaatttattttgttttgatactttcccaactgccgttactcaatcattctcgtgaacgcaaaccccacaatatgacactactgcgaaaatatggtcgtcactcatatcggacaggcacgataaaaatgattatggaatcctcactcacagtatcatgttgttggactttggtagtcacgagtctcgttcttagatattggggtggctagaaaatgagttgttacgtttatcttacagagtttaattaacagtggctttattttggttgattcaagatgagaaaaataatatcggcatgacactatatagttgagaaaaaaatatgtatattcacgctaaatcttgtaacggaaagaaaaaatacataaaaataaacttattttgagatgaaggacataaggagcaagtaacatgcttatgactgagttcgggggtgagggttataaatcttcattcctagtacgaaaaacggaataatagttagttcatgattaattaagtaataattaaaataaaattttaaaatggattaatataattttttttaaagcaactttgttatagaaatttttgaaaaaaaaccacactatttagaagttagggaagcgtgtgcacgaaaaataagtggatagaagttagaaaaggagagtttaaggagtatttgagagaaggagaaataagaagattaagaagataggccgtgtttagttatttggctaatttttttttaagtatacggacacacatttgaagtattaaatgtagactaataataaaacaaactatatattccgcctgtaaactgcgaggtaaatttattaagcctaataaatccgtcgctagcaaatgtttacttagcatcacattgtcaaatcataacgcaattaggctcaaagaattcgtctcgcaatttacatgtaaactgtgtaaatcgggttttcttatccatatttaatgctttatgcatgtgtccaaatatttgatacaacattttttatctaaacactatatataacgagagaaatcttcactcttttctctttatcatccatgaaactcagcagcttacatctgggtccacctgtcagccagccagattgcgtacagacagagcttctccctcctctcctccctcgtttctcctgacacgctctcatcctacaaggctccaaccccaaggcaagcatgccaaacgcgcttcttccataaacccccgcaatcccaacaccctctccaaaccctctccgaccgatcgatcccccaccacctcctccgcctcccatggcggccgccgcggcggcggtcggcgtcgtcgccttgctgttgttgctgccgctcgccgcgtcggcgtacggcgacgggctgggccgagcggccgtgggggtcaactggggcacgatgacgtcccaccccatactcccgtgcgaggtggtgcggatgctggcggccaacggcgtcgcccgggtgaagatgttcgacgccgacccctggacggccgcgccgctcgcccacaccggcatccaggtcatgctcgccgtccccaacgaccagctcgcgcgcctcgccggcgacccgcgccgcgcctaccgctgggccgagcagaacgtctccgcctacctcgaggccggcgtcgacgtcaggtacgtacgcgcccccactgctgctctcgctcgctctacgggtggtgtgctatggtttgcctcggccgccggcgcggtgtcgcgtgtgcttctagtttgcggctgcatgccaagtgttcggtgttgcgtgcggcgagacgacgcggctcttactctgagcgcgggcgtgcgagctaggtgagggtatggaatgtctgttcgggcgcgtcgaaagtgttcgacggaatgccaccgttggacatgcagtttcgtgtaaccgtgatgtccgtgatcgattgatcgtgtagtgcctgtctgtctgatcgggtggtgctgtgagtgtgagatgcacatgcatgcttgcatttgtggttcatgcagaatggatagttttctgttgttgcagtgcttccttggtggctgggttaaggttcccctgtcgcctgaaagacatgagtgttaattagacatcacttacaatcgtgtcacttagataaatacagtaatgtatcctgcatcatgcaattagtttcatacttcatgcatatattgcatatgggtgtgtagcagtagccgtactgatcaggggatgtttggttgatgcctaaccttgccataactaagtttaggctagttgtggcatggtggcataaatgtggcttagaaatagttggccacaagtgtggcatgcttagctctaaatttgagagcatgacatgtgggtcccaaagttaagaaagtgtggcataacacaattgcggcagcgaaccaaacacatgcctaaaaaactgtggcatggctaaagtgtggcgtggcaaagtgtggcaaccaaccaaacagcccctcaaatctgttttgtgtatgatacctcagggtcgagagttaacgttgtaaatgttggagaaacatgctttgattggtttatggaatacagtgtgtttagatcatgttccctctgttgatggtgtttatatgcttccatggatgttgactgaactagttcattgaggaaacctattcaaaatgtggagcaagtaaacgcaggaatgagccgacaattggattaccatttctaggcttctaattgtagatgccaacggaagccagaatgaacttgtatttatgatatttagagcattttaatccttaattgtgctgaatttactgtggaaatttaggtgtgtttttattggtgaagaacagtaggaattcagtggatttcattgacttaattcctactggatttcagtgactccactttctagcaattccttttgtaattactgtgctacttaagtttatcatgcatgatgtgccaaactgagcatatctctatgaatccgatgggcgatggtgtgttgcatataaaatgtatgtacttgcctagttacttatttctgaatattcacattgtctttggtgatactctcctgttatattcactggttatgttaattgctcaggtatgtggctgttggcaatgagccttttctaaagagctacaatggcagcctaatcaatgtaacctttcctgcgctcaagaacatgcaaagagctctagacaaacttggtttaggtgatcatgtaaaggcagttgtcccactcaatgctgatgtctacaactcccctgagaataaaccagtgccatcagctgggagcttccgcaaggatatcaatgccctcatggttgacattgtcaatttcctcaatatgaataatgcaccctttgttgttaacatctacccatttctcagcctataccagaatccaaacttcccactcaatttttccttctttgatggtggtagcaagccagtttatgacaaaggtgtggtctacaccaatgtgtttgatgccaactttgacacccttgtttggtcactaaggaaggctggtgtgcctgacatgaaaatcattgttggtgaggttggttggccaactgatggtgataaacacgcaaatgtgagatatgcacagaagttctatgatggttttctgaagaagatggtcagaaacattgggacacctctcagacctggttggatggaagtttacctatttgcactgattgatgagaaccagaagagtgtactgcctgggcgctttgaacgtcactggggactactcacatatgatggaaaaccaaagttctctatggatctcagtggagatggcctagacaatctggttggagttgaagtggaatatttgccagcacagtggtgtgttttcaacaaggatgcaaaggataagttcaaagacttgccagccgctgtaaactacgcatgctcaaatgcagattgtacaccactgggctatggatcctcctgcaataatcttagccatgacggcaacatatcatatgcattcaacatctatttccaaacaatggaccaggatgttagggcatgctcttttgaaggcctcgcaaagatcacaacgataaacgcatcgcagggaggatgtttatttccagtgcagattctaagtgcttcagaaagggttgtgccactgagatttttgcctacatccttcttgattctcctaatggttgtgtccattcttacatagagtcagagacaatggaggaccggtaagtgctgataccttggggttgttggagcatgacacagtaaagaacataggaactgataccttgggttgttgaagagttgaagctgcagtaacataggtttgtaaagcatttttcccctcgtattttgataggcaaaacaaggtggaaacagagctgtatgccttcaccaccgtgccagcggtaatttgcatggatgagaaatatgagacaggatagactagcccttctttatacctctgttttcagcttgcgatcttgcagttcatttttttttattttctaaacgaccttgcagttcaattgtcaagctgaatgctggtattttacagcagcatgccttccaaatactgatgctacctacctgtaactgtaaggctgtaaaccaatgtattggcggtacagagtcatatgtgaatgaacgctctgcaattttagctgctcttgaattgcaaattttgtttcgtccctggatgttaatttttctttctctgttgaaagcaccatggataatggttgtctatttgagtttctctgcttaaaattagttggcagaaatttcctttcgatgcaaatcctaagctactggagaaccaaggtagagggctagaggccaccattggcaattcggcattgagaatcactggaagcagtatttagttactggaactgtcagatttacttcatgtatatggatcgcgctcctctgacgtaaagtcagagagacgtgggtcactgacgtgggggcccaacctttgtgggtcccacatgtcagtgacagggggactttacgtccgaggagactcatcccatgtatactatggtactgaacagcaaggaaaaattgacaaatgtgaggttcatgtatacacgcggataaacctgagcgacaaagaatcagcggcgattatttccgagtggacaaaccgttgaagtgttgacgtgctagaccaccggacggttgagctacagcttacacccaccgacccgaaaagatttaacttctagagagcccgatataacgtcaaactgtaaaaattacccgagatacagggctacaaatgtaaaattgatagcgatccgaagggttaaaagaatgaccgctacataggcgatagcgaatgaaatcgagcaaccgaacaatgttgggcctccatttagccaactagaaaggaaaaagtctactttgactgccttaaaactatgccaaatctaattcgtcccctcaaccagaaaaccaggtaaaacgactcccctaactattaaagttggtttaattgaactccctcagcagttttataagatggttttgctgatgtgacgttttgacgcggtttgaccagctgactcagcatgtgggacccacacgtcaatgtcacgttttcctcaaatctctttcatttctcttccccccccccccccccctcccctttttttttctccaggacggtaggagtgggcggtggctagccagcggccgtcttcggcttcgacgtcttctctgcgcccgtgtcgcggccattggcggagtacgccgggctccgccacacgggacggcgtgtccgtgaacatcgcaccgccaacgccgcctgcacgaccgttgataccagccacaacgcgtccacgccgaccagctgcgccacgctcgacgcctgcccgagcgcaccccacaggccggaggccgctcctcgccgggaagcagcgcatccgctctccgccgccgatccggcccccgctccccgcgtacgggccggagctccagcccccactccaccccgagaccacgccaccgtcccgtcgctccgcctcatggccaggtcgccgccgctccgctggaggccggtccgccgccgcgcgtcgcggggtcgcccagccgcggctccgcctgggcagtccccgcggctgcgcagaaccccgtgactgcgacgcttgggtggagggcgcacaccagcacgaacaaggactcatcctccatcatccactccaatccaactaatgcctgcaactacatcacctcatcttctccaatttcttcttcttgttgtttgttgcaatttactgactgatgaagaacgaagatgcttgcttggatactgctagtctgcgttcgttgcagagaaagcaagcaagcaaaataacaagtgaggaaaggaggaaagcagagtagcagacaaaagaaacagatcgatcaatgcgatgctatctctctctatttgaatttgaatagtagcagacaaaagtttatatatccgattcaaatttgaatttgaattcaaatattttttatatatagtatttctatacatctaaagtttatacacctaaagtttatatatccgattcaaatttgaatttgaattcaaatatttttcatatatagtatttctatacatttaaagtttatacacctaaagtttatagacctaaagtttatatacccgatttaaatttgaattttaattatatccgattcaaatttgaattcaaataattcaaatattttctatatatagtatttctatacatctaaagtttatagatccaaagtttataagtcaaaagtttatatacccgattcaaatttgaatttgaattcaaattttttatacataaatttttctaactttttgtttttttaaatttttttgtggtgtactgtaatagggaaagaaggggaggaggaagggggagaagggagccagggggggcgggaccgatcgcccattagcccccccccctgaacggcggcggtttgtggtggcgttcggaggcagaggggaaattttcggccttggagaaaaagaggggaaaaaaagagaaaagaaagtgagaaagaaaatgtgacatgacatgtaggtcccacgtgctgagtcagccagttggaccgagtcaaagcgccatgtcagtgaaaccatctctaaaacctctgagggagtcaaattgtaccggttttaatagttggaggagtcatcctacccagttttctggttaaggggtatgaattagattcgacgtaattttaagggagtcaatgtggactttttcccaacgagaaatggatccgatccaaggatctggctgggccaaaatgcgcttatagttttaagcctactaatgggccgtcttggcatgacaagccgagagcccgtgagatcgcaaaggacatagtagtttattttggagtaattgcagccatggtaaaacaacttgtcaggtgggtgcgatatagtgtaagaacttgagaattgaacgtttgagtgcaacaacttgacaagtgggtgcgttctagtacagaaacttaataatttagtattttggtgcatcaacttggctaagcatatgctaggtgagttcttttcacgatgccaatatgtcattacatagtaatcctacggatattaccttataatattgaatttaatctttaagaattatattgaacatacaatttacatccaaatacctttaagaatttttttttgtttttttctccttctcaaatatcaacagaaaaataataatttctacatccaattaaatagactttcagttattagttaataggataaaatataaatatgcttacacaaatccatgctagtatattgtcaaaataagtacttaaaaattggatttatataaaaatgctccttataattaagttgtcgcattacttcttaatttattgtatcaaaatcgtacctaccttgcaagttgttgtatttgtacgatcacttataaagttcttatactaaattgcacatacctgtcaagttgttgcactagaatgcttatttctcaagttattacaccaaattgcactcacctaccaaactgatgcactgtgggtgcaatgcaacatttacttttcaattattgcattcggcagtgggagattgagaggagatttgtctagttctctgcgcgcacgctttccgaactactgaactcaattacgtcagtgggagcttgagaggagatttgtctcgttatccacgcgcacgcttcccgaactactgaacaatgtattttttaaaaaaaagtttctataggaaagttgttttaaaaaatcatatgaatcatttttgaaatttaaaatagttaatactgaattaatcatgcgctaatgacacatgtataaaagttttatcttacgattataagtagaacgatagggttttagctctcatggtagtttgttctgacaaaacacaggattgaagaaacgaaggaaaggagaaccagttgcttcctgaaaaaatttgaagacgtgcgtttcttgttccattcatttgcagtagtcacaggtaaaaacattgatcaaatcatcaaattcacatgaaacgcagggctcctcttgtcattacagcaaaattgaagttgccggggtgtccagacttcatagtagtctacagcatggtagttaagatgtggcaaaattggcaacttaaaatcagtataactacagtaagataacatctgcatgaggcggactcctctactccactgaactgatggtggcaaaaaaaaaaaaaagtcacttggtagttgatagctcctgttggatgtaatgctacagaagtttgatgtcccaatcttgttcaggatcacatcttgaaatttcataacctcatcaagttgatgggaccaatcagtttcagcctgaagcagggccaaattgtcaaatgcacgtcctgatggatctgcctttttctaatgtcgatggatgatgaaagtagcagccgaaggaatttctgctagagatttattggcatcaggaaaagattaagagaaacgaatattgcagaaaaaatcagttagacgtgtaccaagttctgatgagaaagaagactaacctgggttagcaggattggtgactgataaatgggagatcccagcattattggtcgaactaatttctgaaggatatcctacagctgaacatggaatgaatccaggatataccgtatggtacctcgtacagaagtcactaaacctctaggctttagcctctagctcaggttctatatggagttatggacaactaatggcttcaagttagtatcaagttagtatcagtatatttcatgtcgcaccagccaaaaaataaggtgcgcaggagtaaagattatatgaaaggaaaacagtttgatacttcttgctccagacatacagaaaaggaaacggtgttgtttcactggatggcgctgctttagcttgtatcttcgtcagaccctgatgatcaaggaaaaaaaaagtatcagcatatgatttttttttgtttatttaaaaagatgctcaactggttgtttgtcccactaaataacactgagattggtttacaaatgaaaagtgtcacatcaccataattcaacgaatgttactttaagctgcaaaacttgtaaataaaaggtttttggatctgcagatcagaagccactatagaacacatctaatactatatagcaaaacaatctggcaatgcaaatgctggcagtgtcattagcaaggatataaacttttcaacaagagagaatttacagaggagatactgctataggggagtctacagaggagatactactggaaaaaggccaacagcagcacaacacttacaatctcaccttcagacgatgggcagaatcacgaaaaaaaagaatacatatccttggaatttcttctgtactctgcccttgtttagttccaaactttttcttcaaacttccaaccttttccatcacatcaaaactttcctacacacacaaacgtccaacttttccgtcaaatcgttccaatttcaaccaaactttcaattttagcgtgaactaaacacaccctctgtagcactcatttcattcaagtgtaattagtacctgtcagaaggaaacataaatgagctaagctagaaataaagcattccgttagatgtgatagccttgcaagcctcaaaatagcaatcatttatatttttatgtaatagcacaaatattaacagaattaatttagaatatttagtctacataaagcctttgttattccagtttgcctgagattgagggccctgttcggtgtgactagatggcagccagcagctacggtagcaatatacaatttctactgtagtcactgcagcagcagtgctgcacagccgctgtagttggccggccgaacacaccctgaacctgcaactactaggtggtagcgtcaaacgtatggtcttcaacaatgtcagtgacagatagctatatcaaaccagtatcttatcatttcattaaaaaggaaaaatatatctaggtatggacaccaggaacatggtagagactgaccaagggcaagtctagataggtctgagcatgtaaaacatagccttgattttgaaaaatgggaaacagaaagagattcaagagtcaaataagtgtgcactcttgtgggaaataattggttggtttgcttttcagctttgttagctccataattataccaatgaagtgcatgaaatcatccaaaataactgtccgaaaaactaatttctattttcacacattgaagttatgacaaccaggtaaagtattttttacactatacaaggtattggtaaaagctgttcaagcactgtcaaaggtctaaagctcaagttcattaactcacatcagtgatcaaaacttaagctgatttttcccagactacttcccctctctttggaatatttgaagagtaggcatccctgcatgaaagaaactgcctgaatggcttgttcacaatactaaaaaactggaatcaagtaccactaaaataaaatatactagaattttattctaacctggttaacatccttgatctatcctgcatgcacctaggccatccaacatttgaaaaaacttcatagcagaatttggtttgcttaaagatgctgtaaacatcatttatgtaaatgcagagagagactgagttggatggtcccaggaagtgcaccgtgtgaaattcatagattcaatgattgatttggggggattactgatgcaactatgaggcaaactcatagtttgttttcttgcatgtgtttccaatatgtaaacatgacaattcagatttgctgcataatatggatccggtagttctcatactgcactatagtttgtcaaggaggaaagtcaagtgctggtgcaaaaccaggtcgtctcgctagttctgcattaataaaacctgcacccttcgtctttaagtgactattatcagtgatgaccagcaggacaaatttgtcagatcttctgctatcctcctgtaacaatgcaaacaacttaaaaggttcacctccaatttcctgatattctgcactcttgtaatttagcaaatgcccgctttcattgcacctgccattcttccaattcccaatgatagaatcggtcctaagatcacgtccaaacacagaagcagcactagtgtagaccttccgctcatcagcaaaagtttctttgtctttctcttcttccaatgtgaataatccaatttcttcaagtgtgcttcttatatctctttgttctgaatagcaattatcttcggcatcctgttctggagccaaagtttctttagaatttctttttgattccacccaaccttcagattttttatacattcctacaagtgcatttgccacatatacatcagaaatcaggcccatttttataatggaagcatgcagttgccttcccaaatgaatagcacaaagatcagcacaccccctcaagattcttgcaaaggtaacacggtttgcacgcaacccactctgttgcatcatggagaaaaattgaagagcttcatcactgcatctattttgaatataacccaacatcaacattgcatatgaattgatgtttcgactcctcatgctatggaaaaacctacaagcattagcaatgcacccacacttgacataaaagtttatgatagagtttccaacaacaacatccaagtattcagaaccaatcttcacaagatggccatggatttgctcaccagcctcctttgctcctatatcagcacatgccccaagaacagttgagaaggtgaaatgatcaggacgcagaccagaacgatattctctgcagaagagtagaagagctttctgtggcagtgaattccagcaatatccagagatcatggcattgattatcactagatttcgtggaaataatgtgctagagaataactgagaagcccactcaatgtgatggcattttgcatacatgtttactagggatgcactgatgaaatcaacaagtagcccaagtttaagagctaaagagtgaatctgctttcccttgtacatgtcttcaagtcctgtacaggcatttattagattagcaacacagtgctgatctaatggttctccagagtttcttaactctaaaaaataaccaaatgctctttcatattgtaggttcttgacacagcctgccatgactgcagtccatgatatgacatctcgggattgcatagttttaaagattgattccgcgtgaatcaacgatccaatttcagagtatatcgatataagagaattgcaaacattagtataagataaatccccagttctgaaagtataagcatgcatctgttgaacttcctctttggtctgacagatatttatcacagtaaccaaatccccttcccttaaattgagacccgaataaagaagaacctctgcgagtttcacagcttcaccctgacaaccatttgagtgataacctgagattgccaaagaatacaaagacgcatcatgccttctaactgcaggaacaagctttttgatgtactgagtctcacctgccttcccagctgacttgatcagttcagacacaacaaaacagtctcttcccaaccccgctttaagtgcataaacatgaatgttcctagaaagctcaaatgctcccagaatagcagcgacgctagcaactaccctcaatgtcaccacatccattgccatgccaactcgatgcatatcctgacaaagctccacggcatccatgaaacagttattctcaacaaaacctgaaatcattgcattccaagcaactgagctcttcaccggaattccattgaacatcctgaatgaatagccaacattgccacatttcgcatacatatcaacgaatccaacctccacaaacctatcagcacccaatccagacttgaccaccattccatgaaccatgagcccctgttctatgacaccagaccgagcacaggcgttcagcaccgatgagatgacgaaccgatttggcttcacctcagaagacaggagttccttgaacagcccaatggcctcgaagcagtgcccgcggctggcgtgcgccgcgatgacggtacaccatgacacgatgtccttgttcggcatttcgtcgaacaggtggcgacaggcagccatgagaccgcctttggcataagtgtccatcaggacgttggacacgagcgacacggatgcgaagccgcgcttgaggacgtgcccgtggacggcgcccgcgcccgcggcgagagcgtcgcgcgcgcagcgccgcaggaggcgcacgtagaggcgcgcctcggaggacgggaagaggagctcgatggggcccacgatctccagcaccgcggagacgatcccatgccccccgccgactcgggcaccagaagaggccgcggcgatggcggcggcggcggcggaggaggaggaggaagagaggagcctagatggtgcgggcttggagacgagcgcggaatggaggagtagcagagggagagaccgggacataagagaggcggtggatgcgtcgccggagatgggcgacagcggcggcggcggcggtggaggaggacgggatcgccacgggcatagtcgccggcggcgagaggggtttggagcctagagatgtgggcccaccttcgtcagagacaccactcccaaaagtccccagattcgctgaacgctctacgcctcttgccttgcgctcgcgtaatttcgtaaaccgccaactaaaatctctccgtgaccgttcgatcacgtttggacggtagggattctttagatgccctggctcgtgacgtcatcatcttcttcccccaaaccgtacggagtccggttctagtagcctcttaatcaaaaatcgagatttaatccagcaaattaaccgagacggagatggggttcccgacgctgaagcggctactgtccatgcagaaggagcggcggctgcgtcagtatcagcgctggcggcggaatcggccaccgcggcaaatccaagaccgtagaagccgcctcttgcgctgtgtacacagcaaatcctcagccatggtaaaagtttgagccttgttttcttattgtttctgatgaaaatgcttcagaaggatcactgtttacttgtctagttatagattgtgtacttcctccgtcccaaaataagtgcagccatggttttccacgcccaactttaaccgttcgtcttatttaaaatttttttgaaaaaaaataaaaacataagtcacgagtagtaaagtagtattcatgttttaatcatctcatgacaacaaaatgctaattataaaaaaaattcaaataagacggatgatcaaaattaggcatggaaattcatggctgcacttattttaggacggaggtagtatcatctactgtcctccgtcttaaaatctgatccaagccccgcccctccggccttgagaaaggatcggggttgcacttgtggttgattctaactatatttcagtcctcctaatttgtgtcctcctaatttgtggttgcacttggatggcacaactgctatggttgcgcaaaaaataggataagttcctcaaagaatatggcacacggaaaaatgaacattaaaatgaccaaaacttgttttactgaacatttggagtgctgatacaatatacaaccacatcccctagggagagactaaaactgaattcaatttacagtactatctgggttttacattttggatgtcacacaagaactcgattggctatttcttgccatttcggtattagaaatgcagggcaatatgcttcactcttccattgtttactatttccataacacttacacttgacataagattgcttaaaatacgcagctaaacacaggaggcatcagaaaagtgttaaaaaaaggggtttccaccaacttggggcaaatgactttggttgatggggaaactggcattctgcatctgatgtgtaaccttaacatcatgttgttggactatgaactgatctgcaaaatagttattgtagcatgacatgatataataaggtttagagggaaatcacgatggagttaaattgaattcagaagatggcgaaacaaagtaaaaaaaattacggttgttcgtcgtcattggtggcagaatttgtggagttatcagatcagaattaacaaatcctgtgaatggagcacgcggcagcattgaagtactacccgtatgcggtaatgctcctcgcatggaagacaaagaagggaactgtacatagatggaaaaaaaaaagatcttcatttacctaatagaaaacagtaaaaatgggtatccttcttgataacttagacattgtgattccatcatgtgctaccatgatcagtaaatttcaagaaagtgacacaagtagatgtgtaacaatacaatataaaactcaacagaagaaatgcaaccacattcaggaaggagatacaaggttaaggaccataaaggcaagtcaacagtgcattcagaatcattctttctcgctgggcctgtttagaacaattcttgatcaaagagctgggaattcccacatcaaaggaaaaatgatgtcaacaatacgcagaacctatgtggcaaatgagtcaacatattgtatggccccagtgcatccggaccacccagatcttatctaattctttactactcaaacaagaggtaaaactctgtcatactgtcgatgcatgagaagatgagctagcaaggaacctttggcatgttagccaaattcaatgaactttggatgaaaaaatgaatgtcttgaaagggcctaatcaacaagatgaaaaaaggaacaagttttttttttagaaaaagaaaagaaacaagtaattgaatctgtgaactggtatgagtatgacatcatagaacttacattggcagctcctacaggatattgcatgttgtattgtccatatcccatatttaactgaggatttgctctccaatcccagtttgcagcatatgggtggtaactcatggtaaaaatatcctacaaattgttctcgttttagagaaaacaaatatggagcacagtaagttattttgagcatctattacctctggaagtgcctttcctctactagatgtggtgtccacagcaggtctctgtgatgctagtgttcctgccaatatatttgagccatgatttgaaggaagagcatggctcccttgtattgatgcttgcgatgcggctccccacaactgaaaataatcatgcagcaaaacaaaggtctaatacaattgctcaatggaaatagttcttcttacacaatatacaagcagagagctaacctggctattaaccggagcactattagctctgtttagtggagaactgtaagactggatattatctgtggggcggaaaaagaactggttctgctgactgccgttatttgcttgggaaaaagacaaggacttggtactttgcctggttggaaaactaatttgaggtgctgagacagaatttaggatctgaaccagcggaccgttcaaagaattggtactggaaattgaagtggctgtagcgtttttaggagtagtgtcatcaaaagtagcccaaccaacatcaggtaaaggtgagctcttctgcacttcagtttgaccaaaaccttgatgaggctcgaaatctgaatcaaagtcaatcaaacttttcgatatttctaatttaacatctgttgtagtttttgaactgggatcagcagccctcggtggcactactttctgcaaaataggacttccacataaatattttaagttaaagatatcattccatttttactttgttttttgtgacatagaattcgtctgacttctgaaataggacaagtattctcaagaggcaagaccactgttaggacttgggaatataaatatggaaatccctccctagctacctaaaataatgtttccacaaaccagataagaagagcatggcaaaacctgtgagctagcttacaatatgacatattgttggtaaaagttgaaatcaagaataggaccttatgtaagaggaaacaagaagagaaactatgggcaaagcatgcaaacagcaaaagtaagatcagcaggaattggattacctgtatttcagcaggagtggtagatgttgtggctttatgagatctaggagggtcaggaagccttataggcagaacttttctattagtttctttggaaggttcaaccacagaagatactgatttggtcgtatccttaagattattttctgagcttccacctgtcttttgaagtccatccaggtattgatgtttcccagtgttggcattttccctttctgtagtggttctattcttttgatccactttagcaggtactggatgcttattgagattgttttggtcttctgaggtgcttgctgtgctatgctgtggaccgtgattatcttcagaagttccaccatatgggcctctttgaactcccctggatgaatctatattgttgtttctgtaagtgtcatcccgactaccctgagttttcattcagatgtttcgtgtgttacaaaaagaggggagagactaatgctatgtgtttaacagttatggctagcgcaagccaatgacaaataccttcgcttgtggttgatggttaccaattctttctgctgtgaaccttcggtcaacatatacaatcttgatgaagtttctgagcctatctacatcactatatgacagtactcaaacatcaacagcagattcacatcatacattaagagtctatgataatcatctggtttagtggcagacctaatgtcaggaagaggctgtccttggaagtcccaatgtttcaaatatatttccttaccacgctgaactatcaaaaatatatgttgtaagacttaaaagcagacaccaagcatatcaggatttaaattataaataatggtattaagccaacctcgtttcccccttcttgaagagcagaaacttcttgagaagtaaatttagccattgatattgattttacacgatgagtgaactcccgactgaagaataattaaagttcagtaattagacaacatttatcaggagtttattacttctgcacataaattcataattgtcatagtcaatcacaagtagttgtggaattgcatttttaaagtaagaaacagaggaaacactagaaggatattttcaccacttactgtattccgctgcaactaacacagacgaaagttgagaagcttgtgcatacgtattgtggtccctgatgatgaagaatattgtttggttatttatgtcatgaaggaatattatacatttttcatctgtcatcgtattactaccacttaacaatatatcatttcattgctaaagaaacaatgcattgttgcattcactcaactactcaccagatcatttattctagaaaagaaacatggttaaatcatataattttccagacaaaattatacatactgataatgagataatattcaaaatgcttatgaggtgagccaatgtttgataggcagttcaacctcctcagttcatcaagaagacaactaagtattatttataaagtggccaagtgggcatattttgctgcagcagatatctaaagctagtgaaaaacattaggcagtatcactgtcataattatctagtttattgttattgatccaaaccacaagtacctattactaatcggcaaccattttgcaatcctgtgcactctacaaaagttcacccagagctcattttgtttgttactaccttgttactaactcaatgttgatgtggtcaatttggtatatgaatccatacactgggaaaggcatctattatgaatttagagcacgagatctgtaataatatcaaacatcgcaggcacttgtgttatgatctcttggagccaaaatgaaatttcgttatttcgcacattcccgcatatggtaatggtggtaatgtgttattagtattaataacgtgtaaatccatatgaccaggtactagttactaaacagaaactagtaattaataattcatttccctaatgacagtttcaccatcctcaaaattcctaacccatatacaactgaggaaataagaatcagattaaccaccattaataattcatttccgtaatgacagtttcaccatcctaaaaattcctaacccatatgatttcagagtttcagcaacaattcagaaggaaataagccgagcaaagcctgaagacatacagagacagagcagctcagaaccttagccctcctcacaagatgagcaagctacagtacctttaccttccttcctaacacaccattttttgtgtccacccaaaagatcaaaattctcaaaacttttctcagagaaaaatcgagctcaccaggctgttgcagttgatgcagcggcggttgccgggcagcttgagcagggcccggatggccctctcgttcctctcctcctccttcaccctgctccccatccaccccctgctctgctccgcgattcgatccgcagcaacaacgaaccggcggtggtgctccgacttccaagagcgagatgcttcgaagatttctcgatggagtttggcaacttttcttgctgttcttggcggctttgaggcggaggagtggaggaggtgggaagagaaggggaggtcagcgtcggcgtggaggctttgaagggctcggtcaccttcgcctcgcctcgttggctggtcgcgtggccgtggtcgtgggtgctgacatgtggcgtgctccggctaattaccacaatgcccttctctgattaaagaacctgattagtggatcacagtagattacccgtttccctatggtgattaacagccctcatcgtttatctttaatttctactaaaacttaattttgaagctgatgatcgtagtttacttttttaagcattaatttaaaaatctctaagaacatatataaaaaggttttatctatatttttttctttgataagcgtatgccaatcgataaggctataaaattatctgtcattttaattccagacagatcagtggttaaaattgttgttgttattcttaaaagggtatgctgattttggtaggattagctcgggctaaccatcaaccttaatgatgtgacaagtgttccggtacccatgaaatgagcattcagtacagtatgattcaagagttattacacaaaaatggataaagtggttagctcactaactaaagttagttaaagtgacataatctccagtgatcacttagttgagctacttttgagtagattaaaaactgaaaagaggagcaatcaaagccttctagataaagaagacaaccaaagcagagctctgaaatctgataaagaaaagaattctgaagtctgattgcctgaacatccactcccgagggcattatcggtacatttctgttccaaatgggcacgcatgcatcacgcatgacactctcgaacgggttcggaattcagagaattggagattgcctgataagaaaaacacgatttggttcttctagatataaatttttgaaggaaaataatgggaacaagccgtcagattcagagattggagaggaattgacgaccaattcagtcgagagaagaggaggcggcgtcgtgttcggtacgcgtccgctgttagaaggcgaaatcaacattggaaaaacgcacggtcaatacgaggaaaatgattagttagttctggaatggttggttaatagctgtaatggctggcaaatggggatgtttttcttctctgataccgacattttgttctagaaaactaatttgaccttgtactatattactaattattttcatgtggttcaggaaagcaacgtacaactgccttctttttacatgttgtccactgttaacaaaattaccaccattgtttatatgagaatacatgtattgtttatcacaagaaaataattatattgttatattaacaattcacaaatcacaggtatgcgccaacttatccttaaaaagcagtaaaaaggaacgaacagagcatgcaactagttttgcaaattctacacaaaagtatggccccgtttggatcatatgatttttttttttgacagaggaagcacccactacacggatgacatgaatatctttttcttggcagattagtaaccacactttctttgatgaataatactacttttttatataatactaattacaagggaattattgttttatactccctccgtcccaaaatataacaacttttaggcaatgtttggtttatgggagtaatccattagttcctccattttagttcctaataatccaaacagggataactaaaaggaactaaaagtgtatatgaggactaaggacctgtttgattcagcttatgattattataatctggattattaggagtaagctgaaacaaacaagtagattattatgctaaattattataatctataagccaaattactataatccaataatctcctctagaggagctttttccagattattgagtgtctaaagacccactactcttagatgcctctaataatccagagaaacaaacaacttgtagcttattttatgccagcttattataatccagcttacattaatctgatttaataatctagattacaataatcttaagctgaaacaaacagggcctaaaatacattaggccctcttgaaggtacttatagggactaaagtgacaacctctctcttctctctccctcggtccatgtgcttttagtcccttctagtctttggatctaaacagtaggggaccaaagtttttagtccagagactatttttagtctagggctaaatgatccttaggcacttaagatttgtcccaaaataataacaaattctccaccaatattctcttcccaatcaatcataacccttcaccgttcactttttccacctacctccacttctcaaccaatcataacccattcctatttaattttatctacttttcttaataaccgtgtctaactttaaaattctaattcggactgacagagtactataatattcattcaactttgaaggaggcaaagcacataaaaccttcttttttgggctggtttgcaatccagtcaagtcccccatatagaaggactgggattgcgggcctcctaagtaaggcccaagcatataaagaggtgcctagactttatgtaaaaaagtttgaaaattcgaaatagataagaattcaaattcaaacccccaacaatttcttcaaaagaagggcattcctaggaatcgtatcttcaacaaaaggagtatcgtacaaaagagagagagagagagagcctctttagcctttagcaaaatcacctgcctctttttgcaaaatcacctttctttacgaaaagggaacattgccattaggcccccacgcgcagtatgtgggccatacctgtcagcctcacaaaaaggatgtctttacctcgtggatttggacaatctaatggttttaaatatttttttaatcgtatccaacttctctcctccagtcctctccctcccgtagaccgtggatatcgtagaacaaacggaagaacacgagaagcctctcgaagcttccagaatcccgattccaccagattcctcccccccccccccggagccctaattctctcgcgcggttcgtcccgcgacctcccggttcctgccaatggccgacagggagaaggcggaggagacggaggaggagtacgagagcgacctcgacgacgcgcccctcccggcggtgcggcgccgggacgcggcgagcgacgacgacgaggaggaggaggaggaggaggaggaaggggcgaggccctctccgcctacgaaggccggatccgacgcggaatccgacgggcaaggcgccgccgaggtgtacgacgacgacgacgcgtacgaagatgacgaagggtacgaggaatacggggaggtgtacgaggagttcgagcaagggcgaggcgttgcgggcggagtggccaccggggcggtggccgcagcgggggaggaggcggggatgggtatgaagggggaagcggaaggtgaggcgtcggcggcagcggcggagggagaggaggggaagaaggggagcgagccctatgccgtcccgacggctggcgccttctacatgcacgacgaccgcttccaggaggcccgtggccatgggcgccaaaggttccggcctttcaaccttcaattgctgcttgatttgctgttgtttccttatatatctagggtatgatgatatgatctagagaacttggtagcctagtttcaaccttcactagtttggtaaccattagtgttctctgaaaccactgcttaagtgcattgcgtgttcaatagttcaattaatatcatctaagttgataacacgagtgtgtcatgctaactagtcctgtggaattgttagaagaggctaaagtttgatatttatatgtgcagtagtagtgtagtatttgatagatacaagtcataaaacggcttaaatgtatttattttcgcaattggtctattttggttctctagatttggtacggttgctcgttgttgcatctcttcgttatgatgtcctgcctaagtttcctttacaggataaccaaggtctgtgagtagcttattgagtaattccccagcatatgataatacatgggtttataacattgaactataactcgtaaagcacgcaaaacatgagctaaaataacaacacgaagtcatgtattcacaggcattactttacagagttgattgttatatgccaagtcgcaaacatgaaacaaaaatgaaactttgcctacaagtttttaaatctggtgtttcatgtgaaattgatttagtattaatgcaaattggacacacttattaaaaagtagaagcgtttaactttgaagtctgatcttgttcaagtgtttctactagaacaatacctacatgatctgaaacatggtctactaggatacactactacaatatagatgagactggtaaggtatggcatggctatgccaataccatgatacattatctctttactattttaaaaagaaaagttgtgtataatggcgagctctacacccacaagtactctagaagatcttttcaggttagatatagtttgcaagaactttaaaaaaatataatattgtagatcttctaaaaatacactattatcatgtaggttgttgatcgtttttacgtagtcatgtctaaaaaattttagatttatcattttcttaagtttaacttatggatcttatactacatttttttaatgctagttacctcatacctgaaatgattaatcagttttagtgcatcagatgaacgaatgcatcacagttgaattcaagcatagttgaaatcatctgttttgaggagggccaatcgcaaatagcttggattgaaccaaatccaaaattttaccttttcttttgcatgctcccctagtttgggaagcatgaatcttaccaagttgggcattgcttagatcaatgtcaaccaacagaaaaaagagaagtaagcccatcagatactaaaccagtaaacactccattgaccattccatactgtacatcattctataattatacacaataattatgatttgtggtaaaaattgttgatagtgtggtagaatgaattgaagtgtattgaacaaatactggaaaatttgtctcaacgaactgaataataggttgtatttactgtttttttcccttttaaaagtagttgtttgactggtgtgctagtgttccagtgtacaaactggatgctgaacccaactaagctagacaagtttgattatgttgaatgctttatctcaattttaaggaatccaatatgatactctgtttcattctctggacatccatgatctatattttaatttctgctacccatgttgtcatttcaggagaatggtgggtgatagacggctgtggaatgctaaagaggatcaagcgtgggtccatgacagatttgatgaaatgaatttacatgatttccataatgactacgtgagtatcatattgtctttttctgtgtgttgaactattgattcatctttcttaccaagatgcttcttttattgattgtactatagacaagaagaaggcccagaggtcgatttagaggacgtggtggtgcacctgttggtaaagttcgtggtggtagccgtgataatttcagaggcaacaggtcgcagacatactatcgtgatggtgctaagaactacatatacgttccgaaagaacctcatagttaccatgataacaccaagaaggttcaacaggttctgaatgataatggcaagaatagaaccatcaaaccacctaatcctcgtgatggcgatgccaacaatttcgattttgttcgaaaagagtctcgccctctttatggcaatgccaaaagtaataagagtgcaccgagagtagttcgaggaagaggctctaaacgttaccaaccacattggaggagtaccgctgagatatcttcagagcataataataagtgagtggaaggtttcttcttatgtgctatctgtgtctttgttttgttaatatagaacttactgtggtactttttgtttttgttgctcatacttcagatcacaaaatcttgaaaacacttcttcaaatgcaaacttgggaaaacaccaacatcaagcttcaaattctcaaccagaacgaggatttccgatgaagcagagctttgcatcaaatttgaattcagcttcacctcccttttacccttctaggccatctcatcaggaactcccagtgagtcagaggggggatggacaacccagtaccactactagacacttctcatcccccattggtatggagcatgtctctccaaccccacagtatggccctctcttaagagggaaagcctttgtaccgtctgctgggcatggcaagttgcatgctgaagttcctataaagggcatggatcatccttcatttcattcatctacatcatcatcaactagtcaatttcctatagctactaatcaggtcactggaaattcggctaagtccccacacccaattgtccaacaaaggttggttcaatcatttaatcaatccacaccaaagatgcctggtcagatgtttgctgcgcaatttgctagcagtgataaattgccatcttccatgcaatctacatcaacaattttgactgaaggcactgaaatttcttcacctcatggttccaacaaatctaatactagattgatggcaaagggacaacatagtgaccagggagaagaacatgcttcttttatgtatggtggagctcaagttcttgggactacaggatcacttggtgaccaaaatttccatggaacccctgcactatttccaggttcgtatttttactattcacacggcaatatagtaaccagagtgttaaatgagtaaacgattacatgggtgaggggaaaagaaataatccaatttctaaaggcttattcctccattgattagagggtgcatgctatgtgccttgagtgaaaatgtttacagtgatgttagtggatttataatctactttgaacttctggtttgatttctgaaaagtagtgttattttcagtagactgccaccccattggagtgaactgaaccaagtttttgtttccaaaaccattctgcaatatgcctttagcttttttttttcccatacagttatgcagtttggaggccagcatccaggtgggactggcgttccctcaattggcatggctctaccaggatttgtgtctcaacaacaacttggtctgagcaattctgaaatgacttggtaatgactctttgaactcttagaatagttgtttgctttatttttctctacctccaattggtatgatgtggttatcacattgtacttcatttagatgttagcacactgctgtttgctcaggcctaatttttttgtgggttgtatctgaatgaaactaggctaccgatattggctggtgcttctggagctttgggagcaacgtatggttcaccttatattactgtagatggcagctattatccccgaacttctgaacatgcatcttcatcagtttctttgaggtatgttagtctaatactctaatatgattcatgttgcaagaatttggatttcgcacacaaggcatatatactgttgagaattgagataatgttaatttaatgatgattcatccttttgttaaattctggttctgaggtatgatcacctattaccaacatgttgacgacaataaataatatgctatgaactactccctccgggttgataatacttgtcgttttggacaagggcacggtctccaaaaaaaaactttaaccattattttccattataatatgtataaaagtgtgaaaaaatatatgattttattaaagtactttttaagactaatctatacatgtagtcaccatatttgaaagacaaatattttaaaaatgattcataatcaaatattctaaagtttgatctcacccttgtctaaaacgacaagtaatatcaacccggagggagtagtagttaatgcccttacatagccctaatctgaggacttatattctatgatttccctctaccaatgtgcttgctttagctgtcttcctgtgggtactgccgtactggttgaccagccgtatcatcagaataggttttggtagataattggagtaacactactctcctgatctggagaggttgatgattactttatttaggttgaataataattgttttgctgcgatttttctgttttgttgtcttgtgcaactgcaagggggcaatttgaatggcatggggatacaatcattatgcatgcacctagcattttcctattatacgtagtctaattgaacaaatgatcgtcattgatttctgtcccagccttcatcaccaaccaccaacacaacatgcacaaacagaaaaatgttaatgagaatacaaaggatcctagtgcttcaatcatcctagtgctttcgatagtaatgattctttctgtttcttttacagagaacccagtgcctcttctcagttgaagtcacaagaaataactggtaaaggcatcttccatccctttccatttattttgtcttctcaattggtatttattttggggtatcttctcctatttttgccacataaatgtaccgaggccttttcctcttttgcagaggctttaaatgatgaacttagtcaacgccaacataaacctcggaggtatgttaaagtttatgtgttctgtttgctgtatgctttctgttctaatactatgtgttaataccatgttgtgtcttgttacagatattcggaaatgaactttggcaaatgaacatagtgacgatggtgttaatgaggacttcatctgttagatttgggtctgtgcaagacttctatctcaaggcctttctgggtccttgcaacacttcagtgtctgatctgtagcactttgggctgtatccagaatgaatgccaggtacgcatgacttctgttgttctttcattgtgttagactggtgttgttctgtggtcttgccctttcacccaaaccttgatcccttgagggtaacataaggaaaatcctttagcagtagacattagatgtctgttgtctttctattcatatatatctttcacttactatgtataataaggaaatttattttctggcattcacttcataattcttttatggtagattcacagtggcaaccaagtatggaacatgttttcatttgttaaggcttctgaagctagttcagagtcttattctattgattatccaagtttattatcacttagtgagctactaagaatttctgcagtgtttccatagatatctagtattttagtgaataaatatgagattgatattttctaattaaaggaggtaattgaatcgtagctaaaactagcttaacaacttgcaattgcttttggaagtatagtgtgtccgtttcttaatttggcatgctaagtccaaattgtggtataccctgaatctgtccttttctccatttccttcgtcacaactcataaacgaatacatgtctcctctcttctaactgcatttggttgatgagtgactggccatttttccacgagaaaagatatttcagcaagacactttaaatggctagatgtttgtattgctcttgtacctcaaccttggataggcagttgtcatgtatattgtgctcctacatgtgcccatgagcattttagaatcgtaggatatgctttgatttgacaaagttggtgctgctccttttcaggtttgacagttgaaggtgtttatatccttactatagtcatttgcagtgattattctgatgggcagttgctattgtgtaattaggtatgattttcgacaattgacgccatttgaatccttactatttgatggacgttctgaaccctgttaccctgtcaggtgagatttacatggtacaccgtccatgttgctattgatcatcttcacattggcatgcatatatgaataatgcgcgatggagaatacgtgaggtctctgttattgtaagctccttttcttggtgaaagagggggaatacaaggtggtgttgggtttgcttgtgttgctcagctgacttgatcactgtcggttaatccgttatgacattttgaagatctgctatgtgatgtgttccctttgctgaagatattgtcgcgatatactagttcggtacgtgttagtgttacacagagttctttctgttcagttcatactacttgtaactgtgtaagcaccaggtcttctgaattactacaattttaccattggtttccctttatagtggagtatgatattaacaactactacgtagaaagatgtaaaagtgagaaacttatgtgaatgttgtacatgcacgtcttataaaaaaatatttatttattttggtcattggctatccatgttgaccccccgctttccagacatgattaccttgtcttttggcctataagtttaggtggtcagggcatcacaaatgcatctggtcggatcacgttctcttccaataaaactagtgccgggtattcaagaaatcatcaggcttattacgcaagagaataaaaggacccttttaacttgtatgctacagcaataaaaagaatttcacctctaacacataaaaatggtagctatgccgtttcaaaaaaaaaaaaaaggtagctatactaatagttttaattttggcctttgttgcgcgatgcgcatgcccccaaacaagcaaatgcaagcattacaaattcatcagacgtctgaggctgtgtttagttcgtgtgctaattttttttaaagtatacggacacatatttgaagcattaaacgtagactaataacaaaacaaattacagattccgcctataaactgtgcgacgaatatattaagcctaattaatccatcattagcaaatgtttactgtagcaccacattataaaatcatggcataattaggctcaaaagattcgtctcacgatttacatacaaactgtgcaattggtttttttcgtccacatttaatgctctatgcatgtgtcgaaacatttgatttgacggaaaagttagaattttgaagagaaaagtttaaatctaaacacgacctgatttcttgtccctgacatggctgtataatttcaactttttttttcaaactttcaacttttccgtcacattgaactttcataggtacataaatgaacaacttttccattacatcgttctaattttttcaaactttcaattttgacgtgtaactaaacacagccgtagttttactactactttatcttgtgcagttcaataatactaatacttcctcttccgaaaggaattacttctatcattatcttgcatttagtacgcaggagcagtaccatgccgtacgcacaatcccttattggtttgcgtgccgttatcaccttgcacagttgcactatcccaacgattcttctgcaattgcgctggtccattggtcacccatgcatatgcctgaagcttctcttttctgatctttctgatccacaaacgcatgggcatggcaagaaaatggcagaaccatacgcggcgatctgtcactcataatctgatgcctgcatatacgcctcttcttctctgcttcctgaatttttatgtccatgccatgccaaggtagaacaattgcaatatattaaaagaaatggccaatggtctattggcagcatgattggttactctttggcaattggcaccaatgattcgacctttctatttttttgcacaacatattgtcctccattgcatcttccagtttagcttctctcctatgatggaacaactacacgattccagtatcagtagcacatcactgatcagtggccactagtgcatgtttgccaaggttgcacattgtcacatggagagcccagctgcttgtctcctcccacctatcaagccaaaacttgtcagcatccagcacggcatgctatataggcctgtttagattccaactttttttcttcaaatttctaacttttctatcacattgaatttttctacacacacaaactttcaacttttccgtcacatcgttttaatttttccaaacttccaattttgacgtggaactaaatacaaccatagtgttgtttgcaacaactctttagggtgtgtttagttcacaccaaattgaagtttggttgtaattggaacgatgtgacggaaaagttggaagtttgtgtgtgtagaaaagttttgatgtgatggaaaagttggaagttcgaagaaaaagtttggaactaaactcgaccttagcaagaaaaacatctactccatccataaaaaaatataaccatttctgttatttgaaatatatccataaatataagcatttctacagtagtattactttcccaacccaaccgtttatggtttaggcccttattaattcccaaaataaaaacttttcacccatcacatcgaatatttggatacatgcatggagtattaaatgtgaaaaaaaaccaattacacagtttgcgtgtaaattacgagacgaatcttttaagcctaattgcgtcatgatttgacaatgtgatactacagtaaacatttgctaatgacggattaattaggcttaataaattcatctcgcagtttcctgacagaatctgtaatttattttattgttagacaatgtttaatacttcaaatgtatgtacgtatatacgatgtgacaccccaaaacaaacttttttgccatctaaaccgggccttaattttcacctcatcctacccccaacaacctctcatttaataagattcatcacagtctttttttttctcttcatccttaatccctcttaaaaaagctcagaattttacttacatttgtgtatggagggagtactatctcttatcattggacattggacaaaaatacctacctgtcctttggttgtaacttttcaaacgtatttgagcaagaggagcgcactgacgaacaaatttgcctctgtactctgtggccctcatcttgctcaccctagtactgatagtactaaccttaacctggtaagtctactactagtagtagtccagtactagctagctcttgtacaaactctcatggatattcccttgcaatagcacagccaaatagcaacggtaccatcaccatcatttatcatgggcacaacttgctagatctcatccaatcttggtgatagagaagaagggaatgtcagctgccattttaaacatccctgtgcttgttgttcatagcaacttcaattcgatcacagagataaggtcaggtcatagataaatagagagattgtctctgtcactggttgtgtgtgtgtgtgggagaggcagtggatgacgagggcaatgaggaggaggaggctacgcattggcaaggtgctggactgcttctccttctccatgtgttgcgcgagaagcagcggctgcctctgcttgcgcgcgtcggaggaagacggcgacgaggaggcggccatggagaggaagtccctggtgagcagtagtagccaggtcgaccaggtgatcaggcttcgcgatcttgttgatggcacgaggacactcgggttccatctagaaccaaaggtatgcaaaatcttcttcgtcttcgtcttccatcagatatccaagtgcaattgatcaacgtgcttgtgtcattgtgtgcctgtgccattggttgatgtgcattctctgtctttttggttgtgttttgatgcagactgtggagctcaaggtgtccatgcactgcaatgggtgtgctaagaaagttcagaagcacatctcaaggatggaaggtaacaaaacatcatcatcttttagctttttctatgacgaacttctcagttcagaaaaacagtttatttcttccggacagttttcagactgtttgataggtagagaatgttaactcttctgctatcgtcttgagagtctgctctccctaccttcatcggttcatcgaacatatacgttaaccggttttatccaaatgctcgatcatttcaactaacgttagagaatccaaaacataaatcccctccaaaatggttcaggccaggtaatacctttattttccagaccaagctgaactccacatttgcactcacctcatgaactttcctaagatacactgtactttgctaccctttttcagtcacggacaaagtgcccttctttgttctttcttctttttttgcttttgcccctctccaacactctgcaaagatcagttcagttttcagagcttgccatgtaagggcctgtttgggaaacagggccttgttcacatcggatgtttggacactaatttagagtattaaacatacactaattacaaaacccattccataaccttggactaattcgtgagacgaatcttttgagtctaattacgccatgatttgacaatgtgatgctacagtaaactttttataattatggattaattaggcttaaaaaattcgtctcgcagattagctctcatttataaaattagtttttttattagtctatgtttaatattccaaattagtgtccaaacatttgatgtgatatggactataaagttttagccccatctaaccaccccctaagagtagtttagactgtaattcatcttctccagtcgcttgctaggtaaatggcctgggcattttcttggctgtactgtagtctgtagtacaaccgatgaaccgaaaaacaccgtacagaccaaggccacagacgcatggtacggtgaacattaactcggctgcttttatgcatctgtgcttcactgtccttgtactactccagatcttgatactctctaccagcaaaatactccctctgtactaaaaaaaagacaaaccttggttaccgtgttcaacgtttgaccgtccgtcttatttaaaaaaattatgaaaaaaattaaaaagataaatcacgcataaagtattaatcatgttttattatctaacaacaataaaaatactaattataaaaaattttatataagacggacagtcaaacgttggcatgagaactcacagtttgtctttttttagacggagggagtagtcaggatggatcatggaacatggatggcagcataaaatgcgaacacaatcctttcacctttcctctgttccccaatctggatggatctactcgcaactgtcatttggatcttcctgtcatcaacccatgatcctgtgatcatggccacagcagtagtaacagttcacagtgatcctcaatcttggcaattcagaattcagagacgccatagatcattagcagtacagtactcgcttgctctattattgctcctgcatactgtacgctgatgaattcgcaggctgtcatcaatttcatcaaaaaccacggtgttcttgtcaccgtcaccgatcaaatcaccctcctcttgcgtgcttctcgtgtcgctcgatcgagcttgctcgtcgcccgggtggggggggggggggggggtggatccaagtgtcatgctcgcgctgggtacatgtgtggttccccctggtgctgtggtgcatgattgatccttcgaatccacacgcgacaaccagaaaaaaaattataatgttagcatatccatttcaaacttgaaatgtgacatgaaaattgttcaacaagtctatgctgtggtttggcaaagagaatacttcatccgtatcaagatatagcagcctaatactggatgagacatattctactacgaatcagtacagtgttttatacaatactatgttatgtactccctctattttatattataaaacatttaacttttttcccagtcactttccttaaaaaaaacttttttcctagtcaaactttgttaagcttaaccaagtttatagaaaaatttaacaacatataaaatataaaattagtataactaaatctaacattaaatacatttttataacacgtttgtttggtgttaaaaatactactatatttttctataaatttaatcaaacttaaagatgtttgattaagaaaaagtcaaatgacttatataatataaaaacggagggagtattttagaaggaagggacttatatgctggtgtgttttttttagataatatatatgcgggtgtgttgaacttgtggcgtttttgttgggttgcaggcgtgacgtggttcgaggtggatttggagaaaaagaaggtggtggtgacgggggacgtgacgccattggaggtgttgcagagcatctccaaggtgaagttcgcgcagctgtggccccttcccccccaacctgctgcaccagccaccgtctcctccgcttagatctcgatccgttcccatctcaaaatggcgggggccaagccaagccaaccgcgcgtcgtgtgccaccgtaatattatcgcgctcacgcggggaaattgcagattcagcgatgcattggcattgttaccgagaccaaccaggcaaccatcgtttttactgcaccctcttgccggcttctctctgtgtttggaaataaaccaacctaaaataagttgaaacggcacaagttcaaaattgttatactaaggtaatgtctcattttattttaggttggtttaatttagaacgaagagaatagctccatatgcatacatgccacggtaatctaaggctgacgcgttagtcaatcaagctacgtttgaattttcacggcgatctatattggcactaggaataatgaagagggaattataactactagaggctgtttggtatgtactccctctgtcccttaaaaaatcaatctagtatcggatgtaacacatcctaatactacaaatctactatcagattcgtagtactagaatatgttacatccgatactagatttgttttctgtgcaacggagagagtatgtggatatactactttatagcttgtgtggaaaatgaattgtttcatggggaaggtgaaggtttctgcagaattttacgagattttctgtgctccaaataggcttgtaaacattgtactactcgtgttctgaaaaaaaaacattgtactgtttgctttgctatgagattggtcgatctatttttctgagtattttccgcccgtcgttgtgcgtatggtgggagcagatttctcacccgacaaacactttacaaggacatgttttgattctgctaggccgctttgggccatcaaaatcactttcaagaagaaaaatgaacactcctgcatctcttcaactataggtcaatggtcaccagtgtcacttctgactcacaactatacatacaagacgggaaaaaaagaaggcatttcagcaggtcagagtgcttaattttgcttgtgttgcttcgttgaacaatcttgctgctgggccctctgtatccctcgcataagcagaagaaaagccactctgatacttattatcagatgccattctgttgttcatggcgtcattcactcatgcgatgacggtcaacgcatttcagttgcagcctgcttctgaactccggcgcatccaacaaattgagctgcctcgagcttcagcaacaatggagaacttttggttgcttgtaatacgttccaatgggatctgtattttcagtcatgggcttctgaatgcattacaaagctcgggaacgccatggtaatgtccctgaaaataatcaataacacaaaattgagattgggaaaaaagtacacttctagttctaatgtttctagtgagaattcagtattttcactactcactgcaaatagggaagtgacatgttccttagtgatgccgggttcgccttaacaaattcttcccattcctcagggtctatcctgccatctccatttgagtctgcttgactgaatgtctgcaagacaaaaaggagcagcatgaggatcgagtcagaaaaatcatctgaaaattatatttgagagagtaaatgcttagaaggatctttgttaactacagtacattatcgacaattgcctcgacagcgcattcggaaagatgtaggtctgattcatctagaagtgccaagaccatctccctgagctgtttcagtaagcaaacacaatctgttaatttcttgaaagggaaacaaaatcaacctgttaattgaagttcagggttaataatgaaaagtacaaattgccgtgaaagagagtgattcagattcacctcttctttctcaatatatcctgtccctcttagatcatagagcttgaatgcaactgccaagatgaggagaaagataaactgaatacgcctatttctgaaaataataagaagatgaatgcacaggaggcagggccatacacgcagtcttctctgatttaggcgcttttgggtggaacacactgagcgaccgtacaaactccccaaattcgattaccccatttctcttcagatcaaacaaatcaaacacctgccatgaaaaacatgcaacagaatgatcattctttgttcagagaagaatcaaacaagatgaccatttggttggccatctcctgcctgctgacagaatcaggactgaacaagaacaaaccctgtctgcgaagagattcgcctttctgctgttcctgaacaaggcaagctgaaactcctcctgctcaacaaaaaacacaccatgatcagcgcattcagaaggaacaatggtagtacatcatcaagaagattggcatcccagaaacgccattggaggcagctatctaatcaactctgcttaaatcaccttgtggatgaggccgtccttgatgatggaatagctcatcttgttgtacagctcgcgcagcgcctccacctcgttcaccgtaactgcaagaacactgcaaaatcatccacaatgcagaggcaaaacaaacacacagccgttgtaacttgtaacaataactgcttaactatcaatggtgttgcatatgcatcggtgatgtaattaaagtatttaacgagtgcaataaagcttccattatcttgaaaaaaaaaacgcataggtgaagaggtgctcacaggtggtttgggcggcgaggacggccggctcctcgtaccccggcggccgcttgaactgcttcgacgacgcgcatcccatggcgacctcgccgtgaaatccgaacgatgccttcgccgacgagaagaaactagcctactcagctactctccctctctctccttgtctccttgatatcatccatacacacacgtattcgcgcgaggtgaaatctgaattattctgacctgagattacggggagaggagaagacaagaagaggccgaaaattttctggagaagcgtgcggaaaaattttgtgggcgacacgcacgcctccgcctcggcgcctcgctggagtctcgctgtgtcgcagcttacgcaagcccaccgttattttttatagcgagttctccggcgctccaagtcaaattcgctaagcatatgtcgccaaaaaaagaaaaaagattgcgttttttcctgcgtgcatttggcgatcgtgtggactgtggacctctgcgctccgtgagcgtgacagcttatagcaagcgtaatatagaccgtgtttagatccaatttttttttcaaacttctaactttttcatcacatcaaaactttcctacacacacgtaaacttcaaactttttcatcacatcgttttaatttcaaccaaactttcaatttcagtgtgaactaaacacagcctataatcagctactagttctaaaaattaaaacatcatttataacctacttacacaatagtactagttagttatagatatatactatattattaatacataattcatctatttctcacatacttcctctgttttatattatataaatcgtttaactattttctcagtcaaagttctttatatttgaccaagtttataaaaaaaatcaacatctataatacagaattagtttcattaaattcagcattaaatatatctatctattatatactaaaaatccattagactttttacaaacgctcttaagttgccacgtgagatttctataaacgcttctgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggggggtcgggttgctc

SEQ ID NO: 80631 - DNA, 8339 bp, Oryza sativa
accaaatttctttggggcaatacaatccttaagtggagccaaaacatccccgtactgtttttcaagagactctatcactgctttctcaatatccgcaatagccttttattgtaaagcaaggaaatagcacatgttaagttggatttctttgctgtgcaacagttcaataaaggtcccatgaatgatacaaacttacattctcaagaacaaatatgtattctggccatcggcaaatgataacctcgtactctgtcaatgtattcttcagcaaatcatacatctcgtccacaaaaggtgtggtcatatgctgagtcctaactcctgaccatttaacctgatataattggagaaggtgatgcataatgagatacaattacaaaatatattgactgaaaacctgggtggacaaactattttagtagctgccagggcacagtacctacatataacctctccaatgttacacaaatggagaataaaagcaaagataaatactggattaacactgaggcaacacagtaccaatagcaaatggtatttgtcatatgaagaacctgtgctaaccaaacatatcatagatcaacaatgaacaggagcaaaagaaagagcagaacctaccttatccatcctgcaattttccagcaacgtcctgcgcttgtcttcgatccataagacaatgtacaaatgaaatagctcttttgcgtcaacaccggctttaattgggctgtgcagaaattcaaattcagtcttgcctagacaaggcatgagaaagaagagaacctagcaaacacataagaattcttttttaccatatattccagctagcaaggtccttctgaaagtcagcagttgcaatcaccaaatcagcaacaggtgatgaagggccagttggagggcatgccacaagaaaagcacgcagtctatttgagagttccacactatagatggacgcagctaaattggggaggtcaacaaaactgtagaagcagagggacaaacataaaattgaaatgattgatagaaaaaaatagaaacaatagcaaaagcaatataatcagtagaatagtcaacgcgtctaaatactctacaatgaaactatgcatacaaagtaagtaatgaataacagtacatggtaatatactagcctagaacagatgttgcaatacaatcacaatacctgggaagtatgtgctggttatgaatttcaatgtctgtaaagatttcattacgtagattacagcataatgatttcatcttctggtaagctgttgtaaaggtcaccagatccactcttatgccttcggaatttcctgctacatattcatcagtctcaagcatgtatcgtcttgatcgtttcctggcagcagcctggacatatttttgaataaatcaagctacagagttctggctatagaagataaatatcgagatataaaacagttgaagaatgacctggaaataaccgcataatctgagttgagcctctggagataatacatcatggagaagactgtaaagctttatagctggttctagagcacaagcagccaaaccagttggaggtctaaaatcttccactaaacccgacggcaaagattcattcagagacttgtaattctcaaataccatcgctaaagtttgctcaatttgctcctcaacttcacctaatatgcggttctgatgatacaattccagtgaagcagcacagttaagatgttaatgttacgtaagcaatttcagaaagaaaaaacaaaataagccaataaagcataatataatttattccacgtaactagattaatttgcctgttatctctacaacataagaagagttggtgatggtgttggtgtgctctatggtgatcttctatagattgatacatgtatacaattgtgtaccatttgtaagatttaaaataattccataccgtatatgtgcttacatatagatagtcggttgatacaaatttctttagttttacatctgaagataattattctagcatttcttttaatattagaacatataaaatacacattcatttgtaaacagttagcatataggtgcagtactgctattgcacacaaggataacataacatcaacacaaacaagggtacacccagtgctgaaagctcccacacattattgggtgtaaggaagggaatttcttggataatatactatatagcattaacattaaatcatggcatttgctatcagatgtgcaacagaacttgctgttccaggggaaatatctgaagaaaagaacagtacctcttgatggctcaatgcagcagtgccttgggtcttcattagtacgggtaacaaaaggtcatgaaccagattgagccaatcagcagtaggggttgcaacatccatgatataagagagatacctgaacaaggagtcaagggctagcactcagcaatagcaaaggaaaggaaatgagggaagatgacagatatttgaaaaaaaattatgatatgatagaaaaatttaaaggttctaatcaactgctagaacagccttgtgagtcagacttaaataatctcatcaggtattgtaaatatttcttgcatctagacagatcaagaaaagggaacatatggcaagacttaagcaagttaagtcacaacgtcatgccaacaactatatgctaaggctgagttctttccccaactttcccaactcacctccctcgttttacgcgcgcacgcttttcaaactgctaaacggtgtgttttttgccaaaaaaaaatctatatgaaagttgttttaaaaaaccatattaatccatttttcaagtttttttagctaatacttaattaatcatgcattaaacagtcgcttcgttttgcgtgcatgggagggagggttcccaacccatgctcacgaacgcagcctaagtaaaagtgatggttattggtcctatagtaatagccaaatacctcagctttgtgtaggcatctgaaacgccatagtacaatgcaaattctgtcaacaaccatttccaggaaccatgcaagatgagattccgttgttgaatgtgctgtgctttcattgcaacttccaaaacaatatcataagccacagtttctgcaacagagccatactgcaaagaaaatcacggccatgaaaattaaatagatgtcaattagtcaagtatcccttccactcaatagagcacatttttaatctcaaaatggataggccatttcgaatcaggcagctacgaaagaaaggtatacttttaaatcatgtttatatgacttagatcctgataaacagactaccctgttcagacaaattcaaatctacaatgtaaaatcactcttgtttcatgttattccatcagaatgaagatttaggaaacatttcctttgctgacatgctggaattcatagtaacataaataaaagaaaacttcagtcgaatcatgatatgtctggcaagaacaaagtctacagtctaaatacatgataaaggctgttttacactcttttttttaagtgacaaccatgacaggaaaatataagtaagttgatcaatgattgatatactgttgtttccatgttatacaggaaacaatcaaatggtaaaaaatgccatccatgaaaatcatccgtgtcatttaaggtgttcagtaaatcgacagctagcaaaaggagtgtgggggagaaatgagcaataggttacagtgctgcaattaacaggtatcaaataaattaaattcacatgaatacataacatcctaagatgataagacctgaatttgcagaacactgaatcagtaccttcgtgttgttctcatctgcagcagttgtgtagtgtatgtatagctgtatgcggcctacgagttcatgctcaggttcccggtatattgaccaccaacgaagcttgtcagtctacacaagaaagttgagaaatactgtaaggaacaaggattttgaagaagtcatagattgtacaataaccatttagagcaagtatgaaaatctacaataacttctatttaaagaacttaaacagagagtagcaagttggtttggaaaatcatacagattcctctgccattgtagcaacttgagcaacaacacgtccacagggctttccttttgaatcagaaacatcaatgatcaaatcatctccaaggctatccgggaagctgaaatatttacataaaaatattcagcctcactaatctcataatattcagatttccaggcaaaacaatgatatatgtgctcaaagaaaggtcttgctacatacaagacatgtgtttcaccagatcctggctgcatcggtacaacatcatcttcaggtgtacttttaagcctcaattggcaagagtaagtctctgaggcaaaaaggacatgatggattcagttagggaactcaatgttaaaagagaagtgatccatatataccttgcggtgtttcataggatgagctgttgcgcagggtagtcacgccaacttttagcacaccagatacctgcttgatgtactgagcacttgcttgcatgtacgctaagctatgttttgaaaaggaactgttagcaggtagctgtggtaaagtttggatccttcgaaccgactcccatccagaggagagtgtggattgtacatttgacaaacggtaccgaactgaatttagtttcaccatcggcaatgatgagaaattgcaaccagatggtacatctacagacatccggactttccgcactgcaattggaaatattaactaagttagcactatcatcttggcattcctttgcatgcaacaatgacaatgcaaatcaatattctggtaatggtagctatgaagatgtggatataagtagttttcataaacagtaggggaaaatagccagtgttgggtttccataccttgaaccttcatcttgccaattgttttcttgggtttggatgcaactccatcgctaacaagctcagatgtccgttttgccatgagctcttcttctgattgtagaagcacattttgcaggctaaaaaataaacaagaatatcaacttaagattgtattactgtttatgcactaaggatggagtgaaacaaatatttaagcactatcagcatgaatgtgcattagcagtttagcacatggataacaaatgtttaggttatgtttacaagaggctagatccaaacactttctatcagttttgacttctaaagtatccattttaaaaaaaggaaagtacaataacaatttactcaagatccataaatatttccaactgtagcaaatcaatggacaggaacaaccacagcagtcaagtaaaactagaatgaatagataaattttgtatctgaggaatttatttaaagatttttcaaagtacaagaattggcaattgcagacagaaacttaaagcactgttcacctcaggttcagaataggcaggtataaagccagcaaacatagacagctacagtagttaatggcattttacatactgtcatattttatgagcagaaagcattgttcatgcataaaaaataactcaccaaaatgtatttcgcagaagtgtgcattcattttccagaaaaacaggagcttccatgcaacctctagcccatgcatgaaggcacaagcgaacacaagcatcataagcaagaacagaataccagggcccttgcaaacttggataatttttttaagaaatgtgttagtagtgagcatagtacaccagaacaaattatgacttgcttactacacatacctggcatgaaacgtggggactcgaagaggaattgaactagatggtttgctgctgtgcccaggatttaaagtgctcctacataaccgaacaattttacagaaataaatgcaaacataacaaaaaaaaacttctcaagaagtatttaacaaataacatgtattacaaaagctacctttcacttttctcaggcaagttaggttccaagccatcatcattatattcctcttttttgacagtcgaaccatcgcatacgtttgcatcaacattttgagaaacttggcttatttcctgatcataagcatgtattggcggtgcactgggtacatcagatagtccatcctgcacataaaaatcaatcatcacaattacacaacttaaaagtaacaatgtcatcgtgcgacatgttcaatcaacacatcacatattgttccctgaaaacttatcaatataaaaattctcaatatatatgatttcctttggctagtttggatcatttatagaaaacttgacaacaaaacattccccagaaaactgcattttaaaaacggttttgcatacaagattacagtacctgctcagcgcacatgcttttctcaagaggaagcaaatgttccagatttatgacagataatcctaggagagggtttctctttagaatccagaagcaaaaattgtttttttaatcatccagaccataatcaaagtgaactaaattacaattctgcttcagaaaatattcatggaaccccaccaaaaaaaagaaaaagaaaatattcatggaaggggggaaatatttttttttctcagagaactatggagttgtggaggacatactatcgaacaaaattctgagatatagaatgcaacaaacagtatcaggtaatctagattctggacagatgattcctcaaaacaagaaaactgtttcatttttaagtttaggtgctaattttttttagcagctggttgcttggtgcgggttcacatactactgaccataaacattttcagctttatgcaatacaggcttttctttcctaactcaaccgaaaggtgagtgcttgtacatggtaccgcagaatgaagtaaaatggaaatgacaagtaatgctattgctttcacagaaataagatactgaagctgaggataagaaaatgaatatgctttacaggtaagcgcagaaacgtaccatttgagaagatttcacattgtcttgagcagggacatgggcagaatacttatcctgttgatatgttcttgagtttaaaggtgcagtgcggctgtaattctctgcagctgccatccgggttttcggaactgcattgttcgcttctcttcgcgctgggccgttatgagagtactcagatgcatacccacccctcgaggccacacctttgctccgtgtctccacctgactggagaactccgagctcccagctgagtccgagtactcctcctcctcaacatatctaccgacctgtgcctggggccgccgtacctgctgctgcttcgtccttggcagtgcagtgtctctcgacgagctcagatccgagtaatcgctcgagtagtaactcggcatcccgggaaccgtagcataccggtactggggcacggccgtgcgcctgagaatgtcctcgcggcggggcgacgagtccacggagtatctgccgctgcacacctcgacctcctcggtgtccgacgactcctccatgtcggatcccgaggcgacgctgccgtcgtcggtgcgcagcggcggcgccgccgcgcgaggcaggtgcccgctccggaacttctccggcggcggcatgccgaggccgcccccggcgccgcgcaccgcgcggagcgcgtcgatgcggtcgtggctgtgcaccgccccgccatggccctgccacattttgcatcaaccaacaccaccacgcagaaaaaaaaaagcacgcgtcagtgacgaaaacccaacgcgacaccgagcaaaccagctagggctcgggaggagcacggcgagctcgaactctcacctcacgaacccacttgagggcgtctcgatctagcccctccgtgaacatcatcagcgcatgcgagttccaactgaaacggacgaacaaattcagcagaaaaaaatcatcaacaaaatttcaagccactcacaccaaatgcatgcgatccaaacacccacaaaccaccggggaaaaaaaatccacacaacgcagattcaagcacgacgagcaaattccaacgattaggaaccaaatccagcagagaaatcccacttaccttgcacccgagccggagcgcggattcggcgctggaactgagagcgacacgaccgctctggtttgaattaattcgaaaaaaaatccacgcaaacaattccacccagcggctagcggaggcgacagcgaccggagcccggaagagagcccgagtaggtggtagggaagaggggaagaggagaaggaaagggacaacgaagagtttaggcttgggtcagtgtgggagaagaaaggaaaacccactgtaaattttcgaattaacggaaaaaaggcagggtaatttacatgttagccctcgtctggttcctcgtttggtaaga

SEQ ID NO: 80632 - DNA, 9931 bp, Oryza sativa
gtaaaacaaaggattgtaaaacacaagaaaaacataggaatggtcgtttgattggagcgcaggaaaaatgcaggaatcggatgagagagatagactaaaaggaaattttccaagaggttggagctcttgctaaattttctccaaaatctacatacaatgtgccgtttcatatgaattttataggatttggaaagcttcgatcctttgaatcaaagggccaaataggaaaatttcctataggatttgaatcctatgaaatttctatataaatcctttgattcaaagaggccctaacagtaacacacaactaggcccttgctggctgctaatgatggtagggattgccattttgttcctgcctgagctgaaacatagctgttgattgtttgtaacgtgaatttttcatgcatttgttaatctataattccgcaaagcgatcatgtgttaatgcaaccccagcattttcatccactaataaagtaataaacagatggttaaattcaactgaagttgttccgcgtgaacttctctactccaaaattcaggtactagaagcaattcatgcatcgagtatgaacataaaacgctaacctgtacaaaacaatatcaagaacgctccaccgacactaccgatccacccgaccccagcatttccttggctcctcgtcatctgcaggtcgtcgtcgtcatgagcttttcaccgatgtcgaaattgtacgtaggtgtcttccaagcttgagccaattacgtacctttttggcttttgcagcgtggccgatcgcgcggaaaggggagcggtttggtcgggttggacgagaaatcgacggggcaccccggcccgcccgactgatgagatttcacacggaaagcgttgcgcgcgagcgcgagagctgcaccccacccaacacgtaaaggttgcgtccggatcataacggtgaacgttcaggggcaaacctggaaacacagtattaggccattcccaatgcaatgactagatgatgtgtatagtattaaataagctgccacctataataaaaaatgatatgacaactgaataaatgaggaaagagaagaaaactatgtctcaagacatggtttctacacgatatcaaaacatcatgtgagataaataacattaaatttaagtatgaaatagtgatgtttgcattagaatagttgtgtctagtagtagtttcttaatgatatggagtttatagaaactatacgtttagattgggaatggccttacgtaggagtactcgttaatgttcctcgtttactgagcagtgtgaaactgcacgtggacctgaagcattttctccttcgtttactcgatctgcttccttcgacactacggaatgtcagtcagctctgatatgtcgattgtagtgagctgtttttttttgttaatagcaagtggtagtgcaaagcgtttcttctcccgtgtaacacggcaaaatgccatgttgccatgggacctgaggcttatttgcttagcagtgcgggatttgctgaaacgaaaccgattcccgttttgcgtggatggatgcttcacgccggctggatccgagtttcggcgtggatcacttttggtgtgagctaatattattttcgacgtgtgtagagctaaacccaactttatttcgaaccgggggcggaataatagcggaatgtgatcgtgccgtgtaatgattccaattgtcgagtaagcatcgttcgtgcactttgctaatgtcctctcatcgagtattttacatggaaaattcctttgtagagtagtactactgtacttgtagctgcccaagtgacgagggagttggtgagattttcgtcccaggtggatggtgaattggtgatctgtgtcagttcatcctatgggccgagacaaacaaaatggatttcaaagcccatccaaaacacgaatacgttgtacatgggcctgggcctcaagtgcaaccacaggcgaagccacgtcgggcgtgtcaaattgtggtccattactcgaccagaaaatcccccccaaaaaaatcagaaaaatctactactagaaccttcctggcttcgtcgaagcccacgaaatccaactaccgccagccatctcacgggacgggagaatcgccggaatcggcgcgattctccgggcacgaatcgggccgagaaatcccgggtgcgcgctgcgtcgaagcggcgcggcgagaggggaggggaatgtggtgggagtgggaggaggacggcgaggaggcggcgcggccgggggaggaggtccccgtcgacttcgacttcatctccctcctctgcaagcccaaggtgggaatcgccacgcccacgcctcgtctcgtctcttctccttcgatttctccgccgcgatcttttttttttctgtggcacgtttgttcatgacctgagttaaccctcacgggcgtttggattgcgatagatgattgctgtttttgtgttggggggagcggatcttgtagatggaatgccgcccgctggttgcgattgtgctgtttccttttacccaattgggaattggctcagggaccccgattcgtgaatgcaggattactacaagattctggaagtgggatatgatgcgtcggaagaggcgatcaggtcgagctatatacgtcttgcactggtcagtgtttgctctaacacggtgctgatttgtgcttcacattcttgaatcgtcctgtgaattatctcgtcaagtaaagtttggcctaattccacttttgtgcttcacattcttgaattgtcctatgaattatctcgtcaagtctagggattccacttttgtgatggtttacaccaatgcctgcctaatgatgtccactctcttcattcagaagtggcaccctgacaagaagcagggcgaagaaaatgcaacctccagatttcaggagattaatgaagcataccaaggtgagcaatgaagttgtttaattgatctgatacgtctatgtctatgttaacttcaatgtgaaaatagtatgtgccgtactgcagtttacctttgtttttttggtctcttgctaacataataagttgccagcagcaaatcaaaatagatattaatgttcggttgcatgcagatttatctgtattagtgaatttcataactattactcctgagatgcctagacatggaacaattgatgtcatctatgtccaagagaccaagatgttattcttgaatttaaatacaaggaattgctaccacaagactaaaggatgtttggctgttctttcaattgtttaggtgccaatgattcgtgtgtttcctcatttacaatggattagtagttactaggaatctgggttgtgcttaattaaacaatccaatttctctcggcattcagttggagatagcttcctcgtattcttgtcaagtagattgtcaaatcttctggagactaatgcacttcgaacaggagaaattgctcattgcttaacacaaaaatgctcagataatctatagtcaggctagctctgtgattgaatcattgctaagaaattatgtgaaacatgatcttagttcgttgtcacacttgagccacatttatggtgcaccttgaacatcttggatacattcacgtagctttataaatttatatgcattggtgttactatctgtgctcactgacagggcatcttttcgtaactaatctttcccattgtaaagagtgttcttcagtttgatatatcaggtctcattcatgataccataactgtttttcacagtgctcagtaatccagccaaaaggcgagagtatgacaagaaaggcattctttatgttcaagatcataatgtagtggtaagtccccgccctcctacccccacccaacacacacacacacactgaaagaaaatctatgttgcacaagacacttctgatttttcataactctttcaggactatctgaaccggcacaaaggtttaatccttacttgcaatggccttggcataaggcattcagtatggtgatcttactcaggggtactacagtctgcatccatctgctgtctttggatggtgtgtgtcattgtaaaatctcatgtaatctgcaaaatgtagcacggtcatgcggacctgccacttttgggaggaaatgatgacgctgagttcatcctggtatcctacaacatagatgattcttatttggtgatcagttgttgtagattgcacgaagcaagagttctaagttacacatacatgtcgcccctttgtgtaacatactaacataccatatgaaatgccagcacgcacttcaaaatatcttgttagttactgatgttattgagcgcagctgaatggcagggggaaaataactcggttaaagacttacctggcaagttttatattgcctttaaaggggaaatataagtacttcacataacggtatctgcatttcgcactgatgcaactacagatgtagcgatttgccagagataggatttaggatttgtgatttgtctaaaaagttctctatgctacttgcttagtatatatacaatatatttcttccaatgtttttcaaactacagtgttttgacaaatggaaagtggtcggaagggaattagggaaaatatcagctgatctgttggtgacactgcttctcccactcaattttcaatgtgtcaaaactcaatagttctttacaacaaaagggacggacagttatgtgctgaagcaatttaccaaatatgaaggtcgacccatttgatatattattatgtatccaaggtacacagcttcacagttggcggcactttcagtatggagtatatacatcggatcaagtggtaaaaaaaccagaaagacttgagcaagctccgctctaacaaacaaaaatctatggatgtctgatcatatttgaagcgaaagaaacgtggcttacatacacaacttttttccctttcagtaatagaaaaaagaagacctaataataagttggctgcgaagcctaacatacaccataggatcattcatcgtgagctcaaataatcctctctttcagatcttcgaatttcgcaaacagtttgtccctgctttcctgcatatatgataaaatgatcttaggatcacacaacaggaatgactggcgcttgctttgtagggagttgaaaatgtaccttgaagaggaggtaccgtgaagtgaaccaaattgagtaaccagttcctatgagttcaagaacttttggaacctgcaatgagatgatcaagcggtttaggaagtacagtgtaaactcttcaagtaataagtacgacaaaactatatcaaccctactactgctgacaactagaactacatttttcagatactggacaactaggactacatttttcagataatggacaactaggcgtatataccaggagcggtttgaagacagattttaactattttcgatacatacaaatttgtaaacaatgtcatatctacatatttggtgaaaaatgtcatatctacataccaagggaatggaatcgattgcagaaacaactgaagatagaacccataggacaaccaaagcaccggatccatagaggacaagagttggtgtcacttggatgtccagctgaaatgaacgattaaaaaatttgtgtgagcaacagtactaaatgcagtacagcaaaggcgtttcaatgcctcatcccgtatagcaaacacaagaacaggcaagctgaatatatggaaatggatgcaggaaagatgagattatggtgatacatacactcgcttctgagttaacagaaatagaaggaaaaaaaacaatgtggtacgctatacatgaaacaatcaaacttcaatccatagcaagaaaactatggcatatggcatttgtttctgtctatcatgtgttggggtttagagctctgtctctgcaaacctcatgctaggtcctaatcacccagctcacaaactctcacattttggtacacgagtcggtgactgaactcaattttacattttgagatctatcaagtatgcatttgtcattggattcttcaccatacttctgtatgcaatattcttcaactcgtctctcctctcaatcatttgacagcaacaggtaattgggcattgatatgtcagaattggcgatcaattcagaaacatcaacaggtacaacgaggcaataccttgctgaggatgtcatccaagccgccgtcctcctcggctgcccccgacgacaccggcgccgccgccacggtctccagagacccgccattagagaccgccgcgacctcctcgctcttctcctccgccggcggcggatcgggcttgtcctccgtgacgacgacggtggacgccgacgccgacgcgggctcctccgatggcaccgggtccggcgccgccgcgctcgcgcaccgccatcctggcgacaaccatcaccaacagcaaaaccgtcagaaagataatcaatcaatcaatcaaaaaaaatcgtggcgcgttcgggcacctcgagtcgggaggtggcggttgctgcggcggagggtggcggcggcggcgacggcgggaggagcagcgcggcggtggtggaaggaggaggcgaagcataagggggcggtggcgcgcgcggaggcgacggtggagacgaagagctccattttttttttctcttcctcggctttctgtggaggcccgagaaggctgggggtttgaggtttttgtgagctgggaggaggatgagggtggtggtgggctagtggctcagtgagactgtgcgagtgagctgtgcactactactacttgtgctgatgctgtccgaatttttcttttctttttctttttcttctcttttttcacacaccctgattttttgtttgtgcttttggagggtgacatgtggcgctttctcttttgctcgctccttttctctgagtaccacctgtgtgtgtggtgtggtttcgcattctttggatggatctactttcattttcattcttctttttctggtacaattatactccctgtaactgtagtcctgtaccatgcaatttaactgtagcataattcgtattctagaagattttggcctgttaaaatacaaacaaattgatagtgtccgtagtacatgtggagtagtatgtgctgcccatttagatcgagttgtctgggtacttccacgccaccattttttccaagtccataaaatattttctatttattttagtacggcagattttcattcgctagccaaccatagaactgacacattacataggcactttctctttttcctgggataatacattaacatttggggtaacattttctagtggaccaaaaattttgtcggctggtaacacggcctttgagaaggcccagtactgcaggtataccattccgtccggtctccagcccgcttccttacgttgtacttagtaggataatttgggctggcacagtaagtaggcctagcattttcaccgaccacgcgcgtgggcctggctgggtggtgacaatgtgtgtcatgtggagcccaaattggcagattaaactcgtgttagcaagcgaaattaatgggcccacttgtcagtctcatttattctcgttaaacaaacaggcaaacattccgagccgttaataccgtagcctcgttactcgttactcactccgtccaaaaaaaaataaatctaaaatatagaatgtgacatatcctagtagaacgaatctggacatatgtatgtccagatttattgtactaggaagtactatgttggttttttatgagacggagggagtagccattacccgtgcagacaagcatggctccgttcgagcaggagagattgctgggagattgaggagaaaacatctacttttctacgcgcacacttcccaaactactaaacgatgcgtttttggcaaaaaaaaattcttttgaaaagttgttttaaaaaatcatattaatctatttttaaaacttacaatagttaatactcaattaataatacactaatggctcacctcaccttattttgcgtatcttctcaatcccctctttcctatcctctcaggattcaacccagttatcatcatcaccagtattaatagtttccagcccaaggaattattttgtttcggactagaagtctcagacacgatggtatttgcttcggattggctaaggatttggtgcatatttatcggcccagcccaaattcttatcgggcctagcccatccggtagccgccataaccccaccggccaccgtggtcagcttctcttatcgcgttgcccaaataattacacgaatcgaaccaaaccctagcttttcctcttcgattcccgatcccccacccagcgactcgccggaaccctagccctagatcccgcgcggcttgccgccgtgctagccatggcgtccctcaaggagctcctcccgacgcccaaggcggcggcgtcgacgttctacgaccacagcagcgacccgtggttcaaggagcggtatggcggggagtcggcgcaatccgacgcggcggcggcggcggcgaagccttcgggccccgccaagcccgtgccgccgtacgggaagcgtggcgggttcgtgccgcggcggccggaggacttcggggacggcggcgccttcccggagatccacgtcgcgcagtacccgctcggcatgggccggcgcgacgagaagggcggctcgaagatcctcgcgctcaccgtcgacgccaagggcagcgtcgccttcgacgccgtcgtgaagcagggtgagaacgcctctaagatcgtttactcaaagcacagcgacctcgtgcccaagattgccacggctgattccgaggcaaccgcggacgacgaggagtaccagaaacagatcgaagaaaccactgaacgaactaaagctgccttggagaaggttgtcaatgttcggctctccgccgcacagcccaagaatgtgccgacgcatgattcagagtcaaagtttatcaagtataagccatcgcagcaatcggcagccttcaattcaggtgccaaggagaggattattaggatgtcagagatggctcaggatcctcttgagccaccgaaattcaagcataagcgagtgccccgcgcttctggatcaccgcctgtcccagtgatgcactcgccaccacggccagtgacagtgaaggaccagcaagattggaagattccaccatgcatttcaaattggaaaaatccaaagggttacaccataccactcgacaagaggttggcagctgatggaagggggctgcaggaggttcaaattaatgataactttgcaaagctctctgaagcactgtatgtggcggagcagaaggccagggaggcagtacagatgcgatccaaggtgcagagggagctgcagctgaaggagaaggagaggaaggagcaagagctaagggcacttgcacagaaggcgcgcatggagaggactggtgccccacctgcacctacaggggttcctgctggtggtggtagaggtgctgttgatgacagggaggaagatatggatttggagcagcctcgtgagcaacgaagggagagtagagaagaaagggaagcaaggattgagcgtgacaggattcgtgaggagaggagacgtgagagggagagagagaggaggctggaggccagggatgctgcaatgggcaagaagagtaagctcactagagacagggatcgtgatgtcagtgagaagattgccctgggcatggcaagcactggcggtgctaaaggtggggaagtcatgtatgaccagaggttgttcaaccaggataaaggaatggactctgggtttgctacagatgatcagtataacatctactccaagggtctcttcacagcgcagccaacgctatccacactttacaggcctaagaaggacggtgattctgatgtgtatggcgatgcagatgaacaactggggctgcaggaatt

SEQ ID NO: 80633 - DNA, 1607 bp, Oryza sativa
tggagtttgataaacaggaggagaatgatcccttcggtcttgatcagttcttgactgaagtgaagaaggggaagaaagctgttgagaagattggaagcggaggagccatgagggcaagtggtggatcctcaatgagagatgattacgagggtggaggatctgggaggtcccgcattaactttgaaagaggtcgttgaggtattagatctgcatgttttgttcagaagtttctccatgcattccaaatgttatctggagggtattctgttgagaatatcaacttcttgatgagaggacttgatgtctgagttgtcttaatgcaacgtctacttccaaggggcatcttaaggagtgtacctgtttagatcctgtgattatgcttgttgtttatctatttgtggatggatctgtaagcttaacttatcatcattccatatcccttatattttgtggtgctttatgaagtctcgatgtgtctggctgaccttacattttctggtactgtaccaagtctttaagatgtatctgcctatctggctgaaatactgagacacgggatacatataaattccgtgttctgttttttcacaagttctaattatttcatgctaccatgattgttggctggatggatttctgggtattgccaatatcggtatgttgttttggggatattcatgttttgtgcaaatagtgaattcttcgaaaattttttgtcggtaagcattttctgttgcaagactttgccggagcattccctttgcttgcagttgatgtggtttctgtagtaccaactttcggattaaataacttctcttttgtgattattactggtaagatcatggcataattttaaaacactatccatcctaaaataaataaacttaatacatgatatgatatatcttagtattagaatctgaacagatacacactttcagtttgttttgtcttttcctttagttatgtagattcagccatagtgttgtgtttttcttcaggtatgcagattcagctataggaaattaggaacacagtgaagaggaaagttttcattagcacgttttcttgtgtgaagcgcaaataacaggattttggtgttctttgattttggccaaaatcttcatggcatggatggaattttctcaaagctgaaaaccgtaattttctgacgggctgagcaaattacgctggctgataactccggcctgcttaatgcctaggcccaaacgaagcagccgagcaaccttgaggttccatcggcacccctgttcggctacaaaaagcacctcactttcttccttgctcatatctgagcccaagatcctgatgctactcttcccagtgacaaagagaacctcggtctctgacgaatttttttcatttttaatttttttcttttaatatttacagaaataatccatcggcgcaaaaaattacaaaaatagacccctgccgccctccactagggcggcaagctgacgtggcaaacgggggagggacgggcggtgacggcagacgggagagggagggttttttttgcacgaaaacccttgccgccctctggcccccatgcaaaaaagacagcccgagcctagcactttttg

SEQ ID NO: 80634 - DNA, 2117 bp, Oryza sativa
gcatttagccccttgccgcccttacagagagcggcaaggggctaaatgcaattttcgcagacggcggcagacggcgccgtcgagccgccgtctgccacgttagcttgccgccctccattagagcggcagggtctatttttgtaattttttgtgccaatagattatttctgtaaatattaaaagaaaaaaattaaaaatgaaataaattcgtctctgacctcactctgaacccttctccttttttttcaacggccaaacaagattgctttacgctatattgataaaagaagtttaagtacaaagtaaaaactgaaagaaaaaggaaaaactgtacattactgactgcaaactgcaaatatgcttgcacgtcagtccaccttattcctcatggcaataatctcgtaaagtattttgcgtcggtcaactctagcaacccaacttgtgattgattcttactctgaacccttaaccccctcaatgcagccatggccgctcgtagccgatcgatcgatcgaatccaaaatctcccaaattcagcagctaaaatcaggttcacgtcaccatgccgctgcaggagattccgcaccaaaggcaaagaaagaaacgttctttgctatccagcatatcatagcagcgtagccgtcgtcctcgtcgtccccatcgatccatgtcctacgcggttatcaggttatcatgacactgtttgaatcggagagctttgcattcgcaacgcaaacccagtcgccatcaccgaaacgaatgatcgaactagagagaggaagagagagaaagaggtaggtaaacagatggttggcacgggcagcgtgacgtgcaccggttttccccccgagattatattcggatttggtgttcgctttatcatcgagtacaactgaattgtcccatcttttcttactactagcttaagctgtttttaggcttcctttgattcgaacaaaaattatagaaattttaaagtattttatttctatagaattttttcatatatataaacatttgaatcaaatgaatgaatcctatgaaatttctacgtgaccttattacatgcaagtttacatgggaagttttctttgaatattttatctcttctcgaattcatgtgttttttctacagtctaattataatcctatgttttttatattcctttgctttttcgttcctacaatttaaagagtctcagttgaactgttcggtctgtaactcagtaccgagtcgggtctcatggtggatggcgctgtagaatcagtcgatcaagcgaggcgaggcgacggcgaccgaaaggaaaggcacaccgtggtcaatggatggatggacggatcgatctcggccgtcgccgtcgccgtcgcctgtcactcaccatagcttttccatccgacgcaatgcacgccgtttcgctgcgatcgatcgagcgatcgatggatgcatgccctgccggccgtctcgatcggttctgaaatatcaacttgcaaaggcgatcgatcgatgcagcttacctttagaattgtcaaaactgcatcagccgctgcacgcatggcttgccaatcgtcgtctgctattatctcctaatcctgacgagtggatgtgacgaagtgttaaaggtgcaccgccccccaagtgaatatctgatcagtttggctttggttaagaggacctaattccacgtcattttctcgtcccatttcggtaaacaacaatcaaatcaacacagcataaccgatttgttcttcgagatacctgccggtgggtacacgaaccttttcttaataaagataataatgggtacatgaacctactcccggctttaattaatttgcagaatacaaacctaccttctcgagccagcctgccctagtgagaaaccaaccctttcaagactttacacgcagcaagatgttactgcaaatctgcaatcctaacttcagaatcaccaacttgtttctgaactgtagcatatcatagatattcatcaatcaccattcattcatagtactacctagtgtactactatcacacagtgccatgctactccggtactagcttcaaaaaggagtggacaagaattcgcacttagcagcaacagtagtggccagtggat

SEQ ID NO: 80635 - DNA, 5503 bp, Oryza sativa
tggtgcccggaggaagaaagaaaaggaacaggacgaatgcacattgaccatcacaattcacactactgtgatgggagaaaatgacatggagtagcagcagcagtagttcatgtagtatcatagcatagcaatatcatagcaatggcttgtttctttcttctctcggcatggagccatcaagatttgcatctgtttcggcaggtttggtaaaactgggagtgattaaagttgtggatgttaatgtgtggtgctagtagtagtaattagtttaggctccagttttatcaaagtgtaacgacttgcctcatgtagagtgcctacaaatttagatgttgtgttttatgcgagggaggtaagcttaaacacaggaatattgtgtgcagtaactaaatcttggaatatcaggtgcatggctataagcaaattttggggatgaaataaccatgccaatttcaaggggaatactagaatagtaataatgcttttaactatcggtgtacttttcttaaaataatactgatgcttagcgcgcgaatgacctcctagaggtgaaagaattttgtgggaattgacccatgtaaaaattcatgagttccaaagaaacatattttatttaaatactatatgaaattcagaagcaaataatttacatactactagattctaaagaagatagcccaggttaagggattaaataccttaaacatcagcttagcagtttatttaaggcaattaatcctactaatctttaagcctaaacctagagagctcgtatccatccaataggtccagatcagcctacttaagtagggaccatctttgatacgtgagtctcctctttttcacttgcttaggttgtgtttagttttttttttaaagtttttaaatatatggacacatatttgaagtattaaacgtatattaataacaaaacaaattacaaattacgcctgtaaactgtgagatgaatttattaagcctaaataattcgtcgttagcaaatgtttactatagcatcacattatcaaatcattgtgtaattaggctcaaaagactcgtgtcgtaatttacatgcaaactgtacaattgttttttttttctacagtttaatatcctatacatgtgtccaaacatttgatgtggcattcttagctaaattatttttatctaaacaaggccttactccgtattctctctaactacagtgccaacctctaccgcctggaccctggaggcctagagcttgtgattgtaatctagggctgtgtttagttcacacaaaaattagaaatttggttgaaattggaacgatatgacagaaaagttaaaagtttatgtgtgtagaaaagttttgttgtgatgaaaaagttggaagtttgaaaaaaaaacttggaaactaaacacggtgctacttaacgaaccaagtgtctgtcctcgcattgaattctacatctttgatctgcataatgcagtaatgtcctcgcatcggaccttgtcatggcaatccgcatcgcaaaatatcactacgtctgcagtatgctcttgcaactttacaagcctattccgcgcacacacaattgttcctcgttgcctcaaaccatgtgtgtttgatttctcaagcaagtcctttgttataatccgtcatatatattttttgcgagggttataatccgtcattgtaaccttgaacattgctttatacgatatatcatacttcctcaatttcacaatgtaagactttctagcattattcacattcatttagatgctaatgaatctaaacatatgtatcatggtggtgtttgaatttcctgaggatgaagataaagattaagtgtttcacgtaaaacgaggtggtaataacgtgtgactaattgggttttaaatattataaacttgaaaaatatattaatttgatattttagaacaactttcatatagaaagtttttgcacgatacacaccgtttagcagtttgaaaagtatgtcactagtatccaaattttcatccacttcttacattagaaacgaacggggttatgtgtttagattcattaacatatagatgtatatgggcaacggagggagcaatgactcctcacgactactatgaacgatgttatctggagggtgccaacagttgccaagcctcctcaataggagttgcgacgatcaattcgtcggaacttagtacccctctcatgcaacgagtaccttatcattaaggtggtacttatactcaacgagcatcaatggtagtgtttcgacacggtagcgacgtagatttgacatcaaaatcaaatacggtgattatctccctccaaggataaaaccacctttcatggagccagagaagaagctaagggtctatttagttctcgaacaaaaatttttaacgtgtcacattaaatatatggacacacattttaaatattaaatatagactaataataaaacaaattacagattccacttggaaactgcgagacgaatttattaagcctgattaatccatcattagtaaatgtttaatgtagcaccacattatcaaatcataacgcaattaggtttaaaagatttgtctcataatttacacggaatatatataattagttttttttcatatttaataattaatgcatgtgtacagatattcgatttaataaggtgaatttttttaaaaaaaactaaacaggcctaagctgcaacttcgcaatgtctcataattgttttatctcagtctcattttaccgaattattccttgctcccaacacaagaaatacagtactaagtacccacataggctaattagagtagagcctactgcttgcaaagtttgaaggctggtccggcttttcaacagggacgtgtcacacacccgagcagtcaattgctttcattgcttaaccgcccacactattgcagagattcacaaagcatggccgctcctgctgcctcacccccacatgcaacgcctcactgtacaaccgcgccgccgaggcaccgaccgacagccgggccccgcgccacgaacgcttcgctacgcaacaagccgagcaaagccaagcgcggcgcgacgcgacccaactggacttctcgtgcgctcgctttcctctgcctccccccaccccccgacgtgtccacctgccaaccaaagtttcccccgttcggcgaggcggtgagtgcaaagtttcggcgtcgtcgtcgtcgtcgtcgaaagggctcgcgcgcacaacggctccacaccaacaagggcagtcaaacttgcgtggtagcgtagtcatcccagtcggtggtttgttgtcctcctcattaatcttccggttgatctgtgcggcgtgcaactcgttgtgtttgttcttgaggtctttctgagtggaacatctcttggttcttgttgttgatggtgcaatatagaaacggtaatgctgcacgatcctgcttcattaccgccgcgaatcctgataagagagacagtgagtaagagcaggtacaatagcagattattaaccagattattaaccagctataaatatattttaatgatataaagatgaaagagaaaagcagcggactacaaatctgtagccagctgcagcacggactccaagagacagtgtgtgtatgacagatgggaccatatattaatagtatagtaagcaactattgtatgaattggctattagattggctacagatgaattggagctagtagagcaaggataatagtagagctcacttcatactattagcccatcttaaagccaacatatataatggattagctataaggttggctacaactttctttttctctctctatctctcacatatgcatttaatgtatttaactaggagcttgtgttaaactagttcttgcatgaaagccaatatgcttgattttttgttatctctaactcattattatacttactcatagtaggctatactattaaacttgctctaaaattcaatactctcgattcctcggcgatcgcgccaaaaacgcgacagccaaagcccaaaggaaaagaagacacaccgtgttgatgacagtacactgtagcagtgtagcatcagatatctacacatggctcaaataatcatgcaacgcatgggatggtaaaactggagaagtggatatcacttcgcacagatacgaagacacaccgtgtcgatgacagtacactgtagcagtgtagcatcagatgtctacacatggctcaaataatcatgcaacgcatgggatagtaaaactggagaagtggatatcacttcgcaaagatactaggaccagccgtattttacctcggaactcatgaaaactcgtcggcacccggacgcagtcgcctatttgctcacgaggcctcaacttcagagggtttcgtggtttcgtctgtaccgcacggtgtatggtatccgaagtgctcggtcgcatatattctgcacgaacattcagatttcccagttagtaggaagcatgaatagaaaaacgttagacggaaggatgcaggaatggggcaaaacagaggaacataagacacataaagatcagttcaaaacacaggaaagaaatattggattagaaatcaggtccatttgtacatttgcttcgtatggaaaaagctttccatgagatctgagctcatttttatttgcctctcagatcaaacattaggaagcaatccattgttccaaacaatggatatgcaaaatagattcaatccaatccaaacgaggccttatcccaggcctagattacaggtcacgtcctagtccctccataagttttcagccaagttccattctttttttcttttgtgcaaatctgtctctggttagtctctcctaacaaaattcaaacgagatgccccttcagaagaaaaaaaatctaaatcgagataaccttagtaagagacaaaacatactagatgatatgagtatatgacttgtcttttcggttccagtttaaaaactgttaatcatctcctgtttgagtgcagtatagtgaagcagctctatagtgatctttctggtattgtaaatgtggtagtaggctagtagcagaaaacatttatttctttgcaagctaatgatggattagtgattctaggaaatggatgaagaacaatggcatgaagaggagcagtttaagtctgagctgaaatgtcgagccactaaattttcctggcactcacaaacaagcaagttgcaaagtctacccattgtcctccctagagaggttgtaattgggaatataagttgttgaacggtgcattactggaatgtaaaacgtgaaaaattccttggcaaagaatgatgttgcttcttttcatgtgaaactggagtaggggtttcctcccctggttccaaaaagagataatcccttatataccactgaaaattggtctgattccttatataccattgaaaattggctcttcccttatatgccattggtctaaatttgcgcaccctctcatgccactcccatcagttgact

SEQ ID NO: 80636 - DNA, 39391 bp, Oryza sativa
aaacttctttcagatgaagctaccgtcataggtacggttaagagaattcgataggcaactgcaacatttggatagaaatctgcatccataacaaacttcagaatctcaggcgcgaacatccaagaatctggcaaactcacttgcaacacctttaattctgaataaaaatcattgatctcaacatcggatgagatattatgttactagtattaggtgttggcacccccaccattataggccccctaccatcatgggcccccagcggtcgcctcggctgcatagggccagggccggccctgaccgtcggtactttcctacaatagatccagatatactccctctaaactatgcaaagggtgttgattaaaataagattagagttgaggataaaatgaatatatccaattttatatacatactagtatgttcccctagcatgtgtagacagtagactagatgacactgatgattgcttaaatgaagcagaccagggagctgtatcaaatattactggttattagaggccgtgttgtcttctcataaaatgtagattttatctcgatttctgttagcatgttttcaaattgctaaatggtacaataaatttatttttcaagtttataataattaaaacttaattgatcatacgttaatggttttctcgttttacgggcacccacttcatcatcttcatcaatctcaaacaccaccataaagtagatactatatactccctagctaaaaaagtacccatcaaaggataaatgtagtaaacaggaaaagttaattaaaccataaagatatgccaaatgtcggttagctaacgttttaaattaacaacataatgtccatgcaaaaaataggatagtttcccaaacaattttgcgcaaaactagattttaagagttgaatttgacatgtacaattcttacttctatttttacaaatatggtattcttttgtattatacaactatatcaatcaatctacatggatagaaaccgtacacattacaatcaagcaatgtatatttctctctctctttttatcaatatgataatttttaggtctcagatagtttttttaaacttattttagtgaatgatttttttttagcaaagggcatagccctccatttccattatagaaaaatggacaaggttctacaaagaaaagagtcttcaggggaacctccccaggtgctcacataacaacttattttagttaatgatataatagattgttaattatttaataggattgccttgtcctggaagtgatattttgttcctctccagccagtcagcatagcacgtatgagggcactttatgcatatttcttttggctcttttagttttggaacccaactttttgatgaataactaaagtagtcgttgctttaccgttaacttttcgcttttagattattggattgagaaaagaaaaatatcttgtgattctacgaaacaagattttccatattccgcaccgtacagtgagtttgcacacatccattatagcgatgcaagtgggacggataagcaggttattttcccccacttatcatacttatgttttatttttctttcaaattttatattactataaaagaataactgataaacatgtatatatatatatatatatatatatatatatatatatatatatatatatatatatatatatatatatatatatgagtatcaggattttccacttacacccctagatacatatgatggtgctggattagagttgtccatgacatgagctcaccaagcacacgccgatctcaaactcagttcaacagtaaaaatgaaacacaacccaatatagattaagcccaattatggcctatacagtaaatgtgtattaagtgtggtgaataatagcccaatgcaatgaaaaaagtttttaagtttcctccaaaatccacgtgtaatgacttaggctgcgttcttttgtgtgagataggatgagaaagcacatcgttttccgcgcgcacgcttcccaaactactaaacggtgcgttttttgcaaaaattttctataggaaagttgctttaaaaaatcatattaatccattttttaaatttaaaatagttaatactcaattaatcatgcgctaatggctcacctcgttttgcgtatcttctcaatctctctgatctccttctcctcgaacacacccttgttgcatatggattttctgaagaaacaaacaaagcaggctgctgcttaatacacacagcaattcagagactactggctgtactacctcccatgtgtccaagtcccgtcgtcgttcagatagatgtactaccacgctagtgcctgctgctggaactgagaacgacctggaagccattactttttgctgatcgatcgagcgtgctatatcgttatatccaggccgagtgtatctagggcgagtggcgatcgtgcagcacagctcggatcatgccttggcagcggctaaagatcatgcgcccggcgcctttaccgtgcaccatcgatcacaacaaacctgcagacctttgcatgctagctttgcccgtgagagcaaaatcagtcaaaaacccgagagttttccagtgacaccatgacagcaacgtttgctcggttcacagagcacatgggagggcttcaccgcttcaagtctgcatgatgaaacggccgaactcgcttatggtcgtcgtctcgttgcgctcaggcgcggcaccaattaacgttacctcgcgaatccatggtgtggtcaactcagcgagtcagacacacaaatgacccgagtggcaccaattccgcgtcaacttgttcgcggttctaccggtgactagagtgagctgcgaaattttgtttctttctccctctctcctttttcagcatcccatgctgacacgaaacacttgatttcccctaaatttccttctcaccttctctgccactcgatgcatagatgattgtttctgcttagtattaactccagtcatccaatgattgtcttccttcaatgatttgttagaaaggttttaactgctgatcgagcttgtgtctgcaccagtaagtatacatatcctgtaaagttgttgtctcaagctagtgacgactaacaacaagcgcgaggtttgttagtggcttgtagtggtgactggtggcactgcaatggccagatggtagtgcgcggtgcaactaggatgttcttgccgatgttcatgaggctgccgccatgcagatcttgtcaaagcactaagatcaccctcggggcgattttgtctggatcaggtggctcgcagccaatccggaattccagcgcccaggtgcacgcgaaggccggaacgccagtacgccacgctcatcgtgctagagtcatctgatggtatcatggaagagcgagcagacgggaagttgtggatgtgggagagcccgtccgcggccaacttgccgcagattatgtgcggctccgcatgcccagagcgcaacggaggagcaattctacggttcttgagtagataccatgaggtaccaaaaatttagtataaaatttgatacctcatgatacttcatagtaccgaggtatcaagaggtaccaaatttacaatagaaaaaatggtacctcatggtaccttctcaaggaccgtaaaattgctcgcaacggagacggaaggacttggtcttagacggtagtgacatacaggaataagtctacttttgactttcttaaaatattcaatctgatttgtactccctcaaccacaatacagatattttgaccctttaactattaaaaccgaggtagtttaactcccttagtactttttgttgacgtgacttgttgactagtctggctggctgagtcagcaaagggacctcaatgtccattctttatcctattgtcctctctctctccgtgggcgacaattacttccccctccttttctatcagtcatagggggtgaacaatggcacgctcttgcacatccaccatgagctcgtcgacatcggcgatggcccctcttcctagcaaccccccccccctcaactctcttctactttttcgggttttcccctttggttttcctcctccgtcggtatcctggtgaacgcttgggaggatgacggccaagaggtcgaacatcgtgctgctgagcaggtcagcgcccgccataagtgacatccacatccgttgtctccttgacagaatctgcttgttggtggctgagaggacggcggcggttgctaccctagagcagcgatggaagcaccaacccttcacaagagctcggacgttgtgttatagggccagccaacgaaggcggagtccgtttctgcctctctagtcctcacgccgtcgacaacccagccaacaagagcacgattttttctgcctcctcgccgccgccagccaaccatctcgttgtgtgtccccaagtcctactgttgcgcctacttgatgttctccgctgtgacggtggcgtcgcacgtgtcatcatcgtcgtcgtgctcaggcatcctacgccttctccactgcaaaggccactgtgccgcttgccacttggttgacctgctccagctcctgctccacacatccctattgtttccccttgcttaccgtcttcaccattatcctctcctgtgcctagtcctcctgcccctatcatgcgcgccctctgtgctaccaaccagcccgccttctcccaccgcccttttctgcccttgctgccatcgggaaggatactcccctcctaataccatcagtaacttaggacgaggctgctagcttggatagagagggctgcttgttcgtcggcgctggaggagagaaggtggcggcgagcaaaaacaaggtgaggagctggcagtgtatcggtatgggaaagagggggagaagaaagagagaggtcactgatatgtgggcaccacatactgactcaggtagtttgatcaaataaaaagccatgcctgcgaaaattgctcccaaattgaccgaggaagcaaattacaccagttttaatatttaagggtcaagatatacaatataacgttgaggaaaacgaattagattggagctatatttgagggagtcaaagtgcacttatttctaacgggaagatgaggacagtgcgttaaaaccgaggcagatggttatggtccggatctagtgtgggccagaacggggccgttcagcgtagggggtttaacatggatgtttcgccttctcggtccagcggctcagtttagaagaacgcgctccgacgggaaaacgaggtaccccactggggccgtttcgtcttgtactcttgttctcgctccctcctcccgcggctagtccggcaaatcggccgatgtttgcaggcctgcagccgcctaacgttgccggaagagggcatcgcgatgaatcatcctccccacctgacccagcctcctctcctcgctaccttctctccctccgctggaagcgcgagatatcaaagtcggacttatcctttggccactatctaggtcctacgatttgggatctgatgcacgccaagcgatcggagctcagcgaacaccgtccaaggcactcgcgaggaggccccggaagcagcagatgatgaacatgaactctccacttctccaggctccaggtacaaaccaacccttttgtggctttctgcttgtacgcattgcctgatgaattctgtcaacacactccacgcagtacatgtctgaaacggcattcatcagactagaagacaatggagatcggatcaactcctgaaatttctaatatattgaagggatgatatttgaacattacaagctcttggcacactaaccaccacacacttcccacaatggcatgttactttctgaatcacaaaagaaagcaacagaaacagccatacatagcttcaggtagctttagcctaagctcacaatctcacattactcaacctaatagaaacttcaagcttactaccaaaactagtggcctcctcatacttacagaagaggtttatatatctttcgaccacaatcactaagagattcagaacaacatcagactgacaatgctaacaatgccaagcagcagcccaatacttgccttcaacccagcagctccattcaagccccagacgcgcacatcatcgatcactggcccacagagcgagctgtggtcgtcgcttctcgtgttgtaatacacactgtagaacgctacccgcgtcctctcagctcgtgctgtgaatgtcacattcgcagcctggcttgtggcattacccatgggcgagtagtggaagttctgggcctggtcacctgcgaatgccatgacagccattggtggctggcatgaatcccctgctgagcccaatgtgaatgtcaggctgtactctttctgaggggttgtctcgaccatctgtgagatgatgccttccttccctgatagaagctcaatggcgcgcttcccttggggaacggtgtattggtcagagtcgacaaagcggacagctcggtttgactcaatcatccagccaggcaaggcagacgtctgctcatcgaggttggttgggagaagcaccccaaagctcgtgtttggaaacatccatggaccctcctcaaagtctccatttgacaccacagtatctgttgaaagaagacaataccaagtgatgacttaagaaccatacaaactagagcacctctagctctcttaagacatcctgtaaggatatacactctaataggtatagagataagcagaactgtcataccctttggtttgtctggagtgaagagcttctttatggcaacgttgtcaaggataggtccacaagtcggatcatcctccataccagggttcctgaactcaaggctcgcctgctcatctgttgcctgaaaagccaatgcatatgcatcccagccttctatgttgtacaatgtctgcaggtccactgtctgtgatgcaccaccgagcacagacacattgagtgactctagctgtgcacacgttcgggcagcactgaacgtgatagcatactctgagcccttctcaacctgcaccacctgccctatacttgcgtcgtttccaagacgtacagcatgatcccctgaaatgaaaatccaaatattaaacatgtcgaatacaaatcagtggtgcaacttgattgatcagaggacagaaggagaaaagctctgtaggataccctgtggaacaataagaatcatgccaccctggtgctggcctgctgagatgagctcgactgtcccattgatcgtccagccagggatcgatgatgcaccttcagcaactgaagcagatttgacaaaaccaccagctggtgctgtctcaaagtcaccattgctgagcaagcctgttgtgcaaagagatcacttgctcatgtaagtgccaaggtcaatttagatctccaaaagtaacacagctgcaatccaagaccaagaggcagaaaatatatttctcaagaactctacttaatatctacccatgttatatgtgaaagcgttcccatgcaagtgaagccaagtacatctactgcaagtctgcaatgcaataaaaccataactattttaagttgtgtagctctacccttttgtaggataggacgaaccgtaaatatgatcccccactgaacctagtacacaatgcgctggactatctttattatgacatatataaaataatgtacaactcagactgaattgaatggcactgtacaactcaaatcaaatgcataacagtgacaaaaaaaaataaatttcagataaaaacctaggacatttacgggaacctttctacggaaacatgtgtaacaagtgaaatgaaccatcacagtagagtttgggaaagttcatttctaggactggtttttcttataagtgagtgacttctcaagcttgtttttatggctaccctcccagttgaaagcacggttgcacagataaactgtaccataattaaatctcctgtgccaaaatttaacagctaaaacctctaattcagtactataggagagaaaacatgtccatgtttttctattgtacatccaatgcatttcattggggcactgcgggtaggccactttactgtgcttcaatgtccttacaaggacagccatgtgactatgcacgacgatattatgtggtgaaagtgaaacatccaccaaccctaccctatccaccatcccaccatggagagcctcatgcagtggtccagactccagagctgcccatgtccggaggaaatcaccacggcccgtagcgtaattctggggaggttaaggtacgaaaaattaaagagacaggcatggaccctcacggccatccttttaataagccatttgacctttttactggacggttcattgaacgcgtttgcaggacactggctcactggtttctgctgctgtgctgttcggcctggatccaagtttactactacgccacatttcattttgactttcatgcaacttcgtccttgcatagaggttcataatacctcctttggacaagataggaaactgaaactctttcagttacaagcctgaagattttctgaatctttcaagtggttttgttagcagcattctgcacccaacagaatgtctctctcatcatacaggacagctcacttgggggtttttagtcattttcaaacataaaattgcatgaatcatagaaaaggaataattttataaaggtatatacatgcagactaaactcaaaggcaagtaaggaagggggatgtgtattaagcaggtataaatatttttatccaattaatgtacttaaaagaagtggttacactggtcactgcaaaaaactacattcccaggaaagctttggcacaagtggcagtataactggtcagtttttggctgttcagacttcagtaacaggacaggtttggataattgggctgtgtctagttcagcgcaaaatttggattttgattgaaattgaagatgatgtgactgaaaagttgggtgtgtatgacaagttgatgtgatggaaaaggactaaagtttggatccaaactttggatctaaacacagccttggtaaatgttatctcagctatcaagggccaaggctccttcctactttctaggacctttactttgcaggtatactgaaccatatgctctacaaaaagagaaaaaaaaataaaggggggggggctatcacactccttcctcacgagtgcaaccacatctcttgattcctagggcacaaagctaacttcttggcatgctttaccacaccattttcctaggggattatttttctcttctcctacccacccttcaaatttctcctcagtgctatgtatatgtgctaatgaactccgcatttgttatacaaatgtgggatgcggagaggtactaaatcgcatgatttctctatttgctgagatctgtgatgcagaaaactacccatccccacaaactccaaccaaatattccacaaatatgtcaaaatactgccttggatcctccagcatcaaaagaacagcagcactactgatcctccagcaagggcaagaaacagaaacgatcgaagagacagcaaagcataccatcctccaccgcagcggccgaggccagatgggagggcgccagcagaagcaggcccaggcacagccccagcaatgcgagcctcctcgccgaatctccctccatctcctcctcctagccgcctcgagctctcgcctcctccttcccccctcgccgaggaagaagaacagtggagagagtgagccgaagtgcagtgtgtgtgcagctgaccgagtgagcgagccgagccagtcctactctcactgggctggaggcagctctctgctcacgccctgctttttatgggatggcgattcccttttcctttggcactttgctggccacccccattattctatttttctcgcaggcgtggggtctgaaaggaaaggaaggaggagcagtgaccactggatggtgagaatggcgtcgatggtcaataaaatactctagaggtcaccctgctgccttttgcttttttcgcagcgttttggtagcactttgtcgagcaccaaaaaaaggcgccgctgcccacacgattgtagtacagtagaacttgcatgtgggtctgtttagtttatgctaaaattaaaagtttagttgaaattgaaacgatgtgatgaaaaagtttaaagtttatatgtataaaaaagttttgatgtgataaaaaaatttaaaaaggcctgtgtagtgcagttgcgttttgcccgcagtccctcaccagtcagggaagtcacgaggcaatgtggctgcgaagagcatcagatatttctttttttctaccagtaatatgctcatccgtgaatgtacgacaaacaccgggacaggatagaagcatgctacctctatctcgagatataactatttttagcacagtaatttatcttaaaatgaagccgtttttctacctaccctctcctatcaaccaattataactattctcttcacttactttatctaatccactaattacaaccctccttcaatcatctatacctattccatctgttccaaaatataaatatttatgttcagatttataaccaaaaattattatattttagaaagaaggtagtactttttaatatctgtgtctatcttaaaaatgattatattttaggactccagtgattactgattagcgatgaatgtacaggtacggagccacgggcacacagtgtctgttgtttgagacaagcatcaatggtaaagatagcgccagaatattgtttgtttacatttggtatcaccaatgtatatttacagaccagtaaataaggtagacccaacaaaaataaacatctttaaaagttccataatatctagccacaatgataatataaagtttaacaacaaccagtagcatgaagggagagagtgaagatcaatacatagcaaaaaaaaaaaaacaatgtcttttttatttcttacaaccgggttgtagtgctgagagctatttactgagtccacaatacttactactggtaggaatattaaattattgcttattacctgatttgggagcacaatgtggatgttctttaccaacctgaagagaaattgggtgtgcttaatgtataacagaagttggtcttaaggtgggtcccactataatatattgtcaccttcacaatgtaagagcggttattaaagtgagcccctcatttcaagatagagagcaaagtatgagcggaaagagatgaatgatatatttgtttattcctttatgtctaaaccttatgcacaatgctagctcataaaaatgggcaagctcaagtttgtggtgtggatgtatgttgtaaccttaggagtcggtccatgaataatggatcatagttaaagtaatcatgtctaggatttaaacacaagatgaccacatgagatgaaaaaaagaactgcttcggctcttgtccatcaggtgaataagagagaaatactttctttttgcttgtggtagattttaagcacaagatgcaccttaagttaatgttaatttacatgatgtatgtgattactttttaagtgtaatcattgttttaagatcactttcaaaatatactcctaagggtatcttagaggacttagtactctttctatttttacattgtgccttaatcctaaagcagtttcagagtccattctgttttgtttcctttatatacgcaccgtttctgggtacatatgattgtggagcacaatgaacggaagggaattcggcgacggctcaagtgagattgtacccgcgtatgctctcactttaggtaggtggttgcagacagagcggctcaaaaccatcaacgtctgccaaagtgagacccaattgagtaaacaagtgagcatgccggcgatacgggtttctataatccaaagtgtgttatccactatgctggtcagtggccagtggccactttcttctatgggcttcccggccttactgagaccatgtttgggtcattaagtttctggattaaaattagtatccggacaaaaaaaaatagtccgatccatagactaaaaaaattcaaaaaaatttcaaataagatgtacggtcaaagttgagcacggaaaaccatgactgtacttaaaatgggatggagagagtcccctaatataagtgattttgatttttttacttgcattatttaaccattagtcttattaaaaaaattagaattattatttattttttacttacttttttatccaaagtattttaagcacaatttttcgttttttatatttgcataattttttttaataagatgagtggacaaaaccaaaaaaaaaagatgagtggagaaacagtgtaagtaaaatgttaaaatatcttatattataggatggaggaagtaaaatggactaaaatagagggactaatggattaagacccacgaagcaaacagggtctgaatcttcggattaataaagtactgatcgtgtttgtctttgaggggctcgagcagtcgagtagcgttcacttttgggtgcgcaccatgacacgctgctaaccgacagtgaaattcagatatcgaagtgagggtgtgggacgaccgggcggggtggaacgctgctgcacagtgcacacagacacacacagctacacaccgacacattttctcggcgctcacattttcacagcggtcggtcaaacttggtcagtactacttcgcgtagagaacgcgtcgtcgattccacatttctactctactgagccaggcagatgatgcaaaatgccgtattaaatcaatcgcaagtcagcagatccgagcagtgaagttggtttatttgtgtggaccaacctatgcgtgtacatcatgctgtgcaggatacaagatatcatacactatcgaggatctcaggacacaccgtaggaaaaaaaaacttactcctggttccagtaagggcttattcggatcacgggattgtaaaaacgtaggaataggaaaatcgtaggaatatgataggaatgtatgtgtaaaacagaggattgaaaaacacaggaattctgtagataggattggtaaacatgtgttcggataggcaaagaaaaaacataggaaatggaaaaaatgaggtaggagtggatggaaattttcctttgtttctctattgattccacatgaaaggaatttttcctctgatttttctttgggtcgattcctatgaaccgaatgtcaggaaaggaaatatttcctatctacagtattcccttgaaaatcctacaaaaatccctcaatccgaagaggccctaaaatgagtagacttcacgccaatacaaaatgcaaaagggaactagtgttactcctacttcatgccaaattggcaatacaaattacaaaagtactgcaaaggtccagcagggtgagaatgaaagcgcgtaccgtaataaactgttacggtaaaacccaggcgtgattcgtgaaagcgcgatagacaagacaaagctagccggcagaaattcctggtagccgctaccgatgtgcaacgcatggacaaagatggccatgcgtcgagagttggcgtgtaccccatacccctgtacccatacgggccacacacgtaccacgccatgatacttaccatcgcaggcaggcaggcaggcaggtccactcgtgatctgcgacccgagagaccgagccctgtgcagatccaccgtcgtcatccggtggattttctgcaatgccgcgctctctccgaagttacgacgttacgtagtaccacgacgtaccgcggccgcgataaaggatcgccggctggttgggcggggagcctttacgagtggccgggccgacgcacgttgcggcggtgcacgctaccggagaattcggcgctcgtttgcgtcccaattgatttggtcggttttccctgcaccgtttttctgtcgtggtaggtgcccgtaccaccggcagccggagcccaatctgttccaggatcagatcgatcgagccccgagtcccgactagcgtgcggtgcggaactgctccgttgtaatgcttgctgcctctgaaacgaaacaagaccatcctgaaatgatgtgaaatgccccgtcaccttttgcgccaactttgtaggcctttttttttaggtttttctgtggaaaaggcagggatttctccggttttcccgacacaaaggtttcttcacttgcaagactacctcctgtctacgcaccggttccagcatactgattctgtctgttccatattgctcactagacaacactactatcagtcgagatggcatatgagcttgttaattaagaagtatacttttgccaaagaaacagaacaccggggtatccttcgacaggggaaaaaaaggaaaagcaaaactcaagtggaacatgatgctgcatctctctggtagttgagatttgagagtcgaattagagcagatacaatagcatgctacaaaccagctgcaaacatattttaagtagataaatgaggagagagaagagcagcgggctacagatttataaccagatgtagcacgaactccaagatacagtgtgtgtatgacaggtgggaccatgtattaatagtgtagtatgtaactattgtatgaatgagctattagattggctatagatgaaattggagctagtagttggctatactattgaacttgctcttagaggacatcaagcgtcgccgatggcgcgggcgctgggcgatgccgcgtcggattgcaatagtgcgcggggtggaatttttgcgaaaaagtccttcgcttttggtgtcattcgatacatgtccttcacgaatagtacttcgagaggatgttttatgtggagacccttataaaaatcggatattttcattcaaaggagagaaaaccgtaaatttggactgccctgtaaaatcataagacgaggggcttttttgcaaaatgacacccactaacactaaccaccccaaaccctagccgccgccgtcccctcatccctctcgtctctctctcacctctctcgctgccgccgccttgctccgcctcccgcttgcgctgccgcctctgcctcccgcttgcgctgcctccacctccgccttcccctcgcgctgccgccgccgccgtcgcgtcagcatctccgagagtctccgcctcgcgccgtcgccatcgccgagcacgagctttgaggcgaacatggagaaagtgaggaggcgagcactcctctcctcttctcctctcgtccctcctctgcatgtcgtcaacctgccgccgtcgtcgctgccgtcatcaacttgcctcgggtttcgtatggggaagaaagagggggaaaggggctgccgacggccgtatgggggagaagctccgctgtaggagggttgctagttgacgcgcgcgcgcgccagctgctccccggcccacaaggcccatcggccttttatttattcacgattttttcccttttttttgattttttcttttttctttttttcttttttttctgattacttttttaaaatctttagcacacgtattttttttttcaaaatgttttgagttgaaagtttttaaatcatatcttgaaaattttcaaatctgatttgaaagttttcaaatatcgagttgaaagttttcgaatctgagttgaaatttttcgaatctcgagttgaaagttttcaaatctgatttgaaaatttcaaatctcgacttgaaagttttcgaatctcaagttgaaagttttagaatctgagttgaaagttttcgaatctcgagttgaaagttttcagatctaatttgaaaatttcaaatctcgacttaaaagttttcgaatctcgagttgaaagtttttgaatctgagttgaaagttttcgaatcggaattgaaagtttttaagtcggagttgaaagtttttaaatatgggttgaaagtttacatatatatatggaaaaattcgaaaaaaaaaactaaccccgtcttgagccgtatgggccggcacgtgcgcgccgcacgcgccaattagaatttccgctgctgtaacccgcttcccctcccctcgagcctcgacccttcttctcccactcgtactaatcattcgctgcgagagagagaggaaatcgtgaatttcttcgacttaacgcgacgaaaggaattaaattaccatgactccagtccagagcccacaaacgcgttgtcgcccgcggctacaggcgaaagaaagattgacgcccgttaggcccattagtggctagcgggccgtttaacccttccagaggcctctcactgcggagagtatatagcccgtcttgcaacccacgatgaggactcgagcacgcagtcgcacctcccacccacccgcagccgccggcgagttcgagcggcggccaccgggcgggcggcggggcggcggctcggctcccctgatctccctcccctgcgccgctgcgcggtatggacctccaggatccagccgcggacgccgtcgcggccgagccactcaccgtcgccgagaccgacgaccagccgccgccgccagcgccgcctctggaggcggagggtgttgtcgtcgcggaggaagacccgctgccgcatccgccccttgaggtggtggaggaggatgtggcccccgtcgtcgcagaagccggcgccgctgccgtacctatggagccctccgaggctggcgcgggtggtgtcgtgctcaccgacgagctctgcgaccggatcgtcaaacaggtacaccagtttccggtccttccctctgttggctatcagatgttctgttgtatgctcctgcaaagacgacggattttttgagatgttgtgctatccatacgtcaaacgttccatccttgcaggtggagtactacttcagcgatgagaatcttcctacggatgagttcctgattaaattcgtgaagaagaacaagcaggggtttggtaagtggcatgcttttgcttcatgtagcgaaacctctatatattgtgatgctaagtttagatggtttagtctggtagtttagaaacatatgtatttgagacaggagccatgccaagtgtgtagtatcttttctccccattttgaactgcttgtgatgcgccctattattatttgcctgtattattttgccaccgagataattgtacttaggtttatgacaggtttgcttttcgcataaattgcattctagaagtctagaaatagatgtggtaattggtcagtaatatgtatatgattcaagttctgaaagctcttttatatcccttctctctctcttttattctatcctccgtgagacaaggtgtgactcttctagctcctatgtttctgcattattttgccttgtcgatcatacattagtggaatggaggtgaaaatgatgaaatatgacaggtacttatgagaggcatttacataggtactcctggtgcagctttctttagttgtgccgagaagctagtttaggcctctgtgaatactggtttactgttgtctgattcactccattctgttttgaaattataatcagggggactttttaattaataaaccatgggggctggctatttacttatttttgttgtttctctcttttcatggtttctgtagtcagttagatttcctcacatttagtttgactgtcgggccatgaggatacatgaaacttgatcccattaccgatgttgtctggtattcttccatggtagctgagtcaagctgttgcagtgggaactgatatgctccttactcatctgagctgcccctttttatttgagcttcacaattaaagtaggatggattagttttgaactctttgattgatcatttacagcaatagtttgctgccctcattcatagattgggacaagagctgcaatcgttttgcgagacatggaccttttttttttctttttagcagcctgatgttctgtatgtatcatatgcgctggattttgtacatgcttgggaagtagcttgtaaacaatgatccatgtagcactacttattgcatgacaactcagtggcatggtgtggaattatacttttaccttttgttgattttcaggtattaaattctttctgaatttctaggctgtaactggtatatcataagtgactcgttagatatagggtactcttctgtcatgaatcactaaatatatttacattaggtcgggtgaattaagtgttgcttagcgagtttatagtgctcaagtctatatggattgatgttcattagggttaactttcatcaaatattatgtattatatgaagtaaaatctcaaaggttcttctaattatgtgctatctttggtaatagttcctattggagttattgcctcattcagaagaatgaagaaactcagtcaggatctctctataattgaagctgcacttaggacatcatctaagctggtaatatattgcccatttattatctatgctttggaagtggtgcttttggtcagtgggagatagatatggttgctatgttaatagttataatttaaatgtatatcactatatgctgttattttgttcttaactttcaggtcgtgagtccagatgggaaaagggtcaggaggttacatccattgccaaataatgaattgaatgatgttaaggtcaatttccagcccactccttgctgaaatgcattatttatatgtattgtggaatatctgtgttctaagttttaactttaacttgcacgcagaaaaggatagtcgtggtggaaaatctgccttctgatttctccatggaaagcatacatgcgaaatttgaaacagttgggaagtatgttgtttgcttgtgtttgtgatgctatattgttctgaggacacttaatgattgatgctcataatatattgttttggaactgtactttatcttcatatgtgccagaattgcgaagataaccattcatgatcaacattcagtgggagaatctgcaacaattaagaaccatgacatcatgctaagtaacaaggtgtgtatcagttattactcagcgacattttcttaaaagatcttatagatacccaaactacagcccttttgattttactacctactgattgtagtcataggttcgtaatcgataaaataagtattgtagccatgggttatttctgattgacccgccatacaaactaccactcgttgccagtcactgaatggaaaatatatttgataaatttagtcatctctagttgcttttacgtctcctgaataaaattggatatatcctttccttcacccagtattcaagttggtaataggtcagggttgtgcaggtgcatgctcttgttgaatatgaaacagcagaggcagctgagaaagctgtgagttcccttatctcacatttaatggcccatttgattcccagcgtatgaatacatcttaaagattgttgtttatgtgtgatcaaattaggctatcaccttaaacgatgggagcaattggaggactggaatgaaagtcaggctggctaagcgaaccgtaggatcaggaaagcataaccagtcttcaaaagaaaatcaggccatccagggccagccttcaaaagtagagcagcagatggtatcagaaaagaatggtggtactgattcagtggagagtgctttcgacaatgagaatgtgaactctaatatttcccatgaggtttgatttatttcatacacctattgttttttttcaattatccacttggcacaattatgtttcactttctcttacgtccatcttcaccctttgcattcccttactgaactgcacacatgatacaagcatgaagttcaaatgtattattctatttagttttttttttcatatttagatgctatgatcaggaggttgtgtcattgttctgcaagtgtctttgctcataggtcatttgtgcatatctttaggacatgcaccaacaccaaaaagtaaatgctaaaggaggacgaaaaggtcgatataaatctcaaggaagaggtcagattcagcaaaatacaagtgggcaaggtaaactgtttacactattttgaccctactaaatttgtagattatttgggtgatacattttatgccactgagtttcatccaatatccacaatatcagtttgttttgcactgagtgaaatgtttctcagatgaactccatttgcacatacaacttaagttaattcccatgtctgtgcatgatggaggcaggaggcttcatggtcaacatgttactctgcttctttatggaaaaaaactgaacaatatttattatcttaggcaactaataccattgtacacatctcctcacctagttttttgcgcaatgatatccttgttcatttccaaagctaagtctgttttcatcttgatgacagtaggttcaccagacttacattgatgtaactagtttttttttccctacgggtatcttttaacaagagctgaagaattcaatcctgacagttcttgctgtaaacacttgatattccaaatgaacacgcagaaggaaatcaagatcgatttgtagttctctagttttgtactaatgaaaaatcaaatacctgtgattatttctccacatatgtattttttaactctatctggaatatgcatactgatgatttttcatatcaggccatgtctcatcccctgccacttctggttctgatcatgtgaacaagcctattcctggaccgagaatgccggatgggacaaggggctttacaatggggcgtggtaaatctcctacattccagaaaggggataatgctgaagaatagtgcttttgtcccaaaaagcctggtaacaatctaaccgcgtgaaaaacataattctgctgttatgctataagctgtcttgcttcgtgtaagaacgtagggacatgtcactgatatagaaaaggctcttattttttatgtagtgtcttttctgaattaactggtgctttagtaggtctggtaaaaatttaacctcatgaaaaacatagtactgctgttatgctataagctgtcttgcttcgtgtaagaacgtagggacatgtcactgatatagaaaaggctcttattttttatgtagtgtcttttctgaattaactggtgctttagtaggtctggtaaaaatttaacctcatgaaaaacatagtactgctgttatgctattgttctctgagtataagaacatcggcacacgacgtttacagaaaaggtcgtagtgtattttgtgaattcaattttcgaaattacttcagctgactagtaaggttttaccgccaattgtgaagccgttgttccgtcattatttctgatgttctaggttttggctaccatcttgtcctgattaatacgaaaactggatagaatattagagcaagaaatagatgcttgaagtgtatgtttaaactatttaggatgcacaaagggtaaacaataaacagatcgagatccgaaacgctttcagtggacttgaggcttgatttttggagcatactgtgcaccgtgttgatatctcctggtgaatgttcctctgaactctgaagtgaggagccagtagttacagtctagcttgtatatgtaaggttaatcggctgccgaacaggcagaaaactaaacagtcagcgcttgttcagttgatccctctcccatggggattgaaggaattaatctctcagttctcttcaatcccctttctcacggagattaaccgagcaagtccttatgggggctgtagtaccatatcttcgaagtcttggtctccagtctccagtctccagtcaattgagctgtgctgtcccggtccagtggtgctgtgctgttacttttaataggtgcattgctgtgggaatttattataaaaacaataaaaaaaataacatgtaagatagctagataacatcagattaagtaaattaatacggtttatgataatttagatttaaatagtatgtagaatggtgattcaaacgtaaaaagtaaggtggtataactttatggaagaagaaaaatagggagatagtttggactatagattaatcatctaaaagctaaaaacaattgatgtgatatgacttaattagaggaaaaaagagaaagataatttgcaccatagattaatcatttaagcactaagtgaggatgaactatatatttatataggatattataaaacataataaaaatatacattgaaacattatgtgaattatgttggatgataatttaacatgtttgtatttgaaaagctcttaaattataaaaactataaagatatagcatgttttcatgatgtttaaatgtgatgattgttagtggatgatgagtaacatcttgttaattagtggatgatgatgtggcatcttgttagtggatgatgatatggtatctttgcatgttaagtttaaggtattagtggggataactttatagtaagataggatgtgttaaggaatcatctagggacatgtgcctatccgacaagtgaatggagctcccgagggtgtgtttagtttgcgaaaagaaaatttttgggtgttgcatcgaacgtttgatcggatgtcagaagaggtttttggacacgaatgaaaaaactattttcataactcgtctggaaaccacgagacaatttattaagcctaattaatctgttattagtacatctaggttactgtagtacttatagctaattatggactaattaggcttaaaagattcgtctcgcgacttgaatgcaaaatgtgtaattagttttttatctgtatttaatgctctatgtatgtgtcaaagattcgatgtgatgttttggggcaaaaattctaggaactaaacataccctgagtaagaatgaacaggtcagatccgctgaaacaagcctcattttcatgaccagactagtgtcgcagcgattttactgcgatctgtcaccaacttaatacgatgttggatctcggttcctattcagaattgggattccatgagggccactcaggcaggaacaaagcacttgtgatgcctgcgcgcaggcaggagcagaagcaggaccaatccactcattggttccgcagcggcgtagccatgcgctccaaccatgtgacaacgacacgaggcgtcgcgggcggcatgcatgcgtgttcggttcatggccagaggaaaccaagccggtctctcggatacgtatccggccgaaagagtcggccaaagcccgtggtttggctacggcgctgcgccatctcacgcacatcgtgcagaacggtgggcgaatcgtggcggcacggatgcccgggcgccgttcgcctcgcctggtttacgaagcagtgaccggcatgcagatgaaaggggccctgccggctgcgtgctggcggcggcgatcgaacctgaggttttttgcccaagcggaccgtatccaaaccgccgtcacgcgggcaaggcccaagcaagccatgtgctccaccaggccatattcctctggtgacggcaacctcgctgcgtaggccggtaggcgtagatatgccgatcgactaccgtgcaactgtcgccggcgagttggcgaggtagggctgtacttacggtgaagtaacgtacactggtcggatcgtgtccccatataacaggagattgcagcctgctctctgcaatctacagtttctcgtctgcactcctgttggaaggtacttaagagcaatgctacacgtactatatttttcttactaaacttttactaacaataatctcaaccgtttgatttaagtagatggaagttaaaaaaatctagatgcactcatagcatgacacatcagtgttagtaagaatttagtaagaaaaagtcagtatgtatagcttttataggtgtaaagttttagcgtgtcagatcagatatacggacaccacctaattacagaatccgttaataaactgcgaaacgaatttattaagtctaattaatccatcattagcaaatgtttactgtagcaccacattatcaaatcatagagcaattaggctcaaaagatgtctcgcaaattagtcacaatctgtgtaattagttatttttagcatacatttaatacttcatacaggtgtttaaacgcttgatgtgactgggtgtaaaatttttgtgtgggatctaaatagggccacaatctctcccttcctggctcctaagctaggtgtaattttacgttgctcttcgaaatagcgggcatttgatagcagagaggttgagaatggaaagagcggagtcaaagaggcaccatgatactactctctccgtttttatgtttttggtttgtgctaggttaaatattttcaaatttaactagatttatataaaaaatataacaatatttttaacatcaaacaattattactctcaccatcttcgagtttgaccaaatttaaaaaataacgtagcaatatttataaatattaaatatatactataaaagtatatttaatggtggatttaataaaattaatttgatattataaatgttgctacattcttttacgtgattcataaatataaataagtttaacttagaataaaatcaaaatatcttgaaacttaaacggaaggaacacaagtgaggaggatgagaggtgagaatatgttgtttgagaaatggtatatgtatatatgtatcacaagtacccccgtctcataagatattaaattactataaatctgaacatacgagtatcttatatttgtatctatcttttttttatagagtagtacgtttgatcaagagtgaccatacagtttgactgaaattcccttaagagttttcatttgactagtgtacagacagtccaataaaaatatagttttataccgcttacactgccgtccaaaaatatagttttgactagtatacgcagccagcagagaataccgtcacatgccatgctcaggttgacccagctgttgtcagtgtgtcctatggtggactggtcgctggaagtgtggagcatatagactgttccctcttttttaccatcggttttgctaccgttccacttccacctcctcctccttttttcttttacagaacaaaatcaggcacaccgcacacgagatactacaaatatatcctcaggggtgtcgtaggtgctgagaaaagcggcgccactggacactggagtgagttggagtctcgtgcagaggctatgcacctgtgcggccggctgtgcgatggatatggaccgaatctcgtcacgacgtcttcaagggctgcacccaagcgtcgctagcttggctttgccacacacattagtgttgaacaggcaggccttcggagctagcaggcacctaccgcgtaccgcgtccccttatctgctttggacgctgctactgcacaaacttggtgagaggaacgtctcgtcaattcgtcatagtggtaccatgtttaatttgtgccacacagtaattcatatttttgctctattcccgtcactgcatccgttctactaatagtactcctactcactacatccgttataccgttccaataataagattgctcatttcaagatttattgtattagattatatcaaatacaatattaagttggtttttattagaacggagggagtactaagtagcactcctacagttctacttcttttgttaaaaaaaactcaatctaagtatttaattggatataggttcattgtactaactaataagggtgtgtttagttcacgctaaaattagaagttcggttgaaattggaacggtgtgacggaaaagttgaaagtttgtatgtgtaggaaagtttgtttgtgtgtgtagaaaagttttgatgtgatagaaaagttgaaagtttaaagaaaaagtctgtaactaaactcggcctaagtctaatccaatactatatatgttggacttttttaaggagccagtatatgctaatttgattgttcatggtgacagctggagcactgggtgaaatgattatatcgagggtttgctcgcgcgaaaagcaatccacaattcgatcggggcaaagcggcagcactaacccatcaatgctcgcgagtggcgtccgccccacatgccgcttaggtgcgagaccggcccggtcactcggcagtcggctccctgtagagatggtaccgtgccacgacgtcgtcccgtcccacctcgcgtgcgctataaagctcgcgcgccctctcctcatcgatcattcgccatgatcacagccacgtacacaacaaacgcggcctcagtcctcacgcacagttaaatcttgatcagcgtatcaatcgcagtatccagctcccatggatagcatccacgaggagcagcggccgcggcggcggcagcagcagcagcaagaaggaggaggagaagaaacggtcgtggaggtgccggagatggacggcgagctgctcgtcgagctcctggaagcgtccctcgctgcggaggaggatgaggaggctgtagcgcagaggaagcagcagctgggcttcttcacggccgacgtcggcgacggctgggacgggcaggagctgatgaactccatccacccgcaccaggaagaagaaggctgcgaggactgcggcctcgacgacatcctctccgacttcgacggcggcgggtacccgccggcgtcgtcgccaccgtacctctccgagttctggatggaggagatggaccacgccaccgcgggcccgttcgctgtcgccggcgagtgcccgggggaggagtggtacatggacggcatggccatggagtgggaggacgggaggagctactactcgttccactacccgtcctacggcgccgacgcctcctgcacggatcaactgtacagtagcccgttgtgggagtgatcagtgaactccggctagctagtagcccctacgttacgcgttagcgattagtgcatggccttcgcttagactccaagtgactagtaccaccaccaggttccagtttggtagtttgatctgcgttttttgcctcagttttgcaaatttagcgcgctctgaatttgctggagagagcatgagtccatgagtttttttttgtgttatggtttttaccgggcaattcatgccctgttttttaggagtactttcgcacggtcgtcgcgagtgttggtgtatataggtgtgttgagctttgaacaagtgatgtttggcagtttgggtgttgatgttcctgtgccgatgcctcagtctgttagttaaagttggtaatctgtctagcacttcctctggtctaaaaaagcaagtcagttttaaatacgtgcagtcagcacgagttaaatttgattataaaaacatgtgaagtatatgttttgggtataggaaaatgatatattctacacctatgtaacttttgaagtccttttaaaatttatgctaatagtaaaagttgtataattttgttttaaaagatccaaaacgactcgttatttaagaccggagggagtagttcccatcggaaatatgaagattaggcagaagaactataatgcgggaaagtttttttttcttttcttgatacatttatatgtgaagaacatctatagtgtagtttctattaatttcaatctagaaattgtacatcaaaaatttcagagtactatctccttggataatgtacagagtcctgaggctcttcggccatctggcttcgaagatattacacggagatttcagatttctataaagcgaagcgcatcagctcactagtcaccgttcacactgtcacagtttgttggaacaaaaaaagatcgctttgtgaaaagcgtagtataatacacgtacaacgagaaaacttagggcatgcaaaacgagaaaaccattagcgtatgattaattgaattataattattacaaacttgaaaaataagtttatttgatattttaaagcaacttctatagatgaacacacattttaaaattcaagggcctgttcaaattgtagccaaaataaatattaccaagttttggtaaatgctaaaattttggcaagatggcaatattggcaggatttcttatgtattgaccaaatttagcatcaaactaagcgtagacattttttttggcaatttaccaaaaatggtatggttgaaaatggtatcaaagtgaacaggccccaactctcttcaaatatttaactaatgactattttattataattaaattttatttgatgaaaataatattatttgattgtcattttatatgattatgatgtcattgctacaaaattgtaatacttgagaaatttgaagtcagtgatcagttttgaaaattgtgctatgttttccacgtctgagtgagtaggatggaggaagtggaaagtttttttttcacgaaacataccgtttatcaatcttaaaaaacgtgcaaacgaaaattgaggaaaaatcagtatcttgagacaagaacaccacatgtagcatggttaatcatcgctgatccagatccatatactgcaaattctgaataatgcagatgttgtattgcacgctgtgcgacttgtccttgaaactggagcagtaacggtgttccacgataacgatatgctgcgcaggtttttcgcctccggtggtttctttcaccgagaagcgggaaccaaatcatgcacaagaggtcaggtgccgtcagcctgtaacaggctaggacagcctgaagccattgtcgtcgtagtaggttcatttcttcaaatgttcagcaatttaatttcagttctgttcaaccgtcacattacagatattcacgagcgatcatctacaggtgaagcactgctttcaaaaatcacagttaatcttattgcagttcacattttcttattgacatctcccacaattcccattgtaaaccagaactccaatcaacatccgaatcaagaatacacaagtcaatgtaaaagaataaaaaaacaaaaagaagaagaagaagaaaacatccacaggttcatgatgcaatgttccctccaaagttaatgctaaggcagactgcacaggggacagtaggcaaattgatcagctagctcatgagctccttctctgctcgcacaggcggcgggccgccatggacatgtgcgtggtcagcggccagaccaccggacaacttggtgttctgctgctggtatacctgcctcagcctctcgatctccttcctcaacgcctcctgatgagctgcacatgcaggctattgattaattctcatgagtggtttcttttttcagataatggaaagtaaagagatgctccttcaggcatgatgggaagcagcagcaacagaaaatgcagcatgttgcagagaagtaaaaaattttactacaaatttaactcaccatccttgaaaatcttgtcctgtgctagagccgcgatccgctgcttgaggtggctgttgccgacggtcaggatcgtccgctgctgatccagaaacgccacccgaggggacagcacggatacctcgttctgcaaaacatatcacattttacacaaaaccaaaatggcgatgtttaatttgggaataaaccaaactgatgcctgcttgtcaaagaagatctagccgtagtggtcagacactaatggcaccctgaattaccctgcatctagcttgttcggatacgctactgatacacatttgatttgtaactgtctcgaccgatccctccatgtgcacccacgatcagagcgctctatatgacccaacgtactgtgcacacaaacggagcatgttacatggagtacactacacaacagttgttaaatgctagtactactacttgcacaaacagtagtactaccacacatttcttaatagggcactaatttaatcagatgtcgcgcaagcaagctaagctagctaggaaagggaccacgcacaacacaccactgcccactggccaatccatccatgcagaagcagaaccatgtgcgtctggatcatggcatgacatgccattgccactacgtctacgtgggctggttggtgccgtacggggggtgaggtgaagtaagacatccgcaggcgtgcatatgcacgagggtgggggctcacgctctcgctcatctcctcgccacattgtgtgctattgccagccaaccagtgtggctgtgtccatcggtcggtctcaaactggcgccacttctgtccgtgaaactcatcgacgggtcgcttactacatcgcacagaatgcagattgcacagccacgaacggttgatctgacgtgagtttgtagagttgaggtagggtgttcggtttcctagctaggattcagaattgtgccgcgtttcgaaacgagcgtcaactcggcttgctagagctcgaagagcggattggtatagggtgtgataactagttttgagtttggtgttgtcgtcgttgatatgttcgtattgcacgtatatgtatgtatacctgcagggttgtgacgctgcgctcgagctcggagatgtactgaagcttcctcactcgcgacctctgggccgactgccgattagccagtatcctgaagacatttccaaagaagagaacacggtaattaatcgaggaatttatagtgtcgtaaagtgatttgtaattgatcactagatgcatgcatggacgcagtgcccaaccgggcgcgttcgctcgcttacctcttgaccctcttggggtcccggatcagctccgtcggcgaggtggccgccgcctgctcctgcgtcggctccccggcggcgtgctgcccgtcgtcgctctgcgccgcggcgtgcttgtcgccgccgccgtcgctgtcgctgccgccgttgtcggaccccggggccgacgacccgccctcgtcggggaacatagacatgagctggtcgtcgtcgagcctgtcgaactcgccgcccgccccgcaccccgccggcgccacctcgacgaacgccacggagtcgctcagcgaccggcggtgcgcgccccgccgcgacgccgcgaactcggcgaactcatccgcccacgccgcgtcgccggcgcccccggccgaggcccagtgctggtggtgccccggcgccgccaccgggatcttgggcgggagctgcgccatgtacgtgtccttagcctatagtagcgatcgatctcgcgagcttgggctaaccacctagctctggcgcgcgcgttggacggcgccgcaacatggatctgccggtttttgttttatactagcatgctagtactactacagtatgctagctgcaaagcgctatagccaccacgccaccttgttactacgacggagggaattggagggtcacatgggacgagacttttggaacatgacgacagcctgagccagctagcagcagctctcgttaattaggcttcttcgaacgcgactcgatcgatcgatgtcgatccatccccgtccatggatggatgcatccatcggtttgcatgcggcgcccgcgcgggaacaaagttggtggagggggatcaacggtttttaaggcagttaagtaggtgggcaggaatccccccatccacgtgccgctgtcgatccatccatccaaccggccggccgcggatctctcctcctctcgtcgtcgtcatcatcatcatcgaccgatcggctatcatcaacaagttgcagctcgatcgagcgatcgcgtacagtgacaggcttcaattagccctcgttgtcaccccgggatggaccggtagtatggccggttgcgtgcgcgtcgatcgatcgtcattcggcgcgcgacagactgcgatggccggtgccctcgaaagcaagcagtcgagcgcggtgccggtcacctcggttcgttcggttataccgatcgcgcgcctgagacgagcacgaaattttgtgggagatcgatggttggaggcgcgcggcatgccgtcattgcatctgagtttgtgctgcggcgcagtgactagaatatgcatcgcgtgtcagactgtgtcaaagatagaatatactgtcaggatcgcgtgcgtttcaccggggaaatagtaacagctgccgcgtatcgggagcagcatgttcgcaaatccattgggatcagagatctcaccgcgcttttgcttgcttccacaatactactactgtacacgggaatcttccgcaacttggatcccgttaagcacacgcttttctcacggcctctgtacggacgacgtgttggatcggttctctccgttaatcttgcaaacgaaaagcaactcgttttgcccaatgaaggctcagcaatcaacacaagaaacgcacttttgccaactccaaggcccaaacaccacggcaaaagcttcatcaactaggcctgatattctattgggctgggtttagcagtaaggatggcctgatacagtacgattggactgccgaaaaagctaatgcgcgcgtgccggcggcgcgcgtcctctgaccttttttttcttttttttttccgattttttcgtttttttcacactttttttctgattattttttaaatcttttagcatattttgagtttgaaagtttttaaattttgagttgaaaattttcaaatctgaacttgaaagtttttaaatctcgatttgaaaattttcgaatctcgatttgaaagttttcgaatcttgagttgaaagttttcaaatctcaaattgaaagttttcaaaattttcaaatctggacttgaaagttttcgaatctcgattctcgagttgaaagtttcgattctgagttgaaagttttcaaatctcgagttgaaagttttcaaatttgagttgaaagtttttaaaatttgactttaaaatttaaaacttaaatcgaaagttttcaaatctaacttaaaatttttttaatctgttagtaaaaaaatctcccaaaaaatctccagaatctttcctaattactatcattagtgttaagtatattaactaatataagtagttaagactaaagagaacagggagtgctcgccagctggctttcctggcgcgcacgcgcgtgctagccacccccttggactgccttgtattcttatgtgctttcccaatggaaaaagtacatcgaaggtccctcaacttgtaattgatttataaaattgtccctcaaccgtaaaaccagatatatgacatctcccaacttacaaaaccgttcactttagatccttcggtagattttgttagagaatattatctcctggggagataaggtcctttcccgtggaccaatccgaaccggagtagagataatatctatcttctcctaagacccctatatataggggcagggtgtaacatctaaggttggcttacacttcagatcagatctataatgaagagagagctccaccatatatctgtgttcattgtctacttctgcaatgttcttgagggcaaaggaatgggcgcgggtgttttacatcatctcacgcctctattgctgtgggagggacagggaacgaatccgatgatccgctaataggcgcgttggtttacaacacgttatcagcagctctccgttcaccggtttgtcgttccaatctgttctcgttattagattgatttctaaattacagattgatgtgctggtatttcttgctctcatgtcccgacgatctagcgaggcttgcgatgcaactcgccgggaagctacggcgcggctacgcataggcgtcgatgagaccgccgtcggccacgcgaacgccagcgtttcgctcgtgtacgaaagcttctggagatcggcgtgccggcgaaccactgcagtgcgatccatcgcctagccagcggctgcatgcctgcatgcatcacgaggggaagcgccaccaaggctggccgcctcacacaccctcaacgggccggcgtggagccgccgcgcatgcgcgcgcgactcgtgctcccgcatggcgtcgccgcgtcggtcgcaccgcaggccacggagatcacggctccacgggcgtacaatgctggctgccgactcagtagtcggcctgatcttgctcctctctctctctctcgctcacttctctgcgcaggttggcgggtggagagaaggcctgcggggcgaggcgggagagaaggagggcgtcggtggctggcgacgcggccacaggccaccacgcggagtgaggaggccggcggggcccatgttcatctcgtcgaggatcttgtcgccgtgctcgaccagcttgttggagtaccacgtgaggaagaacctccccgcctcggtgaggtacgtgccgccgtccgcggtgaagaaaaacgtgtcctccggcgtgtcgttgtactctccggcggcggcgtccggtagctcccacttcgggtgcccggcttctgtcgccgccactctgaagttctcctcgaggtatttgtccgatgtcagggaattcccaaccttggctctccgggtaggattggtatcttagctcacttgcagggccaagcccaacctcttatgtccacaatcaggccagagtccaagaagccggccatgttctctctgaatcgcttcatgaaatcggcatacaactagtgtcgcagataaacaatctatcaagtcgattagattatcctaaatttgatcatggttgtgatatgtaaatttgcaatctcaatgtcagtatgtcacaaattatgaaatcggtgtacctggatgggagttctgccgtggaacagaggccggtcatccacgccgatggtgaggtactcctggttcctcgcgccgccagggctcgtgtagtgcacgtcggagtcgtcgtcgccgacgtcgcggactcaacgaggcagcgggatgcatggctccctgtacacgcgccactcgtaccgcgccggcccggcgcccttgacgatgccccactacacgtccgccatgacaccgtcgacaccggcctcccgccgcagccgcgtcctctagctcgttctccgcggtgaccacgcgcaactgcacgtctgcacgccacgccacggcgcagcgccgctcgacacgatcaattcgaacgaaagcttggagagattgcgtgagctcggagcttaccgtcagcaggcctcctccccacccggtgcggtggcctgctgccgcgtcgccgcccgtcgccggccactgatgtcctcctcctctcccgcatcaccccgccggccttctccccacccgccggccagccgccagcctgcacacagaagtgagagaaagaaaggatgaagggagagaagaggggtaagaaacaagggctgacatggacactcgacatgtggctcccacgctgactcagccgtcacatcagataaaaccggggtcaaaaccactgaaggatctaaagtgaacggttttgtaagttgagggatgtcatatatctggtttgcggttggaggacgattttgtaactcgatggcaagttgaggaaccttcggtgtactttttcctttcccaatttatctccaacttttcacatacacgtttcctaaactgctaagcggtgtgtcttctgtaaaagttttctataggaaagttgcttttaaaaaaaacgttcttggcttgatcaaccggtatgatcgcgaacagacttttgatatgcttgtaagttgagtatgtgttgctatttctcaacggcatcagtagaaatataattcccagtaatggcgtataaacactcttggtatattatggttgcagacttcatccgtaagcgcacggatataccattgtagcatttcaccggagagtattccaagggtatcgtatttatttaatcccatggaaagattatattagagagaactatactaataatttatatattacatgtaataatcaaagtttaagcaggggttaagattattaatagggtagaatgacacacagaaagagaattatatactctcattataatttatctaagctaagtgggaagaaaatagaaataatctattcctatacttctaatatacatgcatattatacatacatccaagatatatgattactttgctaataccctctttccaatgcactcctggtgcttcgagaagccacccctgattaacgagtttcttacgacaatccatcatgaccatccaaccggggctaaatatggagaagtaccctccccagaaaagtaacttaggattatatacacgcgcggaggaataccagtgctaagctgtcaccatcagcggcccacctcgacgtatccgcagcatataaccacaaataatgatatccaataatctaaacaccacgcttaaattaccaaatactactctaatatcatcgtcatgacatagagcaatcgtatgcacgatcattatacccacaccattgcattttccagataagctagcatcataatcaatatagtttgaatgtatgataaagttggtactcatatactcggaaagtagtacaataccagagtagtatctctactacttaaaaagtccgtagtggtggtggtgaggccattccaggcagacacgcggaatatgaaccattcgatcgtcaaatccatcggttcagaataggcagatgcgcttctctccgcatccttatcgagcgacgcctcccatcgcgacacaactcccctctcctttttctccgcctctgccgcccactccacccagcgccgcttgacgccaacgctcgtcgcccgaactagccgccaacccccgtcctcggcgctactccaccgcgcatcgcctgccgccgacgaccgtcgccatcgcgccctaccatcggcgaccgccctgccccacctgtagtagaatccctgcctcctccgcctgtcaccctcgtgcccggccgcctgtcgcatccgcccgtcaccctcacgcctagggggctactccgccccgcatcgcttgccaccgttgcccgcgcccagccatcggctgccgcctccgcttgtcgccctcgagccctgccaccggcggccgcaaatacctgcccccagcctctcctcatcttctggatttttttcgtcgcggccgccgccatgcagatcaatcgatccacccgctgttcggtctccctcacaccatcatgcattcacgcctcctcgtcctcacgattcacacctcctcttgatgctgcagccgccggattcgggagctacaatgcgagagagagcttgattcttcttgcttgaggtgtgtgttggagggagtgagctgagggctttatatagcttgagaataacggttacgacggttggaaaggttggtaataccctccaaccgtcattagggagtcatctcaaccgtctagccaaaacctggatccaacggagccacggctggttcgattgaaccctgggctgacccaaccagccgacggtttgacaggcctcctctttgtcctctcctatcttcagacttgtgaattttggccatttttagtcatgtcaattctgtgttcttgatccatttgttcataagtctgatctttgacagcgtccgtgattaatcgtccattttattgtcgaatcgcctctattttatgtttattatatgcaaaaggttaggaagcctagtgctagtggaatatatcttattttgacacaatatgcattgcaagcataacttatttctcctttatttttggtaatattgatgggcgaaactgatcgataacgaccgtcaacaaaaccccccaagcttgaacttttgcttgtcccgagtgaaggactcacaagaataaaaacttggttgctgatcaggagttgcttccacgctgtatatctcaaatgtacaggtgcagggtatgtatactatctctcaaatcaaataaatttggcgcggtggcttactcttacccctgattcccacgagacattacccttccttgtcttgagaagttgagagacattacaacaataagagcactagtcacccaatcttcacttaactttggatgtgtttccttgaaatttttttcatggcagcatggcatatttggaagcaaaggaatggattaatctttcaaactgtttagccatcaattcagtcatggaaatctatgtttgttaaagaagttcttctgcatatgtgcagaatgaaagatccactcaagcattccctttctaattggatacaaactttgtagcatatttgttttgctttccctttgtatctttgtacatatttatattttataaaatttaaactgctgggcaaagccctagcagtactttcagtcaaaaaaaaactttggatgtgtatagttcatgccaaaattagaagtttggttgaaattagaatgatgtgacagaaaagttgaaagtttatgtctgtacgaaagttttaggccgagttaagatccaaagtttttcttcaaacttctaacttttccatcacatcaaaattttcttacacacataaacttccaacttttccatcacatcgttccaatttcaaccaaacttctaattttgacgtgaactaaacacacccttgatgtgatggaaaagttgaaagtttaaagaaaaattttggaactaaattcggcctttatatgcaaatgataattactgtgctttggaatgggggttataagtaaatgttcttcctagaaacctacttgctccatcgaaaaaagacaaacatgggattccgtgttcaacgtttgaccatccgtcttatttaaaaaaattataaaaataattaaaaagacaagttacgtataaaatattaatcatattttatcatctaacaataatgaaaatattaattataaaaataatttcatataagacgtacagtcaaacgttggacattgaaatagaaattcaggatttttttttttttttttactacttgtactgacacttttgatactgatagcgtgtaatgtactccaggtctccatgtgtgtgggcccggtcaattgcaccttcgtctcttcggcttccatcttcgtacttcatctgatcatctccttttcccatcagaattcagaagcctttcgcacctcgccacgcaccagtgtgctctcacgcgggtgtactcgccgacttcctgggcgccacagacggagtcgcccacacaccagccgcacacagcatcacgagaaacagtagcgtcctgattcccccaaatctcggagcgcacagggacgttccctaccgcaagtcactgatacgtgggcccgttattaacgtgggtcccacgtgtcagtggcgtacgagctgtgaagggggcgtggctgcaaacttccctctcgttcaaatcaatccacgaaccaaactcctctccctctctctctctctctctctctctctctgctcgtctcgtcgcccactcccaccacttcccctcccctttcaggaaaaaccccaactccaaccagtcttaactcaagctccactcaaccccagcctcatcaaaccctaaccccagcgtgtccccaatggcgaccctccgcgcgcgcaagcgggggcggggcggcgccggcgccggcgcggcggcggtgctcggggcgctcgggctcg

SEQ ID NO: 80637 - DNA, 12883 bp, Oryza sativa
actaaaatgcctttaatcattgaaaaaaagtagtaagagtaataataggtaggtaaagggtattaaagggagttttatctctaaagagtaggtaggatggtaggatggtaaaagttggtttttttatgggacaaaattcaaactctagaagttgagttttttttttgacggaggaagtaggcggtaaaagtaaaatgataattttcgtaggagatagagaatggcataattgttttcgatattagttccaggtacataggtgcatacaatgcctcactaactgtgtgcccggtaatttacatgacatgttttttagatttacattttttcctacgaatatggtcacgcagtaatcctctagattttcattttgttttaggagcacgattggttaaaatatgatcgaatgtttgccaggttattttgatatttacattttatcacaaagaacatctaaccttggtaaaaagatcagtggttagtaggttcatgtgtaattcatcctcaatacgatatatttatattgtttccacgtgtttgcgtcatctccccgatgaaatttaactaaaatgtcttaagcaattaaatagcttatttccttacagttattttgtaatgtatcgggtaaaatggaaatcacatgcatgcttggatagcatgtattgttgccattgaaaattaactacctctttgattttaggatttatggatttagaataaggtattcggatatatggatcaacgtgcgcctaatctacagatttgcgaactaatcatctatataaccaagcataaggaagataagtaccgattcttttttaatacgtaccggttcaatcaagaaagatattcacatcaaacaaaattaccgttgttttactagttacttaccctactgcaattggttataataattttatttcacatcttgcccttgcctttctcttagatcaacgatccacattgcaccacctctcagtacctctacatatctcacaaactccgtaaaagatcttaataaacttagatgaatgtgaggccataggccacacgttttccttcatatccccgaaaactatatcgtatcatgtaacaaatagtctataacagctaactatgcgtccaaacaaaactacagcatatgcatagcaactcgttggtatcaaaggtaccaggaggtaaaaaatttatactaaaaaaattatattacctttatggacgtgactacacagctagtagctagtggtagttagtttgtctaaaccagctaccactccatttatgagagacattatccacatatacttcaaatacaattttctcttaaactacttatccgatttacgatccgattgcaccgttatgtttgtaacaattaaatctttataacaagatctcacatgattatattctaataaaaaaatataaattacttttataatatatctaaattacttttagatttcactaaattacttcttaacatgtaaaagtaaattaaatgaagtctaaaagtaatttacatatgttacagaagtaacttgtaacaaaaagaaagtaactttaatgaatgtgtcgacggaggatacccgtagactggatatagagggtattgtcgacgggggatacccatagaccggatatagagggtattggggtctgttggtacgaggatctacatagtacgacatcaagcaaacaaaagacaaggattatactggttcacgccccttagcaggtaatagccctaatccagttggtatgggattatatgatggaaaccccagattacaaagggaatagaactcggtgatatcgacgagaccgtagtcgagttggcccgactagatctcctagtgacttggctcttgtaagctccggcttcgtaggctgtggtgggtgtgttggcggtgagattcgatgccatagatcctgccagggggtcccttttataccgcggttcagtcgatctccaagtagaacttggagatatcggacccctcacgatatggtaaagacccagtctcgtccgagtaggactctttccatccgtagattctgttcctatcatgggatagatttccttaatgtatacggaaactattcgtacacgcgcgggtatactgtatcggtacccatcgtatatccaaggatagagggcataccttatccgtaaccctgacatttaattggatgtgactacacagctagtggtagctagtttgtactccatctagtatctcctttcaacttaaaaaatacaacagtatcttcttttctcattctacatgaaaaacaaaaatgaaagggaaaaaacaatcgatgattaaacagattcatagagagttacttttgaaccatgcaaaagttacttccaattaacattgaagttacttttaaaaattgttaaacttatgtgtgttgatccatgctgattaaatttaatttctagataaagtcatatttttatccctacaacgaatttactcctattgtcgtgacaaaattactgccgttttgttttaagttacttttataatataatatatgtaaattacttttagactattaaatttacttttatatgtctaagaagtaatttaatcaactctaaaagtaccttatatatatatatatgataaaagtaacttacatataaaatgaaagtaatttacaaatataaatatttttttcatcgtaatataatcatgtaagatcttgttgtgaagatttaattgtaacaaacacaattatataatcgaattatagattggataagtaatttgggagaaaactttgtttgaagagaaaaaggacgtacatgtatattaaaaaaatgcatgcatgtagtactatgtagtagctagacttctccacgtaggcgtcgctagttaagacaaaatcgagaggcctctccaaatagattttatgtacctttatacttcctccatctatttttgatagtcattttttttaaatctgaaaaatttatttttgatagtcatatttcaatccaacaacatatactcttaatgactttctcggatttaatgtatgtctcactattcttccacatatgattggctacatggccattgagaaatataaatattaatgaatcgtttgtttacgaggaatgactagtagcatgtttaaatggatgataagtagaattacttatccttgttctgtgtgacaagatgaaatatgactatcaaaagtagatggaggaagtatttgctctaataacctctcgatacctcctattgaccataaaaatccctataaagaaacttttactacaaacactggaaaacttgaatctttcttgcggtaaagacattgattgtagtatgttagtaccatccaagtctagaacgccactgattctaaaacaatttcatgtacgtccaaaatatataagtaaaacgaaatatgaaaaacaccttatgcatgttgtacacgcctctgaaatcatccaactatgcgttgtaaccaccttatactcgatgttatattgtaaccttcctcactgaaatgtcttcaacacctcgaaattctgaaaaacaattctatattgacatttgccaacatgtcaatttaaggtttacacaaacacatgattttctacgtaaagtggcacacggattaaataaataaccaggaaaattcatattagtttggagtatgtttcctagaatgatttacaataaaaatcggttgacaacttgtttttcttaaaacccatccaacaacgggttagagaaccttcatgcaccagaattttggcattatcatcaccaactttaaatacagaagcaacttgtcacgcagactcttgacaagttcacttgagtcggcatcaattttgtgtcatgttttaggatcaattctgaacatcagatcagaggtgtactttccagttgaaattctacagtaacagaagttgtctgcactacactggaaacaccattgctactgctgtagtgatttactacaattaactgtagcacaagactcatttcagtattgatgcacctctgcagtaaggatcagtttccgttgacactgcttcctctttttttccctcaaaaacgcatgagagcattgctcccatttttatcaaggtaataagctgcatatggtgtcacttcagctaacaagaccaacctttgcagatcaaccagtccaattaatcaggaaatgggccatgctaacattgaagtccaaaaaaatctcatatgactgcctgctacatcatctcaatggctaatgatcatcttgttctgctaacactacagatataaattaagtgaaaagattcaggactgaattttacagctgcagaggggcacttgtatgtcttaccagccagggtcagatgcctcccagctgccatcccatggataactgctagaaaataaaatgtacaactctgattccttatccgtttgtgctacaaatagatgtcaagtcaaaggagtaaaattataaacacataaccatggaaaaatcaggggaaaacacagcagtccaacaggaaaaaaaaatgagtttaactacagccctcagaacaaacaatggcacaagatatgatggaaatatagaggcaacacatggtcttcaggagaagttaagtgcagttcaacccagggtataaatgatccacatatttctcataatataaaaactaaacaggaataacatagctcctgaagaaaacgatttcagaatttcaggctatctgaacagtataggatatagtaaaatctcatcgatcaccaaaaaatccaaataaagcaatagcagatattctcatggatagtggtaatcttggacaaatttgaagatcattacagcatgactccaagcatatatacacaaagagacatgcacagaacacagaagatccaggatattatattctaactcagaacacacatagtttgtctaactaaagaaagcatcaacggattagatagacacactagtgagaggtttctgatgtcaaagggtggttcactgaactttacaatctgcaatcaactgtagaacgaaattgctagaattaatctcttctacatttgaacatacctggcatcaagtgtgacatgtgcagtagtatagcccttcatggaatccaaatagaaaaacactaaaaaggggaagagcttagacatagtcaatcaagaggataaggccattggattgtgaatgtgattcatccatgcaaacaagatttgctatggtcagtactcagtaaacactaaacaatatggaaataatgtaggctaagcaagttgttaacattgtgaagacgtgtgacatccaaaacctgaaaaatcatgatggatttaaggcaacaggaatatatgctttacagataatctgacagcatgctttatgaacattcgaaatacaacatcaccagtggcggattcactgttggggctggttggtgtgccagccccacctctaatccctgctcttaattagtcattaacaaatctaattagtcattagtgaagaaatttcccgaatagcacaggctaccttagttcttctactgcccaaactgataaaacagaacatcctccgagtataaataacaatatattcacatatatttgtgaatattttaatatagccacaaatcaaaatagagagttttttttatcatatgcacatttggttttcattggaaaatactttagttgatatacctttatttgttttaatcatactccctccatccctaaatatttgatgccgttgacttttttaaatatgtttgaccgttcgtcttattaaaaattttaagtaattattaattcttttcctatcatttgattcattgttaaatatacttttatgtatacatatagttttatatgtttcacaaaagtttttaataagatgaacggtcaaacatgtttaaaaaagtcaacggtgtcaaatatttaaggacggagggagtattatattttttacactagcacctcctcaatttacaccctggattcgccactgaacatcactgaaactatagtcttatgttatgtccaaagcattttgtggattcaacaaacatcacatttgtgaggcatctagtcaaatattttttaaaacttcaaaatcatgtgcatagaaaatatgagttttcagatactgacagttgctgaaaggagaagcactctaatcaagaataaatttaacaatcagtctagcgctggcaaggggacaaagaaaacggaatccatgcgaggatagtaatgggactgggttcgcccagggagatggctagagagtaggcagaattttctgggagcaaagtcattaaaaagactttgttaaacgcattaaattgatggacttctgatcaaatcacgaatggccatgatgtcctgtatcatccagcaatcatatatcagaaaattttaaattgatgcctttaaagcacaaattatttgttttggggagatttggaggtaaggatccaacttcaaatatgaggtgtttgatcaaatcaagcgctagctaggactacttgtatcaacgctccatgtatagccaaactgatgctggtgctgttataataaagtatagatacacatctaaattttggtcaaaaaattggaatatccatgatggcatgatgttcatgttgctatttacacgtcaaacagtagtgttgcatggatctctccacttctggcatatcaggaagcatgtgcagtaactaaacaagttgatgaatacaaaacacagaactatttataattgcaattcccaagctgataagatcaaattggtgaaaatttccaattgcttttatttacaatcaatgaagtttactaagaacttatgtatatctgtaaggaatcagtaccacaatttctaaagtgctgcagaacagaagcaggtgaatctgaattgaacagtacgcaggtgactttcttcacctcaatattagacaaacaatcgttactttattgtctaagcaattctaagaaaattatatcgcaaaaaggtccaaatttggcatatagtaacgcagtgaaataatttcccatcctgataaagattattgattagtttccatacctgcaaaggcttcctatgcttgcagtgcatgcatttgtcaggaggcaccaacaaggacagctactgatctttgaaagagctagctacatagctacatatgtcagatggtacaagaagcaaccacaattagattgacatgcaaaattcgattaggaccaaaagagtttacaaataccaaacctgtactgcaacagatctgaaagctacaatattactccagaaaaagcagaataatataaatatctgtctccaattctccatgaaatacaaagaagtgcttgaaatgtttgcagcatatatgacatatttttattccatatataacatatttgctattccatatatgatatatttgtaattccaaacgatagataagccagctctttccatacctaatcagaaactaatacacaaaggtagttagcaaactgagtaactggttttggagaatacaatggccagccggcactgagcagccatatttctaaggcgttgttcgtttaatccccaagagagagggattggaagggaataaatctccttcaaatccacccataagagggattaaacgaacaaggcctaaaggggtttcatgtatgtaggtgtagaacccatagggcccatgagttatatatactaccgccatccttaaaaggatgacatcataaaatgcatgcggtcaaacctcaaaatgttaaacgattaatatatggaaaacatattaggatttgaatatgaaaatatatattagtagatttgctatgaaaaactattttatatagttatacttttattaagttttataaatacatagtttgaaaaattaatgatcgaacatgtgcatggaagactgacgatatccaaaatataagtaaaaaagaatggaggtaataatatggtggtataagtctcacactcttacatgatgagtttaataaataggttaaggccagagtataaaattaacagttccaaaaaaataactccggttaatgcaagtgtaagtagggtaaggcctgatagaagggctagagattagtgatcaaagtattgtctgcaaatatattgtgatagaaattgttatcaaagttatatttaggagaccatgttgatgcccaaaatgataagttttcatggctagagtataaagaatctagattacatcagtattccttactgtgggaaaatatctagtaatacattgttaactacttagtttatgcttctacctctgatgctttcacaaaagaaaccctcaccaatagccaccacatgagcatgaaccattcttgaaatgatgaaaacgactggggtcgcgcactacgatctcatggtccacaatcttggaaatgtaggtgaatgcgctatggcaatcaccacatacacgcaggttctttgtgatccttattgggcaaccagggaaagttgtgaggagaccatatgcaagagcaagtttctcactgtgctcaacaagaagattatttttctcttcctcatcaacatcatgtaatgcgaagtttgtctcaggaacatatcccatagctttgatgcgatcaattagactctccagaagagcataaatttgtggggatagtgggtgtgatcgatctccgacaaagaaagatgctgtgcccttttgaccctggacccagctgcatcctggcctcttcttaattcctgatttcttcatcaagtgcctgatcctcgctacatccttccaccgccctgcagtggcatatatgttggagataagcgtgtaagatccatcattttcagcattcatctcgaccagtttgttcagagcatgttcagcaagttcaacatttgaatgtactctacaggcactcagtaatgcaacccaaactactgcggtgggctccattggcatatccttaactgttttccatgccttatctaatcgcccaaagcgggccagcaagtcaatagcataggcatagtgctctgcccgaggtgtcaaaccataatctgcactcatgctgtcaaagtacgatagaccttgatcaaccattccacaatgactacaagcataaagaacaaccaggaaggttatatcgtcaggaacaaagcctgctttccgcatcttgtcaaatatgtccagggcctcactaccacgaccgtgcattccataccctgtcatcattgatgtccaagaaatagcactcttttgagacatgctatcgaatacatgcctagctgtatcaacatccccacactttgagtacatattaatgaggcagttcgccacaaagtatgcagatgagtcatattggtgatgacgaagcacataagcatgaatctgcttacctatacgtatggctgccaaatgtgcacaggccatcaaaatgcacgaaattgtataagcatttggggctactccatatggttccgaaatcatctccacgaaaagcttgagggcatcatttgagtccccatattgtgcatgccccccgatcatgacagtccaggtgacaacattgcgttcctccagaggtatatcatcaaatatggagcgtgcagctttgaagcttctgcactttgagtacatatctattagcgcgttgtacaccataagatcctcatcctcaccaccaaaatcattatccaaggttagaagacagttctttagggagtaggcatgaatttccataccctgagaaaatgctcccaaagaagcgcaggcagacaacacagagatgattgtgacacaatttggcaaggacccagaaaatatcatttgacgaaatacattgagtgcttcatggctgcatcccctctgagaatagcctgcaattacagcagtccatgttaccatatctaatgggatattttccttgcgcatgttcttgaaaagctcaaaggctgccttaaagttgccactttgggagtacccagccaccattgcgttccaagaaaccacatctttgaattccatcatgttgaaaacctttaccgcattttccatcaaaccacacttagcgtaagcatcaatcagggcattaccaacaaaaacatctagaaatgtgccattacgaatagcattaccatggacttctttagtttgaggtactgcctttagagaaccacatgcagggagtatgttgacaatgctaatgatgtctgacctttcatttgtaggcttctcatggacaatcaatgtcatctttgaaaacagatccaatgcagtccaagcattactacttttaacatgggctgaaacaatagagttccatgagataacatcatcaatacccctctgagttatttcatcaaagatcatgctggcttcctccaaagaaccacaacgggaatacattgccaccaacgcattacatatgaagacattggactcaaagccattgcagcatatcaatccatggaatgcactaccacaacggtatgaaggtagctctcaacatgcttttaatacatgtggtagagtaaaatggtcaagcctagttccagcacgcagcatgcggcaaaagacattaattgcactgtcaaggcggccttgtttaatgtgttctcggataagtagattccaccacacagctggtgacggtgtaacacgttccaacaccaagagagcatagtcggtagcaccacaagcaagataagaagctacgacaccagtacccagagatcttggagatataaatggttcggatggcaatgctggcagtgagactgacaataatggtgtgggcaaagaaagaagaccagaagcaattatctgttggtgaatttgatgaactgtatttgcagacttgcattccttcaatagggatgcaaagtgactaggataaacatctacaccaacgcatgctgcccttgcaccttaaaggaaccgtactccaattggttttaccgccttaggcaagttcaaaagcatagctgcagtagaataccattatgcataatgaatcctcaaagaaacagccattgcatcactgtatgaccaaaaataactgaattagcaaaagccatcatacatattacatcaatctaatgcaaaacaatgtaatgtaaaggaagaataagtcaaagatcacaaaggggaataggcatgctatccatcagggttgcagaatcaaaggtagtttgtagtatcctaccatcctgtaaaatccttcttatctggattattggggttttaacaacctaacatcatgcaagatcaattgtcaactcccagtgacaatattcatgcccaaagcttgtactatgtagcactaaagcattgcgatgcttacaaattatccacctgagcatgtgactgtaaatgtccatttcatcatttcacttcaaatgtcaatctcaggacacagtggaaatactagccctagtaggaaaattttgactatttatgtgtgataagggggtataacatgaaaataatttgagctgcaacagatgcacacatagacatgactataggtttaccaaattgtcagaacgcacgagagaatgagaaaggaagaataataacaaaggagcaactgtttgtaccttttgtattcacaaacactgcagttcaaatcaaccatgagaagcaacagtggaatgattttaaatcaaccaggaatgcaaactaaattgttctttatatcatatcaacgcctcctaaatctatgaggagtatgtggaaaaaattcgaagttcagtactacaactaataagacaaatcgaagccattgaagggtgtcaacttttctcactataccatgtcccatccattttgattcaattctttgaaaaccttacaacaaccagaacacaatggaaaaaaaaagataaaaacatgaatggttccacttcttacgatctaaatcttgaagtcctggtacaagttcccttgtttcaatttagaacaactgaaatccattttttaaggaaacctttgataattggatttgcttgtactactctctatctgtggtctgtactattgattaaccataagcatttattttgagcaataaaatctaaatctggcataataattcatagtaacagtttttcaaaattaattgacaacataaataatgatttcatttttttgttgggcttaagcggtatatggcataactatcaacactggaagcagtgggagtcggcaatgtataattgccaaagaagaaaacatgaataaaggaaagtaaccatgaaacttcatcatccttcaatttctatcagacacgattaattgccgatgctgaacccgtcccactacaatgtatagagattttctttaaatacagtaagctatatgtttcagtgacaaaaaaaaagagaagaagatcaaatggagcacatgtgggagagccaccgccacagcaccagcaccagcaccagcaccactggagttggagaggagctgggagaaggaagagctttgttattacctgtcctccaggcgtccgcgcgcaagaagaatacgtcggagccgcaggcacggaggtggcggacgacggagggcgccgacgagccgcaacaggccaaggcacaaggcagtggccggaaggcaatggcgtcgagcaagcgagggaagggccagcggagcgtcggggcggacgcgcggagaccgggggagcggagctgcagggcaatgcggcggcggcggcgtggcttgtgacggagccgcccggagtctgggttttggagcggcccaatctgtagccacacgtacggcccataatgttatcacttcctgcaactagatcgacaaatcttaattgataaagtcatcataaacacttcc

SEQ ID NO: 80638 - DNA, 3396 bp, Oryza sativa
taaaacatcaattaattctgttttttcaagtctctctggctctcgctccggcgtgtgcggcgcgtgttaacgctgattcttggtaaagatgttcgtcttgattgagggcaaggcgattggtcatactgtaatgggggattaattatttgcaatgtgtcctcttggtgcctgaaactctgaattctttaagcattgtcatcctcctagtaaattatatattccatcgaagatagatagtagattctaggacgaattcgatttggacatagcaattttctgatatatctagtaaattatatatttaattccgaaatgttgggtgatacaggtatttgcctttcaccttgagtcggccccaatttccaatcttgatcttgacttccgcatatgaatgttgcttgatctgtattcgacctatgcaggtgctgttgatcgctttgtgaaatggagctcccagttgctgatcctgggccggtgagggctgaaggattgcttctgcagtgtccctattgtgattcagaggcaatgcacaaactcgcgcagttcttgctccccggcttggctgcggtatgcattgactgcacgacaggcgatctcttcaggaagccatcagttgtcgccgttgacatgaggaaggaaatggtggactacgtcacgcagagaagcgagacattcatatccgattcgcttatcgaatcagaagcaagtcaggatcaagagaacgagatgccggaggacccttttgagatcgtgtccatcttcatggatgattttagtagcacgaagaggaacattatcggccatgtctctgggtggttgatgagcgacagccgcgaagataagattgatgactttgtccaagaaatggagatgacccgcttctggccgctggaaaggagagaaattattgctgaggtcctcctcaagaatgtagacctgaaaaccaagtaccactgccctgagaaatatgaaaatgaagaacgtctcgctgatcataaggcccagtgtagcttcagacctgttacctgccccaatgatggatgccgagcgaaagtttctgttcgctgcatgcaagaccatgattcagcttgcctgtttaaaatccttacatgtgagcagaactgtgagaagcggcttctgaggcgtgatatggataggcactgcgtgactgtgtgccccatgaggcccatgaaatgcccttttggctgtgattcctcctttcctgagcgtaatcttgagcagcactgttctgagtttcttcaggcacacctccataaactcctcaaggctattcataagaaaggttttacagatgaggggctcaaggaccatgctctactgctggaaaaggttaggctcctgatcttgttaatttacaatgtgtaacatacgcttttcaattaaaatggctgccttattttcttgatttggaaacattgctgtcaaactattgtgaaaaagaagacatacatggactgcagcaatatgatttactgaaataatctggttttgttctgcagcatgacaatgatggtaaactggctaaatctcgggatgtaagatctcttactaatgttgtaaagaatcttgaagccaaaataaaagatgattcgagttagagtggatggcgtctccagagcaaaatgcaagttttttttgaggcagcaaaatgcagcatggatattgaatggtatagctgaagagttgtttccactcacagtatacacagaagagtacaagattctgcacgtttttcctttacaactataattttcccctcatgatttttcttttctcaaaatcggttagttttttatggtgtaaaagtataacattattttatccttgctattttgtccaaggaactcttttttttcatataaattgagaataatttatcaggaatgctaatttttgtttaatttatggaagggcgatgcttgaagtaagggatgtttttcccagtctaattccgttccctgtaccagctaaatactccctccgtcccaaaaaaagacaaaccctggtttccgtgcccaacatttgaccgtccgtcttatttgaaaaaattataaaaaaaattaaaaagacaagtcacgcacaaagtattaatcatgttttatcatctaacaacaataaaaatacgaattataaaaaaatttcatataagacggacagtcaaagttggacacggaaactcagggtttgcctttttttgggacggaggcccactagctgaagttaaatgctattcctcacaatgttattatttgttttttggaaactttttttttcaatgatccagatcaaggttaggaacactagcatttatcggtaaactgttggaatagtttaaattcaaattttgtttttcgatttacacttagtaccgtttacatgccctcacatgtataatgcccattgataggatatctccacctcctacaagttgtgtcgttttcatttatcatggattcgtgtatgatgtttatttcaatgtataaattattacaagaatgtcaaacatcttttttttcaactagtccctgatcggtaaccattattcaaattctttttttttttgctgggaaaaccgttattcaaattctaatattcgatttagatttacagtaaaatctattccctctatttcatattataagttattttgaattttttctagccaaatttatttaggtttgacagtttattaaaaaaattagttcggttaaatgtaacattgaatatgttttttttccaaatgttgctatattcttttattaatttgatcaaacttaaaaaagtttgactaggaaaaaaaatcaagcaacttaaagtcttttttatatgaggggaaaaaagagaattgaaaagatacgcaaaacaaggtgagctttagcgaacgattaattgagtattaattattttagattttaaaaaatagattaatatgatattttaaagcaatttttctatagattttttttataaaataaacatcatttagtactttagaaaatatgcgcgtaaaatacgagggagtttttctgtatctaccgaatcaatttctctcaatcagttttatgatatgaaacagagggagtagatcgctaattactggtcaggcttgggtgactggtactttttgcaaatactggtttcctaggttttatcctaacaaataatctggcgatattttacggtgtttgcattttaaaaagggtaaaagtctatcgctgcacaatgaaaggtaccacttaaaaggttgatatagttacttactccctccgtcccacgaaaatccaatcctagcatcccaagatagaattagtggaggatagaaatgactaaaatgcccttaatcattgaaaaaaagtagtaagagtaataataggt

SEQ ID NO: 80639 - DNA, 20612 bp, Oryza sativa
ttatccaacggtcagactcatcgacgcgctcagcccctctatccccaaacgcgcgattctcctcattctcgcgattctcccaaaaaaaaaattccatcctcaccctcctcccgtctccaggtcgccgcccgcgccgatctgctctgtaccgatctctcccactggcattgccttcctcaccgatcttttccgctccgccaccgttcctcgccgccggaagccctcaccaccatcgcactccgtcgccttcgcgattcccaaccctaaccgccgtctccccgcaggtcgccgtcaatcgccgtcgccccgcaggtcaccatcgcaccgccgccacccggtcaccgtcgcgcctccttcggtctctttacatcgcgccgcagacggatttccccgccgacggggcgccgcccatgccatccggtctagcgcgacctccgccaaggagttcggtatgtccctctcaccactgatctgtacgtactctgtactaactaatgcagggaagagttttcatattattcgttttttttatttcagtttttactattagttgtcagtcaaattctgctttgtgcagactaataattttttccttgaaaatgtaatttgaaaatgagatggtatgatgtcatgatgatgggatttacaataaattgagcttcatgtttcatgggtttttatttatttgtatatttgcaatggagaagagaacatcgttgttaaattattttacaagcagttcgagtatatatatgaaaagagtattcactacaataactatatcataataatgttacttttatttgcagatgtgtgcccatattatttactcaatcatatgtagtcatttgtttactgaaatctaaatcaggtactagactttatacattggatgagctgcagttcaatggtatcgtcactgctgcttttctgactcctgtggatctgaatttgggtgtcagacgcccacccaaacggcatctgaatttgggtgtcggacgcccaaacagccagaccctaacaacagctgctagaaaggtctttgtttctcctcaactctcatcgtgtatatatgtttccctacctgattccatgttaaaaatgttactaagtctgaaccattaattttggtatgaatcgtgtgaattttgaagagaatagcatgtgcactgttaattctgttggacagaataaaacctagacttggttggtactataatctatccaacatattcagttattatgctctgtattgtagtgtagccaatttattcaattattcttctttgtactgtagtctagccaatttattcagttgtactatttccagaataggggtatctagggtatcaaattatttgattattctatgagctacatgctagaaccattatgttaagtggtatctctacatcgcgccgcagactgattccatcaccggccggtcgccgcccaatggttcacaaactctcaaaacatgctctcagatacgttgtacttattgtccttcaatatataaactcacaatggttgagtgctcaatatatcttatctaatttgggaacatactatttgattatcattcatataaagctggtagtatccccaggtatactaattgactttgttgtggatgggtgaataactgcagatcatcagcagatgtatcaacatggggaatctcgcctaatttctaccctggcacctcaagctgcatatcaatggcctttgataactatcaaggataagaatgtagtttagttttttgtgttcaggtatgaccaccctcgaaaaaaaaggtatcacaaatggttatgagatagtagagatttatgctcccatgagactaaatctctcataaggatgccgatttactgtaagtgaaaacaagctaaagtgcatggagagtatctatggaagtaatatgagcactgagtaggcgtctgcatcaaatcttacatttatttctatctacagttaaagaatgctaattaatctgtaatttgtcaacctcctaagctatatctcgtattattccttcctgtcattttactctgccaattacatttgcttttaccaattttttaaatcttccaacatgcacaatataggccctggtattttgctttttttacaggattcctgtaagataacatgattgcaatataccttgatcccgagagatgatttttgcaatgtttacccaactttatttgctgacactattaatatccttctggtaatggttaggtttcctgttattcattcgatgttataaaatttgtaacaaaagtgcataccaaaaggttattgttgctaatatatcctcaagaattagtgtgttacagacatctgtagatcattttttcttcgtggtctttgacgagcagatcatagtactcattatcggttatcaatggtttggcaattgcatatcaaacaagtatcctgtttacgattaaacatatggttgccactgaaatttcttcctaacattttagagggaacctgatcatgctatctcatcagaggatagagaagcggtcatgggcaattatgtgtttgccatttagcttatataactgctgtgtgtgcagtattgggtatttatcctttttatgtcttttgtgctgcagaatgagagcagctcagcaagcgattgttagagaagaataggatcgagccccgcaccaagtagaggtgtttgtaaaaagtggctagcagaataggaaaagaagattacaaagctgcttgacttgaatagccttgacttgtgaaaatttttcatgcttgatacataggaggcggcaaaagcgagtgcaaaaggaacctcgacaatacgggtgaaatggtgggctgcagctcttcaatttgttcatccaattaatatacataagcctgttctgtagcttcgatgaaattcgacggatccatatgtttcaatgtttcctcccctctgaattgattccgagaggtaattttcttaattcgccgatgtggtgcttttcaaaatacattatactcatacatatgaaaaattaaattggtctgcccatttaaatatgaatacaaataaatccttaaatacactaactatcgaatgcacgccataaaaaggattgtgaaaaaaactatttaattactgcatggaaaaaaagttctcacgtgacatgaatcacattgtagtgctttaaaataggggaattcgattaatgagaaacaaaatatattttttgtctgtcaaatatgtaaaaggaaaacgtgaaaatccatcttttaatataggcattggcgatagttattaaagataaatagagttacaccgtagcgtttagcacacgtaaaatagcaaggatacaaaaaatttaagtaattattaattcttttcgtatcatttgatttattgttaaatatacttttatgtatacatatagttttatatatttcacaaaagtttttgaataagatgaacggtcaaacatgtttaaaaaagttatcggcatcaaatatttagagatggatggagtataaaaatcctgtgacactaatatactccatggagtgacaacggtcctctttattacagaaccatcccacaccgttcatatcatgccaagttgacgacaaacgagagctggcactatcattcatcaattttgtaatagggcccgtgcacatctatctgacaaccattcaatattttgggctgttcaaatggtagacaaaataaaccaaattttgacaatttgataatattgttaaaattttagtaggatttcgtatgtactaaagtttggcaaaaactctaccaaaaagtgatatgatttgaaataacatcaatataaacaagcctttcaacgtattttttctcataaaaaactaatctaaaataaaatatgctatttttttaatatacttaaatttattgtactagtaaacgtcatatttcatcatagatcgttcttttatgggacggagggaataggagccgcctaaccaccaaccgacgttccaccacatgttggaatgcatatgacagttgatcacaccgccaaagttgtacgtacggcggtagacaacgttgcgtgggggtcggccactcggctggacctattcgcgccgtcgatcgatcgtgtacgtacggcgccccactactcaccgcgcatagtactgtacacgtacgacgtatactactcctacctaagaccggtcgaactaatcggcaaaatacgacggcggcgccgcacgcacacgcgcgagcctttgacaacgcgggacgggacaccacgtacacgttcgtcgatcaatcgatcacccacacgccaccacacgtccacgtacgttgttgagttgtgatccaaatttatttgcacttaataaaagccagctccacgttaaaatctcgttttttttgtgattgatctactgttatttatcgtttgtttgcctatcgttttctaacctatgtaacatgtacttacaccacgtacgtataactgccgagccaacacgcccgggaagaacgctcgcgcgcgccggggagacgacgagagaattggagaccgggtgtgtgtgacagcgagacgccttgcccccgcgggcgtacccgtacgtatacggagtacgttcgtacgcgcgaccgcgaccagcgatgcgccgcgactcgcgggaccgatcgagcggaccactacccgtacgttctgcgcctgcgtgcgtccgcggctcaagcggctggctgtgctgcgtggatcgctgtagcgatcgatcgatcgcccaggtgtggtggtgggaacgcacgcgctcgagttcggcaagatgtggtagtatcagcgaccacggaattttcgttttcgctattcccaagtgggttcttccggtcgggtgggcgggcgggtgacgcgctacatcacccacagcaagtataatagtactactttgtactgagtacaagtatatcgtaaatttatggtctgtccactttgatatcatttttaaccatactattttttttaaagtaaagttatcaaaattttactcattcatcattcatcatgtcacacatccaacgatccaaaatccatctgatgacttaaatccgacggctccccgcctccctcccgatccgatccagatcgcggatcgcttcccctcccccgggcaaaatcaccgcgcactccctcctctttctatcgctcctgccgcctcgcctttcgcccccctccatctcgccaacgccaccggcttcggcttcgccacccccttcggccggcggccgccgcccctcctcccctgcgccgccgcatccgcaccgcccaaccccgccggccaccgaggacgcggaaaccgcacctcactcccggtctcccacgcctccctctcctcttttagtcagaacgcggacgccctcctctctcgcagccgtcgttggagcgagcaccgccactccaatcgccggcaatccccttcgccgtgcgcacccgtcgttggagcgagagccgtcgtcggttcctcctccaccgtcgccgccaccggatcaccgacgccgaccgcccgcatcgtagcctccgtgccaatccccccatctcgcgagcagagcaggggaggggaggggaggggtgccgacgtgccgtggtcctgctgcatcccggtgagcatccacatcatctttctgattcatctctctctctctctcccacccacttttgtctcaaatttacctgcattaaccctagcttctcttctagatctggatggagctcttctcttattttgtttgtttgtctccccaaaagtccaagttcgatccgcccctgctagggataaataagattcaattcaacacgaaacacacgcaaaattaatctgaagcacaagccccttcactcccttcacacgcaaaatcacatctggttcttgtagtttagaatgaacataatgctacagtatgccttgctgctcatgaactgattgacaaaatgtctctcaaggttatatctgaaattctgagcatgttaatttgtgtctcccagtaaggttctgtcatcttctgtcatccattagtgcccaatcaaagaacttgcatataataacatatattctattcttttaaaaaagcagaagctattatctgaagttcagctctcagtttcacagtaaatttacataattaacagtgcatgtaatttgtgggtactcttatataggaaaggaagatcagcacaatactgacgggtttctcttcaagatgatcccgtggttctcagttttctgctttctacactgtctacatcttatatgtgttcattgaagctacagattgatggacatagctgtcaaacctgaacctaccaggcctcctggtcatgtttctcctcagctctcatcacatttatatgttttcttacccaattccatacaaaaaattttaccaaggcagacccgttaattttggtatggatcatgtgaattttgaagagaatacgtacaccgttaatttattcatgcattctgctttatactatagtctacccaatttattcaattattctgctttgtactgtggtctagccattttattcatttttttcgcgttgccctccgctgtcgtccaggaccgtcgcccacggcgctggcgacgattcaccgccgacgtcatcgtccaacaccgtgacttggcccttcgtcctccatgtccaccgcgccctcgccgccattcataagaacaacattgcagcacccaatctgtggcaccccatcgacacatacgaccgcgtcgccctggctcatcgtggctaaccccaccgacgaggtaactagatttaccttttgcttttgttcgattgtttgacggccgagcaacagggatcgcgaccagtcggcaagctgactgttttggttaactgataagtgataactgaggaatttaaagctgtgtgtgcttgtcatgtgctttcgggtagctgttcttaaccactgccaaaagtttcggaaggtgatagaaccaaacaggtagttctttagctgcctgtgcagtgtgcagtgtgtctctggaccaaaggttgtaaatgttgcataaatgtttttttttaaaaaaaaatccagttgaggtactcttgggtccaaagccataaatgcataaataaggtccaaaggcactaatttccattgctagctttcttgtcacttagtttcattacatttgacatatacccagatgatttttgttcttgtttgtgtacaggttcagagttttttatgtaataattactctctttccatatatgcagtacatttttattacacgataacatcagtgttaatgttctatatggcattactatcattatttttcaacttatgtcatgcatatcattccatatcttttacttctcttttattatgaaaatgacatctttctgattcgttgagggcatgcggggtagtatatctgttattttaatatattcagtgttttcatcaatatattgaccaaatattcggtttatatcagtaaagggccatgttcttttcacaagatctgtttctgaatatacagactgtgttgcaacatttatagaattcaagttgtccgtagtcctgctttgcatgagtaaatgccaatcttatgtgtctgaactcttttcttctgtgtctgaactctcaagtgatgatctatgtttcccaaaaaatcttatgtctagcaaacttagtttctgtttccaaatgaaaaatcaagtagtgaataatgtacctgtattaaatgcactggtctcttatttagtaatgtatctagatacatatgctgaatttttatatatagaagcatatgttgcttttacacatgaaggtgtatatgctatcaggtttctataatatggttcataagtgaacagcatcaaatgtctacgttactttagtttgaatgtacacgctgatataaaatttagagagcattcttggaatgtacatactgttaagaaaatttagatgaattaaatccttatgccttatatgttttttctcacacagttgtaagtttgtttggagaaggggacattcacaaactgcttgaaagaggtgttttggtatctcaatatatggtggaatatttactactgcttttagtaactcctagataatctttttttacatacatgcataactaaatttgcatatatcttcatgtgcaattgcgctctctgatattacaatggtaggatttgtctttgaattggtatagtgacgtatttctgattcattaagggcaaactggggagtagaactgttatgtgcgagatattcagtttatatttctaaacttgggtgcactttgaatcaggacgaataggctcagttgaatctgtttttaggatgatgcttactggattgccaattttgaagttccattcagatcaaatattaatgatttatagattcaggtttgtctgaaaacgatataaaacaatatgctttgctgaacttaatactgggagatcactagggtggggtagacggccttcatggcgtctaggttctattgtggtccaacacatactctttttaccgatcctaatagatttggcataggtttatctacatctgactatgactactgtatattcctcaaaaatcctattagtatatgttttctgttctgactcgtctggttgtctcttatattaaaggtaaggaaattgaaggagttgtagctatccaaatacatcagcttctcaaaatagaagagctaaatatactagtaatatgcccgtgctaacgctacgtgtatgtttagtaatagaaatcatgacacatagtaaagaaaagataaagattaggaaaggagatgaaaattagattgaatacaaaaatttagggacggaatattcagtttttgttagcaataaataaataaattatgggccgtacgtgtggcttcagattgggccgctccaaaacccagactctggacggctccgtcacaagttacgccggccgcgccggcgccgccgccgccgccctgcagctccgctcccccggtctttgcgcgtctgcccgacgctccgctggcccttccctcgcttgctcgacgccattgccttccggccactgcctcgtgccttggcctggtgcggctggtcggcgcccttcgccgtccgccaccttcgtgcctgcggctccaacgccttcttcttgcgtgcggacgcctggagggcaggtaataacaaagctcttccttctcccagctcctctccaactccagtggtcctggtgctggtgctgtggcggtggctctcccacatgtgccccatttgatcttcttctcctctttttttttttttttgtcattgaaacatatagcttactgtatttaaagaaaatctctatacattgtagtgggacgggttcagcatcggcaattaatcgtgtctgatagaaattgaaggatgatgaagtttcatggttactttcctttattcatgttttcttctttggcaattatacattgccgactcccactgcttccagtgttgatagttacgccatataccgcttaagcccaacaaaaaaatgaaatcattatttatgttgtcaattaattttgaaaaactgttactatgaattattatgccagatttagattttattgctcaaaataaatgcttatggttaatcaatagtacagaccacagatagagagtagtacaagcaaatccaattatcaaaggtttccttaaaaagtggatttcagttgttctaaattgaaacaaggggacttgtaccaggacttcaagatttagatcgtaagaagtggaaccattcatgtttttatcttctttttttttccattgtgttctggttgttgtaaggttttcaaagaattgaatcaaaatggatgggacatggtatagtgagaaaagttgacacccttcaatggcttcgatttgtcttattagttgtagtattgaacttcgaattttttccacatactcctcatagatttaggaggcgttgatatgatataaagaacaatttagtttgcattcctggttgatttgaaatcattccactgttgcttctcatggttgatttgaactgcagtgtttgtgaatacaaaaggtacaaacagttgctcctttgttattattcttcctttctcattctctcgtgcgttctgacaatttggtaaacctatagtcatgtctatgtgtgcatctgttgcagctcaaactattttcatgttatacccccttatcacacataaatagtcaaaattttcctactagggctagtatttccgctgttgtcctgagattgacatttgaagtgaaatgatgaaatggacattcacagtcacatgctcaggtggataatttgtaagcatcgcaatgctttagtgctacatagaacaagctttgggcatgaatattgtcactgggagttgacaattgatcttgcatgatgttaggttgttaaaaccccaataatccagataagaaggattttacaggatggtaggatactacaaactacctttgattctgcaaccctgatggatagcatgcctattcccctttgtgatctttgacttattcttcctttacattacattggtttgcatgagattgatgtaatatgtatgatggcttttgctaattcagttatttttggtcatacagtgatgcaatggctgtttctttgaggattcattatgcataatggtattctactgcagctatgcttttgaacttgcctaaggcggtaaaaccaattggagaatggttcctttcaggtgcaagggcagcatgcattggtgtagatgtttatcctagtcactttgcatccctattgaaggaatgcaagtctgcaaatacagttcatcaaattcaccaacagataattgcttctggtcttctttctttgcccacaccattattgtcagtctcactaccagcattgccatcgaacccatttatatctccaagatctctgggtactggtgtcgtagcttcttatcttgcttgtggtgctaccgactatgctctcttggtgttggaacgtgttacaccgtcaccagctgtgtggtggaatctacttatccgagaacacatcaaacaaggccgccttgacagtgcaattaatgtctcttgccgcatgctgcgtgctggaactaggccggaccattttactctaccacatgtattaaaagcatgtggagagctaccttcataccgttgtggtagtgcattccatggattgatatgctgcaatggctttgagtccaatgtcttcatatgcaatgcgttggtggcaatgtattcccgttgtggttctttggaggaagccagcatgatctttgatgaaataactcagaggggtattgatgatgttatctcatggaactctattgtttcagcccatgttaaaagtagtaatgcttggactgcattggatctgttttcaaagatgacattgattgtccatgagaagcctacaaatgaaaggtcagacatcattagcattgtcaacatactccctgcatgtggttctctaaaggcagtacctcaaactaaagaagtccatggtaatgctattcgtaatggcacatttccagatgtttttgttggtaatgccctgattgatgcttacgctaagtgtggtttgatggaaaacgcggtaaaggttttcaacatgatggaattcaaagatgtggtttcttggaacgcaatggtggctgggtactcccaaagtggcaactttgaggcagcctttgagcttttcaagaacatgcgcaaggaaaatatcccattagatgtggtaacatggactgctgtaattgcaggctattctcaaaggggatgcaaccatgaagcactcaatttatttcgtcaaatgatattttcttggtccttgccaaaatgtgtcacaatcatctctgtgttgtcttgctgcgcttttttgggagcattttctcagggtacggaaattcatgcctactctctaaagaactgtcttctaaccttggataatgattttggtggtgaggatgaggatcttatggtgtacaacgcgctaatagatatgtactcaaagtgcagaagctttcaaagctgcacgctccatatttgatgatatacctctagaagaacgcaatgttgtcacctggactgtcatgatcggggggcatgcacaatatggggactcaaatgatgccctcaagcttttcgtggagatgatttcagaaccatatggagtagccccaaatgcttatacaatttcgtgcattttgatggcctgtgcacatttggcagccatacgtataggtaagcagattcatgcttatgtgcttcgtcatcaccgatatgaatcatctgcatactttgtggcgaactgcctcattgatatgtactcgaagtgtggggatgttgatacagctaggcatgtattcgatagcatgtctcaaaagagtgctatttcttggacatcaatgatgacagggtatggaatgcacggtcgtggtagtgaggccctggacatatttgacaagatgcggaaagcaggctttgttcctgacgatataaccttcctggttgttctttatgcttgtagtcattgtggaatggttgatcaaggtctatcgtactttgacagcatgagtgcagattatggtttgacacctcgggcagagcactatgcctgtgctattgacttgctggcccgctctgggcgattagataaggcatggagaacagttaaggatatgccaatggagcccaccgcagtagtttgggttgcattactgagtgcctgtagagtacattcaaatgttgaacttgctgaacatgctctgaacaaactggtcgagatgaatgctgaaaatgatggatcttacacgcttatctccaacatatatgccactgcagggcggtggaaggatgtagcgaggatcaggcacttgatgaagaaatcaggaattaagaagaggccaggatgcagctgggtccagggtcaaaagggcacagcatctttctttgtcggagatcgatcacacccactatccccacaaatttatgctcttctggagagtctaattgatcgcatcaaagctatgggatatgttcctgagacaaacttcgcattacatgatgttgatgaggaagagaaaaataatcttcttgttgagcacagtgagaaacttgctcttgcatatggtctcctcacaacttcccctggttgcccaataaggatcacaaagaacctgcgtgtatgtggtgattgccatagcgcattcacctacatttccaagattgtggaccatgagatcgtagtgcgcgaccccagtcgttttcatcatttcaagaatggttcatgctcatgtggtggctattggtgagggtttcttttgtgaaagcatcagaggtagaagcataaactaagtagttaacaatgtattactatatattttcccacagtaaggaatactgatgtaatctagattctttatactctagccatgaaaacttatcattttgggcatcaacatggtctcctaaatataactttgataacaatttctatcacaatatatttgcaagacaatactttgatcactaatctctagcccttctatcaggccttaccctacttacacttgcattaaccggagttatttttttggaactgttaattttatactctggccttaacctatttattaaactcatcatgtaagagtgtgagacttataccaccatattattacctccattcttttttacttatattttggatatcgtcagtcttccatgcacatgtttgatcattaatttttcaaactatgtatttataaaacttaataaaagtataactatatgaaatagtttttcatagcaaatctactaatatatattttcatattcaaatcctaatatgttttccatatattaatcgtttaacattttgaggtttgaccgcatgcattttatgatgtcatccttttaaggatggcgatagtatatataactcatgggccctatgggttctacacctacatacacgaaacccctttaggccttgttcgtttaatccctcttatgggtggatttgaaggggatttattcccttccaatccctctctcttggggattaaacgaacaacgccttagaaatatggctgctcagtgctggctggccattgtattctccaaaaccagttactcagtttgctaactacctttgtgtattagtttctgattaggtatggaaagagctggcttatctatcgtttggaattacaaatatatcatatatggaatagcaaatatgttatatatggaataaaaatatgtcatatatgctgcaaacatttcaagcacttctttgtatttcatggagaattggagacagatatttatattattctgctttttctggagtaatattgtagctttcagatctgttgcagtacaggtttggtatttgtaactcttttggtcctaatcgaattttgcatgtcaatctaattgtgggtgcttcttgtaccatctgacatatgtagctagctctttcaaagatcagtagctgtccttgttggtgcctcctgacaaatgcatgcactgcaagcataagaagcctttgcaggtatggaaactaatcaataatctttatcaggatgggaaattatttcactgcattactatatgccaaatttggacccttttgcgatataattttcttagaatttgctagacaaataagaaacgattgttgtctaatattgaggtgaagaaagtcacctgcgtactgttcaattcagattcacctgcttctgttctgcagcactttagaaattgtgttactgattccttacagatatacgtaagttcttagtaaacttcattgattgtgaataaaagcaattgcaaattttcaccaatttgatcttatcagcttgggaattgcaattataaatagttctgtgttttgtattcatcaacttgtttagttactgcacatgcttcctgatatgccagaagtgaagagatccatgcaacactactgtttgacgtgtaaatagcaacatgaacatcatgccatcatggatattccaattttttgaccaaaatttagatgtgtatctatactttattataacagcaccagcatcagtttggctatacatggagcgttgatacaagtagtcctagctagcgcttgatttgatcaaacacctcatatttgaagttggatccttaccttcaaatctccccaaaacaaataatttgtgctttaaaggcatcaatttaaaattttctgatatatgattgctagatgatacaggacatcatggccattcgtgatttgatcagaagtccatcaatttaatgcgtttaacaaagtctttttaatgactttgctcccagaaaattctgcctactctctagccatctccctgggcgaacccagtcccattactatcctcgcatggattccgttttctttgtccccttgccagcgctagactgattgttaaatttattcttgattagagtgcttctcctttcagcaactgtcagtatctgaaaactcatattttctatgcacatgattttgaagtttttaaaaaaatatttgactagatgcctcacaaatgtgatgtttgttgaatccacaaaatgctttggacataacataagactatagtttcagtgatgttcagtggcgaatccagggtgtaaattgaggaggtgctagtgtaaaaaatataatactccctccgtccctaaatatttgacgccgttgacttttttaaacatgtttgaccgttcatcttattaaaaacttttgtgaaacatataaaactatatgtatacataaaagtatatttaacaatgaatcaaatgataggaaaagaattaataattacttaaaatttttaataagacgaacggtcaaatatatttaaaaaagtcaacggcatcaaatatttagggatggagggagtatgattaaaacaaataaaggtatatcaactaaagtattttccaatgaaaaccaaatgtgcatatgataaaaaaaacatgtttgcatagcaaatcttactgaccatagcaaatcttactgaccatagcaaatccctaaagtattttactgagtactgaccatagcaaatcttgtttgcatggatgaatcacattcacaatccaatggccttgtcctcttgattgactatgtctaagctcttcccctttttagtgtttttctatttggattccatgaagggctattctactgcacatgtcacacttgatgccaggtatgttcaaatgtagaagagattaattctagcaatttcgttctacagttgattgcagattgtaaagttcagtgaaccaccctttgacatcagaaacctctcactagtgtgtctatctaatccgttgatgctttctttagttagacaaactatgtgtgttctgagttagaatataatatcctggatcttctgtgttctgtgcatgtctctttggatatatatgcttggagtcatgctgtaatgatcttcaattttgtccaagattaccactatccatgagaacatctgctattgctttatttggattttttggtgatcgatgagattttactatatcctatactgttcagatagcctgaaattctgaaatcgttttcttcaggagctatgttattcctgtttagtttttatattatgagaaatatgtggatcatttataccctgggttgaactgcacttaacttctcctgaagaccatgtgttgcctctatatttccatcatatcttgtgccattgtttgttctgagggctgtagttaaactcattttttttttcctgttggactgctgtgttttcccctgatttttccatggttatgtgtttataattttactcctttgacttgacatctatttgtagcacaaacggataaggaatcagagttgtacattttattttctagcagttatccatgggatggcagctgggaggcatctgaccctggctggtaagacatacaagtgcccctctgcagctgtaaaattcagtcctgaatcttttcacttaatttatatctgtagtgttagcagaacaatatgatcattagccattgagatgatgtagcaggcagtcatatgagatttttttggacctcaatgttagcatggcccatttcctgattaattggactggttgatctgcaaaggttggtcttgttagctgaagtgacaccatatgcagcttattaccttgataaaaatgggagcaatgctctcatgcgtttttgagggaaaaaaagaggaagcagtgtcaacggaaactgatccttactgcagaggtgcatcaatactgaaatgagtcttgtgctacagttaattgtagtaaatcactacagcagtagcaatggtgtttccagtgtagtgcagacaacttctgttactgtagaatttcaactggaaagtacacctctgatctgatgttcagaattgatcctaaaacatgacccaaaattgatgccgactcaagtgaacttgtcaagagtctgcgtgacaagttgcttctgtatttaaagttggtgatgataatgccaaaattctggtgcatgaaggttctctaacccgttgttggatgggttttaagaaaaacaagttgtcaaccgatttttattgtaaatcattctaggaaacatactccaaactactatgaattttcctggttatttatttaatccgtgtgccactttacgtagaaaatcatgtgtttgtgtaaaccttaaattgacatgttggcaaatgtcaatatagaattgtttttcagaatttcgaggtgttgaagacatttcagtgaggaaggttacaatataacatcgagtataaggtggttacaacgcatagttggatgatttcagaggcgtgtacaacatgcataaggtgtttttcatatttcgttttacttatatattttggacgtacatgaaattgttttagaatcagtggcgttctacaatcaatgtctttaccgcaagaaagattcaagttttccagtgtttgtagtaaaagtttctttatagggatttttatggtcaataggaggtatcgagaggttattagagctaatacttcctccatctacttttaatagtcatattttatcttggcacacagaacaaggataagtaattttacttatcatccatttaaacatactactagtcattcctcgtaaacaaacgattcattaatatttatatttctcaatgcccatgtagccaatcatatgtggaagaatagagagacatacattgaatccgagaaagtcattaagaggatatgttgttggattgaaatatgcctatcaaaaataaattttttagatttaaaaaaaatgactatggagggagtataaaggtacgtaaaatctatttggagaggcatcttgattttaccttaactagcgacgcctaaacacggagaaacgtggagaagtccagctactacatagtactacatgcatgcatttttttaatatacatgtacgtcctttttctcttcaaacaaaattttctctcaaattacttatccgatctacaatctgattacatcattgtgttcgttacaattcaatcttcacaacaagatcttacatgattatattaagatgaaaaaaatatttatatttgtaaattacttttattttatatgtaaggtgtttttatcatatatatatatatatatatatatatatatatatatatatatatatatatatatatatatatataaggtacttttagagttgattaaactacttcttagatatataaaagtaaatttaatagagtctaaaagtaatttacatatattataaaagtaacataaaacaaaacggaagtaattttgtcacgacaatagaagtaaattcgtcgtacggataaaaatatgactttatataaaaattaaatttaatcagcacggatcaacacacataagtttaacaatttttaaaagtaacttcaatgttaattggaagtaacttttgcatggttcaaaagtaactctctataaatctgtttaatcatcgattgtttttttccctttcatttttgttttcatgtagaatgagaaaagaagatactgttgtattttttaagttgaaaggagatactagatggagtacaaagtagctaccactagctgtgtagtcacatccaattaaaaagacattctgtcagggttacggataaggtatgccctctatccttggatatacgatgggtaccgatatagtatacccgtgcgtgtacgaatagtttccgtatacattaaggaaatctgtcccgtgataggaacagaatctacggatggagagtcctactcggacgagactgggtctttaccatatcatgaggggtccgatatctccgagttctacttggagatcgactgactcgcggtataaaagggaccccctggcaggatctaaggcatcaaatctcaccgctaatacacccaccacagcctacgaagccggagcttacaggagccaagtcaccgggagatctagtcgggccaactcgactacggtctcgtcgatatcaccgagttcttctattccctttgtaatctatggtttccaccatataatcccataccaactggattagggctattacctgctaaggggcctgaactagtataatccttgtcttttgtctgcttgatgtcatactacgtagatcctcgtaccaacagaccccaataccctctatatccggtctacgggtatcccccgtcgacacattcattaaagttactttctttttgttacaagttacttctataatatatgtaaattacttttaggcttcatttaatttacttttacatgtataagaagtaatttagtgaaatctaaaagtaatttagatatattataaaagtaatttatatttttttatcagaatataatcatgtgagatcttgttataaatattaattgttacaaacataacggtgcaatcgaatcgtaaattggatgagtagtttaagagaaaattgtatttgaagtatatgtggataatgtctcttataaatggagtggtagctggtttagacaaactagctaccactagttgtgtagtcacgtccataaagataatatattttttttagtataatttttttacctcctggtacctttgataccaacgatcctatgcatacgctgtagttttgtttggacgcatagttagctgttctagactatttgttacatgatactatatagttttcggggatacgaaggaaaacgtgtggcctatggcctcacattcatcttagtttattatgctcttttacggtgtttgcgagatacgtaaaggtattgagaggtggtgcgatgtggatcgttgatcaagagaaaggcaagggcaagatgtgaaataaaattattattaccaatggcagtagggtaagtaactagtaaaacaccgataattttgtttgatgtgaatatcttttttgattgaaccggtacggtattaaaaaagaataggtacttatcttccttatgcttggttaca

SEQ ID NO: 80640 - DNA, 41172 bp, Oryza sativa
taattcaccaactcattcttacacctacatactcattcatcaaatactacggacgagaatcatccaatccaacgccacagaatcgttccacgtaccccctcaacctccgcgcgcatttccccaactcccctcaaccgaaaatcacgccgctcagatcgctcctcctgccatcttcaacgcgctctccttccccaacataaatcgctccgcctccctctcccaacctacagcgccgtcgcatcccctgccaccacaagcgccgccgcactccccccggcaaaccctaatcgcctcctcctctctcccctgctgccacccttccgtttcgccaccagcgcgacggctcccctccccaccgaccgcgtcgcgaactcgcgatatgcctccgacgctcgtgcccccctccagcgacggcggcgccgcccctcgccgctgaccgcgcagccggcgcccagtccctcctgccgaccgcgtcgcgagacgcctccctcatgattgacgcgctttgttctgggttgggcacagtaagctgaagtacctcgtcgccagctccgtctccgaggcctgcaacaactccgtcctgctcctcggcccctgcggctgtgaggttttccttctgcttcccctttcagcagttttctggaatgcaggggtggtgttcgacgaaatgtgccagtgggcggtctacgactttatgctatctgttgttttggcctggactgatatttcaattcttcgcaggggtcgacatggttctagacgatctgaagaaggagcatcctaatgcaatatcctgactttacttgttgctagaaatgtatccatgtatttgcgtaatacacgaccaatgatttacctacgttggccgtgaaataaacacaggttacgagaaaatagtttgtttcagggcgctttagggcggaaggggacaaggctaaatgtagaaattcctttcatatttttatattctcaaatgcatggcctagccaaaaggacaatatatcataatgcacaattagttagactttgttaacttgtagtccagttggatcattgtgcaaacttttttcagatcaggctgaatgggatgctacatagtgatgacaactgtgccacgaaggttagagctttctgatgccagcttttttggttcaatttctgtattccacatgctctctgaaccagatctccctctctcttaactcctgtccaccaattcagttaactccatagttgtttctatgctttatcaactccaatgcagccatgctaatgcttctgttactttgcttttaaggaaattgcgaggcaactttgtttggaacatcagttatcattttccaaaatggtgtgtagcgtctactctagccttcactctctcaattattgttctttttaccattttaaaagaccttatctcttttaggcttcttcagatgacaacacggaattcatgattgacatgttacggtcagtgaagtgttaacatgatgagcatctgtacatcatagagacatcctttttcctgggtgaatttcacctaatctgagccatccttttacttctatgactgagatcacctttttctaattaacaacccttatactcagtttagatgtggagggaatatacatacttttctcttcatgtagcgatgatgaggaagatcggtactgaggaccggcaccagtggcatcttatgtatggtttcagatttactagggatgtatgtatggtttcagatcgtggttttggatgaataaattgagtttaggttttagtgcaaccttgtctcttgcatgcgtggggatcgttggggtcttacagaatgcatgacaaaatggattccggtagaaaaacataatatactcttacttgcaccgtgtatattatatatttacctcgagcatagtaacagattcaatttctatctcgaatggtgcttcaaacaatatatacgtggggttgtttttttggcccttatcttttttaatcttccttcctcttttctctgtgtaaaaatatacgatgcagctcgaaatgtattgttttttatatgttcatcggcctgttcttgtttgctataggaagtatgcattttgttggtatgcattaacagagaaggaccttagagaaaaactgaaaaatcatttgtctgaaaattggttgtgaattttagttctttatatccccgaggaatgcaaatattatctggtttgtttccggcttatttcggtggctttcagatataaaagaagggaaaaaaagagcagtgactgtagcaagtgtggagcaatacctgtagtcatggcatattactaacgctcgaaggtttagccaacgcttatatccatagggttataaaccatttggcatattactagtaagctgtggctgtcgcgacggccgtgtggcagaagtccaccgaccctgcctgctacgacaagctcacgcccgtcttctcgccgcccaagtgcgacgacagcgtcgacccggacgccgcctggtacgtgcccatgcgctcctgcctcacctcgccttctttcactttctcgcgctacaagaagctggcgctcgacgccacccccaagtggccgcagcgcctggccgtcgccccagagcgcattggcaccgttcccgggagcagtgccgccgccttcaagcacgacgatggcaagtggaagcttcggaccaagcactacaaggctctgctcccggcgctggggagcgacaagatcaggaacgtgatggacatgaacaccgtctacggaggcttcgccgccagcctcatcaaggaccccgtctgggtcatgaacgtcgtctcctcctacggacccaactccctcggcgtcgtcttcgacagaggcctcatcggcaccaaccacgactggtgactatttgcatttaattcattcttctactatatcatagcttaattattcaactactcattgtccttccaatcaactctactgtaggtgtgaggcattctctacataccccaggacgtacgatctattgcatcttgatggcttgtttactgcagagtctcataggtacgtacacttgcaaatcagcatttctaacttcaaattcacaagaaagcaagtaagaaatactccatccagttacaattaacacgtacttaccgtacgttgcaattgcaggtgcgagatgaagtttgtacttcttgagatggaccgtatccttcgtcccactggttatgccataatccgcgagaacgcctactttctggattctgtagccatcattgtcaaaggaatgagatggaactgtgacaagcatgataccgaatacaaggcagacaaggagaaggtcctcatctgccagaaaaagctttggtcaggaaagaacacccagcattgaaaaaaataaatcaataacttgatagcctcaccttaatcgaacctggagggatcacaatgtaaatctgctcaacgatttcaagccattgctcaacctaaggcacttcaccctcccactagacttcacactctgatacaagaacattcgtataatgattaaattaaataaaatgagcaatactccaatataggatccaatacttcctactctctgccagttatcacacaattattttttacagttactaggggaccaattaattaataccaccaagaggcagctgtaagttattactttttttttttagaatggacaactgtaagttacttttatactactatatagcgtgttcatttgtattagccatagcttgtttctacgattgtaacaataggaacggctatatatttattttaattgaatgtttacaggagtaagatattgttgttggtatatgttcctcaaattaacaagagttggctgtgggttttgcttttgcaaatcacgatcgatgaaggaagagtatataacgagtaacaatactattaccattattcaataaaaaacaatactattaccatgtgcaatcaaattgccctaacaagcatgacgaagcactgtttttctgaggcacatcagtacactaccaccatgcacaaccagcagcacttgctttggcatacttttcagtgacactacatctgataatatcaaattgtaagccaaagaaaactaaaaggggagcccttctcggagcaagaggtgcatagtagggctgtcaaaaaagctcgaggctcgcgagctgctcgagctcggctcgtcctaggctcgattcgagctcggctcgagctccagacgagccgagccgagcctctccctaagctcgcgagctttgtcgagccgagctcgagcttctaacgagcctagtaatatatcatttttattgttacttaataacttaggagatcaaatatgttatttgtatgtcttatattgacataatatatttattttattcttttttcctcttctattagtatgataaactagaaattaattatttttttaaagattatctttgaaatatatatatattttacttaaaaatcaagctcggtaatcgagctcgagccgagcctgtcggaaagctcgaacattttataggctcggctcgagctcggctcgagcttgtatcgagctcgagcctaggctgacgagctcgctcgagctcggctcgttgacagccctagtgcatagggccattaaggagatgcccaccgacaaagccccaaggccagatggcttcactgggatcttcttcaaagtctgctgggaaatcatcaaagaagacattcttctagtcttagactcaatctataatctcatatgtgcacatctaaatctgctcaactccgcgaacatcgtcctaatacctaagaaagaaggggctgagggggtcgcggactacaggccaattagcctcattcacggtatcgccaagatcttctccaagatgcttgcgctgcggctaaggccacacatgcatacgttgatttcggtcaatcaaagtgccttcataaaaggaagaagcattcatggcaacttccttttcgtaagaaacaaggctagaagataccaccgcttgaagcgagcaatgctgctattcaagctagacataactaaggccttcgattccattcgctgggactaccttcttgccttgctatagcaaaggggtttcccaacaagatggagagattggttgggggctattttctcaacgtcaacttcgcaagtactcctcaatggttcgccagggcagcgaattaagcatggcagaggccttagacaaggggaccccctttcaccactgatattcatacttgcaattgactccctgcaacgaatcctctcaaaggcaacagagctcggtgcaatctcgaagttgtgagggagaacgacccgtctgaggacctcgatgtatgcggacgacgcagtcatcttcattaaccccactcgaggcgatgtcacggcttttgcagacatcctacatcgctttggcattgccataggactcgtcaccaaccttcaaaaatcccaagtggcggccatcagatgtgacaccattgagttgacggaggttcttgagggcgttccggcgataagagcaaacttccccataaagtacttgggcctccccttggtactgggtagattacgaaaggcggatttgcaacctatctttgacaaaatctcaggaaggataacaaactggacagggaagaacatggcagcagctagaagaaccacgcttgtcaaatctatgcttacggcacaacctatctatctcctgactgccttgaaaaccacgaaggaatcccttgagcaaatagacaagcagcgccgtcgctttctctaggccggaacgggagatatcaccggaggaaaatgtaaagtcaattggaaaaagacgtgcttgccaaccagtcagggaggattgggagtcctagatctagagaaattcacgagggtcttgaggctgcgatggttatggcacgagtggaaggatccgaccaagccttgggtgggactggaaacgccctgcgatgaaattgacaggagtcttttcgccgccttaacaaagaaaacaattggagatgggaacatgacgcgcttatgggattccgcctggatcgagggacaaagacccaaagacctcatgccactggtctatgcgatctctaaaaacagagggaggtctcttcgaaatggaaaggaggaggacgcctgggttcaggacctggctctagaatcacactcgcctattatagtagaactagttgacaactggttgccctgtgggaagcggccggaatgtccacttaggcattggagaaccggaccaaattacttggaaattcacaagtagcggacgctacacgacctcctcggcctaccatgcgcaatgtcaaggaacaccgagcacaagtttcaactccttaatctggaaagcctgggcgccggggaaatgcaaatttcatgcttggctcatcattcaaaatagagtatggacttcagatcgacttgcgacaaggggatggcaaaacaatgggtgtttgtcctctgccactgcgaggctgagacggcgctgcatctcattgccacttgtagatacactaaaaggatatagggcctcgttgctggacgggtcggctaccagcagattgagccggctcaatgggaggaggcactgtcagtgcaacagtggtgggagaaccttgcaaacatgccaaatgctccgaaaaaagggctccgatcactcataatgctagttgtatgagaaatatggaaagagagaaatcggcgaatctttgaccacaaagaggtggcaacaagtttcctcatgtcgagaatcaaagaataagctaacctttgggctttagcgggggtaaagcggctgcgcgagttaatcccgcactttgtatagtgtatagctgcaggctccagatttttttttcttttgcccctaggggttgtattttctcctgctctattcaatgaaaaggcactatagtactgtttttcgttcaaaaaaaaaagagctaacagattattttgtgtgtggattagagtacatgatctgcaatttgaaaagcacagctgtctcaaaagaagtctagaactctatatcagttcagtaattaaacttgataattctttggttttttagataatggaaatggtatataatgattctttgttcaccaagagatgaatttttttgaaaggattcaccaagagatgaattaatctgcttttgacaaaatcaatgaattgggagcgaaaataaaagtaaaaaaaaaacagaagcacgttggctatgttttcaagcttcatgtaaagttttaatttaatctagggatgatgtcttaaaaaaatgagcctttgtgcttgtaagtcaagaaaggtgcagtcaatgcaagctatggaacttataggtccatctgtaagcaaggtgggtactcaacaaagtccacaggagacaccgtacgaatgcgaccatggtatgtacgataccatggtgtattggtgtatacacacacatgcacctaatataaccccaatcaagtccatgctacactgttaaactatcccaaaaaggtgcagtcaatgcaatcagtacttgaatcagttaatacaatatatattttcaggcagaaaggctagctagaatgcaatatatttgcaggttagagaaagtaccacacttagagataggcacgcgacaatggatcgagtcagcagataatatatatgcaccatacgaagagcagtgtgcaggagtgtgaatggcgaagaccctttaggattgcagtgtgaaggcacacaaaccagtgagttcgatcaggccggcttcagtgtgacagggtgtatatatctagtccagatctagatagatgaaactacagtatctaattcttgaacctatttttgaatgaacaaactgcttcctgcagaatttcagactcacagttaacaaccaggttggtgagattgaaattaaaggagacagagatgtagacacacagctcgtgtacatgcatgcatggaggcgtttcatcaaacaccttgcgcctgcgggagaggaggagaggagaggatccaaaaggaaggcaactgaagaagaagttgtaaggtgtggtctgccgtctgcggcggggcgaaatgtgtggtgtgggctaaaaaatgtaggccccctttgaattggagggaaaatggaggaaaaacaaaggaattgaaatcctacactattcatgcctttgattcgtaggaatgagaaaaggaaaaatgtaggaaacttttctattcctacaattctagagcaaaaacgtaggaaatttaacatccactctaacctcttggaaaactttcccagagtctatctctctcatctaattcctgcatttttcctgtggtctaatcaaacggtcattcctatatttttcctgtgttttgcaatcctctgtttttacacttgcattcctaccaaaatcctgtgtttttcctattcctccgttttttcaatcctacgattcaaaggggcccgtagtgtaggaagtaaggcccaaggcccatccgatatcgactcgactcttatctgtgtgggccgtcgtcgtcttcaaccctcctcctcctcggactaggactaggactcggactctccccttcctcctcctcctctctacctctacctctgtgtgggcagccgcaggaggaggccggctgggctgcgctgcgcgatggaaccggagagggaggcatcgtcggagtggggagatggtgtcggggtgctgggtttccgggtgaaggcgtcttcgtgcgagccggcggcgcagaaggcggccaatgtgctgtagccagactttgcgcttcccactgggtccacctgccaccaacaccaaggagtgggatccgtgctcgagctcaggcgtgcgtacatagacgacttgttgtttcttccccctctctaactaggagtctccttctctagccctgaatgaattgctgaatttgctgctgcaggagccgtgcctcctctcccacatccgcatctacaacaagtccgtcctcgagtgggagatcactgccggcctgcgctacaacaagccagataccttcgtcaaggttcgcccgcgctgcgaggctcccaagcgcgacatactctatcctgccaaccacaccccttgccgctacgtccgcatctcttgtatgcgcggcaaccctatcgccatcttcttcatccaggtaggagtaactactagtataactttactcttcctccggatatattccgagtaataagtcactcttcttcttcagctcattggaatccctatacctggactggaacctgacctccagcctctagtcaactacctattgccacatatcactgcacacaaacaatcctctcaaaatatccacctccaggtttgtttcttcttcttcttctaacttctgtctgtgtcttggcaacatataagtttcttctaatcatgcaatttttttgatattagttactcaaagacattgcaagcaggctaccaccatttctgccccagattgaggtaagctttccgactagcatgcatctccccatgtccatgtatggtatgttgtgcctttgttgtttccctttaatcgccgctgtctatctgagtgcaggctgacctcgctagtgtcacagacactccagacagcagtgtacactttttggctctgcttgctgggccattttatccaatcctccaacttacaaatgaaaggtgccagttccttgttcaacattcaactgcatatcaattattttttttatactaagctctgtgctgtcctagattatttttcggacagattatgtgtttgtgcaggttgctgtacagacatgtgtgcgcacacctacatgcaagcactgctatctgaaacaccttcttattttacagggattttactaaatcattaattagctctgctgattcagatgctctgaaaagtagtttggcttctactccaacggtttcttcaaactttgaggcatgtagtttttttctttccaatgtacttctaccgcctttctagtttctgcattgcactatgataatgtgaaatgttatagctgatatatgctgaaagagtgaaagctttgattaaatggtgctgttgcacttgctgctttagtaacacacaattttcatttgtgtgaagtgtctgtaagacctaaccttaatcttcagcacattgttttctcgagagactacgggaattcatagtgctaactaagggtatagacacctggctcctttagaccttaccttgaactataggaacagaagctaatggcaggatgcatcccacagtgacataataaaattagataggttttatggttggatccaatagacaaaaagtccttcatgactattactctgtaggctgcaatatctatgtaagatttgacttaatgaaaactaagaaacacaagttgtttcttttttgaaaccaaaagtagtatcatgtaaatcatccacattttcttatattttactggagctttctgtattccataaaaaccatcatgtaaaccaataagacaatttgggatggttggtcaatattataaattattccctacattccaaaatataaggctcaaccacccttaacccaaaaaccaagatattatcacatcatagtttggatcatcctaatcctatatacttatagttcatccccactaagtgtagttaatgctatttctctcttctctcatgaagccacatcacaattatttctagcctttggatgatagatctatggtacacatagtctcttctttcttctctcataaaaccatgcaatctcaatttttaggctcaaaattcataagtatcaattacataaaatatgttcaccttgcactatattggaaccatttttaggaggtcattttgttttggttataaaatatattgtggcttatttgtacatattatacaacttaatttcccacagaaagacggcggggtatttatctagtaaatatcatgcatgcacccaacagaattaaagatcttgagtatggaggatttaaaaaataataatttagtgggaaagaagtgctagttaatagcatgcattcattccttatattatgaaacatctcgaaaaagtagttgcgccttatattatggaatggagggagtagtaaattattactacctccatcccaaaatataacaacttttggttatgtatcttgggacagagggagtagttatcacctacttcctccatttcatattataaatcattttgggtttgtcctaaatcaaacctcttttgtgaccaagcttataagaaaatatagcaacatttccacaaaataaatatactacaaaaatatatttaatggtgaatttaatgaaactaatttggtgctttagatgttagtacacttacctataaacttggtcaaacttgaagaggtttgacttgacaaaaccgaagtgacatataatatgaaaccgagggagtatttaggatttatgcgtttttcatatgggcatttatcttaattgctcctttcagtttctgaattctttgattccctccaggcacaacctaggagatcacggagtccatcttctgttcagcctgcttgttttctggcatttcgatctgaaacagccgtactgctcttaaggaaagcacacagagacagagcccttggaattgtttgcctgaaagtaggttctttgatgtccttttcctttcttattgattacaaactcttcccctcagagggttttcatgacatgtatttattttgaaattaggcatcaaaggtcctgcaagaacttctggagcccgatccattgttagatgatgcttctgaccaagtactttgtacagactactctagtttgtttggagatgaatttagcttatcggagaatcgctttgatgcctctattctgaacattttggatattgctgctgttgaagaaggcattcttcatatactatatgcagcttcatcacaggttctgtctgaactctgaagttgtatctttgtatatattttcagttcctctgcatttactttctgtttttttttttctagaacacctttataacctttttggtttcaattgtagcctctgttatgttgcaagcttgctgagaaaggttcagacatgtggtctgtcttaccacttgttcaagctctgcttccaggtattaagtggaacatatatacacttgtgctttatattttttactttttgatccaaatggccaaaaaaaatgtgaatagatagaacatttgttaccaaataatgtacatattcccccatgctcattcatatcttatcctatatataccaagtgatgacaggcctttgccaactggtgtaacataatgacacctttgtttttgtgaattttctgggatttatcctttggcctctccgttggcatgggcctaaggctttgggatgattgtaattaactgcctaacttcacccattcgttgagttagagaaggggaattcctgcagttgcataagcgtacaacacagatggctttgttgactggtgtcactgatagtatgctttttctctctcgtgttcctgtagcacttcgtcctccacttagccctggttctactgaacagattgatggttgtcttagccaatggaatcatccaaatgttcataaagctctctctcaggtacctgaattggcactattttattagctttgtcatgcatcacggacatcacttaatattcctcaagttaactgtttctgcagattgctacaatgtcaatgtcatcatcagttcttcatcctcttctcagagcctgtgctggttatctttcatcctacctgtcatcacatgtttgttacataactctctcctacaaaaatatcccatttcttctgaaaattagtgatgtctcttattttcattgttaggcaaaagcagcctgtgttttgcttgacttatgcaggggaccattatcaccatgggtacccatgatcacagcaaaggtttctttttatgatttttccccacacttatttctacaatccatatctttttcacaaccttgtatactctttaaacaggtagaccttgccattgaacttctggaggatctcctgggtattatccaggtatgtacaagttaaaaaaaaaccttagcatggcataatttatgttaacctttgatgcatgtaatctggcatatttctatattgagtaagttgcccacgcattataagaacacttggctggcttgagttttattttgcatgtcgctgaagatatgtgtggtatgtaatctggatcctcttggacaaaagtacacagcgaagtcaggtctggatgcaccaccatactctactattggaatatcaatcaagtgatcaatcaactacctgcagtgctcttccctaagctcagcaattctattcctgttgtgtgtttctagtaagattttttagtggatagtcaccttcttgtcgtatgcacaattgtgcatatcttctgtgtatcctggagtggacagcagcatagatgatagatggcacatgcagaagtgtctgtatcatcatggcagagtgcatggcaatggaccatgtccgtcgagtatgctgaccctgcatcttgagcataacatatcccaggtagaaacgtgagcgatgtgaaaacatcgaaaaagtccggataatatttttgcaaatccgaagttgacacgtgctagcgttgacatgggcctcctaggtatcaaccaatgttatctgctgatgtggaaaaaatcatgcgtggcatgctctatgataaaaacacgctacctgaccagtctttttcacctggaggctcattttcaaattcttgcaccagattctacccatctgccaagttattagagcatacataatttactcttctgtatcttaccatacttctataggattgacacttttgtaccaataactaataaataaagaaatcaattcttcaatttatttattttttattttgggttgactcttgaaggcatttagatatacgatgtgtgaaggtggtatgacaatattggtcatgttttctcactacaaaaggagtattttaccatgactatgcgcctttcctttttgccatcctaagttaatatagatgatttgctttgttacttcaagtcatgatttacccaaatttatgtgggatcaaatggttttgtttcttttaatgtttttcagggagttggtcaatctcttactcgttctcgtgcagcactgaagtatattgcattggccatatctggccatatggatgatgttctcacagaatataaagtacattcatttttcctcctgaaagtgagcttttccttggtgattggtttgttttacagactccttaacttgtattatgtaaatttacctactctcaggacgtcaaacataagttacttttcattctggagatgctagatccttttattgatccttctgtaagtgttatgacagatgcaatggcatttggtgatgtgtctgttgtgcatttggagaagcaagcaagcgcttgcaatatttcgttaaatattatccgtacagcagtgaagaggcctgctgttctcccttctttagaacttgaatggcgtcgtggtgctgttgccacaaggttggtgaactctatatgtttacatgcttatcataaatttgccattaagattgatctgaacttgtcatggttgatgagaaccagaatagtactgtcattatttaattgtgacttcctctggtcacaaaattctccattggaagcatgcaattgaacttcatcattgcagaaaaaaagaataccttggaggaactagttttgcctttagctaataagaaagatatgcacccaagtttgaaccaaagaggacttgggatgtatcatagaacctggtaaaccgtgtgactttagcatgcacatatgattgacggcttaaacattaaagcatttctctagctcagacctactttgtatgctggtaaaaacatgctaaatctagatttgatttgcagtgttattctctctaccttggatccgcatatgccactccctcctgacatagatctctgcaaaagttcaatgcctgagattgatcaaatatctctgatagttccaaactgtccaccgcactcctgcagtgctgaagatgctgatgggcgtgatacatctgaaacaactcccagggcagatattcttgaacagtgcaattctttatttgctccagaagaattagagcaatctgagttgacaaagactttggaagaaaaaaagcatgagaaaataagtacagatttggaccagaacttcccagaggacacaaaaagtaatggaaaattaccagctggcctttttcagttagataatatttttgctactgattactatgatgcacatgctgattatctgcagctggtgaactatcaggactgtgaattaagagctctagaatttcagcgcttagcactgaatctatgcacacaacaagaacctacagttgaggggcataatgctggaatagatgcttttctgttagctgctgaatgctatgttaatccactctttctcttggatttccattctaattcggagtctttggatgaaattgaacgtattcatgcagaattgatccaaggaaattgtttctctgaggcgaaacatctgcgtgctaaagatattgatctcatgaaaatttataatttggagaataaacgagataaagcggtcctggatttactcatgcaagctgcaagatatgattttgaataccagggaaagatacctgatgggaaaccttttccagatgatgttgaagatggcaagcaatatatagaaatttcaccagaggctagacaccttgctgatgctgtaactttggtcagaaagaaccaggctatgctttgtcactttatcatgaaacaatttgaaaagaaaggacactctcctaacgaaattctcctccagagcttgttgttcttgttgcactcagcaactgatctattttgtccaccagagaatgtgatcgatatcatattgaaatccgccgaagatctcaatggaaaacttgtatgtctttacaattccgttaatgcaaggaataataaattggatagaataaaactacattatctacgaagacgttgggcactgctccagaagctggttcttgcttcgtctggcagtgataatactagagaacttgtcagcattaaaagagatggtttccgttttaaaagtctggttcctccatcagcatggatacataagatatcagatttttccaggtcttttagtccactacctcgattttttggatggatggcagtgtcccgttatgccaaggaatatttaaatgagcagctatttcttgcctctgacttctcacagcttacatctttgctgtcaattttcaccgatgaactttctttgatgggtggtgttactactcagaaggccaagtctgctaaaattgaacaatctggttgcaataactatgtgcttcttaagaaggaacctttgctgtcagaccaaccaagcatgagattgtttcagattttacttcctgaactgcatttcttctttccgagtatgagcaaaaagtttgatgcatttggccaaagcattttggaagctgttgggttacaattaaaatgtctcccaaaaagtgcagtgcatgatgttctttgttggttttcagaaatgtgcctgtggccttatcttggaaatattagggagcatcttgcatttgcaaacggagttaatagtttaaaaggaaacattgcagctaaggcaaaggctgttgttttctacctacttgagtcaattgtcgctgagcacttggaagttattgttcctgaaatgccacggatggtgcacattcttgtgtcactttgtagagcttcttacactgatgtagctttccttgattctgtgctgtgcctaatgaagccaatgatctcacacttcttaaggaagagtactgataatggaaatgtatcaggtgatattactgaatgcagtgattttgagttactttgttttgaagagttatttgaaacaatacagtttggtaaacaatcagaggatacacctggcaataagaaccaggtgccctttctcatattcattctgggttcgctatttcctgatctgtcctttaagaggaggattgagatattaggctcattattagtatgggtagacttcggcagttctgatccatcatcattgttgtgtagttatctacaaggctttcaggcatttattgatggttgtgaaactatactagttcagaatattgaattatttggtatgcatgtcctttctgagagaaaccagtctacagagtttgctaactccgcaagtccagatgacaccatggataacaagaaagcacaggccagtgtagcacaggtacagaggaggtccacagaatatcatgagaatggtgaaaattctaagggagttgattccccacatactgtttgtattaaagaattttgtggtgccctggagaggttagtgtcaaaccttgcaccatctattgagggcagttggaaatggcaccttcagttggcctctaggttatctttatcgattgcaaaatgtttgctgtatgcaaaatgcctaaagtctattgccgaaggaggtatgatctatagtagcatcaaacaagaggttggtactgaaatatccactgatctttcctaaaaacactgagagagtgctctccaaggtctcgcagaagccattttagtaaatcagaagaagcagtgctggcaggtggcatcagttatgctcgattatatgattaagcttccaaatattcttgcttgggataatgttcttaatgtcatgtcttgtgcaatgaaacacctctgctctcatgcacccaggatatcttggaggcttcagacagagaaatggttatcaatattggtttcttatggaattgaaggccttaagaacagtgagaattcattgattgatcttttctgcacattgttgagtcatgctgaaccagaacagcgctctgttgcattgcagcaacttgggaggattattatgagtacaactaaagttgattatgaatatactacttataagcaaaattcactctcatctggttcaacagtaacatcccttttggttactcatacctgggaccgagtagcagcattggctttctatgattcttctatgttattaaggaagcatgcattggctttgcttactgaatacattccatttgttgatagaaatcatctacagtcctttcttggatccagtaacagcatccttaatggtgcggaacaattttcttatgcaatagaacaggggtatttgacacgaatgtctttgctgttgctttcaagggcgtgtctctattctgctcctgaagatattgctttaatacctgaatgtgtttggagaaaactggaaaatatgcaaacatcaatacctggtaaatttatgctccttaacaatctgcactttcttttttgcataaacacatgtaaattatgttgtacatcctttcaagatcaataactaccaattaaccatgcatctaacttttttatgtcttactaggatgctttggtgatatggagaaagatctctggcgagcactgtgtcaactaagaagtgaatctgatgctaaaagtgtagagctctctctctctctctctcatacctaaaagttattttaatatcttaaaaatcagttctgtggttgagttgataccatagcacgacaaagggaagtagcttcagtagaattttgtacatgtctgtcagcagcaatactgcttccagggagttgccgttgtctgactaagcacaggagaacacaattactaggccgctgaagcgagctactagaattaagaagtctaatgttcgtctgagtgggcctgaatgggcttgtaagtaatagctggctatggctctgtcgacagcctggctgggacccagcaaccagtgagagagagtgtgttgaatataaacaaaacttgtaagaacagaaaggtatctttggagatcaatcgaacggcggcgttggcggcggaggcgatgcgatctcgttgatcgtatcgataattcttgttcttgagtgagctgatcgagagattgcgagagaatcctaacaacttggtatcagagcttcgtgatcctcggaaatccttgattccgctgtaaaattcttgggcaaggattggatcgctcttgagtgaatccgcgaaaaggctacccagccttgccttgcttgagttggtggaattcgggaagagttgatcacttgatctgaaaccctggagaaaccacgatttgtgacgaagcagacggccaaaatcatggagaatgaggctaagcttgaccttctgttgaagaaaatggaggagacagagcgcaagcgagaggagggtgagaagaagcagagtttggagatgagggtcttcaaggaggcggtagaatcgtggatccctgcggtggagaagaaggtggatgtccttcagtccactgtggatatgctacaaacccaagtagcgaaactctctgctccacctccaacaaattcggcgactccttcctcttcgtcgccatccggagcggcaggtgttcgagcaattgactctaccggcttaaatggccaaggcgctgcaaattctacacgggaggaggctgatggggtattcaataccccaaagccacccccgggcaatggtacgcttgcgtcacaaaatttttctccattccattgtcgagttgatgcttctgccatgaattctttccaatctggaacatctgttgggttgactggtggggtagctcctatgacttgcccaaaatttgatggagataacccaatcatgtggaaagttaactgtgaatcttattttgatctctatggaatccatccaattaactgggttaaggttgccactcttaatttcactgggaatgcagctttttggttgcaagctgttagatcacaattagagggggtgacctgggaggagctatgtgatagggtgtgcactaggtttaacaaagatagacaacaggctcttatcagacaatggtttaaaatttgtcaaactggcacagtagctgattatgtggaaaaattcgattccatcatgcaccagttaatggcttatgaccccactttcaaacctgtttactttgtcaccaagtttgtggaaggcttaaaacatgaaatccggtctgcaattcttcttcaacgtcctggcgacctggatgctgcttgcactcttgcatttttgcaggaggaggcgcttgaaggtgataagggcattgacatcaagaaaggtgaaggctctggttctgccaagcactctgtgagagttgcattgccattacctacccctccaactgttaaagggggctctccttcctttgctgaagaaagacgaatttctgacaatggtagatcccaaaaccgtgaaatggatagattggctacactgaaggcttatcggaggtcgaagggattatgtttcacttgcggggagaaatggggtcgagaacataagtgtgcttcttccattcaattacatgtagttcaagaactattggctgttttgcagggccctgacatcagttcagaagagtttatagttcagtctgatgatagtttgatggctatttcaattcaggctatcaatggtactgaatctaatcattctattagattgaggggctggttacagggtattgaggtgcttatgttggtggattctgacagtacccactcttttgttgatcatcagcttggattgaagctaactggagttaaatctatggcttctcctgcaagagttaaggtggctgatggtgggcatctcaattgttctctgtatgtgaataactgtgattggttaactcaaggcattcatttcaagagcaatttcagattgctgtctttgggcacctatgatgtcatcttgggtatggactggttagaacaatttagtcccatgaaagtggactgggttcaaaagtggttagaatttcagtttcagggatctactgtcagattgcaaggtattcagtcccatatttctagctgtcttcctatcacccctgatcaattgactgggttactgaaatcaggcagtgccttgttcttgatccacttagacagcaaccatacatcccatattactacaattcctgcacatgtgcagccactactggatgagtttcagtctgtctttcaggaacctactgaattaccacctaagaggttgtgtgatcacaagattccttacttcctggatccaaggcagtgttcattcgtccatatcgtcataccccagctcaaaaggatgaaatcgaaagacaagttaaagaaatgttgcagaatggcattatacaacatagttccagtcccttctcttctcctgccctattggttaaaaagaaggatggctcttggagagtatgtatcgattacagacagttgaatgccattactaagaagggaacctacccaatgccaataattgatgagttactggatgaattagctggagctaagattttttctaaattggatttacgagctggatatcaccaaattagaatggctgagggtgaagaatttaaaactgcctttcaaacacacagtggtcactatgagtataaagtcatgtcattcggtctcactggagcccctgctacgtttcaaggtgctatgaatgataccttgagacccttgttaaggaaatgtgccctggtcttttttgatgatattttgatatatagccctgatatgaattctcatctagaccacctcaaacaagttctgcagttgttagacactcatcagtggaaggttaaactgagtaagtgtgactttgctcaaactcagatttcttatttggggcatattatcagtggtcaaggagtctcaactgatccttctaagatacaaagcattgttgattgggcagtacctactacactcaagaaactcaggggttttttggggttggccggatattataggaaatttgttaaagattttggtactctcagcaaacccttgacacagttgctcaagaaggatgccccttttgtttggtcagctgaagtgaaccaagcttttcaagctttaaaacatgcccttacttcaactccagtattggctctccctaacttccagcaaggtttcaccattgaaacagatgctagtgacattggcataggggctgttttatctcaaaatcagcaccctgttgcttttgttagtaaggctcttggtcctagaactcaaggtctttccacttatgagaaagaatgtttagcaatcatgatggcagttgatcattggcggccatatttgcagtttcaagaattcttgatcattacagaccatcatagcttgatgcacctcactgaacagcggctccacaccccttggcagcagaaagcatttaccaagctttcgggattacaatttcagattgtttacaggaagggtaaacataatgctgctgctgatgcattgtctcgacatgttcctgaggaaacctctgaatttttaggaatctcaacttgttctccagtctggttgcaagatatccttcatggttatgatcaggacccattggctctttctttacttactgggttggctgttaacccctcttcttatcctcactactctctgtctaaaggacttattaaacataaaggcaaggtgtgggtcggtaacaattccaacatccaacaacagatcatttctgcccttcatgatagccctttaggaggtcattctggatttccagtaacttacaaaaggatcaagtctcttttctcttggccacatatgaagctcactgttcaaaagcaattagcttcttgtgctgtttgccttcaagccaagcctgacaggtccaaatatcctgggttattacaacctcttcctgtgcctgacggtgcctggcagataatatcaatggatttcattgaaggtctgcctaaatcataccaccaagattgcattctggttgttgttgataagttctctaagtatgcacactttatgcccttatctcatcctttctcagccttggatgttgctaaagtattcatgctgaatgtttataagcttcatggattaccacagatcatcatttctgaccgtgataagatttttactagtgcattatgggagcagttattcctgaggtctggcactaaattgcatttatcttcagcttatcacccgcaatccgatggacaaactgagcgagttaaccaatgcttggagatatttctgcgttgttttgttcatgccaccccagctaagtggtctctttggttacaccttgctgaattttggtacaactcttcttaccattcggcattgaataagactccttttgaagtcttgtatggttatcctccttctcactttggtattcgagctgatgcctgcgtcatttctgacttggattcttggctgtctgaaaggcatttgatgactcaactgcttcgacagcatttgaacagagcacagcaagttatgaaaacacaagctgacaaaaagcgcagttttcgctcttttcaggtgggggattgggtttttcttaaactgcagccttatgtgcaatcttcggtggcaaaaagagccaatcacaagctctccttccgttattttggtccttatcaaatcttgtccaaagtgggatcggtggcttataaattgcagttaccagcagatagcatggttcacccggtttttcatgtctcgcaattgaaaggaactcagaactttaagcactccattcagtctcaattgcccaacattacagatcatattcagtatcctgttcagatcttggatacaaggatacagaagaaaggtaacaaagttgtccgtcaaattcttgtttgctggtctaatttgcctgcagtggaagccacctgggaagatgaagaagagctcaagcagcgtttcccttctgcactgccttgggggcaagtcagtcttcaaggggtggggtttgtcagcagcaatactgcttccagggagttgccgttgtctgacgaagcacaggagaacacaattactaggccgctgaagcgagctactagaattaagaagtctaatgttcgtctgagtgggcctgaatgggcttgtaagtaatagctggctatggctctgtcgacagcctggctgggacccagcaaccagtgagagagagtgtgttgaatataaacaaaacttgtaagaacagaaaggtatctttggagatcaatcgaatggcggcgttggcggcggaggcgatgcgatctcgttgatcgtatcgataattcttgttcttgagtgagctgatcgagagattgcgagagaatcctaacaatgtctctaatactgattactgattgcatacctgttcccttaggtcgtaaaagaacttctcacggaatctactgcgaaaccagtcgaaactgattttaagggcatccgtgaatcgattcttcaggtcatattctttagggcactctattgttggctatctttcttctttctggcttgatcctctgccttcaaacatcactgcttatagttcaaaaactcaaactaggttgtcagtgctgactgctgactgtgcttgcacagttaaactgtacaacataaattgcaatacttgcaaattagctaactagttctcctaattgagccaaatgagcatctatttttagaatttgataatgacaggatcagtgcaattactttgcccaaatgaataattcttgatgacaactattattgttgtggattttttattcgtcatgcaatcaataggcacaactggtccactgcagtgtgcttgtattatagtttctttgttcaaaaggttattatctctataccagaagatgctgtaaattatatttcctgatcttgtcagtgctggtctatctcgattcatgattctctcttttataggtgctgtcctctttgagttctgttgaatcatactttgagttcttctcaacaagatctgatcaggaatatcaggttagaaatgcaacaagggctttccttttgggcctttgttttgaacaccttatactgacacttggttaatcataacattaaggaacttgaagaagcagagatcgaattggagattgttaaaaatgagaaagcacgtcacagctttattgtacatccccaggacaccatgattccggacatgtcatcatgtaagactaacgacttttaaggcatcctttcattaacgatgtacttttgatgtgttatgatattattctatttccagactataaggatggtaatgaggttaataagcagctccagcaaattcaggaagatatacggtccttgtaagtcctgaactcctgatttgtttcaactgaactatttttctgtcatggtaatagaccagccctgccaagccctttagggggctatggcctatgggcaataatatatggtcctgcccagtcagcatgtcatgcgctcatgcctggcttttgatcgttccttttgggtatgatgagtctcaagtggttggatattggttcaattgttcaacgtctaaaaatactgataagagaagaaaccagcctactaatgagtaaataggctcaatttgtcccatagagtatactttcatgaaaatagaaagtacattactttcctatattatacttcatttggatttttttttaaaaaaaataactatacatgttgtagaccactaaaaagctaaaaaaaaataacacctgtgattttctccaggaggcacggattgtctgctaaggtgaactaaagttctactaatacatgtttgctttctggattttttttttggaattgctcgataagcttctatataatactgccttagctctagttccttgtaaaattctttattatctttgtgaaatgtcctttttttcaccaatttgaattctagaagaatttcaaatttagtgctagtcttatttatagacttatagtttgtgttcttcttcaatagggaaaggtccaaactcagggaggaaattatagcacgcagacaaaagaagctgcttatccgacatactcgtgaaaaatacttggaggagactagttcaagggaaatggagcttttgcaagaacttgacaggtttagagttgttgcctttgtcatttagcatgtcagaaacaatataaatgttcctatccctatttctttgttgtgttatctgtatagggaaagggctcatgagatggaacgtgaaatcgaaagacagcgacaactggatcttgagcgcgttaagtctagggaactgcaatttaacctcgatatggaaagagaaaaacaaactcaggtgccagaatagtttactcttatgcacatatttttagatgaacaagaatctttgtatttctctttgcactctgtgcttagtatatgactatgggcctgttcagattgtagcaaaaataaactttaccaaattttggcgatgccaatactttggcaatttggcaatattgccaagtttttgtaggatttcttatgtatttactagagcttggtaaaaaaaactaaatggatgcacatattttgcagctttaaaaaaaattggtatggtttgaaatggtatcaatctgaactaacccctatatgtatatgtgttcctatgttgtggtgggtgggttcacttcatattgatagcgcatgtttatttgatgtttcgccacatcctttgtggctagtaatttagggtgaagtatcgtaggttttgacgatactcaacattttgcatgaatttgatatttcttgccatgtcatatactgattgcttttgtagagagagcttcaacgagaattggatcaagttgagttggggcggtcatcaaggcgggagttttcagccaatactaacaggtgtgttatgctggtaggcggttgcctccctcattgtctcaccatactgcttctgatgaaacttcacttgacatgtttgttacccttgccatgtgtgtgatgtgatgggtgtttttgcagccggtctagggagagataccgtgaaagggataacggtaggggacagcaggaaggaaggagccgaggtggaggaggaggggtggaggccggtgggtctgcgacaagatcattttcaggcaaccttcccacaatactgcagcaacctcgagagcgtactacgagtgacgagcgtactagcacaggaggaaattattatgaggagaatgctgagggaagtggtgacgccagcagcgtcggagatccagaatcagcggcggctttggaagcttgcacgaggcatactctttctcggggcagcaagtagttgtcctcaacttcaacttcaacctcaaggcaggttgtagtagaacgcagggagcgtcgagaagggaaatgggagaggaagcattcttgagcaggttgtggtcaaattggctgccagtacgaacgaactgtatcgattatctcctggttgccctgtactgtacttttctctattatgtatgtgtacgcggagcggctaatgaaaatggctatttcgatcggtggcttcggtgttctttttcatcgctcgttttcttcacggatatttgtcgaaccgataaacggtgtcttttttttactagtaatatgcccgtgctaaacgctacggtgcaattctattgtctttagtaacttgaaatttcattttagcaaaaaaaaattatatgatctatgtcattaagctttagttcaatttatgtcgtacatcaaatatattccacacaaagttcaaaaatatgatattgcatgggcataataaatcttgaccagaattaactaaattaaattgacatccagttccacgccaactcacatcatttattttcataattttacatatgacaaaataataattatccaaagaaattattatggttaagcggttgacagatctaaataaattgaaacgcaatgacgactgcgtactgcccttacatttggaacttcttgatgaccggactgcattcatatcgacaggaagagtgtctttatttacgtgagtacatcatggtatgaagtacaagttaaaatattacatattattgtacactatactatgaatttggagctgatttaaaaataacttgtattaagcaaaatagaaaattagaaattaataggtctaccgtctatgcatgaaactgaatcatttgcccgtgctaacacaacgaaatcatttaataatgtaaagtaaacaataaaaagaatatatatgtttcaacaatcaaaaataaaatgagatatgattaatattaaagaaaagaatgatatcacgagttattacattattaattacatagccacatggctaaaaataacatcccaaattttccatctttcgaaaccatgcaaaagggcaaatccatatttctttctcacctatggtatagagacactggacagcttcgacaatcaacccaacactttttggttggtacccccgtgccaaaaaggtcatcatctctctggtgcttatgtcatgtgattttattgtgccctaaaggaaatgcaaaaggatctccaattagtcaaaatagaagaccaaatacatagagcccttagaggagaaaaatgttcctctatatcacaggacaaaatattatgtttaaactgcataatacaattgattctgtagatgttccttgatcatgcttttcgactcagctggacaaataacaaaatacaataaatagcttagaaactgtcatgccataagattctttcaagttattcatgagataaacatttcataagtatgatatggaagcaattccatacttgagtaaacaaaatataagaaatgatgactatagcaattttatcatgcaaagttatttgtttggagctcgtagagtaaattatttggaaggcagacatattaatcatggtagacatattaaacattcctagtttaaaacatattaatctccagcagaaaataacatacgcacttaatcgtggcaatgattttgattgctgagcaccagcatagtactgagtctgaaattaccattgattccaccatgttcaataacaggaatagaaaacacacagtaataaatttatcttgcaaggactacaacaaatagcttgcctgcacacgtccaccagaacaaaatgctatatatatgagtaccaacaatttgaattaatctaaccaaaacaagaaaaaagaagcatggtcaatgctcaccaaggatcgacatctaacttgctgcatgctgaaggatagaagcactgaagcagctcgtcgacccatgacaggctcgctgtgctggacattctgtaaatctcatctactggaggaagctctctagcagaagatgcaaattagatttacattataaatctccttggtggaagaaaaatcgttatacttatgaaacttcttcaagaaagtatattcatatggattgagctacgaacctcttatttatacatcaatgggtacatgtgcttctcaattttgtgcaaatgtacttaaaaaatggtcatggtcaggtccgcgactccttgccttgctataacaaattaaatcgaccaataagaatacctgctgttgacgtgctgcataatcccaaattcagtagtgcatatactgacaacaaactgcattacttttcctcagagattatactacgttgttatacccattaattgcatcagctatggttgtagtcaaaatcactgtgcaatcaatttgacaacggagaaaatcataacttgatgctgtaaccataagcagctctaatgataccaagattttaccatgaatcactaacgaagtgaagttgaggagtacaaaagtctataatattatgtttccacgaaaatacacagcatattcaaagagagatgtaaaaatgaatggcatccacagctactactcatagcaagttcagaaatttacgagataaatagcacagattgttcattccagttttgttgaggagctttatttattatactcatgcctctgataataacttttctttttacctcttattgcagaactcttggaaatcaatggattcagtaggatctgcacggcatataaagcgagatcagcaacacatcacttttagtttcaggagagttttacgcaatgcaactattgaaatcttcctatgcttcaggcctcttaattatttggtcacaaatgcaaaggtgtgaatgggctaaatgtcatctcttctgcaaattagaagaggccgaaaatgatcttatattgctaattgtgtcgtagtgacgacctgcgtggtaatactcttctatcatttaaaagggttatctaccatttttttgctattccatttatttacaagtagtactcctaaattttcaaaattattcctgcaagcattaatttactaatttgaaaagagtacaaatatttttcttgccctcacaattttatccgccgatgcaactggagagaaggtgacacagcttcagctccccgtccaccttgtcccttgtatgtaggagacaactaaacgaatcagtatagatatcacacatatatagaagtgaaaatcacaaagcagtttccaaaatagtatatccacagtgctcattgataacatatagaacacaacataggatgtgtggcaatgtgccatgtttcggaagacccatagaataattaaccatgatatagaacataatgaatctaaaccccggaaactgatcacagatgcatgacaatattaaaaatataaaggaccaaaataaatctgatggtctccacttcacctcttcaattcacaactcacaactacttatcattcatgcccgtaccttaatttctcagtagtataaactattcaagtacagttcactaattagaactcaaaacaaatgaatccgtcatgcaatattaacagtttggaatattgtgagggaaaaaagtatgagccaagaattgctattgttgcaaacctcagacgtttagcaaaaagcaaacataaccattgcacccatcctaatcattctctgtttcttccactgaaacagacagcctttatactggcataccttttgtgtcataatggaaattcagaaaagcaaaatccaattatagaagttatatcatgtagatagtgcaattaagcatttatttcatttataatggccatgatcaagggataattcatcagctgaacgaaattctccatttctgaaataaccacgggacaaggtttccaatactcaccttggagagagcagagagcaggatgagactgatggagagtggtggtgatggggaagatctaattttgatttggaataaatttagcacagtatcgacctaaatgaaatgaaaccaaatcagcgggagagcttaaaaaataaaatactgatggcatcctatattttggcaattcagctgaaccaacaacactatatactaattaattttaacatgaaactgaactcaatggcactgatggatgctatagtgcaacagaggaaaatatatcaaaaagattagattcatttttattttgaattttatgtctctttcagtcactttcgaacaaatttgtatcttcagacaaaaattaaacaggtactcacaattagagttcggttcttcagtagtttagctcgaaggtctgagaatcaccgtacttcaagaattagttgcagatcaaacactctgcactaatggtgagacagttagcatttttcctagcttgacaaaagatcaggcctgctatctctttctcacacgcgcagataataacttttttttatcacacacacggacaataatttattttctcacaggtactacttcagcttattcaggaaataatcagagaaacatatagagtgaaactgaattgatcaaacatcaatttcagtgataaaaatgcagatcatgccaaccattgcatcacatctgttggtaacatcgcactgaatggttatagggaggggtgaggaggagggtttctgtacctcctatcggtggcggatgggatttggttggcggcgccggcgcttgatgcgtaggaggtgacagcacgttggtggaggaggcagcggcatgaccggcttggcgacgacgagcccggcgactccggccaatggtgaactggtgacgcaaaggcgggcggccaggcggagatcggtggcagcgaagttgtgggtgttccggcggcgccgatcggtggcggatcggtgcgattggcgggagggtggcgcggattaaatcgtcgttggtgggcggaggcgcagcgggcggcgccccgggggggaggggggtgctgccgacagagggcggggaaacgggatcgcgggctcgcggcggttcctcggatgggagaggagggggcgtaaaggcgcgatctgtggaggctgatccgggagtggcgtgggggagagacgcgatcaggatgaggcagtggggagccgtcggatgccgctcatctgatcgttttccatcgttggatgtgtgatatgatgaatgatgaacgaataaaaccatttgttcaactatagggagaccactagggttcgcccccggtcgcccgcgcgtggacgacttcttcggtgttcccttatacaagaaggtctcggtcgtcttctttgcctgcaggcgtcggcgtcagcctcattgttcttcttcttcctcctcgggctcctccttcgcgtcaggcgcaatgggggcgcggtggagagcgatgggcggcggtgacgatggtgggcaccagcgcggcgttttttcgcggtagggagaggcgcgcggcacgatggtggtgcggactgcggaggaggagcgcgtcgattctgtgaaaaatccggcgcacgagtgcacgacggtgcgggggcgagagagcgcgaggaggaaatgcgtgggagatgcgggagaaagaggagggaagagcgagacacaggacggtggatgcggcgtgatttcgccatttcaggtgcggaaaggagaggagggggagaggtggggtaatctgaggcgttggattggatgattttagaccattggatatgtgatatgatgaatgatgaatgagtaaaaggatttgttgaactatagggagaccacaaacacatggtcatttgttcaactaaaaggatggtgatgaaagtagtgtgcacttaattattttagaactttttaataattaatacttaattattcatgtgctaatgatttatctcattttgcgtgttattgaaaagcttaactaagtcagtggtgatatggttttgagagtgttatgtttatcattttcaagtgatttcctaaaatcagagttattgtgatttgtgatcacaaagtttagctcgcttttagtttcattgcatatgtaagacttcaatatgtttgtaagatgtgaatttgtatatcaactttgttgtgtgtaccttggccggttctagacaagggttttaatgcacattagaattatggttcatgaatttctgtacgtgacaattgtactatgtggttttcttcgtaatcctctataaactgggttagggctattaccttacgaggggcttgaattagtataacctatggttgcgttcgggaggcacggaaaacggagcagcgattagcaggtgattaattaagtatttgcttttttttaaaaaaggattaatatgatttttttaagaaactttcgtatagaatttttttttttttgcaaacaacacaccgtttagcagtttgaaaagtgtgcgcgcggaaaatgagggagagaagttgggaatatgtgtttgatgtggtattgtgtggatcctcgaatcaacatgccctaataccttcagaatacggtctgtgggtattccccatcgacaactgttcatcgttttccctagttgaaggccagaaacaaaagagggggaagatgggcgcggtgctccgggttaacgacatcatgagttgttgtccggcaaaatccaccaccatccattcaatgaggtcttggtcaatgagcttggtgcagctagatgaggttggttttgttggatctagcctcttcctcctttctactgcttggatttggtcttatttggttcaccctgtagctcccgatctctcgcgcacagccaccgcagactacgcttacacgccaccgtttgcctctctgtctccgcctatgggaacaaccatcagtgaggatgctgccgcctcaaccagcccacttgtgttggcagccgggcacctcttccatctataaagtttgctgagaaattgaagttcccctccttttccaaggcgacacatacgaacgattcgtaggcggaccacggacgtgaacatgtgagaaccacaggcggacgcgaagacgaacacactcttgaattggatgtgtgcaacgcctaacggtgcaaaagcgaaagctacgacgagggcaagcaggggagtcagatgatgtaccaataaatcactcagtttattttgtatcgcccgatccaatggtgacttgaatgatggacgaagaggatggaagaagagggtgtgagtacataatcatctctaatttttataactagaaaggaagcccgcgcatatgcgcgggcatctaatttaatgtgcttgaaatattattctacacatgtgaatataatgtttgtatatgcgtgattgttccagattctattggcaacatgttttttttgtcaatattttgtttgtgaatattttgaatgctaattatcctcgcaacacataaattctaaactaaaattacttacaaacatgaaatctttaattattggaaagtattatgtcgcaaaaatgaagttggttcctatgaactgtcatctaaactatatgttatttttaatacatatcaaatctttgttttggagttctaaactttgagaaattcgtgttcttaagaatagttattgaactttaagccaaaaaaattcaaatgatttcttcaatttatattgggctttggattcaacaaaatttgtttaaatttagcccaaattttgtctgaattccagtcatcctttctgtttttttgggaatattggaggtctatgttctatcaattgttcttgaaatgcttttgatctcttaaaattgggatgtaaacataactatgttgagtgtacaacttggtatgggataaatgtgtcctttctaatgcagcgagaatatacatatatatatatatatatatatatatatatacacaccctaatctccagttgaatcaagagcagcatcaatattaagatagagatctcatccagcaaagtatataggatcgcacacatatgatcgtttactccagatagactgaactgaatagctccagtagcatcaaatttaaacagacagatgattcagtttataatgaataaactaacggaacctgtacataaactccacccatgcagcaagaatgatagccgatcagagcaagaagactttgtcagaaatcagaacatgcctaggaccaaattaaccaacgcagcaacgatggtgccaaaacgtatggaatcgccatctccttcctgacctaggcggtggcggcggcataacacagaggaaaacaaaaaaccaatctcctaatacaaggaacatggcatatataggtggtacaaaggcctagccagctgaacggactaaagcccaacatggactcctacataccgatccaaataacagaaaaaaaaccttattaatgtaaaaccctgattacttggtaatcctgccgctaagcatggaaggaaagcatccacatgcatgcgtacatgcggacgttgtgggagaggatttcgtttttttgtgggtcctcatctcctctcctcccaccacgtgccagcttgagagcgcttttaggatgccacatgtcagcttgagagcgattttagaaaggttaatggacttttagtatataatagaagataggtaaagaaaagataaagattaggaaaggagatgaaaattagattgaatacaaaaatttagggacggaatattcagtttttgttagcaataaataaataaataaattcctcaataagaagggggtttctcttttctttggcgcgtgcgttcctctcctcaggtggtgactcggtcaccccttgcctccttcggccaccctctcctcctctcctctcctctcctcttcctcttcctccctctcctcgtcgcccttccaccaaagcgagagatcgaccgactcctctccctccgccgccgacccccctaggtgagcgatccagcctagatcctttcctcctcctcgcgttgctcgatccccactccgttgttgtttcctacctgtactgtatcgcgcgcggttcttggggggaaaaaatcctttctgattaagatacagaattgttttaaaatatcaattaattcttttttttcaagtctctctcgctctcgctccggcgtgtgcggcgcgtgtaatgggggattggtcatactgtaatgggggattaattagttacaatgtgttttcttggtgcctgaaactctgaattctttaaacattattgtcattgtcctagtaaattatatatttcatcgaagatatatagtagattctaggacgaattcgatttggacatagcaattttctgatatctctagtaaattacaatttaattccgaaatgttgggtgatacaggtatttgtctttcaccttgagtcggccccaatttccaatcttgatcttgacttcagcatatgaatgttgcttgatctgtattcgacctatgcaggtgttgttgatcgctttgcgaaatggagctcccagttgctgatcctgggccggtgagggctgaaggattgcttctgcagtgtccctattgtgattcagaggcaatgcacaaactcgcgcagttcttgctccccggcttggctgcggtatgcattgactgcacgacaggcgatctcttcaggaagccgtcggttgtcgccgttgacatgaggaaggaaatggtggactatgtcacgcagagaagcgagacattcatatccgattcgcttatcgaatcagaagcaagtcaggatcaagagaacgagatgccggaggacccttttgagatcgtgtccatcttcatggatgattttagtagcacgaagaggaacattatcggccatgtctctgggtggttgatgagcgacagccgcgaagataagattgatgactttgtccaagaaatggagatgacccgcttctggccgctggaaaggagagaagttattgctgaggtcctcctcaagaatgtagacctgaaaaccaagtaccactgccctgagaaatatgaaaatgaagaacgtctcgctgatcataaggcccagtgtagcttcagacctgttacctgccccaatgatggatgccgagcgaaagtttctgttcgctgcatgcaagaccatgattcagcttgcctgtttaaaatccttacatgtgagcagaactgtgagaagcggcttctgaggcatgatatggataggcactgcgtgactgtgtgccccatgaggcccatgaaatgcccttttggctgtgattcctcctttcctgagcgtaatcttgagcagcactgttctgagtttcttcaggcacacctccataaactcctcaaggctattcataagaaaggttttacagatgaggggctcaaggaccatgctctactgctggaaaaggttaggctcctgatcttgttaatttacaatgtgtaacatatgtttttcaattaaaatggctgccttattttcttgatttggaaacattgctgtcaaactattgtgaaaaagaagacatacatggactgcaacaatatgatttactgaaataatctggttttgttctgcagcatgacaatgatggtaaactggctaaatctcgggatgtaagatctcttactaatgttgtaaagaatcttgaagccaaaataaaagatgattcgagttagagtggatggcgtctccagagcaaaatgcaagtttttttttgaggcagcaaaatgcagcatggatattgaatggtatagttgaagagttgtttccactcacagtatacacagaagagtacaagattctgcacgtttttcctttacaactataattttcccctcatgatttttcttttctcaaaatcggttagttttttatggtgtaaaagtataacattattttatccttgctattttgtccaaggaactctttttttttcatataaattgagaataatttatcaggaatgctaatttttgtttaatttatggaagggcgatgctcgaagtaagggatgtttttcccagtctgattccgttccctgtaccagctaaatacccactagctgaagttaaatgctattcctcacaatgttattatttgttttttggaaactttttttttcaatgatccagatcaaggttaggaacactagcatttatcggtaaactgttggaatggtttaaattcaaattttattttttgatttacacttagtaccgtttacatgccctcacatgtataatgcccattgataggatatctccacctcccacaagttgtgtcgttttcatttatcatggattcgtgtatgatgtttatttcaatgtataaattattacaagaatgtcaaacatttttttttcaactagtccctgatccgtaaccattattcaaattctttttttttctgggaaaaccgttattcaaattctaatattcgatttggatttatgtccagtaaattctactccctctgtttcatattataagttattttgaatcttttctagccaaatttatttaggtttgacagtttattaaaaaaaaatagttcggttaaatgtaacattgaatatgttttttttaaatgttgctatattcttttattatttgatcaaacttaaaaaagtttgactaggaaaaaaaatcaagcaacttaaagtcttttttatatgaggggaaaagagagaattgagaagatacgcaaaacaaggtgagcattagcgaataattaattgagtattaattattttaaattttaaaaaatagattaatatgatattttaaagcaatttttctatagattttttttataaaataaacatcatttagtagttcagaaaatatgcgcgtaaaatacgagggagtttttctgtttctacctaatcaatttctctcaatcagttttatgatatgaaacggagggagtagatcgctaattactggtcaggcttgggtgactggtactttttgcaaatactggtttcctaggttttatcctaacaaataatctggagatcttttacggtgtttgcattttaaaaagggtaaaagtctatcgctgcacaatgaaaggtaccacttaaatggttgatatagttacttactacctccgtcccacgaaaaatccaatcatagcatcccaagatagaattagtggaggatagaaatgactaaaatgcccttaatcattgaaaaaagtagtaagagtattaataggtaggtaaaaggtattaaagggagttttatctgtaaagagtaggtaggatggtaggatggtataggatggtagaagttggtttttttatgggacaaaattcaaactctagaagttgagttttttttttgacggagggagtaggtggtaaaagtaaaatgataattttcgtaggagatagagaatggcataattgttttcgatattagttctaggtacataggtgcatacaatacctcactaactgtgtgcccggtaatttacatgatatgttttttagatttacattttttcctgcaaatatggtcatgcagtaatcctctgttacattatttacgtgtttgttttagatttatatttacgtgatattttctagattttcattttgttctaggagcacgattggttaaaatatgaccgaatgtttgccaggttattttgatatttacattttatcacaaagaacatctaaccttggtaaaaagatcagtggttagtaggttcatgtgtaattcatcctcaatacgatatatttatattgtttccacgtgtttgcgtcatctccccgatgaaatttaactaaaatgtcttaagcaattaaatagcttatttccttacagttattttgtaatgtatcgggtaaaatggaaatcacatgcatgcttggatagcatgtattgttcggaagtgctaatgggtgatcgatcgcccggcgacaagggttgccatcgatcccccttccccctccctccctctctccacctggtttccttttttggcaccgtattactttcctattttagtaaatttatgcatctaaagtttatacatctcaagtttacacatctaaagtttatacacctcaagtttacacatctaaaatttagagaccaaaagtttataagtcaaaagtttatatatccgattcaaatttgaatttgaatttaaatattttttttatatatagtatttctatatatacatctaaagtttatagacctaaagtttataagtcaaaaagtttacatacccgattcaaatttgaatttgaattatatcgggattcaaatttgaatttgaattcaaatattttctatatatagtatttttatgcatctaaagtttatacacctaaagtttatagacccaaagtttataagtcaaaagtttacatacccgattcaaatttgaatttgaattatatccgttcaaatttgaatttgaattatatccttcaaatttgaatttgaattcaaatattttctatatatagtatttctgtacatctaaagtttgtacacctaaagtttatagacccaaagtttataagtcaaaagtttacatacccgattcaaatttgaatttaaattcaaatattagtttatagacccaaagtttataggtcaaaagtttacatacccgtttcaaatttgaatttgaatttgaatttgaattcaaatattagtttatagatccaaagtttataagtaaaaagtttacataccaatttcaaatttgaatttttatttaaatttgtatggtgtagtagtaagagaagaaggggaggtaaagtagtaggggcaggggcgagtgat

SEQ ID NO: 80641 - DNA, 17508 bp, Oryza sativa
accttctgacctcattattaaaactagttactgacttactgctttagaattctcctggtcaactttttacttatatcctggctcggattcaagttcccattacactcctgcttacagcctagatagggataacatacctgaattagttactcaaacccagtagaaactgtccatcctgatttttttttctaagaaagaaacttctcccatttcagtaatgaaatgatagtagttctacaagcattccaggttcctccatcctgatatttaataagcttatgtatatagacgttccaaacataatatggaaaacatacagcccttagcatatgatgtttattagtatcaccgctctggtattcttactttttcaggaatcaagatttattatgatcattcagtgagcttgtaataatattgctaatcaacactctttctgtgatatctataacaaataaatggcatcacatgtgttttatcagagaccaataatgagtgggaaacaaaaaggaaaatcactacattggatcagctgcatacttatcattaaacaggttaggtcataaatgaaatgtacattaagctgatggcatctctgacaggcagtgaactgatgtttggggtggttggatatcctttttgttacgaattcactttgaggttgcttcccataatgattgaaaagctatgtattagtttgatttccacggctatcagagacgatttttcatggtgaaactgggatcatatccttcctgcagaactaaggaaatcataaggtctacatgtgagggttgccacttgccaaacaaatgctaccaggaaatgcaggtaagataagaacaattgattgaaatatttttgtttgcttcgccaatttagccattattatgctgattgcacgaaacaaacacactgcaaagtgttggagctaccaaaaatgtaactaattgtgcttttctatgttgaaggtacataagagtgatgttgtgttgctattagctacatgcaagtttctattcaagtatgcaaccagcagtcaaagcatttcacagatgcaacttactcctagacaaattggtaaaataacactgaacctatataggacccaggaaatattttaatacatttgcaagtgacaaccaattgctgcaataataaaccaataattagctaacctcatataaactcctgatcatctgcactaacaagaaatctcgaaatattcatttccttctcagacctatgctcttcttcttctgtgtgattgcaaaacgcctagacattgcaacattgtaaaatctcctcatatgctctgacaaccgatgtatcgcgccaaggttgcctacagctgatagccgcaacatgatagcatcaaacttcttgtacgaaagtttcatgccacggtttattacctcatctagaagagcggtcgcatcttccgttcttccagaatcaaacagcccatcaatcattgtttcgtaggtatcaacagcgcgatggcatcctctcttgtccatctcgatccaaatattgattgccctatctggctctctcatctcaaagaacatcaccatcagcatattatatgtatgaacactaggctcacaatgcgcctctatcatcctttcacagagttcaagcgcgtcatcagccttttgaagaccacaaagcaccttcagaaagcaattgtaagtgacaatgtcagggggaaagccagcctttgccatctcatctaaaacacaataagcagcatccagtttatccaccaacaacatgccttcaatcaagtctttatatgtcgacacatcaggcatacagccgcactttctcatttctgaaatcagttcaaagcactcctccatctgaccagcctttgctagcgccgcaatcataatcgagtatgtcttagccgtgggcgatgaaattgtagacccctctgttctcatgaactcaaacaaatcccttgcctctgagaccaaaccagcactgcaaaatgagtcaatggcagcattgtaagtgaagttctcaggggtgtgcttcatctgaatcatttcctcgagcaccttcatggccctcttggggtcccttgcccggcaccacccgaagaacaggatactgtatgtctcggcattccccagcagcttcctcttcacgcggctgaacaccacctccgcctcccggaccatcccgcacttgcagaaggcgtccagcagcacgttcagagcgtcggtctccggcggcgtgcgcatccgcacccgccgcttcttagccagcttcctgagatgcgtgaggtgcttctccgtgtatgcgcgcaggatacccagcaagtcgtcgaccggcacggaccttgtgcggcggcgcttcatgtggtcgagcacgtcgcagaggacgccgaactggcgggccttgtaccgcgtgccggagaggatgtcgatgacgtcgttgtacgtcgcggcctcgtgctcgtagccgtcctggtgagacgcccagacgaagaaccggaaggccagcttctcgtcgtaacggaggcgatgcagcacgtcggcgacgagcggggtggtcagctcggcgcccagcgcgtcaagggccgcctccgtgccctcgctggaacccgccgcggtctcaatcacggcgtcgtagatcctatccgagagagccgcgaaccgctcgtcctggaggtttgtggggaggacgacgtgcgtggtggagcagagccgtcgagcctggagggtcgggagatgcagctgccgcggcggtggcggcaccgaagtggggtttagccgtggggaggagcggttagcggagtgcgcggccgcgagcgaggaaaggggtgcgaccgcgagaaggcggcggaggtggcggagccggagggcgaggtggcggcagttcatgtggccgtggagcgtcagaacggcggcgcgccgcggccggcggcggtggggggactcgcgttgcggcggaggtgcgcctgagaaatcgcgtggccaacggaccgatgactgggccgtccgaatggcccatcaaaattggatagctgatccaatcggaggtctggcctgttcagatcccgttcagttcagcacttcagctacttctataataacgttataacacactaactcctaaatcttaacatgcaaatatatcaaatcatcatctactaacaagctgacacattatcatccactgacaatcattatatttaaacattatacaaacatactatactatctataatttgaaatttataaaattttagagcttttaaaataaaagcacgttaaatcatcatctttcataattcacataatatttcaatatatgttttcattattttttataatatcctatgtatctaaatagatcatccttacttggttaatgttatttctctcttatcttattaagtcatattgcatcatttttttagtgcttaaacgattaatctactatccaaattatatctctaattttcttctctcattaagccatatcgtcacaattgtttttagcttttagatgattaatctacggttcaaaccatttcactacttttcttctctcataaaatcatatcaccttacttttacatttgaaccatctttctatataccatttacattaaaattatcataaatcatgttaacttacataatcttatattatctagctattttacatattatttttacttatctattatattattaaaggaatagaaaaaggagcctccacgttcgctctcatggcctagaaattctcacattaatcggagaaaaataaaaggcagagtccatatagaaatacaattaggaaatagttgaaattaggaattaaaaataaggaatattagaagaggagactagagtccatatataaatacaatcggagaaaaataaaaggcagagtccatatagaaatacaattaggaaatagttgaaattaggaattaaaaataaggaatattagaagaggagactagagtccatatataaatacaattaggaaataactgaaatttggaattaaaaataaagaatattagaagtagagtatagagtccatatagaaatacaattaggaaataactgaaattcggaattaaaaaaaagaatattagaagtagagtatagagtccatatagaaatacaattaggaaataatagaaattcagaattaaaaataaggaatatttgaagtagagtatagagtccatatagaaataaattaagaaaaaatagaaatacagaattaaaaaacaaggaatattagaagtagagtatagagtccacataggaatttaaaactaactaaaattcggaaaaaacataataaaattaaaaagtggagtttagagtccgtataaaaatacaatttacaaaaaactaaaattcgtgattaagaaaaacatgggaagaaaagcttaaagtcaatataggaatacaacttagaagtaaatgaaattcgaaattaaaaattaaagaatattgaaagatgagtttagagtccacatagaaatacaattagaaataacaaaaatttagaaataaaactaaatattattggaagaagagcctagagtctatatataaatacaatttacagataattcggaattaaaaaaagaaatattaaaagatgagtctagagtccatataggaatatatataattcacaaataactaaaattttatgttaaaaataattaataactaacacgttgtcacgcccagaaattcactagtaatttccgaactaatttgtgcatagaaccctcgtccaggaatcagctgaggtacacaaactgacaatttaatatacagaatcatcaataatagtgttacatacttacaaaagaaaagaaaactgcagcggaatataaaatctagcgaagctccggctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacagcacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccatgaccgcgggcacggctattcgaatagttttactctggccagaggtgtaccactgtatccacaagacacagcctcatcaacatgtctaccatgcgtcgcgatactggaaagtacccgaatagaggctgtgacaataccctttgcacaacacaactcaccacagtgcaccattcctggatcataatcaccccctctataaatataaccagaggcatgaactccccagcgacccccacggacttctcgccgcttctcagtctggtgccccgcaatgaatcatgctatacagaaggtaaagccgttgcccatgctggcttgtggttggtacggttaatgtttcacaacagtagctcgtgaactggtccttaattgtcatgagcacgaccttcaaaaccatgtgctcacaacccaccattgtcaagttttagttatcaattaattatcataacacgattaaacatcgtgagctaccattaaatataatcataagtgatagtgtaacattagttatcctaattatgtgataatgtttctaagcatggctaagcaattatatatatatatatagcatttagctgaaccaaaccaatatataaggttcaagctaatcaatttgttacccaaggtatcaaggaataaagtaatcaatgcaaattggccataacaaaggaataggttcacaccacccggtgacattcgaaaataaatgcacagttgaaataaatagggaatttaaatatatgatcaacatgctcaaaggattgtgtttaggatctgtgtgacttgtcttgcaataatcggtcttcaattaatcttcttgaatacttccggcgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaacaggaaaaagaaaaaaaaacgatgatgacgtcatgatgatgacctcatcaatggccgaaccaagatggcgacctcgccggagattggatggtcggctgcgactttggaggacaagaacacgtagaggacgacgagacgaacccaacggtactcaccctcgaaccaaacgacgaacgacgacggccggcgacgacggcggggtggagcacgtggcggcggcgctacgaggcacgggagaccacgggagagggggcaaacgaaagaggaggactagggggtcctatttatagccttggattgaagagatcggactcctcccgcaagaaatcgatccgggaaatcaaaaactcggttttggagataaactcgaaaacgagttcgattcggataagatactcaacgattagctcctatttttgggggtaaagatagaggaggataagagaaatatttcccctcaactaattttagaaaaacacaaggggaaaggtcagatttggaggagaaaaaccgagccaaatcggtctcagttcggctgctagaggtagaagataaacagtgtcgagggaggcaaattagacttttcgtcttgggctggctgaaaacaaagcaaagaaagaaagagaagggggaagctcggctgggccgacttgggctgcacggccgtgcagacaaaagagggagatgggctggaaagggcccaagactaggaagaggattattattacttttccaattaaattaatcaatgaaatgatctttggattgttaaaaatacttcctatgctcaaataattccaagaaaaatcttgaacatacttggacacccaaagtatttaacaatattaaaaccagaccatttaatgattaatttaatatgtgggtaattactgaaatgctctttgtatgattaaaaaattaagaattgagctccgaaaaatctgagaaaatttcagagagtgtaattaatcatggagaatttaatcaaaattaaatccatccatgctttatatttagaaaattttatttcccacatttaacttcacttgtaaattaatgaacatttaatataaattctaataataatttattaaataatttataaatcctgaaacaaaaatcaggatgtgacacacgtatataaaatacaatatgaatattacacattagtagtttcgtaaagttattgaaaaatttaaaattatgttgttattttaatatatttgaataatatattgagaaaacatatatgctattatatgagagaaaatataatgatactagccgcgcagattgcgcgggccaccatactagttattattgtactacactcccacaacaacgcgtgggtttcacctagttaaatccacgcccatactcatcggacacggtgcccatgggccatgggtagcggacccagagcaggattgccattcctaatcggatcgttatagattattactatttgcttctcgcctctataaaagtatgttcccttaaaatacttatttaaaattatttgtttggtttgtttctttcaaatatttaatttatctcaattaagtagataatttttgacatatcataatctgatgaatagtttgtttcgaatgggctatgtaaattttgttaggagtatatgccactccaaatgttgtcacttgaagaataacatttataaacttgaaattgaaaaggcacatttctaaaatgtctcttctctggtgctgtttgccaccctgtgaccagattgccctgtagtctgttttgtccatcgtcgttgtatacctgacaggcgacagctatagtagttgacgttgtttccatgcattttggttgtcccattaaactcgttgtaacttttccccatttttcagcacggtttgcacgtacaaagtcaagaaaaaaaagttcatatcgttgtcatctacataaagcaatgattatccctgaaaaaaaaacatgtgaaagtatctgaatcgcttaccgtctagaagggaactaaaggtaaagtcgttcttaattgagccgactaggttgaatttgatcttgaaaattcttttctaagaattttgatgttaaccttgggcagacaaaacagtacatcaaaactattgcacatattatttgccaaaaaatagagagttattttccttttctttcagtccaggaagggataagatttcagttagttcagattgtacgaaaatactccattccaaggaggctgcattagtacttctgctatgtagtaataggcttcagtttattcagatgtattggcaaatcttacatattgatcgatcatcgatatgaattgtaaagttaaattcttaccctcggcgtccagtcgatggagatggtttaccagtcatattgacagagcctgcgcccggccgaaacggcgggtgttaatgcctaacatttcatttatgcattcgtctcctgcacaaaccacagtgtaagagctaggatgaatataattatctatccaattaaagacacaaaatgatactgcgtgcgattgttcaggcatcttttattctactgatttgctcatgtacaataatatacattcacatctaagggtgcgttctttcaaaggagattggggagagattggagatattgtcactcgttttccgcgcgcacgcttcccaaactactaaatggtgtattttttgcaaaaaatttctatatgaaagttgttttaaaaaatcatattagtccatttttgaaatttaaaatagttaatactcaattaatcatgcactaatgactcacctcgttttacgtatctttccaatcttctcaatcccctctccctcaaacacagcctaagtttctagttccaaaaaaaaaaaagcatctaagtttcttcaacctagtatgtatattatttcgcctttgctattctgcagtcacctgattgatcaataggtgctcccataatatttgggcatatcggcgttgataatatacctagtacagagtacagaatacagtcccaccgacaaaaaaagaccatttctttctttcatgtgggaaaatgcatgacgtcaagttcaactgttcaagtttctcactcaaaacttctgttcgttttctatgttcgaacttgcctggtagctgccttctccacgtccacagccgccgccgccgccgagctggccacagtgcaaccagggtactgtgcagtcccatgagcagaaccgtcgtcggcaacatcgacggcggccacgcgcttccctttcaccttcgtcaccgacgacgacgaggatgatgacacttccacctgggtgctatccggcgttctcctcgacgacggggagaggaaagacagctttcctgacaaagaatttgagagaaaagatgaccatctgcccgaccgcgaaaaccgggggctgcaccgagcgcccatgccgaccccttccccgagtctcctcccgcggcgcacgctctgctcccccgccgcgaccatctccctgtgtacgtgctccggcagccgcagcgtgtaccgctctaggtcgccgtcgagccggacggcgagggagtggccagtggagtgcgaccggggaagcttcgccgccgacgtctttggccgcagccccgaccgtgaccgcatcgcgcggagctgggtgcctatcgcctgaagctctagctcctccttcctccgctcctcgtcgtcctcctcggtgaccacgtcgatcaccacggctgctgggtgcgccccgtcttcttgccgtatcacaactatttcactggaggtgctgttcggatcggcggcggcggcggccgggatgatcacctcttcggtggtgtccttgttagggtcgagattgcggcggcagacggggcaggtcacgtggctggcgagccactggccgatgcagtccgggtggaaggcgtggctgcacttgggcaggaacctgagcatctcgtcgtcctcgaactcgctgaggcacaccgcgcactccagcgcggcgccggcgaccttccccacccgcagcgccttcgcctcggcgtacttcatggtggggaacatccggaccaccgacgagtcgagcccgcgcggccgccgctgccgcctcgagacgaagctgttggcagggaggatcatggaacggctcccgccgacgccgccgccctccgtcgcggggtcgtaaccggtgcagtggcggaggtagatggtggagatcgcgatgaacaggaaaaccccgacgacggcggccagcagcacgatcatcgtcgtgctgacgtgcacctgctgcccggacacgtcgccgtaggcatacccctgctgccccgccggctgcgctccggccgtcgacgacgacgccgcgagcgcgcacgcgaggagcgccgcgagcagcgcgtgctggtgctggtgcgcgtgcatcctagctcggcaacttggcatgcagatagcgcgcgtggtcggcggcgggaggcgagggcgccttggctagtcgtcttccctgcgcatgcagcgtgcggagtcgtactaaatagtaaagggccgtgtaggagtggtcaagtcgaggtgagctgtgacctgtgaggaggacgatcgacgagaacgtcgcgatagcgtggcgcgcgccgggtctcgcgggaggatgtggattccgctgtccggccaggtggatacgctgtttggcaggtttgactgtacgatcgaaccgtccaggtgttcagaagcagtgtggtgactgggcatgccagttggatttggaccttggactcctctgatttcagctacgtgtctacctgtcaggtctgtaacggacccagaaacggttaacagttaaaccactaaaaaaagcaagtccacatgtagcttgaatcaacggttacaggctcggaaacaaaggtgaatctagctcgtaattaattaggtattaattaatataagcttaaaaataaatttattttttatataaaacatactccgtttagccgtccagtaaacctattaacaaacaaaaaggagttgcccaaagcaatagccgctttgaaaggaacaggtactaagggcagtcccaacctatggtgtccataagtagtgtctatggtgccatgtcaataagacatcacaatagaaactatactctacaacccatactttcttaaattagaccattaataaatacatcatctttcttctctaccaatcatatttattctttatctattatgaagacaatattctctcccaatgcaaaacttgataattctctcccaatgcaaaacttgatagtgtctagtgcataggttctcgtgttgaagttgtgtcttgcatgagacccagtttcttcctctcttcactctctctcaattaatatagtgccacataaactaaaagtcctacatggcaatgtagttaatgccatagacaccatcctagatggagggctgggactgccctaagagatgttgcaaatgattcattctagtgtataacggaaggattaatcaatgcgtacaaatatatctatgaaaatgaaataaatagttgtgctaaataaaatccaatcttttatagatattaggataatcctaacctttcatttatttattaattaaaagctataaccaagctattaatattatacattccgcagcccatatgtctgcatcgcaaaagcattaacggttgctaacataactcgaatgataagacatttttagaagcaaattgtattgctaaatttccatccatgattagaagtatagccatcatctctaaataatggcatgttgcatcatttcttggtcctcctcacaccttcaaaatccaatcgcacttttaaatctaacctcgtgtaaaattgtgcaacaaacagcctcattggggcctttcaacttataggcagttgccaaattttaaattttaaaactcaacttttaagttgattttaaggttttttcaattgtaatttgtttctaacattggttttaaaatcattaatgacacgtatataaaattttatccatgaattcatttttatgttgctgataaaatattatgttttataatcaacataaattcgcgtgccagttgagtgacgcatttgtgggttccaccctcttattcattgatcaggtgtacggtatctttatatgtttttcatgcgttttgcaacttgataaccattgcccataacgtatatgcatgatatgcatcgattgtacagctatgaacatcaatgagacaatgaccgtacgtgcaagtacaagcagggagccagggatcagctccggcgatgcttttattactctccctatcccatattataaatgatttttaagggatatgacacatcgacagaacattgtaaagttctttgatatataagagaagaaatgagggaattatattttttcccgagccatgaaaacaaaagtgggttgctccaagcttatatggccttccagttgcagcaataaagctaaccttcgtttccgtaaaaccagtacagtataaagaccctatttagattctaacttttttttcaaacttttaactttttcgtcacatcgaacttttctacgcatacaaactttcaatttttccgtcacatcgtttcaatttttttaaacttttaattttagtgtggaagtaaacacagccaaaggcgagcgaaagaattccttgaaacggacttcaaaacaattgacttccttcgcttcgctcaccccaattcccacggagcaacgacgacgcctgtcacgtcacctgaggcgacaggccaaaccgacgatctcccaacgaacgactctgatcgagagctgacccgatcgtcgcgtggcacgtcggcgtgcgccacccccgggcaaagtggcggcccacgtacatacgtagtacagctctagcttggccgtgcgcggcgcggtccacgcgctatccagctgctctactcgtcagtgtggctggccaagtggccgcccgcatgccaagccgacacccgcaggagacggcacaggacaccacgccacaccacacttgcgcggccgcgagagcgacccgtaaggcatagataggctccgctcgccacgactacggcctgggccactgggcgagagggacgccggcgccacgggcgccaagctagtcggagtaggacgcgggaggctatcgcgcgcttggccgattccatcgtggggtccgggtgctcgtcgcgtcgcgtcgcgcgcgcggctcccgcggatgcgggggcagccactcgttcggcgtgcggtggcgcaacgcaacgtgcggtggatatggacgccaggtgcgctgtttgaggggtgcaaggcaccggagccggcgcggcgcgggcgtagatgccaaaaccggcaaactgttcgacccttgtgttatttacgtatgcgcgtcgatctggagagttctggaggattcacgccattcgcgagctgtgggtgatttttcttttagcaagcggcaaaatatggatcatcttccgttagcacgttttctaactaatacacacacaagtgttccctaaaataccatatcactttttaaattttttatagcaattaatatcgattaatcatacaccaattatttaactcgttttacgtgccgtcaatctatttaggcgaaatattaagtcggacgcaccggggtttcatgcatggggattgaatcggaggtttggtcctgcgcgtttggtgtggaaaaacaaatctgtcaggatcgatgtgcatgtcgtagaatttcgcaggttagcttattactaattgcgatgaagaattctacgtgctcgttgatcgtcttcggttgctaacccagatgcaacgtacggcactagctagctgctagttagagagtataataaacacgggtttaatttttgttacatgcatgacgaacgtaatgaggtttcaaacgaggaaactacacgccagggcacccacaaagacgtgatggcacgcttttgtggggcaccgtgtgcgaaagcatgaattctagaatcgtttggcatgtttgtttttttgctctcaaacgccaacgaaaatgaacgcagaatccaaggtcacaggaggacattcttcctagtctaccactccgatattatattgttcgtaagtgtagcttttagaattttgacagttaacttatgaaaatgttatatttgtttacaaattagaaaaaaagtacgaattaccccccccacacacaaaaacagacatattaaacctcaaactattaaaaccggacaaattaccctccaactcaatctggagcggttttaatcctacgtgacatacacgtgacaccgacgtggaaatccaatcagcaaaaaataaaataaagaaaatataggacccacaagtcattctattattgtgtgttgtggcgttggaacttaagacgcgagcagctacgcgcacagcgggcgcgactccgatcagcggcaattggcgacgggcgtggctgggcgagcggcagtgggagcggcagggaaggggaatcggtcggtggcgacaggagcggttgggcgagcagtggcaggagcaagcagggagaggaggaggaggagcccgtggtggcaacggtggcccaccgcgcgtccccgtgcgcccacgacaaggaggagcccgcggtggtggcggtggtccaccgcgcgcccacgacgaggaggaggagcccgccgcccaccgcgcatccccgcacgcccgatcgacctccgcctccatcgctggccaccaccgtcctcggcgctcctccgccacccctaactggctccgccccccgcgcgccgccatcctcagctcgccaccgccggtggggattgaggtgaggggagggcagagatagagaggaatgggaaagagagataaaaactgacatgtggggcccaccttttttttataaaagaaagctgactggactgccacgtaggataaaaaccaccgctgattgagtcaagggggttatttttttggtttgcatagttgggggtgaaaaatgtctggttttatggtttagaggtgtaattcgatcggccgttatagttccgggggcggggggatttgtactttttccttacaaatttctttcatatgtttcttgttttgctgtttctgctaatatcagtgaaaggtattgataccggattgtattggtcctattggagagatggagacagaactttgaacatttcgtttccgctccatttcagtgcatgtcactgccaccgcctcatacgttaggcttccatttccatccttgttcgccaatcgttcaggactttcaagtttctttcctcccttccgttcctgtatacggaagtccgaatggacaaaactcaaaagtctacccagctgtgggccgtgggtaagaggcttcctctgttctgcgccacagagcctcacgcatcggcccaaccagcttcgagctgtgggccgccattgcctcatacagtcatactccacgttgcttgtttcagccggagaaatgtctcgattgctaccgcgagtttgtacatgtgcatgccgtgaggaacctcatcggtgcacgtagaaacaaaaccaaaaggtatcaactttttatcgttccggccacactttacatctccgtacgatgctgccatctgacgctacccacgctacctttcaccagaatcaccagcggcatctcctctcaccaatcacttgcccaccctgcctacacattcccggatacccctctccccgcacggtgagctgcaagcttggaaccacaatgtctggcacggcacctgcatcactctgcaggtttctgaaagagctagcaccggcaccagcccaccagcggctaccaaccaacagtgccatccaacagcggcgagctcgatcggcagcatcagagattttccggatgccgccatggacgccggtgtccgcacgcggcctatatgctcgccgccaccaccgtgggtgccggactgaatgccaccagccgagcgatcgatcgatcgataaagcgcagctcgtgttgcgtccgggagagcagacaggtgcctgcaggtctctccaactctgctttgtacgaatcgagaagtagcaggaggagcagtacactagtacttgcatcgggagcgttttgtcctggttcgagcgttgataaagtgattgttcttttccgagtgaactgtttcaagcatgggctgggcacaccgtcgtgttcgtgtcaggtcggtcgtttgagacgagagaatcaggggatgggaacaagaggcggctaacggcgatcggttgatcttcttctctggtaggaggagcactgatgatggtggcacggcaccgtgcaattagtcaacaggatcattggcggctagcattcatggttgaacttgatgcgtcctttcacaagaagcacgacatatactgagcatctaatcggtctcctcatcttcttctgaacttcatatcaaaaagttcctaacctcacccggtatttagtgagaactgttgcttcttctttctgaatcatggaattcttgcatcggaaaatctatcgatctcgtggctcccccactgatgagacgctgcgtagatgaggcagcagctttcgaccgtggggcaccgagctagctggcgactcctatttaaacctctactataactggcggattgtacacctaattgtcatttcctgtggcgattacaacttgtttatttggactgactagtcattgtccattacgtgggggtacacccccaatcaattcgttaagcatttctttttctcgcaaaaaagggtgcaagactacagggaccctgatcaagagcacataactacatactacttccctgcactcccactctgactctcaaagtctattctactgtttgtatgcattacctttttcaacaaggacaaggaagatggaatcaaagaataaccaatgcgtactgcaccagataattagcccacaaaaggatgattagttgatccctaattaagctaaagctatgctaatccaagcaagctaccatacgcgaacgtggcatcgggcgacaggccggacacgaggatacgtgtggtttgcctcccctggactcgccatgtatataccccatattcccttcttcttccccgtgccgtggcaggttgggtcgttgtccccatagcacatccatgatattc

SEQ ID NO: 80642 - DNA, 1079 bp, Oryza sativa
attcctgcagccctgattgttcgtgacggcttgtatagtatagtaatggtggtcgagctagtgaaaggcaaagctacatgccactatgctagagattctggcgaagttcatggagtatgttttcgggctgattccaaaatgttttgataggtgctcagcgtcatatatttctcctgccttaatggttgagctaattattactctcttatattataagctttgattttattcctaaacaaatttaaaaagtttataaccaaaattatagaaaggcataattacattttcaacacaatgtactatcagaatatattcaatattacatttagtgaaactaatttggtttgattttattcctaaacaaatttaaaaagtttataaccaaaattatagaaaggcataattacattttcaacacaaaatgtactatcacaatatattcaacattacatttagtgaaactaatttggtgttatagatgtatatttttttttgtaaatttgatcaaatctaaaaaagttttgagtttggctaggaaacaaagtgagcacataccaagaaaaataaacagagcaactaaaaatattgatttctgtaacttttcgccgtttgaaagccaaggctttgatgcaaaaccacctagtttaatttaaagttagtttaaatattcaaaatttggctgcatcagtacgaaataaactattttggataagtttggaatgaactgccaattagaggcgtcaccggttgagcatcaccagttcaccaccacacggccttctgcttacctgaacatatcatgccagtatgccacattgccactgccgtctcagtcaaagtaatgcaacaaggtaacggcatgaaacttgttataacaaagagacgacgaattcagcaaaagtaatacgaaaatgtacggcccgaaacttattatcgtgtccatagacgatggtgtaacgttacttggtcaataacatagaacattccagcggtagcacgcagcagtgttgtgacgttacaattatttcagtactcatggaattttagatccatccggaattacatgatgcgtttactgg

SEQ ID NO: 80643 - DNA, 21061 bp, Oryza sativa
caagtttatacagcaacagaaatacagtattgcagttcgaatatgccttacaccagtttatatagcaaccagaataaatcaaggatacatgagagtgtgtcatcataacgagaagacacaactggcaagttatgatcaaactaaatgcaacataaacagtgaaggcaacagtgcacctttctagctatatcataaatctgattagataatctcaactgtacaattgaaaaaaaatcacaaacagcagtgatctcatgttcttattcatcattagtcaatgcgaggaactactttcgtgaaataaaatgaaattggcaatcgggataactagatgattaatcccttgatgagataacaactttttttttgtttccaccatgtaaccacagaatctaggaacatatgcaccgattaccaactggcagaatcattgtgtatgaattgaatagttatttgagatgagattacctttgatcaccgaccctggcctatattgaaactgaatggctcctggcctgcgtcctttgtgctgagagaaacaaaggacacaacatcagatgaaatttctatcttgtctgaatatttttgggggaaaataactttatccaaaattacctccaagaattttgatttgtgaggtctaacgataaattttctacccataaacaacaaatacacagcattggctgaaccaacgccacgcgacgcgccatccaagttacaacagaacaagaaaagaaaaaggatagtttttgtacctccaaaacttcttagcgagatcattatctttccctgcagaaaagaaagcagcatggcaaggaaaccaagttaggcttaactactccaaaacagaaactcagaaatctatccacaaaccggacagaggtaaactagcagctgcgatttgaatctaaaccatctatccaaaagacaatcctggcatcaaacatgagatccaacaagaaatggatctgggaacgaaccaccttgttcttaccgctcaggttgattcagctaagcacacgcacggatccaagaaaagaaaaagcatgaaaggaaatgttctgggggagatagggagggaggaaagcggcgaaccgaagccggtgcagtggacggtgaccttctggcccttgacgggcttgggaccggtgccggctttcaggatcgtcttctcgaagcccatcctctcttcttcttcttcttcctctccgcttgcctctcctcccttcttctcgattggactctcctcggcggcggcgctctgtgctagtatgatcagtggtggattggtggtgccgtgcggctcgcccttatagagcgctagtagattccttttttattacaccaccaatccactacttttttttattacacgactttctggtggtgtaattgttccggcgtctcctgggccgttggatggagagacgatcttttcagtcctacggtccagcttcaatggttttcttcttttttttcgcaataaaattgcatccgacctctacgtatataggttgcgcacaaccataaaaacatgggaaaccgctcaaaaaataaaaacatgggaaagaaactggaataacataaacataacggtaaacataacggaaaatactatgcgtacgatattttgttacattcctataacgatctcgaaaaatatattttgtgtcgtcctatgaaaaacctattaaaagaaccatacaatattagtcgtgaggctacaaatgccgtattaagctgctgaccggccattgactaagggggtgatgggttggttgtctcactttaccataccacactttagtcatatcacgattatttagtcatgtgattgtttcacttcacaattatgcacactttcttactcttaagacctacccgcactttcaaatttgtaactaaacatatcacacatgcgggcgagaaatttgtaatattgggactgcaaacacgagagcttcgctgttttgacactccgagtggatgacaaatgggtccatctgtgtctataaaatgtgagcctagtgttattatagcaaaggttaatgtttgcaatgtcataattgtaaatcccccctgcgggctataaccaactatttcttagacatattacttgtctaaccttagttatgtcaaagttaggtatcaaccaaacaacccataatcttcctaataacaacatatgatgcctctcatgtaatctctcttgcttgatcgtcataacaaaagaagaaatgataattgcttatgagaaaacaaaatgtgtgttatagaatactctctccatcccataatataacaatttagtactatataatatagtgatgtatccgattcgtagtactatgatgtatcctatccagtaatagatggcaatattaataaatgatgtgcttaacctaagaaagaagtaacaaggcttgaatatgggatttttaacctcgctaaaaaaatcttgttcaaaacacactagcacgtccaacaccaatatatcgttatggtggtagaacaagtatcaacaccaatatattggtttggatcgctagtttttctttgaattttttctctaaaattaactgcaccatggtacaatacaaatatacaatgatcaatgcatgattaataacttctattgtgtaaacgcagacgctcataatacaaacacattaaaaaaacttttattgtagatgtacgcttataatgcaaacacattaaaaacacttttattgtactcttttcatactatgaatctaaactaggatatatcttatacaatcaaaatttcttatattattagacgagggagtatatgctaatctaacgatttataatattgctgattttcccgagctgttacaactccaccagaccagatactgtcgcaaaccatccatccccagtcccccactgtgcccccgaccggaccgctcgcttcccaccggaccgttccgaagccacccaacctagcgcggtaccgcccccataaacacggggacacacccggcgcgccgccgctcatcgccatccacccgcaccctcccaattcttcccacgaaaacctcccaaattccgtagccgatctctcccccccaccggcggccgccgccgatggagacctaacgccggatcgatctctcccaccggcccgaggcgggtgaggcagggcgcgtcgcctccatggagaccgagcggatccgtcacctcctcctcctcacgctccgcgcgccgcacgcccgcctcgccctcgtgggtggcaaccacaccgccgcccgcttctgcacccgctaatccccccctccctcgccggaagactcatcatcctcttcgtcttcgccaccgtctctgtgcggtatagctctctctctcgctcgctcgctcagatgccggacggctgcgtggtgatccggctcccggacccgcgcgtcctccgcgtgatcgcgcgctcggtgctcctcgccgtcgcgctgctctccctggcctggctccgcgatgccgaggcccccgccggggacgcgctccaggtggggctcctgctccgcgacctccgccgcgagggcctgctcgcccccggcgcgcgcgccgtcttcctcggcgccgccgatggagactgccaccaccaccctcccgccctcgacggcgacgacatgcgacgcatcacgccgcgggagttgctgacgacgggggacctgtccgtcgacttcgtgctggatttcggctacttcgacaaggacggcgacagggttggcctcgtcgacagggtgctcaaggatggcggcatctttgccgccccaattggctcggcgagcgagttccgcttgccgccgaactaccgcgtggtttacatccgtcggttcaccgagactttcgtcgggatcaagaagattgcccgcgtcggcggcgacaatgggattgccggcgccagaacagggatggcagcgacgactcctgctctgaaggaaggagttcttgcgttttctgctcaaacagctgacactgccctcgctgaactcaagaacttcaggaggaagctcttactgcctcacatcactggagcatcagcggctcacgcgcatcaagcgtggctaaaattgcgtcatcgtccagtgattgcagttgatttcccagcaatgtggaatgtgaataagctgcagccagcacatcctctcgtccttcaggataaggctgttcatggagcgcaacagcagcagctcaacaggagcgtgagactgaacccatctacaggatattgaaacgaagcctgaattggaacagggaaaaagctcaactgaagaagagcattcttgtccattgcaaatccaggggggtgatgctctctgcctgccaaaagaaatggttggtttgcttttttctgaagttctttatttaagttgtctgtcgtgcgtgatgattgagtttgatggtgtgctactgcttaccagtatgtgtgtatgcttcgttcgatagtctccaatttgttgttttgtattcagtggtgactggtgatctactgatctccaattgcactactgtatggtatccgtttggaatgagcattgttcgtcttgatcacctatccttgttatcacgcttgtgcttcagcatgtgcatctctgaataatgcaatcgtagcagttcggcatctggttataagatgcagtactgactactgagaagtcagaactgctgttttttactcttgcatattcaattctttgcaaatttccacgcgtataagattatgatatgaaacaaggctggaaattggaatagtttactttggacatctcaaggaacataaaagtatgacaggattcatacaaaagggaactcacttctgccaagtttgtgatgtttagcacagaacaaatacaagaatatacaaaacaatgtgctacatggcacatttatttctacaattgaacaatcaatacatatttccttgctcaaatgcacgcgacaactatcatccgtaaataccaccatgtgacaaaaagatgcacaacaaactagtctccaaatgtgaaatatgcagtaccattacggatgatagcgcagtagcaacctcagaggcttgacttaaagtgcagcaaagaatactgatcgaagatggctcaagtgcctttgattacaacaactggacagaccacattgttgatgcagtagttgctcacacttcctaagaacattctgtagaacaaaaccaactcagaatttcaatcagaaaccaaaacaagacgattcatatttgatatagaaaaaaaaggggaataaataagctgacaatcaaacaaaatcaagcaagaagtacttaaaaatcttcatgacctagatacatgaacactagatcaactgcactccataaaataggagtcagttgcgccgagcatttgaagattgtatgggtataggtatggcgagcaggccagccccccttggattttaggttcttaactaccgaagtgaagaaaagctggatcaagaaaaggaggggcactactagccctctgccccatgcatctaaccaatgtctgccttagtgtactcttagagcatcgccaagagactagccagatggctctccaagttaaaatttggctaagttgggcaaaaaatctactccaacagactagtcaaatggctctccaagccatccggctggctaaattccccacctcactagccaaagttggcaagccatccggtgtgggttccacccgtctcctctctctccccctttccccatcccgtccgtccgccactccctccctacctgccgcgaaatctgcccagctactgtcgtccatggtcgccgccgccgaatttccgtcctacgtctccgtgccgccgtccgacctgcaccgccacctcggcaagctgctcaccagtggggacggcacggacgtcactctcgaggccggcggcgagacgtacaaggcgcacaggtccgtgctcgccgcccgctcgtccgtgctcaaggcggagctcctcggcccgatggcgcagccgcggagcaccgccgccgccacgccaacgcgcatcaacgacatcgaggcgccggtgttcagggcgatgctgcacttcatatacaccgaccacctgagctcgaccatggcgaccgacggcttcgagcatctcaccacaagctgccctgccattctcaaggagctcatgtccaagcttgttgttcactgaacactgaatattcagcagaagcatattaagtaggatggtgtcaattcagagctagtgtgtgattctactctggagtgtcaaatagctagacctatgtataattatcgtcatctggttcgatctggtgctaatcccgtgtataattattatctgtcatctaggctagtttagatggtgtgatgcatcatgctcctcctctctatgtttgttttggtttgtggttgtatccagcatggacagagcagtatcggtcaaatgtatggtgatagcctgcaactgtcctcggctccgcctcctcctcaaccgggcacccgtcgtcggcaccgctgcccgccatccaccgtgctgccgccacatggggggcttggcgccgtccggagcacgacgccgcttctgccagggccgccgacgctggggagacggctcccggtgtgcctccaccgctgacgacttcacggagcccggcgaccccgaggcacgccatggtcatcctcacagcgccaccgtcgtcgtcctcacagcgccgccgtcatcgtcctcctagtgtcgcccgtcctagcgccgccgtcatcgccttccctcgccgtcgccgtcgactcgcacgggagaaagaggaagaagggggagaggaggaagaagcagtgattgacatgtagggaccctgtgtcatagactgaaaatagaggggtagatggagaggccgttggagtaaataactagtttggctagccaaatcagatgaaaagttggctatatgggtgtttggagagttcgatttggagaggtcgttggagatgctcttatggccatcatctacttaggctgcagaagtagggttggctactgtgagaaacttccatgtcgaagcataaccaagtccaaactagtagcaaaattaaatgacccaatgcaagctaatggttccactccctgctcactgaatgcttcacttgtgttgtcagtattcacttttatgaaaaaaaatgctggtgccacttgacaaacaacgagattgcttagctgtcttacagggtttgtgtcaggttccagaaatcatctcttgattaggctaggaataagaataggagtatcaaataagcaagacacatagaacgattcgcaaatactacagaatgttttatttttccagtttcaaagctcagatttgcacataaatcttgcgttaaaagcttataaacaggtcaagaactgaacttggagttggagcaaaacaagtgaacagataactattataaaattactgttgcccaaaaaaccaactttcccaacaggcccctgcctgatgatggcaatatggtttcagtaactagaatttcccagatagcttatcccccccccccggcccccctaaccattgtgtcatgtgcatcttccaatggcctgaaaattccctgatgtgtagcctagccccaccagcagtactgaatactgattccccatatattgcagaatgtgatacaatttactatggaattgccctctcaaaaaaaaaaactacggaattgcaggtctgttccctattaagtggacagaatcaaaccacgccaagttagctaaccagtgcagagagagtgcttattatccattacctcttgagggggccaaaagcacggcaccccatgacgagcagatcggccttgagatttgccgtcacctcgcagatcttctccttaggatccccaacgaccacatccgtcttcacctccacctgcaagaagatcatcccaatcatcaaacgagaaggctagaaatcaaaatcgtcgagcaattgtcagcacaaatgtggttccccttacattcttctcggagcaaatcttgagcgcgtgatccaggatagcctgcgtgatccgccgctggtgcgcctcgatcgcctgcgtgaacgccggcacctccacctcgcctgatcagccgcgcgtcacattcaggaagccatcaaacccagctcgaccaaacaaatttcgcaagaaccacagctcacagccacaggaccaagtgtccgtcctgatttccgcgaagacgagtgcgagagattgcttactcgggccgccgaaggggatgggtccggggttgagcccggcggcgatgctcggcggcggctggacgtggagcacgacgagcgcgccgtcggggcggaggcggaggttgtcgagcgcccaccgcagcgcgttcatgctctcctcgctcccgtccaccgccaccaccacgctggccaggttgccggtcgccatggcgagctccctcagctccggcccgagctcgcctcctcgcgcagtcaggggtcgcggaggcgcggcgatggttgcgtcgcgtgcttgcttcttctcctctcgtgctcagctcgatcaaacgagatgactacgcagccttccgctgagctgtgcaagtgactccttgactctctctctcttgtcatgtcacatggccgtctgatgcgctttgggttgggaagcttggatccgtcggatcaacggatcgagagatcgcacggctcagatgacctgctccagtcgcttaccaccgggctgctttcttcaagcatgaaccgcgctgatcaactgactggttgtctattaaggtgtgttttagggataggagattgataaaattgggaagatacgtaaaacgaggtaagccattagcgaatgattaattgagtataaactaatataaatttcaaaaatggattaatatgattttttaaaacaactttcctatagaaaaattttgcaaaaaacgcatcgtttagtaatttgggaagcgtgtgctcagaaaacaatgtactttctaactcaatgtatctagaacgaatgcagcctaagtggagtactccctccgtcccaaaataagtgtagttttgcactattcacgttcgacgtttgaccgttcgtcttatttaaaatttttttatgattagtatttttattgctattagatgataaaatatgaatagtattttatgtgtgactaaatatttttcaaatttttcacaaattttttaaataagacggacggtcaaacgttgggcacggatatccacggctgcacttattttgggacggaggtagtagtaatttggttgggtggaagtagtattactgatatgacagcagcgctgagattactgcaaggtaggaagagcaagtttaatagcatagtcgactactaactccaaatcatctataaccaatgtaatagtaaactcatacaataattgcttactatactattaatatgtggttccacatgtcatacacacattacgtcttgaagtctgtgctgcaattggctatagatctatagcccgttgctcttctattccttcttctatcttcttaaaatatatttatagctgtcttatagcctactattgtacctgctctaagagcaagtataatagtagactgtaagtcggctaaatgctgaggtgaagaagagaagagaggagaagcgagctgtaaacttatagctggtttggacacaagaactaaaaaattaaaaaattatgtgagatagacaagtgggtcctgtattaattgtaaatagctaactattatatgtgtgggtaaaaaaaaagctataaactactttataattaataagttggctgtattattatccttgctgtaacagcgttgcacatgaagtgatggtgcagtgattcagtgcaggtggatgtggtttgacccgccattgatccatcggttattcggttgttcctcccggcacgacagggttcacagttgttaaaccccggaaaagtcttcgtcgcattacagcctgctctgaatctccatcttgtaaattacttccttcgtaaaaagaaaaaaaatatattcctagcatctcaaaataaaattagtggatatgtagaagaactaaaatatccttaatcatgaaaaaaattagtaagagtaatatgtataggtaaagaatattatagggataaaacttctcattttacgtgctgagggtaggggtggacaaaaagcttgggctcgtgagctcggctcaggcttggctcgggctcgcatagctcggctcggctcgaaagccaaacgagtcgagcctaagcctccttcctaactcgtttccgaaacgagccaagcccgagctggctcacgagccgctcgtgagctcgcttggctcactgcaatagggtcatatgcaaaaattttgcaccttttctaactatttatttgttaaaaatgataactttaattgtcatattatatatttatgtgttgtgatgacatattaaagaaaaattatcacattattacacattctatgtggtaaaatgttgttcgatttctcttagatttgcttgagatttactcgatgccaggctcgcgagccagctcagcccataaacgagccgagccgagcttcccttgcaccaagctttcacgagctaagccaggctcagctcggctcgtttccacccctagctgaggataggtaggatggtagaagttagtttttgtgggataaaatttaaactctagaaattgagtttttttacgatggagggattaaacgctgttttaaagcgttcgtttctcatgaaaagggtggatgaaattttggatactcgtggcacgcttttcaatatgctaaacggtgcgtttcgtgcgaaaactttttatataaaagttgttctaaaatatatgattaatccatttttcaagtttgtaataattaaaactcaattaattacacgttattaccacctggttttacgtgaaacacttaatttttatcttcatctccatcttcagaagattcaaataccaactgaatttcttgcaaggtcaataaccagacatgattctgacaaggaacggtgtttcggcaggctcgtagcctcctgccagcatgaacggatgaaccgaacttcttgacattggcaatggcaaagcgtgcttcgaggttagagcgtctctcatctggggacgagttttgccttcacacaggcatgcgagagcacagcgcactacagactacagtctgcatatctgcacaaggcttgtagcatctagcagttcatcctttttttttttacgtcttgcgaagttctagagcagaaaaaaattataatgttactaccctggaggatcgtaaccaagaaaaagaaaaaaatataccaccacccacacgacgacatcgccatcacacaaggccaggagaaggctaacaccggaccggctgccgctaagcgtgaccgaccgccactaggccaacaaagggacacagacgaggtcgccacctaggggatgccaaaacgacgtcttcaagaagagaagcgacagagaaaccgccgccgtcatccgtcaggactcaaaagagccaagacagggctttcgcccggcaatcaccctttaggggtgagacagcacgacaacgccctcaggaggggggataaccatcgttgtctgtccgaccaaggccggactgggttttcacccgtcgctcaccacttgcgaatccacgcgtgacgcaccgatgctccaccaccacacaagctttgtcgacatgtgggacccctgcaccggtgtcccccgccggccagtcttcattcgccaaagaccgcaccacacccaccggcagctcctcctcacacctaggtcgcctcctccaccgccggccgcgccactctgcgccaagccggcctcctccaccggacgcgcctcgcgctaatccggtctccctccatcggtcgcgcctcccgcgccaagccggcctctatctctgccgctcgcgcctctcgcgccgagccggcctccactgtcatcggctgcgcttctctgcgccaagccggtctccgacccctccaccaaacgatgccgcgccggccagatgtagtcgtctcccacgccctcagctagccgtttgaggtagccatgcctccagtgactgcagacacggtcgccaccaccgcagccgctgctgcctaacgcccagccacctcgccgtcgccatcctcgcctcgcagccgactccttccccgccgccgacgtcgccaccgcctccacaaacggccgccgtcgtcgctgccaccgacgccagcccccgcatccacaacctgccgctgtgtcgtcgcccttcaccaacatgcggctggccgccgcccgatgccatgtgcaccactgccgccatcaccagccgacaccgcagccgccaactgccgcaaccgccgccgtcatcgccaactgccaccactgccattgccacaccgccgccgtcgtcgccgcacagccgccgcctgtaggatcgagatgtcgactagagggggggtgaataggcgatttaaaactaaatgacacctaatcaaaactaacctaagttgctaggcttggtgagggtcaactctaactaagcaactaagttatgttttgcaaacctaaagtgatagtggctcaattatatctctaggaaaagtaaatcacactcctatgtcaatgtttagcaatcctagggtgatatgatttcaagtatgtctctagaaatgtaaattgcacaaatgtaaatgcgacaatcaaattagacaaggggacaagagatttttcaccgaggttcggaaactcgccggtttcctactccccgttgaggcgagcccaactcgaccactcaaccacgaagccaccgcacgcccccttcatcaaggggtgggcaaggcgggagccgacccacggagaggactacccaagcctcgatcactagggtagttcttcctttactccgaaggtggtgaacaccaaaccactcacaaaccggcgccgggcctcctccacaatcttctcggagaagtcaccgggcaacttctccacaagccgtctaggaggcggcaacctacaagagtaacaagcaatgacccagcgtggagatgatcaatcaagtgccacactagctctacaaatggaagcgatgcacttgactcttggctaatcaaccctctaacacactagatagatgaacacaaagctcaagtgggtgtgagagaggtgcaagggatgtatgcaattgaattgggtgccaagagagtccccttgttgctggtggggaagtatttatactcccacccaccaaaactagccgttgggggcgaaatcccccaactttgtgctctgccggtctgaccggaggtatgtagccggtcagatcgtgctactctgcaacggctagaaaactagccgttgaagtgctgtcagagggctccatcggcctggccggtcagaccagtgttgagtgggcggtcagaccggcctcggctcggtcagaccgccatcggctcggtctgaccgactacggctccgtcggctctgtatcggccaccccgagcagcaccatcccggcctccaggggccggtctgaccgcgcatgtaccgccggtcagaccggccttatgcgccggtcagaccgccttcttgcggccggtcagaccggccaaggcacgccggtcagaccgccattatgtggccggtctgaccgcccctggtcaggccgagcccagtgaaatcccaagtgattgtgtgtgtgtgatgaaaagcgagcacacgtctaaatgcataatgacctaatgtggcaatttaatcatctctttactaggtcattacccctcttaatagtacggcgaaactagaaaataaactagcaaatttgacgccctacacctcgatcaattctaaattaaagcactagttttaccgtcttgtttttctttgctttgcgtcgtcaattttaatccatcgatagtcatccacgcgcacacatgatgtggacctaacttaaaatattatctcaatagcaacggtttgtccacaattagcgcttgtcattaattaccaaaattaacaacgggggcctagatgcttcaccgccaactgccgccggccaccctccaaatccggccgagaggcgcggatctgggggacaccgcgccgccgccgccgggcaccgcgtcatcgccaccacaagcccacacgggaccaccaccaccaccttcgcgcccgctgccggttccgtccccgccaccatcgccatccctgccgccatcagccgccgccgcccggcgccgcacgcccctgccttcgacgtcgccatccccgccgccgtcctccccgccgccagtcgccgccccgccagatccggccagagcggcctggatctggcggtcaccgccatcccgcttggtggctcccctgcccgcccggtgagaggtcggcgaggggccctgccgccgccgtccttgcggccggccggcggccgctcgagcagcagcgaggcagaggggatggggggagggagaggagcggccgggtcgtcacctcctgtgccgcccaaggggaggacgacgcgaggtagtcttctcttctgacgtggaacatagttcatccaaatttgatcctccatatacctatatggatgattatccaaaagagattcctcctttatattcctcctcactccaacaaatcatctatattacatcctctatatcatatccccctatattttattagtatctttcaactaccatatatttatattatttttcttttttcacctttctttttcttctctcttctcccgtcctctcgagctctcttctctttctctcttctccagcgatagagcaacgcgagcggaggggcgaggggcgccacgagcgatcgggggcggagggcggcgcgggcgacggggcggagggcagagggcggcgcgggcggagggcggcaggggcggagggccgcgtggaggagcggcgagcggcgggagcggaggggcggcgtgagcagcagagcgacgggagcggctggatttggccagagataggggcggaacggagttcgccgatgacgacggcatggcgtgcagcggtgcgcatcctctctaacttcgctcctccatgccttgatccggattggggcgggagaaccagatgggtgcggcggttgcaggatggcgttaggagagagaaacttcaaatataccgattctttctccggaatagcgcatgcgccatctttggaggccctgatggcgcatctgatggagccggattttctcctcccatgagctatatttcggatggaagatgggatagaggatctactgggatgctctaaaggcgatagtgcctcatattatctggcttatcttcctcctgtctatttcagatcgagttctgagtccaacaacatctcggcttggttacttcctactacttaattaatcgtgctaatgatagttctcgttttctgcgtcattgaaaatctctgcttacatcatccgccttaaaatgaatttatttttgagaatgaatttaaagaaccgcgtttgtccagaacttttactataagttgttattttgaggaggaagtgcttacctctggtctaaaataaattaaatttttacacatctcatacatatcaataaatatttttactttatcaaatctcaatacaattatctctcactttttctatctgtaatgcatttgtctcttacttctacaaacaacatataaataagaaaataataaaaataatacgaaaggagtacctcacaaacgaacgaagaaccagcctgtctttgttttgcagcacgtacgcgagtacagtaccacgtagcacaccaaaacaagactgctcgtagtacctgtactgtactgtacaccaaaacaggccacgagcagcagcagtgcccccgtaccgctagctaagctgtgtcgccgagccttgagccgctaggcgctagctgcatctgcatccagggtacgagtacagtggacacagctccgctgcacctaggcgcctgcccgtggcacggggtacgtcgttgtactgcacggtgcacgctgctgttcgctcccgtgcggcgcgtttcgccgggacaaggacacagacggctgtcttccgcgcgcgagggcccgtacgtcccggcgcgttacgccgttaattacgctgttatacgacgcatcgatcaagcggcagcagttgcgtgcatccacgcagcatcggttggatccgtggatcgcggctggctcggcgtccgcgggcgagagatcgtgtttgccgccggtgggcgaaaatcttcgtagccttttggatgccgcgagggctgacgtttccgcttgcggatagcgtgcgggttgggggcctggggtctcagctgtcgacacgcctgtttcctgacaccgcgtgacctgtttatgcacagtgaacttttgcgcgtttttgggcatggatcttgatgggttcatggtcggagttcggctcatagtcatggcccccaataagggaagctatagcctagcggcagagctgggcttgagcaaaccgcaaaaaggcgcgtatggcatttcgtcgcgattcccctgcatgcagggcttcgccgtacggccgcaacatgtcgaaggcattccaatttttttctttaaaattttaatttttccgtcacatcgaatatttagacatacgtataaagcatcaaatataaatgaaaaaaaccaattgtataatccgactttaaattgcgagacgaatcttttgagcctaattacaccatgatttgataatgttatcctacagtaaacatttgctaataacggattaattaggcttaatagaatcgtctcgcagtttccagacggaatctataatgtattttattattagtctgtttaatactttaaatacgtgtccatatataaaaaaaattttagcacgtgaactaaacacaaccaaagcatgagaaagcctgcactggggcaggagtgggctgtcgtgccattgactgctggagactaataaattattgaatttgctaaataatctattttttataatagatttatttttcgtcgctcttattagtcacagagtaaatttatttttcatcaatcattacattggagaagtttatgaaaatgagaggtaaatacatttagagtagatagagtagaaaaataatcgtattgtaatttgataaagttgagagcattttaattttcttattgatatgcgttgatagatgagaaatgaaattattttagaaaggaggaaacaacacactagaaagtcagaggatattgttgacccgttgaattcaggttaagatttatatctaggcggtggacacatacagatggggtgatagcaaccgagccacggagtcaaccatgagcagtggatcagtgttgccaacaggagcagacgaagcgactattcgatggtagcttgtggtgtggagtcacacgagatggggaaaacggtaaggcaggtacacccagctaccatgggcgtggggaggatgaggggtgaggggaatgagtccaatttgacggagggggctatgcatgaatcttaaagaggatataccaaaagtcacacgatatggagttcgattggttgtctaggtactctgtaacttaatattgatcttaaatataatagttgacctagattggtagccaaaaatagctactccatccgctccaaaatataaacatttttacacggatatctacaccatttgaacatggtgttatggaccataacatatgattgctcattgtctctatatcttattgaatataaccgctattgctcgttccagcatttgtccataaagacatgtaacttacagtaaattcttttaagggtttatttaataggcgtcattataaatatgcatattcagataaatgtcaatataattcgtctattcgaagtcatgccatacaaattttacaaaattaaaaccatgccatcaccgtcatgtttttcatcttcttccccatctgtgtgtgggactcactcgtcagattcatctttttcctctatcctcctctcttctattttccccatctctatccacctcttatcagctttctccacacattgcatcgagagcaagagcaagggcaaggatgtatcgagatcgatttgacctccaccccttctcccccctctgctcctcctagatggcgacgtcttttccaaatccctcacctttatttcctccttgcctcctcctcattcgccctctctcccgagtctaaaccctaaccctagcgcagccacttcccatggccaccgagtaccgcacacccgaccgcctcctatccgccgttgcccagcgaggagcatgcgtaaaatccgcccaagctggtgcttgttgttgccgcgacccatgacggcatccgattctagtattacatgcttgccggcgttatcgagcacacaacgatgttccccgtcgacaccctcaagatgaacatgcaggtcggtgccccaccctgttactcggtcctgtcattggaggccgccttgtctggctaagtagtggacacatgttagccaacatgaacaatagatgacaatatggatgacgccgtgtgcattggtttgagtccaagcatggaaggtggtgtgatgtgaaagttaatttgtcatccctcggtgcaaagcgaaggtatatatgaaaccgggtgtaaagggaaaacaaaataaatctacccgatgttaagtgcaatttactctttatttatttttacttatttgattatgctgtaaccgagttggatggcaaaccacgtatggtgtgatagatttacttccaccattatcctcctttttatctcctacatatgtgtttacagttcgcttatagtatgctgttgtatatgctctcactgcaaactataattaattaacctgaaaaatataacaaaggtcctttcagattgctgccgagtctaagggctcattcggaatgtaggattgaaaaaaatataggaataggaaaaatataggaataggataggaatgcaagtgtaaaacagatgatttgaaaacataggaatttcatgtgaataggtgtggatggagtaaaggaaaaacataggaatctttagaagaaaataggtgcactattacaaaattatcacatactactagtgaattaaacaacattaatcaacctaataatgtgctttagttgcttgatggcatgatttgcctcgttcccacgcgaagggagagaaaaaagaggtcagcatggatgtttttcttcctatgatcttccagtgatatggctagcgtaggaaatttctctatgtatttcctacgaacattttcatgtgatccaaatgacgccacagtaaagcaatccataggaacccaaatccttcatttttcctgtgtttctcctctattctgaacaagccctaaagaaattcaaggaggcacctgaacgccggccaattagtgccagcgcaaacagccgatcgctgagaaaatgtgaataaggcaaagcgcgaactctggaaagcgctcgagagaggtcggccggcgacccaacaacacaccaccaccggcctcgcgcccgcggcgcacacaagatcgccacagcgccgtggtcggaacagcgaatccggccgcctgcaggcacaggcggcagtgccacctccccacccccccaatccgctgcgtttccctctggcctcgtcccttcccaacaaacaaacccgccaccacacggcgcccagcgcccgtgctctcctctcctctcctctacccgcccagcccagccgcccatcccccctcctttccgcggtccttttgctcggttcagcacgcacgcgggcacgcggcacgccatcaccgcgcggccggccgcctgctgctgctacagccagtggagtactgttctgggccgcccgcgccgcccgaagccaccaccctttccttttccggaagcctccccaatcctccgccattccccgcatagcgccccatgcccctaccgaccatagcctcccaatcccccatcgcctagctgcttccccgtttattttaagatttttctttgggttgtgagtaaggcttggtggggcccagctcacggttccttctggcataaacaatgacttgggcctgcccgccccgtggcctcgccatccgacactgtgcctctcatcccgcgattagtatatttttgctgtttttttatgggtgaaaaactgtgtgggctctctcgttgggttgctatccgtccacccgtccattcatcctcgcctttgccagttgcggtgttgcccccctcgctttatttatgtcgacctgccaataggagcaagtccccgtctcgagacaccagccgcgccgcgcctcgcctcgcctcgcctcacctcacctcacctcaccctccgcctcgtctccttcccccctttcctctacccacgcacgccctctctcccatcccagccgtagccgcgccgtgacttgtctcgatcggcggcgaggaggagggcttccgttccctggccggtgggggaggatcaggcgggggggcggcggggagggggaggagatcggtctcggtcgatccgcgcgcggcggcgatggcgcgggagaggcgggagataaagaggatagagagcgcggcggcgcggcaggtcaccttctccaagcgccggcgcggcctgttcaagaaggccgaggagctctccgtgctctgcgacgccgacgtcgcgctcatcgtcttctcctccacggggaagctatcccacttcgcaagctccaggtatgctgttctactcccacgcctggatatctctcgactccgcttcgtctcccgcgtttcgatagatctagctaggcgcgtttcctcccccggtctccctttgacttcgatgtctaagatccatccgcctgggctagggtttaacacgggatattttaactagtaacacggatctcaccatttccacccgttcagaaaaatcaatacagttttagaacgactcgtggttactttcgccccctttagatgtagggg

SEQ ID NO: 80644 - DNA, 79625 bp, Oryza sativa
  unsure (1)..(79625): unsure at all n locations
ggtgggccccacccgtcagcgagggggacgggcggcccagcccgtcagcggcgcgcgcgcagggagaggccggatgggccgcggggagaggagagggagggggagggagatgggccgagccggcccaagagggagtgggagggaaaagggactttttagagcttttctttttataaaaacattttaactttgtttatttcttaatgattattatttgtgctctgaaaattccactaaaatttatttacgcattttagacttttaggaaatatacaaaaattctccaagccttatttgacttttaactttgcacattttaattgttggaggctttcacacggattttaattattctaggcataatttagaggttgtattttagggtcgttttgggacgtgacatgaagtttattagagtaaaagcctttttccttcccgttggtcgtgtagacgctgcagcttcgttagatccgctcttcgtggaggttgaagccgacgtttgggaaagcgagcaaggcaagtcacatcatccttgaacatattgaatcccagtttatgaaattattttgatttaaattaatgcattatcactttatttaaattctcgcgttatcactgttttatttagccatgcctatttacctttgttatgaccttattattattgttattgttattattaccttgttcaccctagaataaacaaaactccaactagtgggtactctatttatggttccactagtatgaacttaggtagatgcttcgctggttaattatgcaacattaggtggttttacaactctaaactttgggaatgttcttatcacctggacactatggaatggttggattattgtggaattggattcacacctccccctctattcaaaatcctcaaaatggttttaggctgggctcggggtgcatggttttgatagtagcacctcggccacataaggaccggtcttcgggcctctgttgcaaagcactactgtacttccacatgtctagtgggtaaggtttagtttgtggcttagtctggttataaacaaaagtacacggatggagatggacgaagttgggggtcgatggacatctctagggcaaatgaaggctacacgagctgcagcctggtagtcgagatgtcatggcatagggctggtgtcctgctgctaggggctcagtcctgcctacttgtcccggaggttccggtcgtaggtggggttgggtcggtactcttgtctatggctaggatgggttggaaactatgtcacgtcttccgtccgtatgccgtggtggtatgtggcacgtggttacacgtgaggaagatgtgtcttgtgggtaaagatgtacacctctgatcagagtataatctattcgaatagccgcgccctcggttatgggcaagcctagcaatgtacccaagttagtgttttaattcttaaaacatgcttaacaactaaaatgtggaatggttggcctgggttggcttgggacgagctgggacccagggtcgggttgccagttcggtccaaatcatcgtaggccttgggttaaggcaggttcgtgtgggttcacggccttgattaataatcttgtatagctctaggagcatatttacaaaatagctttcagcaactaagtgtcttttaatgctgtttactgcaaaccctaaccccctatattataactcccttgtactcccatgcatttattctgcacttgtgggtgtgtcttgttgagtacggtggttgtacttagtcttgctcattttttcccaaacccagaaaaggagttcctggatgatgaaggctttggtttctagctcgtgcctgccgtcaagcgcctgtggtcgtcgccctagtcttccgctgtttttcgtttgtcttcttgtgtgctgggccttcgccgcccatgtaataaattatctatttacgcttccgcttgttaaactctgaattgtatcaacttttggtgtaccttggctcctgggacaaggaataatacacgcacgtaaggaacgcccgttgggttatttccggtcgtgacatgccacgtttctgccgcctcaacctattgttgatccaatacagcagcagccgattcagcagacacccccaattcagcaggttgtgcagccaatccagcaacaggtcatgcaaccagttcagcaaacaccaccaaggcagcagcctctgcagccgattcagcagacgccgttaagacagcaaatcgttcagccggtccagcaccaaggttcaataggtgcatcggccgggtttgcaacgcctggtggtcagcctgtacaacaatttttaaatcaagttgtcccagaacacttggttcaccacgtacagccggatggcacagtaatacctcaagttgttcctgagcatttggtacgtaatatccagccgaaccttcataattaccaagggggtaacttgaattaccaatatcagccttcttccccgcaagcccaatatcagctagggggattggctcaacctcagtttgcgcctcaatatggtcagttcgagcccatgcagcaacagtcacaaggggtagctcagcagcgaccatgggccgatgtgattgctgacgtaatgagggaacagtttgggcttaaaccaaaagagactggaagcttgtatcggcagccttaccctgagtggtttgaaagagttcctcttcccaatcggttcaaagttccggacttctccaaattttcgagacaagatggtgtgtcaacttatgagtacattagccgattcttagctcagtgtggtgaagcatcggctgtggacgctctgaaggttaggttatttcggttatctttgtctggatcggcttttacttggttttcctctttgccgtattggtcgatcaatagctgggccgatttggagaatcaattccacagctatttctacagtggggttcatgagatgaaattatccgacttgacagcgattaagcagcggcatgatgaacctgtgcacgagtatattcagagattcagggagatgaggaacaaatgctttagtttgagtttaactgatgcccagttagccgatctggctttttaggatatgattgctccgattagggagaaattctcgtatgaagactttgatagcttgtcacatctgatacagaaagtaaccttgcatgagcataggtctgcggaagttaggaaaaactctaagaaggttaatcatgtttgtccgtacatgtatgggtcggatgatgacgaggacgattctgaaatagctgcagccaagtgggtgaggagtaaaaaggtcataccatgccaatgggtaaaaagttctggaaaagaggagaagtatgattttgatattactaaagttgacaagatctttgatctgctactccgagaaaagcaaattcaacttcctgctggtcatacaatcccatcggctgaggaattaggcaaaaagaggtattgcaaatggcataattctgggtcccattctactaacaattgcaaggtttttagacagcagattcaggtggccattgagggaggcaagattaggtttgatgattccagaaagccgatgaaggtcgatggtaatccttttcctgttaatatggtgcatacaactggccaaacagccgatagggcccgtgcaaggggttttcgggtgaattaggctaagattatcaacaaatatcagaagaagtatgacaagcagcaggagaagtatcatgagaaatacgatgatagttttgatcctcattggggttgtgagttcttttgattctgctggaatgaaggtatgaggttgccatctattgaaaactgccatgggtgtagtgatatcgtcgagaactcaagccgatcatataataggggcaatcggctaaggcagataagagtttatgttcatcaaagattgggtccagtaaatcaagatcatggccaaaaggacaatgtaatcaggaagaatcaatggtgtccttctggtattttcacaaagaatcagaagagaagggttcaacgattgaggaacagggagcgccttcaggaggttgaacaagaaattaatcatcggctgaagaaagcaaagccaaggcaggagtggcgtgttaagaatcaggttcctgcagctgatgatgttgcagctgatgaggcaaaatggttggcaaaagggaaaagtgttgtgacggcaccggttaacatggtatttaccctgccagccgaattcgggatcgaccaagccgatgttgacgaggtggaagaggaatcggctaagttggttctgtcaccagaacaggcagtgttcgagaaacccgaggggacagagaatcggcattttaaaccattgtatataaacggctacgtcaatgggaagccgatgtctaaaatgatggttgatcgtggggctgcggtaaatttgacgccctatgctacgttcaggaagttgggtagaaatgccgaggatctcatcaagacaaacatggtgctcaaagattttggtggcaatccatcagaaaccaaatgtgttctaaatgtggagctgacagtcggcagtaagactattcctaccacgttttttgtcatcgatgggaaaggttcttacagcttgttgcttggaagggattggattcacgccaattgttgcattccttcaactatgcatcaatgtttgattcagtggcaaggcgacaaaatagagatcgtgccagccgacaggtcagttaatgttgccagtgccgatttagctctttgggagatggatggccttgattgtttatctgaaaaagtctgggatggagattttctaaaagtgttcgattttgatatacaaccaattgaagatggagaacccaagctattattttgagggcgtcgtggagggttcaagtgtttacactacggacacggtagatgatctcgatgacaagcaaggtcaaggtttcatgtcggccaatgatttggaagaagtggacataggtctaggcgatcggccaaggccgacatttattagtaggaacttatctccaaagtttagaaccaagctaatagagctcttaaaagagtttagagattgcttcgcttgggagtattacgagatgcctggactcagctgatcgattgttgaacatcggctacctatcaaaccaggggttaggccatatcaacaacctccgaggagatgcaaggccgacatgcttgaaccggtcaaggctgagattaaaagattatatgatgctggttttattcgtccttgctgatatgctgagtgggtttctagtattagttcctgttatcaagaaaaacagcaaggtcagggtatgcattgatttccgaaatttgaataaggccagaaaatatggtctgaggatgaatccgacaaaatgtgcttttggtgtatcggctggccagtttttgggatttcttgttcatgagagggggatcgaggtaactcaaaggagtgttaatgcgatcaagaagattcagcctccagagaataagacagaattacaagagatgatccgcaagataaattttgttagaaagtttatttctaatttgtctggaaggatagaaccttttacaccattgttgagattgaaagccggtcagcagtttacttggggggcagagcagcaaaaggctttggacaatattaagaaatatcttagctctcctcctgttttgattcctccacagaaaggaataccgtctaggttatatttatcggccggtgagaagtcaatcggctcggtcttgattcaggagttggaagggaaggaacgagttgtattctatctcagtcgtcggctcttggatgctgaaactagatattcccctgtggagaagttatgcttgtgtttgtatttttcgagtacaaggttgaggcattatctactgtccaacgagtgtactgttgtatgcaaggccgatgttgtcaagtacatgctatcggctccaatattgaaaggaagggttggaaattggatattttccttaaccgagtttgatcttcggtatgagtcgccgaaggcgattaagggacaagctatagctgattttattgtggaacatcatgatgattcaatcggctcggttgaaatagtgccatggactttattctttgatggatcggtgtgtactcacggttgtggtatcggcctagttataattttccctaggggggcatgtttcgagtttgcttatactattaaaccgtatgcgactaataatcaagctgagtatgaggcagtgctcaaagggttgcaattactcaaggaagttgaaaccaatgccattgaaatcatgggggattctttgctagtaatcagtcaattggcaggagagtatgaatgcaagaatgatacgttgatggtttataatgagaagtgtcaagacctaatgaaggagtttcgactggttactttaaagcatgtctctcgagaacaaaatattgaagctaatgatttggcccaaggggcatcgggatataagccgatgatcaaagatgttaaggttgaaattgcagcaatgacagccgatgattggaggtatgatgtgcatcagtatttgcataatccgtctcaatcggcttctaagaaattgcgatataaggcattgaagtatactctgttggatgatgagctttattaccggacgattgatggagtgttacttaagtgtttgggtgccgatcaggctaaagttgcaaccggcgaagttcatgaaggaatttgtggtactcatcaatcggctcataagatgaagtggttacttcggcgtgcagggtatttttggctgacaatgctggaggattgtttcagatattatagggggtgtcaagattgtcagaaatttggggcaattcagcgagatccggcatcggctatgaatcctattattaagccatggccattccgaggttggggaattgatatgatcggtatgataaacccaccatcgagtaaatgacataagtttatattggtggcaactgattatttcaccaagtgggtggaggcgattcctttgaagaaagttgattctggggatgcaattcaattcgttcaagaacatataatctaccgatttggtattcctcaaactattataactgatcaggggtcaatcttcgtgtctgacgagtttgttcagtttgccgatagcatgggtatcaaattattgaattcttcaccttattatgcacaagctaatgggcaagccgaggcgtctaataaaagtttgatcaaattgattaagcggaaaatttctgattatcctcgacaatggcatactaggttggccgaagcattgtggtcttataggatggcttgtcatggatcgatccaagtccctccttacaaacttgtttatgggcatgaggctgttttgccatgggaggttagaattggctctcgaagaatggaattacaaaacgatttaacagctgatgagtattacaaccttatggccgatgagagggaggatctggttcagacacgattgcgagcccttgcaaaggttaccaaggataaggaacgtattgcttggcattataataagaaagtggtacctaaggatttttcggaaggagaacttgtctggaaattgattttgccgattggtactcgtgatagtaaattcggcaagtggtcgccgaattgggaaggaccgttccaaatttataaggttgtgtccaagggagcatatatgttgcaagggcttgatagtgaagtctatgggcgagcactcaatggcaagtatttgaagaaatattacccaagtgtttgggttaacgcatgatcggctagtattgccgatgcatgacagccgatgtgtttgcatcgccttgagatggccgatattgttatatcgcccttagttgtttttcatgatataatcggttgtgatttgccgatgtacaatggccgatattgttatatcgcccttagttgttttataattttatcaatgcttttgtcattgtaaaattaggggggcacatatatatcaaaatgcaatgcaaattttttgaggcaaatttttttagcgaattttaaaagtcatattaatcggcacaaaggattgttaagacagtaaagtactagagcatcttagctgattacaaaaaatttctgagtcctattacacaaagttattgagacaagtatcgctggatagccaaaatagccctttgcctgatttgttctacttcttcaatagcttgggcatcttgagcatcagttccagagatgactttcagagacttggttaagtcagcaacattcttgatagccgatttgagccttgctttttgttcttcaattgattttgggagatcggctagctttttgtgttctatatctagctcggcattgcattcctcaagttgcgccaagagctcaattttgcgagcttcgagccggtcaatattggatttgatcagaccttcagatagctgatcaagtttggttttttcttcatgcacaagctgccgattagtttggattgtggccttaatctctttgcgatcacggcgttcggctagtcttagcttggctttttccagcttgaactgatgttgctcgagataagcggctagagttaggacatcggccagatcttcgggaatcagagcttgaacttcatacagccgtgtcctaattgacccacggtcaactaccaaactgtctaaagaagaggctgctagccgatgagagatgtcttcaagtgtttttctcacatcatcggataggggagctagggctttgcttgaagtgtcttcttctgcttcatcaaggtaatctctgatgtcaaaagagaagagatcggctagagcctgcagagacaatttcggaaagaataagagctgggtaaattatagctgatctaattgttgagacaaagggaaacttactgggatagcaggagcagctggttgttcttcctcttcgatgtgatgactccccacagccgatggagtctgatcacttgacgattgctgtataggaggagaagtaggaggaggctacgaaatagacaagtgttatatataatcagttgagattgattaagtaaaagaattaaggacatcttactggtggagccgatttaacaattgctgctgttttttttcttcacagcagttttcttcttctgcaaccacaaagtctatgggtaattagccgaagagtgaggtaatttcagaagaagtcagagagaggtacttactcttgtaaaatgaacgggggcgtaaggagttggaggcgtttgcttgggtgaagccgatggtgttctttctgtgtcactcatttcggctacagcttgatcaacatcttcaccaatttcctcgtcatctaaagcttgttcaatagatggatccaaggcgggcagatcatcagtcgacatatcagttggttgtggttgagttttcttgaatttggtctttttctttggagccaaggctaaggtactcatggctgatgatctggttttccttttcttgcctgcatcggctggttctctagttaggccgtgaaggagagttgaagtcttgggggcatggtagccgatgaaagggggagatagtccacctccattcggaattagacctgaagcatattcaatgttcttgccactgttactttgatgaggaggggaggactctgttgtctgcaaaacaggagcaagaggtcagtcaagtaatgaatcggctaactggttatgcaatttagtaatgacaaagtttacctagggcatgacgtcggggaatagatctgtcatatacattgaagcggattgatgaaatagatgcagcttccattcgccccaccatctgtcaaagtttttgcttctaaatcttgccaactcaatattatcaatactgcccagagagggtcctggtaggttaaatagccgatccatcattagagtggaagtgatttgtcctcggcactgaatcttgtcggcaaagaataagccgattgggagttggcccaatccaagttgtctggccgagctcattgggtgataaaactcgtaggagacttggatgtttcttccttggtgaatgccgatagggaggatgcatgggctgattgcagctataagaatttctctggatttttggatttttttcatggttaatgtcttcaaatctaaagtctgatggaagttcaaggtctgctgagtcttcgtagggaaaccagattcgtgcatctttcttaaaaccttcgtagaaactgcagaaccagtccttgagtaactcagccgatagcttcgctccagcatcggttggtgtggatgcatattctccatatgacatgcatctgcgatgggtacgctcttctccgtcatcttccacaatcggctctggcaatgggaattcagcttctgtcacagagggccgattgacaaccttcatgactaccaggtttaaccaagtttgcagcagccaccatggtccacctgctccaactattgagccgacggctattttagccgatgcattgttcaacatctggtacagatagccgagaaggattttgcccaaaggaaattctttctttgattctaaggcttcagttacgaattgccagttggttgtagggccacaactggatccatagaagaggaatttttccagccacataagcaagaaagctacatgctctcgaggggtaacagacccttggcccatatatgccgccacatagccagaccagtcacctatgcttttggtcttgaagtcgaattggttcttggtgttcatgctcatagggttagccgatgaagttacatctaatccagtaatcatggtgatgtcgattaaagttggagtcatcggcccttggttgaataagaaagcattgatggtgttggaccagaagtaggtggcggcagccatcagaggttcatccttagcagaattggctatggtgagagtgagtgcttggccgattccaatttcatcccagtgaactttcttactagccgatacgcgttggtaccaggtggtccagctcttatcaggagtaggtttttcgagagatggccaagacttgaaggtattcttccagtgacccaggttagggttggctagtctaaaggggatccggttagtttcaccgatgatgaaatcagtggggtcgagattcgagattgccgattgggccaagaaaatagtagtttttgtgtgaaaggctgggaatcgtgactaggttggaaaggtgctgcaaatccaaaggaattgagaagcagaaaacgtgaggagaaaaggagaagtcgatttcatgcgaggaaaagggatctagctggtgaggacttacctcagcgtactcgaccgatggcgcgatagaagggctggtggaagacgacatcgccgcgggcggagatttggtcgggaacgaaatcgcctggggatcgccttgtgcgtcagggagatcgccggagagagagagagagggcaaagttggttttagtggcgaaaacggaggaggacggtgtgagatttctcgagggtaatggttagtatttaaagcatggcagtaacggtcggaaaacggcaaagtgcgaaacttgctcggagtcgatttacagcaaatccgaaatattatcaaatattctggacttggggggcatgtgttaacaaccaaatttggtaatatcggcattaggaaagaagattagatcgaagcaaagtcggaggcggagatcgagttcggaaacagagcaggaatcggctagagtccagatcggctacgattagaatcggctgggtctgagtcgggctaggtaagccgatgcagccgattctgacaatgcaactcgatgtatgacatcaggttgaattgaggtgcttcaaggtgattgccgcacatggatagagtcctaagaaggcaattgtatctattaattaggatgttttatgtaatttccttagagatattcttgggcaaaagtccgccgcaaagacttatggtatcttggagtttgttagagatagttgtcgtgtctgttatggacatatcttgtaatttttgggtataaatagacccgagccctatgtaacttttaacacacacgttcaatacaatctcgacgcatcgccaccttttttgctttagttttatttcaacgagttcttgctttcgggttgagctgcatcggtttcgatcttcaataagaggtaaaacttgttatggtggcttgcgttctcgggattagtgcttccatctttatgacactctaatcttgtttatgtaattcgtcgagttatcatatatcctacataatccttggcaatatcgatattcaacctacaatcggctaacatccgtcaatagaaggcagccgattaggttaaataccgatgttgacttagattatataggatatctaccactctatggcacatccaatggcttgattgtctagatacggcttgacttaagtttgaccttataagtcgtgattagaatctcaatctctagcccgcttcttggttgctgattagggtagtatcggagtttcagccgatcttacctaatttaactgctttttatcctatatgcttgattgacatgttaaatctgtcctttacgttaagatcttgctgcatttaaatatattaggcttgtgtttagtatattctacttgctttaatatcttaatatagagtagtatcggagtattagccgatacatgctagatctatctgatcggctatgctatgaacgtatatagtctcattattaatatatatttcgatctaagtgatttatactgtctcggcatagcgaccgatctatcccaatcacttgatttaagtacgtattgatataaagattatatattggtaatatctgcagccgatcgagtagattcagtcctttcttatttattaatgactgccgatcgatgcatatacgacatcggctgaaagataaatgatatgtcatcggcacctagccgatcggctatcatttatagatttaactgcggtttctttgcttctatttcttgttgattacaggatcaaatcaactggcacgctcatacattcgaaggtgagctttggacctgcactggagttaagcagatctccaaggcctcgtgttttctgtcaacaagattataataatctagcataataatctatttgtttgtttcagcttactcctaataattcagattataataatcctaagctgaatcaagcggggtcttagtttgttgaaaaaccacccattacgtatatgcttaactgaatcaacatgtattttaaagtgtcagcgttaatgtggtctttaccaaaattaaatacctatagtcttgatacttttttgggtaagattccacaaacaaaattactgacaagagcttaaacgttctctcattgagttttgctatatgcacaaaaaaaagttcaattaaatatgaaaataagtctaatgtaagcacttggataaggttgaataggcttagcttagcctgtggtaactctacatcagtgctaacaggttaattcagttaagcacgtacgtagtgagatggttttgcaacaaaattaagtaggggtagatatttgcataaaatgatttattatgggggtagaatgtcatatgagatgattttggaatttttctctattatattttagagcggagggacatgagatttaattaaacacatccactataaaactcataggcaacaatgagatttaattaaacacatccactaaacacatccactatcaaaagcaaaacacccaccttgtgacacaaacccaggggctactgtaaaccgatggagtagaaggcacaaccgcacaaggcagcagctgaaaattgggggaggaagaagaacaccaggaagggaaagcattacttcatcattaacccactcgcccaagcataaatccgccctccagttcatatgcccctcttgccgaacatgaccgttgggcgctgtccccttccagatcccagatatactaccacccctctctccccccgcatcgcccccacgattcgtcgcgttcgcgtgctgccaaatcctcctccccctcctccgtccccacaacattctgtcgcgccgattcgaccgttgccgcctcgcccgctccgcgcacgcgcgcacgccgctcccgttcccctcgcgcacgcgcgggccatggcgatcgacctggcgccgctggctggggagttggaggtcgcgggggcggcggttggagggaagaaagaggagggggagggggaggagggcggggtgtgcggcggggaggccgtggtggtggccgcggcggacgcggaggtggagggccacccctacgacttccacgtgtccgggccgcggaacctgccgccgcccaactggagggagatcatccgttcgagctggttggtttccggttactctctccatgtttccttgcgaaatcttagttaattagtttgatatatgcattttggcgttatggagatatcagatatggtcgtcatgggcgtgaatctgtggggatcgtttacgccgcgggcacccttggtttgttgcctcttctgattgatcggaaaagggactatgttttagggaggggattgccgtccggttgcacccggctcccaggattggaaggggagggaatatgctagatgaaaggcgatagctttgttggattgtaaacaaggaaccgaatttactgctattttcaggattttgttgcaatctgcactggcgcaagggtatagcatgcattaagattaaaatctccaatcgatcacctcacaaatgtctgcacaacatttaaactttttttcaatgtcttttctgatgatcctgcgattcggcgtgtcagctttgtgtttagttggttagtgttgcgcttgcgcgcctacaagtaataacctacaagtcaggttacagactaccatacccagagttttgcccttccttccatacactgtttcgtgaggcatgggtatggaaatgcacctaccttttcttacggattgagtattcttcttaaacaagaaagtgaagtagcagataatcagtgattgaaaccaaggtcctgtgggtggtactttcctatgggatatgtatggacttacttttgttgaagaggtgcctttctaattctcgccccttgtttttatgaccttcaataataatcaattatacagttctacactctattgctctagtttttaggctataccatttcaattggacggtacaaactctactggttgaactagagttatcactacagttcccttgcttcgtgctatagtacttggacgtagtctctaaagcatgggcgggaatgggtcacagaattggtattccgaaaaagaaatattcacagaattgcacgtttcgttctgaacattataagtgcttaggatgtcaggtcttagtaaattccaatctgtggcaagcatacaccagtattcctattaataacgtaatttcataagcggatgaaagcttttcacgacttttggtgaaaatggaacatgcaaatctgataattttagcggacaggaggtgcattaccataccaaaaaaaaaagaaataataataatatgagctatttggtttcttttgtcaaagtttgtcagttagttatgacatcaaatatatttcgatttgacctcatacatacaagaacttctggtaatgcagtatatgctttgtatgcgtaaccaggtttacttcagtgtatcacacttgttaatttgtatctgctacctttagttctaatgccatcaatgttgctttaaattgattgcaggaaggatcccaattacaaaaggatggtaatggcctgcttcattcaagcagtctacctgcttgaactggacaggcaagatgagaaaggagaagaggatggccttgctccaaaatggtggaagcccttcaaatacaaggtcacacagacattggtcgatgagagagatggttccatctatggtgccgtccttgagtgggatcgttcttctgctttgtctgaccttatcctcataagaccaagtggcgcgccaagggctgtgttagctctccgaggaacactgcttcagaagcccaccatcaagagagacctacaagatgatcttcgcttcctggtgtgggagagcttaaaaggatcagtcagatatattggcgctttagaagcactgaagacagcagttgagaggtttggtagcgctaatgtcagtgttgctgggcactccttgggagctggatttgctcttcaggtttgcaaagagctcgctaagcaaggagtcttcgtggagtgtcatctgttcaatccaccttctgtttcacttgccatgggtgtaaggagtatgagtgagaaggccagctacctgtggaaaaaagttaaggctagtctaccactgactgaagaagcattacctgacagtaccaaagaggagggaagtgcaaagaagaaattgcgtgctgacaagaaatgggtgccacatttatatgtaaacaacagtgactacatctgctgtcactacaatgcccctaattgctccaccaccaccaccactaccaccactgatggtgcttcagatgagcagcagcagcaacgaaaggcaagtgagatcgctggtgatgtggtcgcgaagctttttgtgacatcgaaaggcccacagaagtttcttgaagcgcatgggctggagcaatggtggtcggatggcatggagctgcagctagcagtgtatgacagcaagcttatatacaggcagttgaagtccctctacacagcaactgcaccgtcaccccctgcaaagtagtagaaactgctgagatcgctgtttcaactggcgttagaaatactctttctaatcagtttctgcctctattaacttgatatgtttcatcatggttgtgactgtgaactattatacagtaaaatataataaacggacatgtgctgataaatacattgatatttttcatgttccatcttctgtcagaggttttcaagactctaaattgttacaagggatataagggatactagtatgtctggataccgattagcatccatgtttatgattatgatcttttgatggtgcacttggctgatgttcgtagggtgcaactgtgaagcttttccagaatgaatgtagcatggcaaattagcatccatgtcatgatctttcgatggttcgcttagctgatgttcgttgggtgcagctctgaagctttttccagaatgaaatgtagcatggcagatgatgaagaaggccaccaaaattgtagggagtggttctgaagcttttccatttccatcatgacaaaataatgaaaacgccaccggaatctcgaccaaaagaacgattaaggcttatatcgagggttaaaatggttaatattgaaataacaaaacgactccgctggggatcgaacccagaatctctggttccgtagaccagcgccttatccattgggccacggagtcgtagttgaagatgcagagaaaaataaatattcatcttatacttagtaatgccttgaaagagacaaacaaaaccaagataaaaaaaaatgggaggaaatgtggaaattcgaaggctaagaagaagtaattaagaacgatcgtccaagctctacgtagggccaaatctccgaacactgtagcggccgcgcccttttaagctcagtacggtacgggaacagcccaaaatagttttgggcctatctcttctgtacgctggagacgagcctctagtaagctggtcgatttgctgtacagtttctcttcgccatcgtcgctagattgtagtacttctgatgacatctactgatgcacattttggtaacggtccagcagtgcagtcgtcggtgagcatccattattcaggttcagcggatgcatcctctgacggcgaccagctctttatattgaggtgacagtgaagaggtcactttggaccacaaaaatttacagcctcctccttgacaacgcattgttgagcagtgcctatgccttgagttgagcgatcgagtgacctcaattatatggaagcatgttgtttgcttcccattgatgattcatgcgtccccgcagactgcagaaaccacatgacagactgacaatggcgacggaatgctagctctctcgtatgcactctctatcagtatgcagtagtagggaatcagggataccccgatgctaataaataacttttacagtggtcgctactggtagtagaaaacaattgatcaagactactacaatattttaccgcgagaccgatttctatgtgagttcagttctaataaatccgatccgtctcattgtggccttctttcctttgtcagaaactcagaaggtgattctgatttctgacgctgcagatggtaattaggaggtgacaaaattcagtgagcttcgcatgcgcagcagaaacctgcaggctgcagctagcacccaagggaagctgctgccttttctggcaacggggccttgtgtttgtgttgttgtgcatagcatagactttgctttgcttttggtatggagcccaatctttggtacatgtgtacgtaccgaatggccttgctcttgcaggaagcaatgttcctgtctcgtggacaaagctaaatagctaatgcaggctgtactggtcattaactatacacaaacccaatgatccagaacgctttatttggcaattgagttgtaataagggactaatagctgataagaaatgcagcagcgtaccgtggtttagtctaaaagataatggcctggaatgcaggatcatgactactgattaagctgctcctactaatggtcagtgtcctccttcctcttttgcctctcattttgttcgtcgatagtacatcattgcacgatctctttccctgagtaaagctgatctctttcccttcttttctggctatcattatttgtatggcaaatgctaacacttaacgccttgttgatctgaataacaataatgaaatctctacctgtcattcataattattcatccatgaaccgagaacagtcaaattcgtctatcttacaatccaattccaatcgcaaatggagtatttttttttcacaagataataggcatagggagaacaagtggcttatttaagctcagatcgagacctatcaaaagacgagaagaatcacattggtgccacgcagataaatcacaacatgaaaaatgtgaatcatgcaaattcggctaaattccacttatgttatctccttgctatgtacagattacaaaattacgtaccgactattggtcaagtcactgctgcaacaaccaatatcatcgacaatggatgcaagaaagaagagaacaaaaataaaagagagagaaaagggaaaaaaagaaaaagaaggtgaagaaaaaggaatgcacatcgctcagcattcagcaaccacaagacccggtcgagatcaaacaggcattgaaggcgatcgagtcagcggccggccggctcatgggcggcggcattggcggcgccggcggcgggcgcgggcgcgagcgcggcgtagtgcgcggcggggcggcggccgtcgtcgaagttcttggcgtagctggcggcgtcgtagccgaacgtgatgggcctggaggaggcggcgcccgacggggacgacgagctgcagatgcacctcgtctcctgcgccaggcgccggagcagccgccgccacgcgcggtggccgcaccaccccgcggcggggctgacgtcgcgcaccacgagctgcaggctccggaccacggcggagccgcgccgcctgcccgtgccgccggcgccggacagagaaggccacgaggacggcaggcagcccgatgagccgccggagacgacgttggcggcggggtggcgcgccgcggttagctctgtggtggttgtggtggtggtgcccgctcccatggtggtttggagaggcgcgcaggaaggaagaagtgggagagagctctctcgtggcggttatacctgtggttatatgggaagcgagacgaataatagcagtattaggctgttagcatgtcgagatgagaaaacaatggtggttattgggctgcggagtagacaagtggtagagtgagatgagctcatgggtttttgtggtggttacttttggagatggaatggacatgcatgggagcttgtgctatttttagacacaagaggatgagtgatccttgtgcagttgtggaatgagtagttagtggattataatttaattactgttagtatcttatattcgagggaatatgttaggaaaaatgttagtgatggatagtagcgaatgtgattttcaaggtgcatcttgtacttttttaaaaaaaaaatgtttgagccactgtaaatgtattactatctccgtttttaatagatgactccgttgattttttctcacatgttacatgtttgaccattcgtcttattcaaaaaatttacgtaattataatttattttgttatgagttattttatcactcatagtactttaagtgtgatttatatcttatacatttgcaaaaaaaattaaataagacgaatggttaaacatgtgagaaaaggtcaacggcgtcatctattaaaaaaaacggaggtagtatgagccagcatatttcctaaacagggtacctaactaaaattgcatttcaaagattctaaggacgtcaagccgtcttgttgaccataagaaacatttcaccagcacaatttttatgtgcagcttgattaggaccgtcgtccaatctacactagacattgtatgcaattattccttcagatttgtttataacgatcatgtagtggtcctctaatccaaaacgagatagtggttggttgtacccagttacccacaccacgagagatcatccagaaactgtgttctgaagccacgcatactaatcttttgagcaaatcacaccctatctcatgaaatttgatccatctgcaaaagaatatgatattatgattacctaaacagttagcctacactattcttctttgtttagattatcccggtatcccatctctaatccatttttgggccaacctccaagatcaaaagagttttaagtgccggggtatcatgtactactcatgtagtcatgtgggttgggtttgccgactgtaccaattgcatacgttgtccaaagctcctgccgatctgcgccactacaaaatgcccttgaaatcctcgattttaggttcctcccgatggatttggctgcgtctttccaccgcgatttgcaggtgcgaagccgctaacgcaccgcaccgcaccgcctaaaattgcgctctaaactcggctaaaactgctatagcacgagcaactattgattatttagtcgtgcatatctttccgatgataatggcagtttgctctcaagtggagcagtaactaacaaccgatcgactttgtttagcaactgaatgatgtagcaagctgacaggttgaagtcagcatagcgtgccatgccagctgctaggatcagaacgcccttgaaacattttatgcatgataagaacgagacagagtatcaacatggagagatcttctcaaggcaaaatctcctcatagacaagctgaaaccttactttgccagttctattaactaaaatgagttgaggaagctaatgtgacggtggggaaaatctgaatgaacagccagccaaaccatgaaaaactctcatttctatggctatttacatttgttaatccttaaagccttacccagagttaattctaatggataaacgcatactgtgcactcattggagaaccatgctacattcacaggtaattcccttcttttctgatcactaaagtttccttgaagtaggaattacatatccatctttgtaccaacaacctgtcagaaagctactagatgccagtgcacaaatgacgcattggtaaaattctagcagattaaacagactgaagtttccacatcaacggtttgtcttctggttaaatagggcttgacttgagggcctatacatcgatagattagtaaagtcagtttattagaagtatgtagaggtagaaacctatgaattttaattgaataacgtaatactgcaagtaccttgttagaggatgtaacggcagtcctccattgtggatcctgtgtaggggatggtctatccctgaacaaaataacaactcttgattgtgtgggcctttctactgtctgccgatgaggaatatctttcatgacccatagaacaaatcctgacggtatggatgatcctgcaagagtatccgaagtaaaattaacaagtggttgtgccatctctctctctaaaaaaaaaagaggcttgccaagtgctttcttgagaatggaatattatgttcgcaataaacatgagaaaatatcaacagaaaaaactattatacaacatgcattctgattccagaattattttgattgattggatgcctagtaaagagttaatttttgtgactaggcaattccactgttgcagttcaatgtgtgccgtaaatacaccatgcaactaattatttttctaaaatcattcactagtttgatggtgttgctccctacagttgagttgcacaacattcactaagtatcaggtaaggagaactaagaatccaacttcaaagtggatatcataaatataagaacaaaaagaaatgtaagttctgacatgattgcaatatatcaactagcagagtttgagtatttcaatctggtactacacatagaatcattagatctagactagcttcaccctgggggtatgagaaatgaaaggttggataaataatttatccacacctaccaccacacttactcatttcactaacttattgtattaattcccacatatggttccatgttggagcatgctcacatgcattcaccatcaggcttcgaagcatgtgcacataataagcctgatggcacaccacatcctaccatattttcccattgcaacatgaactacatttaataaaatgttatcgttcaatttaagaggagttatttctagccatagatggtggagagatacctatgaaatagtacataaacaatatgatagcattgttgatgatgtattcatctgctgagtaccaatacacaagcacctgcaacaagaagtatagcaaattgatatttagcaattcaagaaccagctagtggatatgtcagctactcagctattattgtataaatcagacttactggaacattggtaacaagtgctagtatagcggacgacgagaaacaaatcagtgacacagtagctaaacttgcaacctgcagagaagcaagcattgatatagagaattacagatccgaaataatatatccttgaagattgaagaaattcggatagactgaatggtcctcgtaaaaacacatactatttttcataatttatgctactatatatgaaatactccagtatccagccaatagtagagccccgcttggcccatggtgtggtgttagtgcaactagtcccacatcgagagtttacataagttggggccagcatataaacccgtacattgcaatcataacacttctgagttgacccttttacacaaaaggggacaaaagtgtaagtgaggtgctctttatacatgggctcacttctcagaagagctgggctcatacagattattgaagcaggagtacgcatataggggcatcctgttttttgtcatctggttttataagcactatgaccatattggaatgatatcttaaagtatagaatttatcagaactgaaaccaaaagttgtatcttttgaatatatgaccatttattcaattaatttaatattgtatacgatcattattagtttgctttctcatgattttacaaaatacaatacatgcagcaaatgataaagcagtagagagatgcaatccacaaattgaatgattctgcaagagttataccttccgcttctcagatgatccagtttcagaacgcactttgctcatctttgaaaatagtattgcacctttaaatgatcataaaaaataaaagaaaagggcaagtcaagaacatgttgaatgagaggattactggtagcagatgaaggtcaaattatttagtaaggcggatgtgaaactagatataaagtgaaataggactgtgagactcattcaatatttaatctactgcgagggattagaaacaagataataagagtttatcttaggttgaaacaattgactagaaaacatcatgcctaatattgcgacataattatggtatggtatagatgagtatacataggctatgcttaccataacatgccagcgcaccaccaagtacaagaacaactactgagaatacatccaagtaaacctacaaaataaaatatttggctaaacaatcaagtcacaacacaataggtgattaaataactattgatgaaattggtgagcttgtaaatttatcaagtaaactaatgtgaaaacatgaataaaaagtgtgtgaagaacaagtaagatacaagtcataatggagacaattgtacttatagcatcaaacttatcacaaatagaacacataggattttgttactctactggaccatctctaacaaaaattcatgtttgatctgatgaatttcacattgttgtgtctacctacctaaccttgctgtgcataggtttagaatgcattggcctgaataggattgtttactctgtgcctacaaaacttagtccacaataatgacagatttgtgcaaaccacaacacatcagtgttggaacttggaagacaagtatcagattccatccatgtaagataaacatctagtatttcttcattctatttcttcaccgtagttgtttatttgagtttatagtaatacaaaggctgtcttccagcacttgcaacacatcaatgctattatattgataaaaaataagttgatatatcataggaaatgcagcacataaaaacataaagaatttctaatcatcatacccttttcaatagagatgaatcaataggattttctcctctaccaatccagatgaggatggcgaaggcgattgtaacaacaaatgacagtagaagcacctgtatgggaaataaatattaggtcagttgttagttctattttcacaaatactatatgatggtaggtgcactacatgattaaagttaatcaaacaaatcattctcaagcagtacagtctaaataaaagaaagtgtcataaaggaatgtgtattatgtgcatgagcaaggaatatgccaactaaaaagattaccaaaatcacaaatttttgccggcttccaagctgtactcctgggcaacacctccggcgaacatcaacagcacggatgccaggtttattttttgttctatccagtaaagcctcatggtgactcctcgtatcctcttcatcttcatcgtttgtctggtgacacaggtcaaccctgtaagaccattattttagagaaatatagagtgaaaaaagcaactatgaaaaggaaaaagaaggcagaaaaacatatgcataataataacatgattcatgagaaagcaaaaaattgacaatacaaggttcatggcatatgttatctcatagaaatcgttaaatcatgaccatcatcttccccctttttgtttcaccctaacatctctaatgcaatcctctcaaacgtcgcgtggtaaaccaatgcataacactgaacttatacaggtttggtcctcaagatgagaccttactatttctgatgcaccccaccaacgatttgtggttagatacctcaagtgcaaccgttgtggcaagtgctacaagacatgttacagcttagaactgagctaaaggcagtactagtatgtcttttgcctatacaacgacaaggagtgcacaaaccaggtgtatgaagaaagggaaacaaagtcttctacagtaatgaaaaacactcttcccttgccccttcatgatttggaagactgttattaggccccattggatgcttgttggcatagaaagaccctaactcagactggggagcaatatgtgggttacgtgatcaccttccatgtaccctatcaccatggtgaagtgagcaaaagtaaaaggaaaagtgtaaaacccaaacctcattgaggggtagggcttatctccaataagtccatacatggagaagccttttcgcataataccactttgagcaaaagaacattctcttatcacactgagattgcaagcatagatcgccatcaataataaatcatatggtgatcataccaatcaatcgtggtcgtcatatggtcatccaatcaactggataatgtccataaccacgaaaaagaggtgagtaatgcggcatgtatcagagattatatgctaacgagtaatagactaatagtgtcatgtggccatcttgtattgattataagaggtcaatcttaacagggttacccagacagtaagtcagtaagatgatttaaaattattgaagtccaaagaaattataatgagaagatccatcagttttctaatcaagcatcaattaggaatgttgttttccttttatgctcagatggtttgactggtcatcatgcatgacatattgacatagcctatgctgtagttgtagaggatatttacttggtctagattagataactaagaaataagaattggtgtagtccaataaaaaaactggatatgttcgtcaagtgacaattctttcaagtggatatatgaaacagagacatagtaaacaagaacgggaattccaaacaaatctttattactctcaaaattattagcaaagctacatgagaaatgcattgtaagaaacaagtgccgactcaccagaatgacaacagcaacagaaaagaagcaagaagcaatatctgtggactagctgcaaaatattgagaatgcacaactattaggtctggtcagaaaaatagcatacaataaaaggtcatgtagataagcagggaaaaaaacaaaaggacaacagcaaagctatatatccagtaaaatatacccatgagtacaaatccacatccatggacccaacaaagccatctctcacaggtagcgatgatggtagacacgaaatacacaaggaatactgccataggattgggaaaataaaaatcagagttagtaaaatgttggtaatcataaaatatgcaaggaatactgtcaaaggaatggataatgaaagtacacatgattgacctgattcactagtagagataatacaaatactttatttagaaactagtcaacctgagaagctgttagtgaagtaacaacatttttcttcttataaagttaaacatcagtatatttgattcattaattgtgcacaaattaagacaagtgatcagcagtcatgtcatttggtgtaaattggacctatttaaggagagaactagcatgtccgtaatagaaaaattgcaaacaaaaatgagatctattttctatttcttaatcaaagcttcaaaaccagaatataaatagttcaactattccttgtgcacatggttcctcaatgtcatagtggttgcattccagcatcataaaagaggaagctcgctcaaaaacttgaattgtaacattttccaattgccattagttaaaagtttaaaacatggatagcaggaaccattcagaacaattaagacagtcattaactactgactacattatgcagaaatttccagtgcacaaaaaataataaagaaacctcaagcaaaataaagggaaaaaggtattatcatagcaatacagatctcacctaagttgcataggccaatcataaaatggaatatctgcaagaacgtaggcatataacattaaaaatctggcagctgagctcacagcacagagggaaaaaaaaagtgaggcactaattagcattatttaatatcctactcttgagctctcattcgaaaaccctacagcccacgtattgaagtaaaatgtcccataccaaggaaacttgctacttctgtcaaatagatagactataaaacacattgttgttttgataatctatagttatgtttcattcatgagaaggtcacatgattacacatcattaaaggtatgcataaatgaaataacttttgggggttaacatttgtaaatataattatataaacaaagactatattgcaattcatccgaaccttggaatcagacaaactaaataaatgcatactgaacatgatataaagtggtatgccacaaatagtaccattagtaatctaaattactaaagtgtagaaagataactgaaggatgaagacaatctactcccgtattaactataagaaaagtattatagagtagatgaggaagcctagtatgaagcttgagatatccaaaaaaaaaaaaaaaaaaaaaaaaaaaaaaaaaaaccgggataaggaggttttgcgcctggttattttttagcctccaaactgtcaatgtaagtgactagccactagatatagaggtaagcaaaagcttccaaccagagataaaaacatatggacctaaccacatagctagagcatcagccaattaagtatttatccatgataacaatagagatattatttagtgcaagcatatgaactcattgcaaaacaacatatcagacagttggacaacatgaaaaatagcacaaataggaattgtgcataccttttgccgagtccatccatgctgctgatcatgcctgtggattcttgctagctgcaaaattggaagtgcttaataccgagtaaacggatttaagagatcagattaagtaaaggatttaggtcaatttgcaacagagctcattggtaatgagtaatgacaactactacataattcaccgagtaatataagtgcactacataactatgctacacattgctccactatgaccaaaacatcgttccactgtgaccaaaacatcaccaaatagtaacattatagcaataccagagtgcaataaccttgcaggaatccctaggtgaatagcacatgacaatttatgtggctgactgatatctaattctcgtaaagagcaaaattatcattccaaaatctggcactcccccattccccgtcccgctagcacactaccgccaacgcgcatgacatgcccgtctccccactccctgcccccgccatcagtcgcggacagagcaccaccacgagataaccagatcgaattgcccccacacacgcacctgcacgaaggcggcgactgaaatggaagcgtcgatgacagcgagcgcgacctccgccgagataacaggcatcggcaggcatcccccgccgtctccggccgcggcgccgcgggacatgccgtggcggcccatacgcccgggcaacgacgagcggcggcgaaggaggagagagaggaggaggaggaggaggaggaggagggtgaggatcagggggccagagggcggcggcgcatctcgcggcgggcaggggatggcccagggctagggtttggtgcggaggccggagcagcaggcgggagcggaggcggaggcggaggcggccggaggagggtcagggaggaattgactggaggaggccgcgcctgttggattggaaagcgccccgagacctcggttttttagtcgtggtggcctcggtttctagtcgtggtgtggtgccggggtgcgtggctgcgtgcgtatgaagtgtggtccatggtgatgcgcggggggatccccacgtgaggatgggggcgtgtaaaccgtgaatatgcgaacacgaagggcccggaataccggattgatgggctggattcacgttcaccgtcggtacaacagtaagcttacgttggcgtacacccagggggcttacgtttgttcgatgtagatgtactacaatgttgaaaaaactcggagtaccatatgaagtttgttcgattttattttgaaacggagaaagtataggatagactatttttattgtgtctattttgtttaaatttctagatagataggattagtttttcattaaactatttttattatgcagtatatgtatatctggaacttttttctatttatgttgaattatccatactcctattatataggatgttattgttagcgtcgtccttgtaagaaaagcaatctgatcgaccttagtacttataggttgtttataggctattgacaattggcctaacaattagaagacaaggagtgtggttgtgtgtggggcgcaagtggagcgggagcatggatagacggggaggggatagagcatggatagacggggaggggattgcgagggctttacgctagtacaccactagatattttctttggtcacgacttaaatcgacttttttttttgtttggatgaaacattagagtaaactagatgaaaccccacgcattgcactgggatattttgctgagattggtagttgaatttgataggctaaagtggtataaaattatttaaagaaatattgaatttgatctaaggctcttgatgtcattgactatcttgctaaagtggtcatacatatgttgctcgggcttttagcattcatcacaacaaatcactcgaattgtcccttcaagatctccacatttgactcacggacgctatcaatttagtttgtgaaaaaaaaaacgcccaacatgacatatcaattttggcttccaactggctaatttttcattattattattattattattattattattattattattattattattattattattattattattattatgcacataatggctcaagtgcatcccttatcacaccgttagagagatggaggccaaccgtaaatccctaattttaagggaaccataatttgtaagaaaaatggacagaggccctgtttagattccaacctttttattcaaacttttaacttttccgtcacatcaaactttcctacacacaaatttttaacttttccatcgcatcgttctaatctcttcaaactttcaattttggcatggaactaaacacagccagagtaatgcgcccacaaatgccacaactagatcagtagatcactcattcgcttgtgctcacattttcagaaccgtgccaaagcatgaaagggaatgatcagcgtcttgctatggacatgaggtaagctgcagcatccatctcatatcccacaaagtttctccaccaattgcagtcgacaccggtagtcaacttctcgattttctttgttccgaggttaagcgcaaaggtccagggactgcttcctttgccgagggtgaacaagagggtgcaactcttctcgcagaaccaccgcagtttactggcatccgcactcttaatcttgaactggcggcgcaattgtccgatgccacctttcctcacccattctccggcaccaccacacatgtcatctccggtggtctcaaagaccattgatgccaaaccgacatatcctgaggaattcgctgcgtcgatgaagcacagcttccgttcaggtgtgacaccaagcagacgaaactgctgaatcgtgctgataatgccgtctagcggcatgcgcacctgtgtcggctgcggcgtgtcgaggactcgaggcgtactgctagactgctagtgtcgttcttcgcagcggccagtaggcgacggcgtggagcacgatgccgtggcctagcttgccaaggtcccagtttgtgagcttggggcctggcgtcttcttcgcctccatgctccagctgccggtgtctgatgagtaggaacggaacgcggtaaacctgtcacggttgtagacgatgagcacgcggaagaagttggcggacggcggcggttggtcgatgtcggcgtcggtgagcaatgtgcatgcgtacatcctgggcctgtctttgccagacagaggcggcagcacggccacgtcccccgtcatggggttgcagacgcacaggttgagcttgccgtcgttgacatgctcctcgctctggagctcgagaacgaggcgtccgttgcgggaggccactgggcgtgagagtgatagatccaggaggccaagggcgtcggtctggacgcctaacggcagcgcgctggcggaggggaggttgtagccgaggaggcgagagccgaacgccgtcgggacgaagcacgggggcgtcgagtagtcgacgatgatggcccggcgtttccgcttgcgcgtggtggccacggcggcggcgtcctgctccttgtggaaaaagccgagggcccggccggggagaagcggaagcgctcgtgacagagcgttggcctccttggccaccacgctggcccaccgcctgcacgtcgcggcgcagcggactacgtcggccgcgttcggcagccgggtgaaagtggccgcgagcgcgtcgtccgtgagagacgtcccgttggcgtcgtactccgccgtgtcggccccgctactccggcatcgccgtgacagccagcctccgcggtacggcgagggacgggcggcggcggcggcgcgtgctcgtccttggcgcaacggtggcatcgtgcgcgcaacagattggaatgaggtaacgatccaagggattcagcgatcccgtacttatggccggcgcgaagcgcgagtccgactcccaagcggaaaccgtcgccgcatcggaatatccgatgcacggggcttctcgcacgaccgccgtatcctctccctcctgcgccgctttttctggttgagcagcgccgccgaaaacggcgtgccgctacgctcgccccccgctcgcgttcacctgcgcctgggcacggggacgcggctaatgaacgcttatccccatccccccgcgtcttctcttcctactagaccataaattaaaaaaaagaggaaatttcacaaaactaaatattttatggtttaagttatagaaaatcacacatatattaacacttggcacttaagtacatatattttggtagtttagttttacaaaaccacactatcgatgaatagtttcacccgtgatattatgtggttgtttcatctagtctgaggacgtggtatcatattaatttcgtgcgatggctgataatagaatgtcatgtcctcgtcctaggtgaaacagccacatcatctcgcgggtgaatctatacatcgatagtgtagttttgtgaaactacataaccaaaatatatgtactttaagtaccaagtgtcaaaatgtgtgtggttttctacaacttgaaccacaaaacatgtagttttgtgaaatttactctaaaaaatatataaaaaacaaagttggaaaaaattatgtatagaaatatataaaaaaattttaattcaaattcaaatttaaaatgggtatgtaaacttttgacttataaactttgggtctataaactaatatttgaattcaaattcaaatttgaatcgggtatgtaaacttttgacttataaactttgggtctataaactttaggtgtatcaactttagatgtatagaaatactatatatataaaatatttgaattcaaattcaaatttgaatcgggtacataaacttttgacttataaactttgtgtctataaactttaggtgtataaactttagatgtatagaaatactatatataaaaaaaatatttgaattcaaattcaaatttgaattgggtatataaacttttgacttataaacattcgctgtacaaactttagatggataaactttagatgtgtaaactttaggcgtataaacttaataaaagaggaaaataaaaaaacgatcgccgccagcgatcaatcgctcattaggactttcgcctgggcacggccacgctccagcgcgagaaaattgacattttaccatcgtaaaaaggtattcgcccaaataccactatacagctgggattgaccgaaataccattctcaattaaggggctctgcccatataccattttcttccaattatctctttactctcatcattattaaccaaaatgctcctagttgaatcaatataagtatataaaaatacgtagattataaagtaaatacgccaaaaatagttttacatgttattttttttttctctacaccagattacatagtatgcaacgtactatctcaaaaactcacaatgttttcaatgatataaaaattatttttatttatgatgtaaagatagtgtcttatactctataatttagtgtaaagaaaagaatatatatatatatatatatatatatatatatatatatatatatatatatatatatatatatatatatatatatatatattgcatgtcaagatatttaggtgatatatactctgtaatctacatatttgttttacttgaattaattcaattaggggcattttggtcaacaaagatgagaggaaagagagaattggaagaaaatggtgtttcggcgaagcccctcaattgagaatggtatttcagcgaatccgaactgcatagtggtatttagttaaaacctgttttgactcaggatgggaatggttaggatatggattgaaccaaacagttttaagtgagtttgttgatccatggtttaatagggtcaatccatcatgagtccattatatcactaggttatccatagatatccaaatggatcggctacattactagtagaaaaaaaaactcttatcacatcccttctttctatatagttaagacctaaagctgaattgtggttgagccacgtcacctgtaaatctcagccattgaatctaatctggactcttggtaacgcttcaatcccagcccacttctcttttatcgccatccgccctaccgatgccgccgccagatgcggtcgcgctcccttctcctgcccccgcgctcctttatcagagataacgttagactccctttatcagcctcgtgcgggcacctaaagggtttgtctgagttaatctccgacgtcaaccaagaaagtacagagcatacgactaagtcttccgtcttgctgtaatcgagaatttggattgaagtcaagaaattttatctcggcgggtacaccatctcttcattccgcattccttgtcgatatccaccaaccgttctcgagtaatcgagaaggcgcagagtctgcgacggagccttgtcaacatttgtcgtactcgccttagtcgaacttggtgtagaaccatagagacatggaaccttcgataatgtcgaatagaattttcctgaaatcaatagtcagaaaagaatattagatagaaatagcccccgagcgaacgctcaaagggtaacatgttatagaatgtatggaaaactgaaaatgaattaaacatacagaccaatgttttgtatatgagcatctactcttttactgacttcgatcagtcagtttgttgagttatacactctccctagcccccagccttgtcgtcggagaatcattctcggaagataaggctcttggacctttgacatgcctcggttaaacaagcactaatcctagcccccagccgtgaagttggaaaatccatttccgattacacgacttggttaatacgcacggcgagaactcttacacgaccagatcttacatggtctttcgtctctgaaggatccgacaaggccttatctgctctgggcgtccccagccgaagttcccttaggttcctcagaggccttgtcaagacggcataaagggacattaggataggtttcaacgctaggtatcttttgtggtaagggatctctaggtaaaacacttggcgatattgtgtacctgatatcaactttgttgaagtagaggtaataggagaatcgctacacctctggtcaagaaccaggtagtagtcgtaactcaaccactagaagtaaatgtacgagagatcgctacaattgactggttgaggaccagtgagtaggtgtctctcgatcatttgaagtcgtagtacaaggaccgctgcgttattgctgcagtcgtacctcgaccatctgaggttgcggtgcgagagattgctacgtactggttcgaggaccagtgaacgagtagaattatctctcgaacaccaatggatgttgcggtgcaggagattgctacgtactggttcgagaaccagcgagcgagtagaatcatctctcgaacaccagtggaggttgcggtgcgagagattgctacgtactggttcgaaaaccagcgagcgagtagaattatctcttggacaccaatggaagttgcggtgcgagagattgctacatactggtttgagaaccagcgagcgagtagaattatctctcaaacaccaatggaagtttgcggtgcgagagattgctacgtactggttcggaaaccagcgaacgagtagaattatctctcgaacaccaatggaagttgcggtgcgagagattgctacgtactggttcgaggaccagtgaacgtgtagagttatctctcggacaccaattgaagtgctagagttggtttattacatgtgcatctcatgtagccagcatgactcacgcacccaacttatagcatatccagatgtccgttcgcaatcatgtcgggtgatcaagccgacggcgttcgcgaggagttatccgttaacaaccttttctcgagtagtccagccatggccggtgctatgagataggtcatcggtcttcgttggtaggttaggtgcgacgactctgcatttgtcgagatcgttctcgacaatacggtgtacttgaccacaacctactcgagtgctcaatggttcctgaaaaatattttctagaaggtaagacatatagcagagaatatcgagtatgtatttgaaaaactgtatggatcttctagtattatcaggatatagcgagcagatgtaaatatcaggcattatgtaaaccgtaaacaagcatgatttatacggaagaaaatagggcgagctcccagcgttagactgtagtcggcctaacatcgggaacactcgcacgacagatattgtataaaaaacatgctctagataaacataataaattattgattgaaaatatctgaaaataggtacggtaaattgcatataaaatattgcgtacctttgtaaatacatgtcggatgtatctatgaaattagtagattaatttaaaaaaccaatctaccaattaccttgttgcgcactcgttcgacatcatacgatctaacatcttttggtacgctgcgaagcttgaggcttggatgatctcgatagaccaagttgtcgatgacgacgatagttccgatctcatcggagcatgtactctggtcgggttagatctccacagccgaagtcgtcgagtagcttggagaatccatatcttaaacccatctcgtcaaaatccagaagcaccaaaatctccctacctggtgcgccactgtcgacgtttgatgtcacgattccggtatttgcatagtatggggatcgttggtactaggatatacgcgggactgaggtaaaagagacggacacagggatttttatataggttcgggcccctgaattgtcaggcaataaccctacatcctgttggccaaagccggtattgctcttattcaccataatcacaccagtacaatatttgggatagcctatctaactgttgtcgacatggcggtctgaaggtttgactcgtagtcgacaacagggtagtcttcctcctcgagttcatgcccggcgagatcaaagacagcactagatccctacggctggcctctgtagttaccggatagggtcgatctaggcatatctctgatgtcgatatctgacgtcttatcttgacgtatgttggcttgtattggctcgtggctttgtggcgtctatgttgtctgtatcccctctcctcctagggggccttgtatttatacccataagtgtccccttgtctaagtagaactaggaaaaccaatatagatacaatccgagtagtccttgtcgtttccatataaaactctggttgtctttccttatccggaactcctcctatatccgcaggttgtttccgtataggacatggtatgtggtgggtcctgccgagatttagtcaactactattaggtatgtggtatccataaccctgacacatttactcaccaacaatgagccgtccatcaccggcgattaattccatttatttccctcttaagcctctttcagttcctctttgactaaaatttttacagggctattgctttatttttaacactacacactatactttattcactttcaatttgatgacagtgtcaagaaatccatttagttcccatccgccctaccgatgccgccgccagatgcggtcgcactcacttctcctgccccgcgctccttctccgtcccgcacagcgccgcgcgagctgcggcgcgggcccgcgctcgcttctgctctgcacccgagcgcgcgagagagagatgcgccatgaagcgctccttcccctcccccgctgccgctgcgctcgcttctcctctgcccccatgcgcgtgcgagagagatgcgccgcgggcccacctcgcttctccttctccctcgcgcgcgcgcgccagctgcgccgatgtcccgccagccggcgcactcgcttctcctccccgcgtcgcactgtctcccgccttcccccatcccccacgcgccagccatgccgcggagctgcctccggcctctcccaattcttccagcggcggcggctggacgtgcgagcccatcgccatggcgggcgggaagatccagaagaagcggcacggcggcggcggcggaggaggaggaggaggaggaggaggaggaggaggaggcgggnnngtgattcccccgctgcagggagggatcccgttcgacaagtccaaggggtcctgcggaacccgtcgctggtggactccatcgttgagaaggccggcctcaagcccaccgacaccgtcctcgagatcggcccggcacggggaacctcaccaagcgcctcctccaggccggcgtcaaggccgtcgtcgctatcccacatggttctcgagctcaaccgccccatggttccagttctttaatcgttttctaaaatatattacaagcctaactaatactaccattctaggtcccgctaattttacattacctttttgctccagcatatgagattagaaattatcagtatacaattctgtgagttgtttcttcgttcttacatatatggtgaggattataatcatttggttaattcctacttcctccgtttcacaatgtaagtcattctaacattttccacattcatattgatgttaatgaatctagataaatatatatgtctagatttattagcatcaatatgaatgtgggaaatgctagaatgacttaaattgtaaaacagagggagtatttatcttgcagagataaattccttaagcaattcacaattcccaactgaatggtttacataacttctttgagatagcaaattgaaggtatgcatatatgtcaaaatcacgtctttgcctcttgcgatggcatttgttttgctgtgatctttgaaggttttaatatatgcgttcgtcagtatccaaattaaatccaaacgaaatagttcataaatttgatagatttggagaaaatagttcataaatttgatagatttggagaaaatagttcataaatttgatagatttggagaaaagaatattgatgccttctgttttttagtatttctttatttctattactgatgttttcttccaagcttcacgccaacatatataggaactatgtcagtcagtcacaaaagtaccgatttggaaacaatactgcagtcagatatgcgctctccatgctgatctccttcagatttcagtagccagaattgatctgttccccttctcctaatcggctgttgagctaccgatcatctccctctaggagcaaaagcatttactcaccaacaatgagccgtccatcaccggcgattaattccatttatttccctcttaagcctctttcagttcctctttgactaaattttttacagggctattgctttatttttaacactacacgctatactttattcactttcaatttgatgacagtgtcaagaaatccatttagttcccattcatccacatgacaatgttgaaaattgagttaatttatgaactctgctaggagtcattcaagcgtattggatgtggcttctaaaaactgaggtatgtataccaaaaaatttcagcatttatgtaataatttttagcttttgcattcgtcctgtgttgtttgctgcttggtcgctgtattgttgcagctgccctgttcgtgctgacctggatatgagtttgcctctctttttactccagaatttgtgtttactccaattacgagttagtatagaatagtggctatgttttttttgttattatttcgttcaaatttatgttacacaggatttaaacaagtttagatcatgagactacagatatctgatgacgttgttacaaaagttctcatcatgcatatattttagcttatgcttataatcaggttaacatgggcattatatatgtcctgatacattccattcttctgattgctatttgatttacgttttgcccaagttctgttatagaacctgtcatgaatccatttgatttgctattatcttaaaaagatattaaaagttttttgtaggctttaactttgataaactggatgcacatgcatttacttattgtcagtgcaaatacatccttgaggcatcttggatgatcccatggtgttttaattagttaggaaattttatccgctcattcctctaccgcattgatccagtcagtgctcgctcaaatttgttcattatacatacattggcacattctttgcatgaattgacaaaataccatatggaaaacactacagtgattgtgttcttgatcttgcttgctacatatctgtattatccttaatttcccgcagcaacgcgcggggtttcatctagtatatgtaaaactcggacccaaaatttttaaactcgtgttcatactataaaaacttatcgatttcagtcgaattttggtgggataatttattgcacagagaagcaactttgtgtaaattttgagcccgttatacacatggggcccacaatgcactactaaaatactaaggaaatttcattatatgtgtgtaaaactcggacccaaaaattttaaactcgcattcacatttaaaaaaacttatcaaatttagttgaattttgtaggaatgatttattatatagagaagcaactttgttcaaattttaagccatttagacatgcggggcccacgattgattactaagacccaaaaattctagttttaatgtgtgtaaaactcggaccaaaaatttttaaactcacgttcacactatgaaaacttggtaaatttagttgaattttgtaggaatggattattatatagagaagcaactttgtacaattttttgaatcattttatacatgtaaagttattttgggttgaaccccttaaacctaggttctaatggtttgatccatttatatttttggagcgacaaaaaaatccattaggacaaatttacggatagttttagtagataaatggatcgaccctatgtaagtttaagtgccttaatttggttttggtgattaatgacaaatctaattatatgagactaacgtttttatgagcctttctttgactagtcttatttggatatgaaagtaaaaatgatgggaggtatgtattaaacttcacatattctaacttggtatctcttgtggatccaaaatatagtgtgagctccctcattgatattgattgattatgtgcatatgcattccttcatatccatatgtatgcacatcttgaggggagcttattctatattttgttcattataagatctctaccttgatttgaaattatctttcatatcatctctttgtattgtttatatcggattattatctatcacaaaagagagaaaagattgaaagatcttggattaaacaatttgtgtaattgttactttggtgatagatgataaacaaatgtttatgggattaacctctcttttacataagttttcaacaaggttatttcccgataatgagatgtggtagatatgcattctttggtgatggaccttaatcatgacaaggatgaaattcatggagataaagcgatatgtatcacttcttatctcctactttttgataggttcatatatatgatttccatgttattgttatataagtgtgagactaatgtttacttgagtcttatcttatttagtctcctttacattgagaacatggagatcatgaaggtatgtgtttttttgtttatcttcatcattactacatatgccttctctatgtatataggataaacccccattggttcttctttacttatgcatacacttgtctctcttgtatatttctttgtatgcatatacttagggggagcaaatcctatatatttattgtgcatgttttagatccatgttgttcacctattatatatatcggatctttgcacttgagcttgcatacaagtatatgacacttatgatgttaatgaatactcaacaaacatatccatatctttcatatgcaaccggttggtcaccaagtggaggatgccaaccgatttgttgggactaatgttttcctttgaaccgtgcaaaggaatagatctaattgcgatgaggctaatgaatgacaccatgggttaatggtcaccaagccaaggacatcgtcatgttggcaagaataaagtcaagcttgtgatgagaataaagtcttgacaaaggatggcaaagacctcggcataaacatggttcaaccgaatggtcacaagtgttgatgttggctcaagcattgaccccaagttggatggcgcaaggctaaggtataatggagctaagaatgttttcttagtctttttcccggtcttggtgtttggtgtagaccggatttactagataggtgccgtactatcaagaggggtctatgaagcgagcatgtagatgattttgtgccatattagttcatatgcatataggtgcattttgtgggcttgtctagccaagtgtggtgagttttatcaagtcccaaacaaagagagaagtgggcacatcctataggtttgagtagcctcatgtggttatgtccggtggagtatcctttggagtgtgagccatttctccctgagaaaagttgtgtttcttggattgattgttcatgggttggatagccctttgaataagctttccatagagtccgagaacgccaaattccgagatccgagtcaaaagatatcgtcgttttactgacggttggttgtgctgaaaagtgacctgcggtctgaccgtgggccttaggtcggtctgaccagggctgttagccggtctgaccggcgtggtaaggccggtctgaccggccctattggtctgttgcactggtctggtttttggtggcgatacagagccgccagagccgcaactggtcagaccgagccgatggcggtctgaccgagccgtggacggtctgaccggccgcttcattgcggtcagaccgaccaggttgagtagtccgttacaaagtagtccggtctgaccggcagagcacagagttggggatttcgactccaacggctagttttggtggttaggggtatatatacccactctccagcagcaagggcaaggttttggcactccattgcattatcttgaacccttgcaagagctctcacacccttgtgcacttagtttatctagtaaggtgttagagagtgagttaagccaatccaagtgcattgcttcattgttatagctagtgtggcacttgatcatcctcggcaagcatcctagacttgttactcttagaggttgccgcctcttagacggcttgtagaggtgttgcccggtgacctctccgagaagattgtggaggaggcccggcgccggttgtgagtggtttggagttcaccaccttcggagtgaaggaagaactaccctagtgatcgaggctttggtagttctctccgtgggccggctcccgccttgcccaccccttgacgaagggggcgtgcggtggtttcgtggttgagcggtggagttgggctcgcctcaacggggattaggaaaccggcgagtttccgaacctcggtgaaaattccttgtctcttgtctcctttttttgtgcaaatttactttgagcaagtttacatactttgtgctattatcaccctaggcttgcaaacctcaacataggctagcttctttgtgcacttacttgagactagttgatttaggtttcgaattgtgcaaaaccattttgatttacgcttccgcatacaaaactcggttttagccaaaagtttgaaaaaccgcctattcacccccctctagtcggccttcttgatcctacaccttaaccattcccatcctgagttttgacgatggtaatatggtattatgccaattttctcctactcggctccgcgccgagccgcgcgagctgctctgctgccccacggcgcccgtgcggaggccgccgccgaccgcaccactagcagccctccccaaccatgccaagcaaggcaatcatctctcttgcggcggtgatgctcctcggagcaacgtcccggccatttgcgcctcaaccacgatgaatttgttcctctagatcatccccatgtcgtcccgtgccccacctccaccacccatcccagccaccggtcgccttcgtgtgtacttcggcgagccccaccggcgctcctagaccccgtcgtcggcctcggcttcgccggtgtgcctagttcccggagaccgtcgccgccgcacccaacctccaccggctccacacctgtccctagctaccgtggcgtcacccaagcggtggccgtggttcccctgggcatcccatcgccggccgccccccctccggttggcgcctccccgtgctcacgcgagagaagagaaaaatctgattaagtctaatggaatactctccatcccaaaatataagaatctatgatcgaatgggacattttctagcctgtctagatttgttgtactaggaaatgtctcatccaatcataggttcttatatttttgggacataagtagttaagttaactaatactacctccgtcccaaaataattgtatttctatgattcaaactttgtcccaaaataattgtaattttagagtactaattgccccatcaatcatctatcattcaaatttctccctattatacccttaaccatcttcccactctcacataaacaccatttaatgaggggcaccatagtctttcttctcaaaccttaatatatgataaacaacatagaattacaattattttgggacggaggtagtaatcagttgtccctatgacatatgggccatgactactaataaaaagtgtttaatactacctccatcctaatatgtagcaacaaggatgagatgagactcatcctaggataatgtatatagacatgcctcatgtttagatacattgacccatcctaggtaattacattatgggacggagggagtacttattttgtaagtttgtgatactgacaactgggcccaccatttataaaacccgtcacatctgacctcacgccgacctccatactcgctgcctcgattgaggagggaggagatgacgagatggattagtcgggaggttgagagatagtggagagagatgggagaaaaagaagaggggaggatggacgaataagatgaatttgacggattggtcttacgtgtagatgaggaagatggatgtaactacagtgggacagttccaattttataaaattttaatggcacgacgacaaataaataaattgtaatggcattttatctgaaatgatatatttacaatggcatggatcgaattgatctatataattcatcatccccttttcgtgtaacatgtctacattgtcaatatatcacaaacgaaacgattggagtagtaatattattggattaaagaaaaacagaagcaaagatttggagcttgggctccaaatcagtgaggaaggagatatccaagattactaaataatttgttattcacaattcctaaatactcctaaaattccttcaaagaatccaagattactaaatgaaataaaaagtagaaaatatgtatttttttagtttgtttaacatgtttttgaaaaaaacaaattccaaaacaacctaacaaatttatgaaacctgtttatttattgaatgtatcactatgcaatttaaatggaaagcatggaaacattataaatgcattggctttgatcattgtttattttatttattaatcacccttatttattaaatgtaaaaacaatgtactttttcttgaaaacaccaagaggagttaatatggttagtttggataaattaccaatagtaaggcaaataaagggcctacgttgggatagaggctaactttgctataacttcatttgccataggtatgacaagtcacataaaaatgtgccaaataatttgttatccacaaccatggcaatctttagctatgacgtatgggctcatgtgctaataaagtgattttgtctaatctttgtcatgcaactagcctaagaaatcacaccacatctaaggcttggcaaacttcaacccctaaccaaataacccaaagtattctcacgtactcccgatagtttcgatagtttttggtaatttatgttgcctctcgcaagattgcgtggagctattagttgtattgcaaaattaacctatttcacccatctaaaaatatacgtattttgtgttgcaaaaattacctaacactatttcaaaatatagttatttttatatgttttatcgaaaattactgttaagatgagaaatagttgcgattgatacattgagatagggaagtaggtactccatccgtcccattttaagtacagccatgattttctgtgcccaactttgatcgtctatcttatttaaaatttttttaaaaaaattaaaaacataagtcacgcataaattactattcatgttttgtcatctaataatgataaaaatactaatctaaatttttttaaataagacggacagtcaaagttgagcacggaaactcatggccgcacttataatgggacggagggagtaaaaaaagatttatattttagtatataattggaatcccgtatatatttatatttttcaatgaaggaattctatggaatgcaaatcaattttcaagttgagatcacttaacattggtcctattaaaaaaagtccctaaatgctactccctctatctcaaaatataataagtaatctaggtctagattaaacataatttagtataataaatatttgacaaactaaattatgtctaacatggagggagtaaaaagaaaataaaaaaatactactccctctctctcaggtataagatgttttgatcttaagtttgacaatgtttatagaaaaatagtaatattttcgatccaagataaatttattataaaaatatatctaactattaatttaataaaatttatttaaaaatataaatattactgtatttatctgtaaactgggtcaaaataaaaaaatatcataaactaaaacgtactcagcactcactcatccagcgacacctaggcatctctctggaggagtcgtggtcaacatacaccacgtcactcccgcgctcctccacgcttcttctcctctgcctcgtgcacagcgccaggcatatccatgtccatgtccatgtccatgtccatgtgctggaccttggcgttccatgctttcatttacttctggatggcagcagcagcaacgtgccagtgccagcatacatcatgtgctcagctgggcgctacgtgctctcgcctttgcgcggattgcgccggccataaatgaaaaaaacggacgaggagtgcaccagcgaatgctgcaagaaacgagtcatacttaagtactgtaccctactgggaattatctaatcgaaattcaaaagtcacaagcattctagcgcaaagatcacatgaaatagcctagtttctttcctttcgatacaaacgagggaagatgatttcttagttctaaccatagtcaggcacaccaggaatttgcaagtacatcaattgcacaacggaatacgattagaatgctacactgaaactcacggcagaatcgcacaaaattcaggaaattatgagatcacttgcagaatttgaaaatttagaacttataattgctagtacatcaaaaattcagaacgggaacagcgcgatacaaaaatttttctccaggagcaaaagaaaagaggcaacagcaacaagcactccggtcaggtgcaacgtgcttggctcacaaaagaacaagaagccaaacagaactgaacaggccacgcgacggccaacgccgagaaggttacatgcgatgcgaagttgtgcgaggagatgatgatacaggcgccgccctttcaccaggcttcaggtcggactaggacgccggccgccgccgcatcgaagcagaagagcacgcagatcaggtacccatcaggtctcgtcagatgttgcagccgcagcagaggaagaagctgcagagcgcggcggagaggacgacggcctcggcggcgtagaggacgtggaagagcgcgtcgtctaggagggatacgaccaggccagccttctccccccacctccacccgtagccgccgccgccgccgccgccccctcgcgccccctgcaaactcaccatgcctcctctcgcaaattccggatccgcgcgagcagattgatggatggatggggatggctctcctcctcagctggtcccccggcccggatggagatttctttgtttgaaatcttagaagtggaagatgatgagcagcagaagggctgatgggactgaagggtttttgtacgccatttgctggacttatgggttaattaggcccacgtttttccgttgcttagattatttcctactagcccaagttgctttcacgatttcagtacggttaatatagtgattcttttgccataaaaatatagtgattctcgtcttctcgagctgctatcatgggacctagtatgtgtgtttagtgcttagtgctgaagtatttaaaaacgatctgggttattggtaaaggaaagggaaatgttcctcgagcggtgaaacctaatggaaaaatcatggtttcttctgaatagagaagtttgtgtttttcaatcgggaagatatgaggttttgcttttgggtgtaagattacttaaaccacagatttgggcttactgtagtttctgagtttaatgtttaaatagtattgcgtgagatatatactgcgaatttcacaataaggatactgttttcgactaactgacaatatgtttcagtttcttcgcctttgaccactagctactcttaaataattaaattttgcttatatttatggacactaaacacttcaacatcatgacattttactaagtatttgcaaatatgttacacgagagacaagtggtcaaagtatgaaaataaatagtgtcgtataatttattcagaagcaaagggagttgtttttttttcccacgaagggtcaaggtgatatatcaaggcactgttcatttctgattccgaattttcatttgcacgcttcttatgcttctaaacggcgtgtgcttaaaagcaaatatttataaaattttatttgaatacttttctaaatatgactttttaactctgtagtagttaatttatttatttatgtcctcagatagtataaaaatagattattcattaatcctctaatttcaattatctcagggtttgtttgacacaattctagctctaactccatctctcgtggagctgaatgttagccaaacagtttaatgtccattaaaaatagaagtaaaactagatcgagcgctctaaacaaataaatatagagatgagactagtttaggttgctccacgaaacatctttgaaatgtttaggcaaccgatcacctgcaagattgtaagcttttattgtcagctcgtaataggacgcaacagtaataggtagacaaatccattcaacacaaaatgcatagcctttcttggcactccagggcttccaaagtaatggagcaattccatgctagattgaccctaacgaagacaagagtacaaagaccagtctaaaaaagagagtagtacaaagctaaactattccgaataatctcgccaatgcaaacagttgatcaactcttcccccttagccccatctcaaattcacaatcttgtgagcgaattcagagatgcgaataggaatattttgtacgtgtgtgaatacatatgagtaagtgcgtaagtattgtgagtgtttatatagtttttttaagtattgtgagcgtatgtgtttatacagtgtttaaaaaaagatcatatgaaaacacaagtagcaaaattagtttcatctacctaatataaatccttttagttgtgagggtagaactaaaaatccatatatatcgccaaattttacaacccaaatcacaagggagaacaaattgaaattgctccacccttttggctaatgtttcttaatgtgtatgaagtgtactccctccgtcacatgaaaataaatctgtagaactatgtgcaaattcctcctgtcaatttgcttttttataggatataggaagtacataaaaactatatataactactcaaaacaacccataatgatcctccattgatttaaaatacaatgctatttatatttcctacgcatattaaaaaaattcaaacgagaattcagctgtttgcaagacgcaactgctttattttccggattaaatcttttctggattcaacaaaggcaacgtattatggaaacccgtcttcccgaagctgacacgggtttctgggtgatgtgcattcataacccgcaagtgtgagcccggaagtacgctctcgttctccgcatgcgggttgcaatcctcgcggcatccttggtaatccccaaacgccagggacagtagcgaccttgcggccgtctccccaaaccagatcggcgtcgggtctttgccccttttcacgagcccaccagcgcattctcgcagccggagagaggaggcggcggcggcggcggatcgaggagagggagcggagaagatggggggcggcatggaggtgcacaagaacaagtggatcgaggagtggaacgcaggccgcgagaacctcgagttcaacttccgctggacccgccgcagcctcgccgtcgtcggcctcttcggactcgccgtccccatcctcgtctacaagggcatcgtccgcgaattcgtaatcccctcctccgaaccccccctcctcttccttgccgtgccctcttgggttatccaggtcctaacgaagaatctctctctgtgcgtgcttgtttggttgcagcatatgcaggacgaggacgccggccggccgtacaggaagtttctgtgagtgctgcctccggtggatgcctcgagactgcgaccgggagaaggactctccgttcggtttgttctccatactgttttaattggacagggagtattttggagtgctcagactgttgcgtgggatctgtttgttgaataagctgtcatgacttgttgtcttttcaattgctgaaatcttggagattttattcggttaattcggctgaataacagtgttgcaatgttgtttgtgcgttcttcaggtactaattagaaccgtagtttgcttgtctcatttattaaaatctgaaatggattacagtgaatggttttagcatgtcgtttctctagtgtggcctacgtagtacgtgctattggattggctgaatagatgcagaaaattgatagcaccgatgcccatgaggcaaggtattgaccaagaactttcttacgattaattatggctttgggagtttgagtgcattgatgttatacgggctgtttcatagcaacccaatgtaggctctaaataaaattgtatggattggaagctgcactgaggcactgataaagtaataatgatcattattcctatgtggcttggatgagatttcatttctagtctcaaaattattgtactttaccactcttcaattatacttgttccttggccactatgccctgtgtatttgctatacatgagtaggtgtctaggaccttttcagtttttgcctataaaaacattaagttactttttcttcagcacttgctagatatgatggtctgagtctgtgaacagcctaactggttgagtagtctcagttgcctggcaaatggttcatagcttatttgcataactttactgatatactgtagtatagctagttttttttttcttccttagtattttcatgtataaaacttcatatattcacagcgtttagtatagatgaaattgttagttacaatagctgtaactcatcgactaccgaaacaacaggtaatgctatttgagcagacctggagagagaacaggatttaattgcttttctgattcatgttgatggaaatgataggtaagagtacgaacagttttctgataataagttctgtagagttagcattcttgaactgctacagcagagtatgccactcccttttttgtggaaagggccaagcttcatgttgatggaagtacagttgactttcatcttgctatattattattgtattgtctggtgaagtcttatggaacatcttgcatactgatgatccattgactccagttatccactgaacattttcagcaaagtaatagatgaaactgtgaccataggccacatggtattagatgtgttgtgttgcatacctgtccatacacttctataactgggttttgttttctattgcactgtttcaatgagatttttttactgttagtaagaaaggtagattttgtgattttcttttgttggatatgttaatgtagcgtggttggttgaaagggcatgttttttacatactaggaaactaatttagcctgttctctatggaaaagatggtatgctagcaacttcaaaatctttgctgcttatatatggagtatatatatttgcatttgatcacgcggtcgatttgctgatgcaccattatcatatcatatgtacctatagcctccttcaaactactgggtatatatgttagattagacttaataaggctagagtattgttttaaaacatcgtgtatttggatgtcaccccatgcaccaattattagaaaaccattgtaaccatctcaacttgaacatttgatatctttaatttcttttatataactaaactgtcaccgtctcatccactccaatagctactgcgttgtatgaaacttgctagttcttgtttagttttttgcttccaagatgtgttcctgcttactgctggcgtgtataatgaagtatggactcaaaaagtctatgggtgatggagtgaccaaattgctatttcaatttaccagttgtggataacttcacagtgaccgtgttttattttagtgcattttttgcttgatctttagttgtctcttcgaagttcttaagaaccttcatcattcatgggctgcctcctttattttgttctgagcttctaaaatggaattaacataactgatgtggctgggtttactctttccttctgatgttacatgcggttcttatgcttagtaccaaataatcacataaattgcttttgacatgtcagtctaggttgatatgtcatcatagtggcacccaaatgaaaataaaatctgcctcatatgtcaaaatcctgaatctctctctcatagctacgactgacgaacttccgagcagaaaaaacatgagcggacacgttgtttctgaatattgcaggttgattgctggccatacttgtctagtgatgaatggtgatacaagtatcgaagccactgcccagaaaaaaacagaggtcagcctcattttgtgtattaagctgtcaacctatatcattggctcgcaagtgctctgccggtatctgaccaggtctacctggttaatgctacacttgcataaaaaaaaaatccatgactaagttcatgtttagcggtttagtgccatttctattcctcgtggttaatgctacacttgcataaaaaaatccatgactaagttcatgattagcaagtttagtgccatttctattcctcgcacaatccaatcgaactctgactttgcacggtcaatcttatctaacactgatagctactacggcaaaagaaataagaagagtagcctagtcttttcatggatactaccaagtttcgcctgtgcgtctgttgcttacgtcgcttgaaaattgaagcaagcaagcgacacgaagatctgcacggccaaagagaaaaccacctcgtggcgaactgcgtccagctcataggtatatataagctcttgatgctctctcctcttcttgcccattagcattggacctattggtcgtttagtgatcacgctgggagctgcacgtacgttgcacttgcacgccgcgcaaccatgtccagcccgtcgccgacccctcctgctccccctaatcggcctccacagccacctccttcagcaaatccgccccaatcgccaccagctccccctgatcggcctccacagccacctccttcagcaaatccgccccaatcgccaccagctccccctgatcggcctccacagccacctccttcagcaaatccgccccaatcgtcaccaacaacacctccgccgtctactccaacaacacctccaccgtctcctccggttattccaccacaacctcctccagggaaccctccaccacctcctccggagaacccaccgccgcctcctccaggaaatcccccatctcctcctccggtgattccccccacgcctgctccagctccacgtcctccacctccggtggacccccctatgcctcctccagtatttccaccaccaccacctccaccaccttttccaccaccgcctcctccagtgattgccccagtcccagcacctggtccggcccctactccgaatccggtaccttccccaaatcctaggcctaatccgcaattcccacctcctcctcctcctcctccggtgttcccctcaccacctcctcccgtgagccctccacctcttcctcccgtgaaccctccaccaccaccaccatccagaccgaggccgagtccaacaccgtctccacctccgcctattgcaagccctccaccacccgaggtccaaaactctccacctccgccgccatcacccccaccaccacaggctgtcgaagcgccaacgacgtcaccctcaccttcatcatccaaaagcagcgggaccacagtgggtgtgggcgtggctgtcgccgcggtggtcgtgatcggtctcgcggccgggctgatctacttcttcatcggcaagaggcgccgtcgccaacagcagcctccgccgtcattgccaggtacatatgctcgtatcacctttcctgggaaacaaattccttgccttcgcgttataaaggcacggcgccatttgaaatatgaacggttggctaaacggacggcataggtatattacgatgctgtatcgacggttgaagtaggtgtgtcactgcagctggtgcttgacttgctccttcatctaacggttgagatcgccagaaactatcgtcgcagctgatagatactcccaccgtcccaaaaacaaatccattcctagcatcttaaggtagaagtagtagagatgaagaataactaaaatacccttaataattgattaaagtagtaaaaaagatatgtagataaaaggtattgaagaaataaaacttatcgttttctgtgctaaggataggtaagatgtacggagggagtacgctttacgcttaaccttatcacacgcttgcacggctgttacccacgccccagtttgtttgtggtgtgttacagtaattccatctatttacttttgattacgcgggcgtcgagaatgatcatggtcaattggacatgaccattcaaattaaaaggcacatccacaccattttgaatattttgccagtgctaaccattatcgagttagcagcggtgtggaataaatatattttacaacataaaaggacaattacatgtttctcacatgcaaccaaatacttcctacatctacttttgatagtcatatttcatcttggtacatagactaacaataagtgattctacttatcatccatttaaatatgctattagtcatttctcgtaaacaagcgattcattaatatttacatttctcaatgcccatgtagctaatcttgtgtggaagaatggagagtcacgcattaaatccaagaaagtcattaagataatactccctccgtactcataaaggaagtcgtttaggataacgacacggtctccaaaacacaacttttgacttcttgtttctataaaaaatatttattgaaaagtgatatatgtatacttttatgaaagtatttttcaagacaaatctatttgtataatttttatattttcaaactcaacaacttgagagttattcatgatttatattcccaatttttgacttaaacattgctctaaacgacttcttttataagtatggagggagtaagttgttagattgaaatatgcctatcaaaaataaattttttagatttggaaatatgactataaaagtagatggagggactagttgccaacgattttgaaataatttgaatacatcgagttgaacatgccactcacatagattctcaagttcaactcgagctacagaaacaaataattcggctgtgaatagtgtctatgctgattatttgcacatttcggagaaatgggtagagtgcgaggacacatactatatataatcactttcttctttttttaaaagatgacgtcgttgactttttgtcactcgtttaaccatttatcttatttaaaaaattatgtaattataatttattttgttatgagttgtttaatcactcaaaatactttaggcataatttatattttatacatttgcataaaatttttaaataagatgattggtcaaatatggattcaaaagtcaacgatgtctgcatatctgccagtactaagatacttttttttatttgtgctctacaagtttgtgtgatctcatagagggattggcatacattttttaaaccaccccacccttgttttttttgtgatggtacgatccaacttcactctgttaatcgctcttttacgctatatcaaaactcaagcaccgaaggggagaccccgtggtttaaaatttaataaacttcgttattttttaattaaactaggaccatgacatgcaggttgccttcataaaacagaaatagaaagagaagaagaaataaagaagcgaaatagccatttcatagttttaaaatggtactccttcgactctgaaatataatgacatctatcatttaaaatttatcctgaaatatatcaattcttcaccaatatttttttcctaaccaaccataacctttcaccattgaaattctccacttacttcattttcttaaacaatcacaacattccccatttaaatccacatactttcttaatacccatatccaaggtaaaaattcatatattttagaaggatttagttttttgaattcaatttttcgtatacgatggcatttggtagcttcatgcaatgcctcctttattgtgtttcaagcttctggaataaaagtaatgtcttaaaaaagaggggggggggggggttgaaggattgtttacgctttggtgcaagtcatggctatcttcgttgctatacatgcttctttagttagtactccctccattttttaatagatgacgccattgactttttttcacatgtttgaccatgtcttatccaaaaaatttacgtaattataatttattttgctatgagttgttttatcactcatagtactttaagtgtgatttatatcttatacattcgcataaaatttttgaataagacgaatggtcaaacatgtgagaaaaagtcaacggcgtcatctatttaaaaacggaggtagtaccttgcaacagtttgacttatgcaacttgtcataaggaattacaattataaaaaaaaatgcaaccttctatcgtcagtaaggatattatcgggatgaaccattcatgcaagctaaagcatttggacctcggactagtagattcaatatgacgataacactatatgcgacacatgcactcacatgttaaacagattgttagataggttaagaattggtagtcgtaagagagaacgctagctaaatgcaatatttgatgaattaggtgatcacactttgagaaatgtcaattgtggcgagtataacacgtaactgtccaacttgcaatcatagtagaatatatgggaacattttttacaatatgcaagattcttctagtgaactattatgagctacaactacctttgttcttttcttcttaagcaaacgatggagctggttcctggtagtgccacaactttgaaaagcaagtattaagttaatcattcatcttgcaatatttgttcaaactagttatacaaatttctttaaaccctatctattatggtccaaattacacaaaaccacactaatattgacatatgacacataaccctgatattatcgtcctaaagtttcacaaaaccacactagtttccattttgtcttcagatctaccatattttttttatacaatcacatgtcaaatttataaatatatttattctaaattttgatataagagtgtgtcaaaatggttagcaatgttattttgtgaaactttaagaccataataattatgttatatgccacgtgtcaaaatccatgtgattttgtgcaacttggaccgtaataataggtggggttttctaaaatttactccattttattttaggcgcgcatatctagtcgaaatagtgaagacaacatttgtgctcaacctatatataagtgatgtccaacttggcttaacccacctaatgtgaacttgaacttgatttgtatatccaaattaacatagagtgtgatgcgcaatccataagatatattgtaacacctatctttcggattgcacaaattacttatggattatagttataacagttcattttaccttttttttttaaaaaaaagaaataaagtctaaattatctttaaactattgtgctagtccgatttacactatatacagttgataaattgtgcatgataattagaatgtgtttacatctgttttcgcatcttagaacgtgattgatccatttatacatagcaacagcatgcatccaaccatcccatatactagtatggaagtgatgaaatcacttgattaaacatccgtttcctggcccctcatgatacagtcaaggaaaaactgttggccttgagtttgcgaaaggcggatggattcaattaagcccaaagccccaaaccgttttcagcaaattgcccaagaaaaataatcttaccttggcttgactttagagactcgcaagcttcatactcggagcagaaaaacataccgctcctgcgctccagatcgatcaactcagaacccaggttgatcgacggcgtagcttatatcttctgagagaacacgtaccgcagtcactgctcaaggaaaaaaaaaagagtacaagaaacggcaacagcttcgttttttttttctcgccgggcagcctgagtttcatttgtatttgcggtcaagcctttgtcatttgctcattttaaacactttgcgaccgaagttggagagtgagtatgctaagctgctagccgtctgtatctgaccggttctgcttgccacgctggcatcagaatgctcacgattacgcactgcggcgggggagctatacatatgccgtcgctgtcgctcgaggcaagcaacaaaaatctcttttcttgccccctccgtacggatcataccgatacctgcaccacgttgcacttgcacgcagcgcaaccatgtccggtgcggcgccaacgcagcctactccgcagccgacccctgccccgttgccgccgtcgccgccgcctcctcctccgccgattcctgtcccttcagcgacacctcctccgccacccccggtaacctcaccaccacctccaccggtgtttcctccgccacctccagtaccatcaccaaagccgacaccaacccctacaccggtgacgccaaccccaactccgccggtggtgccatcatctcctcctccacttgttccaagcccgccagcgcccaaggcctcgccgccaccaccgagcaacaacgtctcgccgccgcagccaccctctaacagccccccatcttcaccaccgcctccacagtcacccgatgcaggcaatgccccgtcttcaccggcgcctccgcaggcgctcattaatttatctccaccgccgtcgccgccgcagccggcgtcctcgtccgccccgtcgtcgtcctccaacgggaccgtggcagtagccgcgggcgtggtcggcgcggtcgtcctgctcggtctcgccgccgtgctgatctactgcttcgtcgccaaggggcgccgccgccgccgaagccatcaccagccatcgccgtacccggtgtttccaagtaagttacgcgccctacgtacgtacttgcgtattgacatttgacgcgcgcgcgcggccgttgcacgagacaatgctacgtcgcgggcatgtcgacgcacgtgacaaccgcgcgcgcgcacgcatcgccagcgcgagagctccagttttttgcggtgtttagccctgatgaagtcaagaggatcgacagttcgataccgaaacggcggcattgcgtacgtagcgtgcctgcgtagcgcgttcgacctggacaccgtcttgtgtctagcggcgagcggttcaaacggcacgttcgcaccattctgtacacacgttaaggctaacaatgggaacagtactttaaacaccttacgcatgtgccatcttttcttgcaaacgcttgaaatagttataaaatatcttaagaaaactaagaacgtgtaagagcgaatttgacgtccacgcaaaagaatcattttgtgaaaaaaaatgcagttgtttcatacagttaaatttgtttttctatcaccatttataaatctaatttgaccttacatatctgtagagtaataatattagaccttatgaccttagttacatttggacaagacaaagtaaaatgctagggaccaaaattactccaactcggagtaagggcatgcatgctcaaaggtatagtccgatgcaagcttgtaggtattccaagtcggaaaaatgccctttcatataactatctcttgaacagactcttcattaatacatactccctttgtcatataatataagggattttaggttgtttatattcttaaaatctcttatgttataagacagaggaaatagaaaggagtattaattaaatcgctgcatgtgtcgttaactctcgttgaacgcttggtgttatctagtcttggatgtacaatgcttggtgctatctagtctcttcacttttttttttttgctaagagtcattgttgagcaattgttaagttaaacaacgatgtttccgtcttctctcctctcccttaagagactaaggtaactattatttcaattttcaaagggattaattagctgcctcaagtcacttaccttaccttacgatggttaagtcaacttgccacaaggattatcgatccatctgtccatccttacctatatatctacactaattgggaacattgtggtcgtgggccacttattatgatcatagatatctctctgtttcatattataagtcattttaatttttcttaaaattaaaattttaaattctaatcaagttaaaacatagcatttcaacataaaacaaatatatatatatcaaaatatgttcaatgtatatcaaaatagtttatttattttggtgctgtagatgttcctatatttgtataaacttaatcaaatttaaaaagttttggctatgaaaaaaaaagttaaaatacattataatataaattggggttaataaaatatatgtgcatttcacttcacgggccacttttaaagcccatgtatgtcgaccaaaacgtcatggcctacttctaaagcccatataatctatgtgataaaaagcataccattggaaattatgtgtacctttttagcgtttttttactttaattaaaaaaaacagtactccaaacgaatgcaactcattgcttattaatttcgatttttagaatcattaaattataaagataatactaaattgagacccccacataagaccaaatttgtagtgattaacttcgaattttagaattattaaaccaaaaaaaaaagctatagttgaaaattgaaaccaagcattagctcaatatttattaattacgaattcataactattgaatcaatacgatttaattgaaactccaaactgagtacagcttgatatatttattaattataaattttaaaattatcatatcaaaaggagctaaaatttaaactccaaactgaaaacaatttgaaatttatcgattacgaatttcagaattatattgatactcatgaaaaaagatgaagttgcatcttcaaaccgagtataattaggtactgatttattccaaatactatatcgattatgtgctgtttattgttgatttttttttcttgcgcgatgattcgggaatactggtgggcatcgaaaacgtgcgtgctgatcaccccagttagttgctttcgcctaccagaacttgattgatgcatacacagcaaaaacatgcatccaacttgccaatatgtatagacagtatatagtatagaattggtcgtgacgctgtgacgtaaccaatctcttgacagccctttcccctcatgaaacagtcaaggaaaatttctggttttgcatgtgcgataggcggcggattttcttaaccaagaccacttttcggcaagttgccaaaaagaacaatattctcccctcgatggatcgggacagtcacaaaacttttatcatcaaagcagagtagtggatcaatcgtttcacaaatcagaatactctgaaggctgatctgtgtccgtacttgttctgttgtctcctgagaaaacataaaaaccgcagccactgctcagaagtagtacaactgtacaagtcggcaagtggtttgtgtgattatgtttgttacttcacgcaatgagccgtctagccttgtccttggctcgctgctcgcatgtaaccgaagttggtgaggctgctcgctgctggtgtcgcgctgtctgcctgtatctgaccaggtcgatctacctgtcaaagactcacggttgcatcgaaaatacatgattaagttcatgattagcagtttagcgccattactattcctagcacaacgaagcacaaatgcacaatccaaccgaactctgacttcagcacggtcaatcttatctaaccacccaggctagctaactaccatcatacaaaggacagaaaaagattctcgttttttttaagagaagccaagttattgctttcgcttgaaccaggcgagcaagcaagcaaagccgaagaattgttacacggccaaagtggaaaccacctcgtggtgaactgcaaccagctcatagatatcttgcacgtaatcttcctaattagctagcccattggtatttggtcgtggtcgttgaatcataccgagagcctaacgttgcacctgcgccgcgtgccaccatgtcatctcaggcgccgtcggcgccggtcacgccggcggctccaccgccgcagacgccacccgtgacgcctcctccggtgactgctcccccgccggtctcaccccctccggtgacgccaccaccggtgactcccccgccggtgtcacctcctccggtgagtcccccacctgtgacacctcccccggtgagccccccacctgttacacctcccccggtgactcctcctacaccggtggctcctccaccagtgccaccgtcaccgcctccaccgacgccgaccccaacgccggtgacgccgtccccacctccgccggtgacgccatcccctcctccgcctgtcgcaagcccgccgccgcccgatgtcccaaccgccccgccaccgagtaacaaccccccgtctccgccaccgtcccccagcaacgtcccagcctcaccaccgccaccgcgaatttctttatccccaccgccaccgcccttgacgccgacgcagtcgggtgcctcctccggctccaagtcctccaacaacgggaccgtggtggccgtcggcgtggccgtcgcggcggtggtcgtgctcggcctcgccgccggtctgatctacttcttcgttagcaagaggcgccggcgccgccaacacccgccgccgccgcaccacccgggctacccacccttcccaggtacgtaagcgcgtattcccctcctttcattggcagtgttggtcgcgcgagatcatgctacgtcgcggccacgtcgacgcgacaatgcgcgacgcggggtcccccaagcctttttcggtgttagcgcgatcccatccacgcccttcgctgcggtcgtcgcgggtgaccgatggtggtgatagcgacacatcggcatcgcgtacagtgcgacgtattccatctcgtccggctcgtgtccgcggtcttcgcggcgcacactcgttagcgtttgaccattttgtatgctatgctcgtgaaaattttctccagggatgcatcgatctgtgcgcggcgattgagttgagctgatcgaatgttttttttttccctgttttgttgccgtgccacctgcagccgaattctacgacccgcaccggccgccgtcgcagcagcagtcacacgcgctgtcgccgagcccctcgtcgacgccgccgctgctgctgcagccgcactcgttcgtgagcagcggcggggcgtccgaggcggcgtcggcggtgccggggatcgcgatgatgggcggcgcgttcgggtacgacgagctggcggcggcagcggacgggttctcggaatcgaacctgctcgggcagggcgggttcgggcaggtgtacaaggggacggtgcgcgggcaagaggtggccatcaagaagctgcggtccggcagcgggcagggcgagcgcgagttccaggccgaggtggagatcatcagccgcgtgcaccacaagaacctcgtctccctcgtcggctactgcatctacggcgagcagcgccttctcgtctacgagtacgtccccaacaagacgctcgagttccacctgcacggtaagtacttgctgccggatgatgtaccattgttgcgtgtaatgctggggcttgcttgggctgacacgagtggttggtttctgcaggtagcggccggccggcgctggactggccgcggcggtggaagatcgcggtcggctcggccaagggcctcgcgtatctgcacgaggactgtgagttccaccttgtgtttcctccgaaatctaaggtggtgtttgggaatctctaacaaaaatataagtccctatgagagagacttgtgcttttgttaaaaggattaaagtttagtcctttcttcctaaacaccacataaatatatgcggaatctgtgaaactgtggttctgataagatggcatgctttgactgttgtcaggtcatcctaagattattcatagagacatcaaggcagccaacatcctgctggactacaccttcgaaccaaaggtaaatcgcgaaaatttggaacctgcaataattgacgttatacgcgtatttatcgcgaaggtgcacacatgtttgtacaggttgcagattttgggttggccaagtaccaagccactgagcagaccgctgtttcgacgcgcgtaatgggaacttttgggtaaacacatcaccatcacaaccacaacaatcaattacacttgcactcgtacgtcaaaagttcctcagtgcacgcaccacgcggactaaactttgtgctgtcaacaacttgtatctccagatatttagctccagagtatgctgccacgggcaaagtgaacgaccgttccgacgtcttctcattcggcgtgatgctcctggagctgatcaccgggaagaagcctatcatggtgtctcacggtgaccagcctgacacattggtttcttgggtgagtgggcttccgagtcttgaaccgaacacgtagatttccatttgccacggccggtgaaagtagtcatctctgtgtgtgtccaacaggcgagacccctgctggtgagagctgtggaggaggagaacttcgaggagctggttgacccgaggctggagaacaactacgacgcgtacgacatggggcggctgatcgcctgcgcggccgccgccgtgcgccacaccgcgcggtctcgcccgcggatgagccaggttcttgccaaaactcctcacaccttcactgaacaaacacaaacacacagcacacaccgcacggcttctggtttcagcaactccgtagcttgtacactgaaaatgtggacactcgaatggtcagatcgtgcgttacctggagggcgagctggcggcggaggacctgaacgctggcgtgacgcccgggcagagcgcgatgcagcggacgagcggcggcacgacggaccagatgaagcggctcaggaagatggcgttcggctcggccaccggtacgggcaccgtcagcgagtacacgagcagcgagttcagcgagccaactagcgagtacgggctgaacccgtccaccgagtacaccaccagcgcagccggcggcgacaccggggaggtgacggtggacgtgcagatgacggccggcgccagcggcgaggcggccggcacggagaggctgagcaggcggaccaccgctagacgtggcgggcgggtgtgacagtgcgacaccggaatttcggtgccccgcccggcgagcccggcgacttttagccgtacgtgatcgtcaaggttgcgatcgaatgaattaaatcattttgttcgtgtatatatacacgtaatgctgtcactgtaaattaaactacattccaaatcccgcggttgtttctttggttttcgaattcatgcaatttttgttggagtggaagtttgtaaattgtacctaccttcactaaccacccaggttaataaacatcaaagatgagatttgtttggaagctggaatgattcgtcttctccttcccgccctgaatatatgtactaaagattctgacatgctacaagttgactgaaagtttcatgttatgttcagatccacaatcgtgccatcctattatcttttcgtttttgaaaactaagctagattatgctggtgctatatcatgtgcaggttgcaacttggaatgaaatgctcgcttgagagcctatgtcgcctgacacagtcgatgggccgaccgatgttgtgggtgcctgggtggcaaacggacccaaagatcataagcctattgttaagtttttttttaataggttccgttaaaaaaaagttgtttttaataggccaagccatagcaaccatcagtacgcagtccctcgtacccgtttagtgtcatatatggatctctattcatttgtgaccatatcaatcgccctttcagtgtggaagattttttacgccccttttttattgaatataggatgagaaaaaatgtgcaaaagtcaaaactttacagaaagagaaaaaactatgggatgatctgtgctaggtatttcactcctatcagagcttaaagttttggcagcctctcacgtgggttagtgttgagaattctttgtgttgaaacactatcaggttcctttctttctatatctcccatatgctcagtaagagaagaatgcggattcctttcctgggcgtcccaggttgctagccatcgttgtccaccagctatggactaatgtggcggcgttctagctggtcggcttgctatactcctgtgccatccaattcgttaggatgccccaaattatccaggtgtatctgtactccatgaggagatgaaccgccgtctcaagggtgcgtctctgcacaagtgcagtatgctatccccaagtcgtaggcctgtttgaagttcagactctattttggatagccagccaagcgaaaattttacatttgtttggtccccatggcttctagatgttcgcattgtagttcgtgttgatggcttcgaggaactatgctttctaggctgagcctaccatgtactctccgggacttgtgagtttccaggtgatttcatctaccacatctagggttagctacacactatccactgttgtctagagggtcactagctagtctagaagctcggttatcattgctcctaggatcaagaggtataggtcttgcgactaggtatcatctgcaatcgcctctcttaaggttctgttctttcttttggagatagcgtaaacctgtggcaacacgtcctttggttggcgtccacacttccaggttgactcccagaagcgtgctattgcgccatccccaatggttattcgtgtcgctgtcggtgacatgggaccgggagtatcatgactagaggcttgggcagccgcggtcacccacgtggcctgaccccctcggggggtcgggcccgagggggacgtgcccaccccctcctctgtctccccgaggggtcgagccgctcctgtttcggccccgagggctggggcgccctgaccccctgtggtattggcgccacgggtgtgggttaggtgggcacagcggcgctcaccaaaccacttttattgcggaatggacaagcgcgccacgccgcatttaatgcagcacggcgcacgcatatccggtccgtgaccggtcgcagtgtgtgaccggtcacagaccggtcagatcgcgggttaggtggcagcaggcggcctgtcacacgcctcgccccgtcccgtcggaatgatgagagcctcttgacactcgtccctagctggagccggcgtggtaactcctggagttagcacgtcagtcccgactcgattcatgccaggcttcatcgcaaccattgcaaggaagtcactgtatgaagaagggcagatgtgcggcatgctaaactgacgcgtggtggagaagaatgactggtctgtgactggactgatgccggtcacgtcatcggcagacaaccgtgctcccacgttgcatctgcttccggcggagtggaggtaggtatgacccatcccatcggagggtcattcagacagcggccattgcagatctcctcctattaatgaagaaatgacagggtgatcccctgtgtccgacgagcgacggcgctgggcatcactcaaggacaagcggtgatttagcttccaggcggaggcgtgagtcaagatttggtcaagatagggtgggtccccacctagaagaagagtaggtagaagtagtgcatgtggtatccccttgagatataaaaggaggaccttgcccacctaaaaaggggggaggagatcgagagtaaaaaagaacgagaagagaaggaaaaatgggggttctagagcttgaactctcttgctctccatttgctctgtaactccttcacacacagatccaccagaacacaggagtagggtattacgcttctcagcggcccgaacctgtatacatcgcccgtgtcttgtgcatttgctctctcgcgaacgttccacagatcgagggtgaagaacctcactcagcgcccccggccgaaccggcaaaggggggcctgcgcggtctcccggtgaggagcttgccacccgcgtcggtacactcttgggaggatttgtgccagcagttcaccatgaacttccagggcacatatccgcgccaaggtgaagaagcggacttgcatgcggtacagcgaggggacgatgagtctcttcgctcgtaaattcagcggttctgtcaagtccgcaataccataccgtgtatccccgcacacgcggtgatctacgcgttcagggggggcgtgcggcacaatcgcatgctcgaaaagatcgcctccaaggagccctagaccaccgtggagctttttcagcttgcggaccgtgtggctcgcaaggaggaggcctggacctggaacttctctggttccggtgtggcagctccggccgcccccgggtccgccgctcggtcagggcggcgggacaggaggaggaagaagaggtcggcctatttcgacgacgaggggcacgtcctcgccgtcgagggcgcttcgcgggccacccgaaaggggaggcctgcgagcgacagaaagaaggaggccggtgctcccagcagggagcgcccgaccggcaagtggtgctccgtgcacaacacctccctccacgacctcgcggactgccgcgcggtcaaaagtttggctgagcggacgaggaagtaggaggaggagaggaggcagaagcgccgtgagggcaaggtcccggcggcccccgccggcaaccagcgaggtgaggccaagcagaaggcccccgccgaggacgtcgacgatggcgacgataacctggggttccaggagcctcaggctactgtcgccaccgtcgatgggggagcgtgcgctcatgcttctcgccggagcctcaaggccgtgaagcgagagcttctggccgcggcccctacccatgaggcgacgcggcgggcgcgatggtcggaggtggccctcaccttcgaccagaccgaccacccgccgtgcgttgcccggggaggacagatcgcgatggtggtttcccccaccatttgcaatgtgaaattgaggcgtgtcctcatagacgggagtgcagccctcaacatcctttcccccgcagcctttgacgcaatcaaggccccggggatggtgctccggccgtcccagccgatcatcggtgtgacgccggggcacacttggccgctaggtcatatcgaccttccggtcacttttggtggttccgccaatttccgcacggagcgggtgaactttgatgtggcggacctcagtctgccctacaacgcggtcctagggagacccgcgttggtgaagttcatggcggcagtccactacgcctatctccagatgaagatgccgggccctggtggccccatcaccgtccatggcgacctccaagtcgcgcttgcttgtatggagcagcgcgcggaccagctcgccgcggcgtccaagcccgagggtggcgacgagaggctcagcgcctccgtcccggccgccccgaggcagcggatgatcacgtgcgacgaggtcccggtcaaggaggttgccctgggcgacggcccgtccaagaccacacgaatcggtggtcttctggacgacaaataggaagacgcgctcgtctccttcctgcgggcaaacgccgacgtcttcgcctggagaccggcggacatgcccggggtccccagggaggtgattgagcaccgtctcgccgtacggccgggcgcaaggccggtccggcagaaagtgcggcggcaggccccggaacgtcaagccttcatccgcgaggaggtggcgcgacttctggaggccggattcatccgtgaggtcatccatccggagtggttggcgaacccggtcgtcgtccccaaggcgaacggcaagcttcggatgtgcatcgactacaccgacctcaacaaggcatgtcctaaggacccttaccccttgccacgtatagatcagattgtcgactccaccgcggggtgcgaccttttgtgttttctagatgcatactctggttatcatcagattcgcatggctagggaggatgaggaaaaaactgcattcatcacccccataggaacttattgttatacgacaatgcctttcgggttaaagaatgcaagacctacttttcaacgtaccactcgaatttctttgggtagccagttaggacgcaacgttgaggcttatgttgatgacatggttgtgaagacgcgcaaccaagagaccttactctcggatctagcggaaactttcgaaagtctccgctccgcccgcataaagctgaaccccgacaagtgcgtgttcggcgtgcctacgggcaagcttctcgggttcttggtcactgcccgaggcatcgaggccaaccccgagaagatacgagctatagagcggatgcgccctcccagcaaacttagggatgtgcaatgcgtcaccggctgcatggccgccctaagtcggttcatatcgaggctgggagagaaggcgctacccctatttaagctcctcaaatgttccgggccgtttacttggacggaggaggctgaacgggccctcactcagttgaaggcgtacctcagttctcccccggtcctggtcgccccgaaaccagatgaaccgttgctactttacctagcggcaaccccgcaggtggtcagcgcggcgttggtcgtggagcgcgacgaggacaaccctcgctccgcgcacccccaccctgtatcgactcgacccgggagagagcagggaggagaggcccccgagccgaacggtggcccgatgcccccgacggccggagctggccctctgcccgcttgtccgacggtgccaggcgcccccgaccctcaggatggccccggggccactgcgggaaggccgcgcctgtcgccctccgaccccgaggtcgtcgacacagaagccgagtgcgcctcgcgcggcctttcggacgaaaagcaccctggagatgcggctggcgaagaggatcggccccgccgaaaggtgcagcggcccgtctacttcgttagtgaggccctccgggacgccaagacccgataccctcaggcccagaagatgctttacgctattctgatggcttcgaggaagttgcgccattatttccaggcgcatcgggtcacagtggttacgtcttaccccctcggccaaatcttgcataaccgagagggtactggacgggtggtgaaatgggcaatcgaactctctgagttcgatttgcactttgaaccacgccacgcgatcaagagccaggccctcgccgactttgtggcagagtggaccccagctcccgagcccgtctccgtccccgaggccagctcgggcccctcgcagctgcctcacaccgcctactgggtgatgcagttcgacgggtccctgtctcttcagggtgccggtgcgggggtcacattgacctcgccgagcggagacgtcctcagatacctggtccgcctcgactttcgggcgaccaacaatatggcagagtacgagggactccttgcgggactcagggtagcaactggactggggatccgccgcctcctggtgttaggcgactcccaactggtcgttaaccaggtctgtaaggagtaccggtgctctgacccgcagatggatgcttacgtgcgccaggtgcggcgcatggagcgccatttcgacgggatagagcttcggcacgtgcccagacgggataacgcggtcgccgacaagctctcaaggctcgcttcctcgcgagcccagtccccaccgggcgcctttgaagaaaggcttgcccagccgtcggcgcgacccgaccccataggggagacggacgcgcctgaacggcccccgaggcccgtcggagtccaggcctcgggacccgaggggagcgctcccagctcccttagatcgattgcttggatcccttagactctacccgaggaccgcgaagggagtgaacgcgtccagcgcatctccaagcgctacgtgctggtagaagggaccctctatcgacgcgcggctaacggagtcctcctgaagtgcattcttcgggaacaaggcgtcgagcttcttgccgatatccatgaagacgaatgcggagcccactccgcctcacgcaccttggttggcaaggcctttcgccagggtttctattggccgacggctctcaacgatgcggttgacctggtccggcggtgcagggcgtgccagttccacgccaggcaaccccatcagccggcccaggccctgcagaccatacctctttcatggccgtttgctgtctgggggctcgatatcctgggtccgttcaggcgggccccggacgggttcgagtatctgtatgtcgctatcgacaagttcactaagtggcctgaggcttatccggtcatcaagatcgataagcactccgcgcttaaattcatcaggggcatcactgctcggttttgggtgcctaaccgtatcattacggataacggcacccagttcactagtgaactcttcggtgactactgcgaagacatgggcatcaagctctgcttcgcctcccccgcccaccccagaagcaatggccaagtggagcgcgccaacgcggaaatcctcaagggcctcaaaacaaagaccttcaacatcctcaagaagcacggcgacttgtggatcgaggagctgccagcggtgctctgagcaaaccgaaccacgccaagccgagcaaccggggaaacgcctttcttccttgtctacggcgcggaggcggttctcccatctgagctcaccctgaggtcccctcgggccaccatgtattgcgaggctgatcaagatcagcttcgcagagacgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggctgggatccgttcggctggccacgggcgacggcacagagctgcctaactcgtggaacatcgaacaccttcgtcgcttctacccctagtgggggtcgggtgtcaggtctcgggctcaggccaaccccgcacccccccgggcgtgcagggttggccgggggctaccacatacagataattgtcttttttctcttccgtatttcaataaaagcattttcggtttcctaatgactgtgtttgtgccattgtttccttttgtagaatcttgactttaattagcacgctcgtgctcgatcctgccctcggtggcccgggccggctaaaatcgccaaaaggggcccagaaccgagccgtgccccggggcgtgatgaactccgggggggaatcggcaaaggcccacaatcgggtcatccataaccctcggtcaccacgctcccggcctggccagtctcgacatgtggatctccccaggcactagctccggcccgcgccgtttgaggctgggacccgggcacgagcccttgttcaagccaagacacagaaggaccgcggcacagaccatcctcgtctcatacacacaacaaatagaattgacacagaaatttcctctttatttgattgcagattaagttagtctatacaagaaggggacccgaaggcctcggaagaagaaataaaaaactatataagattggcatgggcctgggggctcattccgacgcgcccgggtcgccggcctcatcgccgctgtcgcccgcaccgccgtcaccgccctcttcgtcggagtcgagggcgaacgcgagccggggggccgtaccctcgaagctgtggacgatgtggtcggcagcgtcccggacctgcgcgcgcgcatcgtcctcggtcccgggaggaaactcgtccagcgctgcccacggggagaagtccgggtccctggcctggtagcttgccagtacgagctccaccgccccccgggcgaggtccctcgaggatgacttgatcgtctcctcgagctcctcggggagccgctggagggtcccggccatctctgagaggcgctgggcgaggcccccctggttggcggcatacttcgcagtccgcccgccccagaggcccgcctgccgcccggcgcggtctatacgggagacggcatcccgaagcatgccgggccctacctcgcctgccaagcggagggcctcgacctccccggcggacgagtccagcgcgccctgcagctcggcgatggtgtgttcggcagctgcgaggcgggcggctaggtcgccgtcgcccgcggccgccccgccgctgcgcgccctcgcgtccagctccttcgcccgcgcctcgagctcagtggcccgctgatccagtgcggccctctcggcgcgggcgccttccagattacggcgcgcctgctcctcccgcgctgcctctgcggagggacaggctgtccgacagccgatgcgccgcggactcggcctccccgagagctcgctcccgctcggtgagcgcgtcctcgctgaggctgagtgtggactcctcttctgcgcacgcggcctcgtgcgccgccagcgttgcctcccggatggcgacggcggcctcgcggtccgccaggtccctctccctcgcgcgggcgcgctcttccagcgccttggcacgagcctcaagggcctcttcgcgccgccgggacaccgcctcgttctccgccgcccgccgttcccgtgcagcggcggcgtcaaggactccccgggcggcgtcgagtttcttctctagctccgccgcccggctcccgtattggaggcggagatcgtcccgcgcctcgttgagcacggcggtggcgatgagggcagtctcccgctcctcctccacctccctggcgatctccgccagctccctccgacgggcctcgagctctgaggcgtgccggcggtgtgccttgcggcccgcctccaccatggcttccaccgagcgccgcccctcctcgacgcgcgcccacgccgcgtcgagctccgtccgctctgctagcaggacctccatctgggcacctagctcgtccagcaccgtggtgttcgcggcggctaaggcctgcaggaggggctccgcgttcagtggggcagcggaaggcagaggggagagccgcctcggtatgggcgccgcgcggctcggcccgccgatcgacgtgccggacccaggggcgacccccgaagctggctcgtcccaaacgtcgcccgaggggtcgggcccgagcggtgcgcccgcgacctcatcgtgggtggcctcggaagtcatcgtcgcctcgggcggagtcgggtcgggggtttggcaggccgcttggcgtgcacgcgccacctccgcctcccgaacggactcctcggcccggcggagtttggcctcctcccgagcggcttcctcagcctggcgaacccggacggcctcctgggcagcttcctcggcttcccggaggcggtctgcggcttctcgccggtcagcctcccgcctccgggcctccgcggtcgccgtctcctcggcctcggactgtccggacttggaatgacgggaggagcgcgacgggatctcactgaggcagaagaaaaaccagaggacaaaaagaaacgggtgagtgaaaacttgccttgggagatgggagaatgaatacggccgcagtgggcgcggggacgaacctgcgaggaggtcggctaaacgaccaccttgggggagagataaggtttccccggcgtggttcggtctcccccatcttgcggcgccgcttcttctttcgctccccctcgggctgcgacgtcggcacggcaccatccaggcgcctgctgctggcacgcgccgccccgccccctcggggaggagatggggaaggggtaccctcctgcttcctcttcccccgggcgtcggcagggtggctgcaccccgggcccccatcgtggggcccagaagcatgaccccctcccagggtagattgttcccccctgcggctcccgcccgcgccatcgtgacctcgaggagcccgctcctccgacgccccgaccgcctacatgatggtcaggatgttggcgcgatctggatcgctgcagagggggaggactccttgggggatgagggatgcctccacggagctgagattcagcacccgttggaccaccatcttgaagtcctcaggggcccagtcccatctgcccccctggtgggtcctcatgtagtcctcggacccggtgtactcccaggcgcctctggcgcgccgctggagcggcgcgatctggcgatgaaggtagtcgccgtacaccatggccctcgtgagcccctgggatcgcagacctgccaggcggtcaagaacggcgtcgtagccgtctcccagatctaccggcgcccgccagctggaggcctgcgccgggggctggctcggaagtcggaggcgcgtttcatcggcgaggggggtgtagaaccagtcgctcttccagtcgtcccacttcttgcggaggacgcagggaatgtagcggttcagcaccggcccccgcggctggaagtagcagccaccgactaccgacggcggcgacaccggctgtacggtgaagaaccaccggaacagccggagagatgggcgcaccccgatgaacatctcgcacaggtgcgcgaagatggccaacgtcattaccgcgttgggggtgaggtgcgccatctggagatcgtaaagttccagaacatccatgaagaaagaagagaatggtgggaccagtcctgccattgcgaaagagaggaagaagacggaccgccccgggtagtgtggcgccgggcgtccctcacccagcgcgaccacctcccggccggtggcagattccggcatgaatcggcgcggcagcccggcctgcctctcgctcacgatgcgggaaggcggcagcacgctaccgtcgagcggtgcggagccccgtgccatgacgccggcggaggaggagcttgagaacgagtgagtgcggcaagggtagggcacaggaaacaaggagttagggcgcaagcggcgaaggcaaggggaataatggcgagaggaaggaaacgaatctcttccttggcgcctttatacccttgccaacgttatgcccggctcctcgtttctcgcgcccactatctcgccccctcgtttctcgcgcccacgcctccactaatcctactcgtccgtttgcggcgcacgaggcggatgtgcggccgtggcagtcaagatgggacatatcgtgcgcgtgttaactacgctcgccgaccgaagcgccatcatcatatctccaggcgaaatgaacctgctcgtcccgattcgcgcgctactcgagtaatgtaacggtcttgaagaggccactcattgttatcggtcgtttttccctagccgatgcacgcgatttgcgaccgctgggttcctgcccgcctgtagagagcggccccacctgtcaccaggtctaaagagtggcgtcacgcccgagcgcttccctcgaggggggcgatcgccctggcataacgccgggggctactgtcggtgacatgggaccgggagtatcatgactagaggcttgggcagctgcggtcacccacgtggcctaaccccctcgggagggtcgggcccgagggggacgtgcccaccccctcctctgtctccccgaggggtcgagccgctcctgtttcggccccgagggctggggcgccccgaccccctgtggtattggcgccacgggtgtgggttaggtgggcacagcggcgctcaccaaaccacttttattgcggaatggacaagcgcgccacgccgcatttaatgcagcacggcgcacgcatatccggtccgtgaccggtcgcagtgtgtgaccggtcacagaccggtcagatcgcgggttaggtg

SEQ ID NO: 80645 - DNA, 14338 bp, Oryza sativa
tctttgacatcagcaaatgagaaggtcaagaggggcttacttgacaaggttcatgctttatatatgtctgatggcaacctatcattcgataaaccagttaagaagagttgctatatccgcagtgtaattttggacaatgaaaactgtaccacttttccaccagtcttgttgaagtttgaatttcttggatatcttgaaatccatggagttgattgcaagaaacttcctgaagcaatctccggctgttggaacttgcagtcacttcattttattcggtgcagcggatttgtgatgttacctgagtctgttggcaaacttaagaagctaagaactttagagctaaattatgttattgatcttgagagtttgccgcagtccattggtgattgtcaaggtcttcaatccttgcaactacatagctgtaacaaacttcaaggcatgccgacttcgataggcagaattgagaacctaagggtgcttcatattacgtcgtgtccatgtatgcaaaaactaccgtcagagccctgtggggagtccaacaacctggagataatcaacttatctaattgccacaacttccatggcctgccaagcacatttgcctgcaaagcattgcgtactcttaatctttacaataccaagattaccatgttacctcaatgggtaacttcaatcgatactctagaatgtctagaccttggatattgccacgagctcatggaatttcctaaaggtatagcaaacttgagaaggcttgcagttttgaacttagagggttgcagtaaactacgttgcatgccatcaggtttcagacaactgactcgtttaacaaagatgggtttgtttgttgttggatgtgatggtgataatgcaaggatctcagagcttgaaacccttgatatgataagtggtaagatgaaaattatcaaccttaaatatacgctggatccaactgatgcagataaggccagcttgaagaggaagaacaacataaagtatctggagttggactggtctcgaggtgaaactgaaaaggagttagtaacagatatggtcatggagcaagacctggctgtgctgaacgctcttgaaccaccatcccgaattgaggaaatattaatatattattatggaggtccctgtttgccatggtggatgaagaagcaaactgattcttcttgctgggaaagcacaatgttaaagcaaaccaatccatgtcagcttatttatctaactagaatgacactacatgaaattccaaacttgaagcatatgcaaggacttgttgagttgcctttgctgaattaccttgaactatttggattgcctaatttggaggacatgtggaccacgacaggaggtgcagaaatcaggggtgatgaattgcaggcaaaatactgtttccctgccctgtccaccttatggataaggggctgtccgagattgaatgtggtgccctacttcccatcatctttggagagactttttttaagagaaagcaatgatcagctgctatcttcaggcagcttctcccatctccttcctccacttgcccatgaatcttctccttgcagcaatgcgcactcagcggtgccccgactgaaggaactaactataattaaaatgacaggatcatcgtgtggttgggatttcctgcagtaccttgatgcactagagtacttcaatatttttggcagcaatgacctaacacaattacctgagagcatgcgaagcctcacctccctccacaagctaatcatccacgactgtcccacctttggcatgctgccagaatggcttggagaactgtgttctttacagtccctgtttatcaaggggaccccaatgatggacagtctccctcaatcgattggctgccttacgtccctcacgcacttgactattgcatgcgataatttgaaacagctgcctgagacgtttcaccacctcacctcccttcgagaactcgacttggcaggatgtggtgccctgactgcactgccagaaaacatcgggaaactctctgcacttgaagcactatatgtcggaccgtgctctgccattcaatgcctgcccgagtccataaaacaccttactaatctccggcgattgaacatttctggttgccctaatttggtcaagcgttgcgagcaagaagtgggggaagactggcagcttgtctctcatattcctaatttaataagtgactaaggctctgagggcagcatccgacccttggtacgttctggagtacctgtcactgatttgctacatcagcttgtgtttgctaatgttctaaggtccctgctttatttttatgtatgagtattgagtttacagtagtctcttatactggtactaaaagcacttgtatgcttcgtatttcaagtttcaacacagtcttgcctgcctctcttccctagagtgtggttctacttgttcctcccaatataacatgtcctctacaatcgcactcctgttttcttctcgtaatgatagatttcatgccgatgctaataaactacgcttcttgcgtacaggttttcagattggagaaagtgataagaaggattggactgtcgaagactgtctgctgagtacatttcttcttctgctggaccattcagaaaatgcttccgtgcttcttttgtactgtatgctgatcatcttagatctataccgtttaaagagtgtggagactacaactttactctggatctcgtcttttgtacttctgtatattggtcatcttactctgctagagtctggtctcactacacgcgtttggttagcatgtgacatgtttttgctacttactcttgtggtttctgtgaggagtcacatttgatcgatcaattactcttgagcttcctggaagcggtggtgatcaagcttcttttcctgactaagcgatatcctaaactgtacaagggaaggatatatatatttgtagtctgctttactgccatttcatgttttgctaaattgtcaattccttatcctcagattcatcgtaaaaaagtatgttttgaaatcatggaaaaaagtctaatcataaaagttggtgattgcatggccctttctttatgtatcattttaggatgcaggccgtggcaccttcgtaggtcactacagtagttcatttgaattcctaaaagcttatgaaaacattcagctagttcaagtgtgtgttcactcctataaacattgataaggacagaatgaaaaggttttactcctattaacattgagaagataactggacaaaatgcaatctgaaaaccgcatataagcaggcaagatgttctatgaagaatcctcatatcgtccttggccgattgaaccggaaacgaaaccatgccaattctatcacgcaaactcgggtagaaaatattaaatccattaaattcttcttgcttgacttgaatagattccttgaccaccttacacgggagcttggccccaacaaggccaaatagcaaactaaccaaatcttatctttaacttcttgtcttttaacttaaaacatatctatctcttatccatagcagcatatctcctaattaaataaaagcaaccagccattgcggccggtgctacagtaaccctgcagataattagcacaaagtacgcctagataaaattcattaatcccaaattgaacaggagaatattattcattaatcccaaattgaacaggagagcaagcatggtacgcatggcaatagaaagaagggtagaacggcggcgataatattggacaaagcaaaacattatgctacttactgtaaggactgaactttctgaagttctgaattaactaagagcaaacaccatatcaactcgtaacaggacaagaaggcaacagatcaaggaaactaaattggaggaatcgaaacaccagtgccaaattaagaagttttgcttgtattatatcatgtccgaacatgtaagattgggctgaatgccagttctaaacataactgaaacagaaaagatgctatttctttcgacactgtacagaagttaacccctatgttttttttctacaaggactagagggctacgaacttgtttcactgaaactgctggctttgtacacggagcacctactatcagctgaacaaatagaaccaaggtatagaattgttacatggctggatttaagatctggacagcacaatcagacatctggaatctatagcgacaaagcatatgcaaataacccatctatctaaactgatcttcatgcacaattgatttggttgagcaaactgttgcacatatcatgtatgtggaggcctcggcaacatagagttagccagttcttcattcaactttacaggaaggggtggcatctgcctcattatctcaggaacatcgcctatcctgctataaaattgaagaaattgttgttacataattgcagtttcacaggacaagtgatgaaacaacagcaactaacttaatcaataaataacatctgtatttcaagatcacatggaagaaagtgttcggttattaaaatgtagcagaaaagcattgatataacaaggaggggactaaaatgacattgcaacttattgatatagaatttaggccagttagaaacttagattccaaagtaaggggactacttggggtacaatctgaagtggagaagaaatgaatttactttagaagactcaggaatgagagaaaaaaaaaacataagagccagataaacaatcatgggaagacaaatctggtactcaaatcccgagttattcaagattgtacaaaaagcaaagtagagaatcttactccttcaggactgcaagtatattatccctagtttgacataaaagagggatgttctcctgcacctacaataaatgcaatcattattagaatattgacagcatagcaaatatcaggtgaatgtgacaggtatcagtcatacctttgtgaaacaaaacaatcatacaaatttcggaagaaaaatatttggaatacattcttttaatatagcatacattcaaatggctgctcctttccccaacgtacaagtatataaccatcatgaaatgggtactaataaagtaaaacacctacagttcaatggaaattgcattatgggtttcctggacccgtggttctattaccaagtgaaattcttctagaaccttgcaattattgatagaatgcttgtccatgcgtgatttacgggcaacttaagaaactaattgcaacactacatcttcagcgacaatgcataagaaactaattgcaacactatatcttcagcgacaatgcaatgtaaaccacagccaatgtagatcataatagccaaaatattattcatataatcttatcatgctggggctgagtgctgaaaaaataacagagaagatagaactagaagtacctgcatgtttgaaatattggtatagatctggttcaagatctgtgcattgtgctcaagaatttgaccagtttggcctccaattgctgcaatgacatggaaagcactgatcaaatataatatcttaattcaacgcttaaaatctcaacatagtgataattgttatattaatgaagatgcttctaaagttacagcatgcaacttcctattcctattatatttaaaagtaaatagtactctactactggatcacaaacaggataacatcatacagtataaatatttgcaagcatcatgttctactatttactctattttaaattttcatacatgctctggaaaacttcaggtttggacaaattacaaataagttcaataatatatattttacataataaagcagcatcaacaaggtcgaagagaaaaaaataaagaaggaacaaaggattaaatagccacatgcctggaaccataatatcaagaaaaaataaaagcaaacaaatgagacaagaaagtacaaaatatgagtgctagtactaacaaaacacttacttttgtatgacacatcatcatcatccatgggaagaactggaagagaatatggagcagcattaggtcgggccactaggtgagctggcccttttgatgaagaatcattggctctctcctacaggttagtaaaaaaatatacattttaatcatgcaagaaatttaaaaacaatgatgcttcttttaaaacatctattcatttttacatatttacatccaaacacctatgcatttttacatatgtgaaacactgactttgcatgtgccaccttctaggttgctaaaacacttaaaagctagtaatctgccttttaaaacttcactagaaagaaagaatgtcggttaccgctttcatgaaatcaatagcttgccaaatcaggaacaataatagtgataaaatagggaatcagtagacaagtgagccagatggtaaccttcttttctttgtttttcttagatgactcttccttccttttcttgttactctcctttttctgcaagagatgaaaaagttgatgagattatataacaatatttgttaggcagaagaactatagtgcatgtaatatgaaacatcagaatgtttgaaaacaaaattcactagacataactatctgttgatggcaatactggtcagtttgcatggttattacaagcctacaacttcagttaatttttataataaaaaacaactatgatgcatgacttggaaggattcatttctgaaagccgactgattttgaaacagatgatgtgattttggcattgatgtagtgtggatgtagatttaatcgtattcactagtgaagaagataaaagatgatgatcatgatcatgatcatgatataataataataagaacagtaatcatgatgaaagttgtaggtggtgctcaatatggtattagtaatggagatgctagaacctagcatctatgttagattcactatataaacctgatactccctccgtcccaaaatataataacttttagctctcaaggtttatcccaaaatataacaacttcttgaccaacattctcttctcaaccaatcacaaccctccaccattcaattttctcacctacctccacttctcaaccaatcacaaccttctcccatttaattctacctactttcttaatacctgtgtccaaccctaaaaatccttatattctgggacggagggagtaattgcacaaggaactagtaacaggccatccggaaaccattggctaagcatagcaaaaaacaaagtgaaattacttgattgatttaaacaattaagcaactaataaacataatgagaatgataaaataataatatgaggtactgaattatctcaaattggttgattggcatgggatgcttgataaacataaaagaacgatgtattatagaatttttgggtgggaaattcggatgcgctagatatattacttaataagacaagctgaagcagtgaaacataaacccatctgtcaattatcataaccacaactttcctgtatagaacgagctaaagcaaaataaagagcaaacaaatatagaagtacagcaggtgatcagaatccaacttacagccatccatctgcaacgcagggccacatctcgcactgtcttgtcaggcagattcatagcaatttttgcatagcgaactacagctgcatccgccgcatagctacaataggtgtagtcagaaagtaagattgattaacttaattgttgctacatataagtgcaggacattggaggatttgagctagcttaaatgaggacaaaacaaaaatagtacaattcaagaattcagattccgtacaacaattgtggtaatgatggggacattaaccaagtgcatgaggccactacatttattgccagaacaacaaagaacagatagtgttacatacacactacgaaccagaacaaggtggctgcacaatatcccacggtccgtcagtcccacccgaaacggatagactggtgttatgtgaaactaaatttaagtttaccctggtgtaaagtagaaatttatgcttaagtcagtgcattgtgaaacgtaagtcaatctaaacggtgcaagttctcaaaaaaaaacaaaaatctaacgagtgcaaactgtaatttactctattaaatacaagcctccaccactgcactgagtaataaaacgacaactgaaatcctactacaggccatttaagaattcatctagcaaggaaaccctaacaaacaacatgataaatgcatgcctacattttgcagaaaatgtgcgtgttccacaagtcatggtactaatttccatttgggcttccaaattaccaaccaaactccaacgccataaccgatggcagttatccgtttctatacaagcacttgagcattaccatttccttgtcctgttcgcaagtcatgcagcaactggcatgacctgagccctaacagtaacatcgccattgcaactacgacaaaaggaatttcatcctagatagattatatgacagcagctacaactgcgaaattatactcttatcataaaggacagaaaaccttctataaccacttgctcatgaatgacaacaaaaaaccttgcagatattgaatagaagatggggaaaaataacctagccaagcataactactccccataaggaagcatgcaaacattcctacccaaggataacttgctatcattcactagtaaaggaaacaagtaaatattccatcctagacgggaaagtggagaaactatagcaaacatgtagtaaaataattccattctagatgagcagtggtagattagaaaataatcactaaaaccaccatacccacgatccaagaactccccaagatcgatgccatctacaacgctcttccacctcctaaccagactatcaatcaaaagtagtagaaagaacggactattccagagaatcctccttctacgagttattagacgaagggaagagaaaccctagaaaactcacctggccagccctccttcgagcacggcctgctcctcgggcgtccaccggacggagagccccgggtcgtggcgcagcgccgccgcggtgctcgcgcccggcggctgggccagcgccggcgcgggggaagggttgcggtggtggggcccgcccagaagcacccccgtggggtcggcgttcgcccccatctcgccgcctgccaccgccgccgccaactcggcaaccccccctcaggccaggggacgacggtcccgcccaaacccgagggaatctcgcgaaggcgcgcagggattccgcggaatcagagctctgcgcggccgggcggcggcgtcggcggcggcgagggtttggattctccggtggcgcggccggcggcgagtcgggggacggggagcgaggaagggagaagggaaacgaatgaattttgggctttttattttgtggggggtagatggatggatggcctggattggaactcactgtgagtaactgccttcaatcatgaaaaaacggtaagttcctgccttcctgcttcagttgagtcttcctttcactttttttttttgctagggtaaatatgaattgaaggcttccacttttatttttccgcgtatattttttaagcgtatgtctccattatatgatatatacgcgttccggtttatatatagatcgagagttagaacacttgtactacttgcctcatctatagacgtgtgtctgattaggtaggttgatatatagacgcgtgtttgactaggtacgttggtacggagatgtgtgtccgactagatacacatgatacatgaccccacctcatcatggggtcgacgttcgcctccatctcgttgtctgatatcattgtcgtccctgggagacgacggtcctatcgagtcttacctaaatcactcagagaggcggacgaattctacttgtatgatagtcaaatcagagcttcacgcacccttggcggtggagacaatgagcgtttttagactatccgaaggtggacgatggcgaacgggggacaagaagtgagaaggaagcgtgagatgaatatgtgcttttttgggggtcttggggttagatggatggctagagctcactgcctccaatcatgcaaatgattatatgtgaatttctcgtttagtcgcatctccatttcgtttgggtaaaggggtaatgtgaatatgaaggtttacgtccgtgtttctgtatatattttatgtttccgttatacgttgcatcccactctaataggttaatatatagacgtgtgtttgactaggtaagtgttacatctaatatttgtctgattagatgcacatgaagtatgatatgcggcggcggcggcggatccggaaacggaggacttggtggccgcggatccagcgtgggggatctccggatctaccatggcatctccggtgataatgacgataacgatgggaggggcggagccagcaccagtccctctcccgtgcacatcccgcagcccctccacctacaacgacatgatggttgcaagcgactacgacgacgaggatggtgttggaggcttcgagcgacgatgacggcgacaaagaaggctgtcggtggcggctgtgagcttctactgttagggtttcttgttttttttcgattttctcttttcgcagtcgaacgaattaagcattggcatgcataaatccgatttttcgcatggttgccctagctgcatgcaaaaatccgattttcacatactttttcgtgcatgtggcaagagcaaccgcatgcaaaaatcagttttgaccgtatgccaaaatcgattttgtagcagtgataggatgtgttctaacttctaatctggagttaggttgggctatcgtttatcgtgaacatgtttcctaaactgaaaatgataagtttcgtgaaaaaaaacttataaaagattcttaaagaatcaataaatccattttctaattttataacaattattacgtaattaatgaatcgtgtgctagtggcttgtttagtttccgcggtactcccttctttttcatattatattgactttttttctagtagtttgactaaatttatagaaaaatatagcaatatttttaacacaaaacaaacatattaccaaaagatatagaatgttagatttaatgaaaccaaattggtgtcgcagatattgctaaattttaataaatttaattaaatttaaataagtttaactaatgaaagattaaatccttttataacatgaaacaaagggagtgctacataactaaatagaactgctatatcaaacttagtgctatatagtgttatatagttgccttatcagcgattagcggttacacagatgggtgaaaagagcttaatatgctgtcaatcatggaattgtttatttatttatttcggtaaggttctatcagtttcatttctcctttcctttttctttccgaggatagggaaattgtcatgtgaaactgcaattttagcttctattattattattattattattattattattattattatcttttgaccagatagtatatattattaattattggatggcgtgtgcatgtatatacatatgttgtgatcgtagagacatgtgtctatgtaggtatacgaggtgcaaaacgaaaaacgatgcataattaaggtgtataggcaagaagcgtacttgatgcatatctaattgtttgtgttatttagtgtgggtaaaatgcctaccgtacgtggttctccagcacaatccaaatgtttaaaattggtaagtgctctaaattggaatagaaaaggaaacggtgaactttatcatacgtttccaagtatttcaattaaacttggtgctattataacttataataaatcttgctagctccttgatgcgaaaaaactcaattttttaaagaatacactctctaaatatggtcatttcctattaaatctggatatatgggaagtgccaaacagcaaatagatgtatattttgaaaaaaaaatgtttcttcactcgaaggtatccatttggctatgtcctcatataactatgtacggatcaaaatatattctcataaaatctattggctattgcctcccacatggcgctaccatatttagtccgggtatttcaactcccggattcacggtcctagttgcatacccgggaataaaggggttgctaaccgggagtgtagatgtattctcccgcagtgtgatatgccccaaagacaattatagaaattataatactatatttatgtatttataataaagtgttccttaatatagataacttactattgatcaatgagtatgacttattcataatacttcttatgtatgttactatttctaaataatttctaactaaatgtcataaagtaaattgcacctaaccccacctattatatctaaattgcacaaaaccacaggggttttgtttggtacgtggcacataaccacatatattatagccataaagttctacaaaaccatactattgatgtttttgactttcatctagttctataatcatatttcaaatttatggttctttatccatcatataaataaagtgaatatatatcacatccatatgagtacagttttttcaaaatttgacacatgagtatgttaaattggttaacgatgtagttttgtgaaatttattactataatacatgtggttatgtgtgacgtgataaaatccttacgattttacgtaactggaccataataggtgaggtttttatgaaatttactgttgattgttcctcttattaaaataatctatgtaagtattatgtacagtattataacttgttttgtcagttagggcattttgagttatagttctgtaaatttgcactaattttttttattataatgaatggtcaaatgtcatgtccaaaagtcatcagtgccataaaatttaaaacaaaaggaatatatgtgtgtgcgtgtgtgttttagcattacaacacattttgggtcagatgatagaaagtaaacggtatggaaagtccatgatgaatactgttcggttttaaagtatacggatgatttttaaacgttcgtgaaaattcaggatgtaaagtagacttttcgcacatacaaactgttggcagttggtctggctgttttgcatttcagtattgccaatttgcagtcattttcggacctgttattatttgctatttctaaccttgtcaaatttttacaatagtgaaaattggccatgtcaatttaattttttttataaagatcaactagggttttgttttactactgatattttattataaaataaattaatcatcaatgtataatattgaaatccgtataaaaaaacttggacatttatatttttatattttaattggaggccaaatggtataaatgctaaaaaaaatgttaaccatgactttttttcacactctgtccaaagtttaattttaaggtttacagcctcagcatagcatgaccattaattgctctgatgagatttttctcaggtagcatagtaacaagctcggaataatacatcctcttgccaattccccgagtaatgtttcaacggcaatttccaaccacacttttttatcgccatatgtattagagtttttgccaacaaaaattagtacaggttcttatactttattaaatattttttctgccctggcgttgaactgtgatcacatgatcattgaaaagaccttcagccaaactatcatcaagttgctccctgtcctctggatcaaaatagttcaataatcaataccaattaccaaaggtgcatgcattgttgctggaaacaacatagaaaaaacagccaaacattttaatattgttctaaccaagatttgccggtgcgtatgcatgcatcaaactatatgaacatcagtagtccagatgaggtgcctaagcatccttttgttttcaaatcctctctcctaagtcaaaatgttcaaataatgctaaaaaggataaatagattagttatagtagtagtacacgaatgggttctggaagagattctccactcacttatttaatagagacttgtttgaccatcatgcatcaaccgggtgcctgtatatatgttgccatcgtgtttgttgacctggttagccaccaaaaaggcagacgcgtttaggaaacggtaaacagagatcgcacgttagtacactgatactagaacctgacataattttcataaatcaattatgaaaagatgaacaaaagtgtaaattctaaatgatttaaatttgtcaaaatttgcctgaaatgcatgggaaaagagatccatttcagctagtggcaagaagattcttctcttctttgctctgtcatcagcaaacttcaaagaactcatctacaaggattaattagtcatt

SEQ ID NO: 80646 - DNA, 1087 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagc

SEQ ID NO: 80647 - DNA, 9190 bp, Oryza sativa
catctcgaagactgtgtcgagatccaaaaatgcttatattttgggatggagggagtattgtttaattttcttatatagtcatattgtatatataggtgatggactcaataaatatatttgggtcagatcttcatgggccaagcctaaaggtttttcaacacttttgtccggttgagtgatacttatcggcctcaataaatatattgtttcctagtgaagctactttctagaatttctctatagtggaggtgaattttcatcccacgaggggacatccccctcgttgtttgcatgtcatcttggcattcgccgccgccgccgctttctcttgccgacggagtggccatggacaggaggaaacagggtggcgtacatgatgcccatttgcgccatgatctgatcgcctcctggttttcaagcagcagacgactggatttatctcgaaaatgctttacaacggacgttcgatacgacgcaaaaaaatcggacataccaccgagtggaggcgtcaaccactcattcttctctctttctatcccctcaataccgtagcactgtatctcactcgtgtcttcccccttcttcgccggacgcacgcctcccctcctcctcctcctcctccacatccggccatcgccgcctcccatcatcctcctcctctagccgccgcacctcccccctccccctctccttcggccgacgccgccttccctcctcctcctcctccggacgccgcgccacccctcctcctactccggctgccactcctcttttcccattggcggcggcgctcccttcggctgggcgtggccggcgagcttccgtcctcttcgctggatggggtggcacgtgtagggcgacgagcttggggggcgtatctcgcggcgttggctctccccccaccggcgtcccctccctgcaaatcgaggcgcagggcgacgtgatcccctgcggcggcgcaaatcggctgcagccggcgcggggcctatctcgctctccagatccggccagacgcagagcggtggtggtggcagcgggggtgttcgctcgccgaagccatgccgcgcgaggacggcggccggagttgagggtggtggccggagttgaagacacgaaggtgggtttagttttgtgattcactttgttgtatttaaggtgttttattttgttttgattcgatattgcatatattgattttacatgttgcaatcgatatgttttgattgaatttggttgaaacactttcgtctatgcgatgaaacatttttctctggttgatgaaacatgtgaacatttttcaatgaaacattttgcaacaaccgtatgatgtttcagctttttatattttttgttgcactttattgtattaaggtgtttcattccattttgactttgatgtttgcatgaatttgatttcttggtgttacaatgcgccagtccatattgttgaatattgcatttagttgaaacaatcttcctcaaacgctgaaacatttttctctgggagtgaaacatctgaaacattttcattgaaacatttttttctgagggatgaaacatgtgaaacattcctcgataacatggtgcaacatcgtccggcgatttgcaccagatcggacatccgatccatagcagcctccggtttatctgctatctatctgcacatgtacaataaatagaagagaagagcttcaatcgcaatcggaatcggaatcgagtccgagccttacggcgtaccggagtgaggaagagaaaggggaagtggcggcttctatctctactgcggtcttaattgattgatgcatgggcctctgttccagcccatacacccgacctgctgagatacaaaggaataagctcatttgaagtacctggatgtggattttcttccctcgatgggacgtcccctcgttgtttgcatgtcatctaaatagttattaaaaaatttgaaaaaaattgatatatttcaaattaatctatgttaccaaattgtttttcatattttttttatgtctatttaggtgacatgcacgaaatgagaggatatcccatatattccctcgagtgatgatttcactttccggaagtaccttaacttctacagtgagaggaggaaaaagaacaaaatcgaacaaagctgcaaagtttgacagattaattaaagaatcatcattactgcgatgcgaccattagcgttgagtattacatctctctagccagcgtcgccgatcatcaccggcggtagcactggacgtgcaggaagaatcctccgggaggatggcccttgctggccatcacctcgtgtgctacaagtgctacagtaatctacatttactaatgacggattgattataatcttttgtgtatgtttttctattataaactcttctattataaaattttaatgtgtttctgtaaaaaaaaatccgtatttttttccatcgtcgtgtcggtttatttcccacacgacgcaaccgcgctcactcagccaatctacgcattcgcttacagatacacgcgcgcccagctgaccatctgccccttaggctcttggctgccgcagctggacaatggccatgcctcacctgagccaaatggtctaatgggtttttcttttttttattattctctgttttcacctactcactttgatatatcttggtataaataaactggatgagatattatacaatatgtatggtaaatcccataactttatcaagccatgcatttttcatgtgacgtttgtggtgtgtattttttttccactgaaccacttttagctactccctccgtctcaaaatataagcatttttagcatagtgccaagtcaaccatttttaattttgactattgaaaggaaaaaaataaaaaaatatcaataatgtaaaattgatgttactagatttataattaatcaaactattataatatgcaactctttttatttataacattttatttttatagatattattggtcaaaataacatctcaaagaccgtgtcgagatccaaaaaatgcttatattttgggatagatgggatggaaggagtattgtttaattttctttcactgattcacctattgcatatgtaatacttctttttaagaaaatagctggcacatatttttcttaattatttttcttttttgttttccttaatttttggtgcatcttacgtttgtcgtcggcacatcccctcttatcatcgtaatattttctctcttttctcgctctgtccataagtcttgtatcagttttcttccagagttcttgtggacaacacatgaaaagagatgtcctgtacataaaaattacaactatgcctataaaagcccaagcattatgggcaagaatatgtagtacattttgattttctatactcactgtgatgatgcaaaaattgatttccctttggacttaattttggaattcaggagagagtgccatgtccccgcaaaaaaaaaaagaaaggagagagtgccatggaaatggtgtccagtgttgctcaatgctgatagtgttctttcaacggcaaaatgtattgtgtctttttgccagaggtcgacgaaaaccatgaggccaggagattggtgagtgaggttgatgacgttggttgtgcgatggtcgaagtaggagagacctagcaatggtggcactgttgccccaaggttgaagtgggtggtggtccattgctaggtgtgggagttgtagaggtggagctcgtattcccctggtggcctaaacctgttgacagaaagcgcggtgacgatgtagcgttgtttgttgctgatgaggggttcgttaatgtcctgaggttcagggatgtagtgcaggatggagacctcgtggttagtgaaggtgatcatagggccgggatgggtgatgcgcgtgagagacggcgggatatcatcagcaatggaggccgcctatttattgtatgtgtagcagatagatagcagataaatccagtaggctgctagctacttgaaagccaggaggcgatcagatcatggcgcaaatgggcatcatgtacacctccctgtatcctcctgtccacggccgctccctcggcaagagaaagcggcggcggcggcggatgccaagatgggtactcctcgacaagctcgcctacttctctgacgccgacgtccgcaacgccaccaccgacctccaaaacaagggagggccatgaaatccaggtcaccttgtgcaccgccgcttgcccgccgctcgtctcctacgtgtgcgtccactctcccaccctcaaccctaaaaccaattacttcgccatggagccccagatcatcgccgcacacgatgacctcctcctcatccgcctcatcctcggcataggtaacaggttcaccgatccctcgccgactacttcgtcgaagtaacagagcttcaatcgcaatcggaatcggaatcgagtcggacggcgtccgaaaggggaagtggcgggcttctctctaccgcggccttaattgatgcatgggcctctattccagcccatacatccggcctgctaagatacaaaggaaataagttcatctcaagtcccttaacaaagttgcaaagtttgatactagattaattaaagaatcatcattactgcgatgcgaatgcgaccatcacacaccattgacatctctctaaccagcgccgccgatcatcaccggcggtagcattggacgtgcaggaagaatcctccgggaggatggcccttgctggccatcacctcgtccatccacaccctcccgccgtctccgtctccgtctccgtcgcgcgccttcaccatgaactgcgccccgccgccgccgccgccggcgaaccaccagtcgtgcacgtcccacatcacctccaccaccgcgccgtccccgagcaccgccgtcctgttcccccggaagttccacttcacccgccgcgcctccaccaccttcttcccgtcgatgctcaccgccacctccccgtcccgagtcccccactcctccccgcggcacaccaccgccacctcgtgctccgccccgtcagcccggaacctgcaccgcgtgctgtgcgccaccgccgccgccgccatcgccgccggggaagccggcgccgcgcggagctgctcccgccggcttagcaacgcgcgccgcggcgcagcggcgaagcggcgtgcgagctcccgcgccgcctcgcccccgcccaggaggaccgcgagctccccgtcggcgacgacggcgaggtagtagtcgcgcgtcggctccggggacgacgacccggcggcggggtacttggcgtccgtggtgtcccagtagatggccaccaccgtgccggcctcggtgacgaacgaccgggtcccgcgcttcttgtgcaggaactgcggcgagctcgccagcgcgacggccgaccggcgaggcgtcgctgctgaagctgaaccagcagcgggcgagggggacgaccgggaggcctcgtcgacggcgacggcgaggccagtagcaccgccgggcgcggcaccggcgacggtcctggtccacatgaccctgacgaggatctccttgcgcgaagacaaggcggccttgtagacggtcgccgtggccgcctgcagcgagcggtcgagcgcggcgcccgccccggccgcggcagctgaggccgcgaggctgacggcgccgtcgccgaagcaggagaagtctcgcattgctgccagctcgacggcgacagcgagctcaattcggagagatcgatggatggatggtcacaatgggaagggagtctgcagcagcatgtgcagcgcaagaatgttgatcctagtacttgctactagtaaagaagaagaagaagagaagaaaagagggcaaatttaatggcaaaggctcatcttttgggcggatttgtgtgacttggtgattttggatgtttctgccatgattatgcccatgcatcagcatcaccgtgtttcttctctttatttttacctttctttttcaggtgaagttgcaattgcaaatgcaaatgcaattgaagtcgatcggggtagaagagcagatacaaggtatggttggttgggggagaaggcatttaaggtgagcatgtgtgtgcaatttgaccagataaccactactaccatccgacccgctgttgctagtcatctgcgtcgtggcagccaggaacctctttttcttccttgcaaaaaaaaaaacaaaaaacaaaaggatggctttccacttgattaatcaagataattgtttgcatcaaaacgtttattaagttttgcaataaacagaagaacaagtacaacaagggaaactcgactgtcatgtcatgatgattatcttaggatcaaatggccacgatcgatcgtgtgaatggaccacgcaatgcaaggaatggaacagattgaactggagcaagtactcctgctatctgaaaactgaaggggcatccatccatccatcatgggcatcacgaagtgagccaggtgtcgatgggtacagttgcaggtcacaggtgtaggcaggctgatggatgctgcattcggacacgcatgtcgcatgcaagagccgacctgttcctaattaacctgtacattcttatcatggatgttacatcatactcttatcatggttgagtatatgcttgcttgcctgatcaattcttatcatggatgtttcatcatacattttatccatgtatgtaagatcacactactctttgtaaatggatgtagtagtagtagtatttggttgaccgggtctgaccgggatgaaaatggaaattgaccgaagagagaagtaattactggtcgagggaggagagagtcaagcacgaagcagacgtcgatatggtcattagtgatcgtcgacgacgatgatcctttagtccactgcagttttaattgttttggcctaacacaaataaatggtgataggagagtccaggtctgacgtgttcatgcacgcgatacaatgccggtggtattgcagccccgtagactacttcacacttggacatactcgtgcctactcctacacaaacatggtcgtcattgcagtgccgcggttatctcctcgtcgtcgtcctccattaatatttaatcatagtaatcagtgacgtgaataaagtataagtgatgtgatcaatagtccagagaaatatacagtatttgtcaagaaaaaagaggaccaagagtaaagtattaagctaaattaagcataactaagtatgtaatgtgttgtttttacgaatttttgggtggggaacccctatgtctactagtgatagtaactaacttttaaatttaaagaagtgcttgtttaaatttgtagtttaaaattattatatttcgtgactggtggtggagtataaagcagcatatgcatgcgttctgatgcaaagttgagtcctcccttgaaagactgaatgaagccaatggcatttacttggactgaagaagcatcagagcacccgcaatggtaaagtaaggtgctctctataaaacatgtacatctcagcaatagactcgattaatagtaaaccaccttaatagtatgtctacattggtatctatagctctctcatacattgcctcgtttttctctatagactatctctaaattagtagatagctttgctctctctcttcatttaatacctttcaagtagaaaaatatactgacatagatctcttgtagagagcctatagataaccattgtgggtgccctcagagatttcagtactaactctacagtagtacagtggagtcaatgaatggtcatctccgttcccttggaagtgatcaatcaattcaattattcgatgcagatatataaatgtttacatagagtcatagacgtagagacacgggatggactatgacactgttacgctgtaatgctaaacaatctctatctttgacactgatgaccattattgaacaattattatggatcgagtactagcttaattacctgacagttaattagctaggggaagaggagtatacactacagttagaatggaatggaagttaattaggagtagtagcttgatcatttgggcaacataattaacttgatggcaacggttggctcgattcgtaatactcaagttgcgacggccggaaacgtggaatagtggaaagagatggtagcaaagcagccatggcggcggtggcggtagcgcgcatctgatcttatcaagatgcaaacaaagagcagtgcccgcgaaacagcttgcatatatctctcccaaaaacatcagatatatcagaatcagcagctgccgctgcatgccggcttccaaaacacctgctacaattcttcatacctcttcttcatctctccaccaaaacccttttttaccctacacagttccgaagtgcctcagtcagaaaatgaaaggaattagtttttttttctatggaccaaaggaactagcttcttttaagcatagttacgttcttatttttttctagttgattgtccatgcttttcacttgtactagtactccaatactacttactccgttttatattataagactttttaatattgtttatattcatatatatgttaatgaatttagacatctataaagtcttataattttaaacggagggagtactgtacattcatgaaggttcttgtgttaattactggctggcttgcatctgcacgctcgtatgataagatcgagtaacctgatcgatctttgacagcatacaagaacgtttagttatgtgatgtcggtgtccgtgtggtgccagatgtgaatcggtgaacagattagggagaggaattacaaaactacagtgattcttccaaaaataaaaattaggaaaaaaaatctactagtactactggactgcaataccattaattaggtgtctatctccttcgtctaactagtccatgagtttgttctagctcctccgcacggcaacaagccagtagcagctcagctggcctctagcagccccatcgcttggctgataacggaaaattgcgaaatgagatatttacaaataaaaaataatccatgaatgaactattatatactgttcgtaatgatctaaaagaaaaaaactaaaaaataagctacgatgaactaaaatcaactctaaatatatatttcttttaaaaaaaaaataaattttggctaataagtataagtataaatgaaaagataagcatatggaaatt

SEQ ID NO: 80648 - DNA, 1986 bp, Oryza sativa
tcctgcagccccgtagccgatgatgatggcgtcgatggtgcgggtgccctcgatccagccggggagagggtccctgtggacgctggtgatgatgctggggcgggcgatcaccacggggatcccgtggcggcggccgcgccggcgaccagctgctcctgaagcatcatctcccccatggccttggtgaacacgtaggtgttgggccacccgaagtggcgcgccctggctaaacccagatccttcatcgccttcctctccgccttggcgtcgccggcgtcctccagctgctgcctctgctcgcccaccagccgcagctccgtctcgatgtccaggtacgtcccctcccgcagcgtctccccctccctcaacgccctctcctgcaccaccccggacctctcgccacacacgtacgctgcaatttcatatatttttctcactagcttagcttaacttgcatgttaatttgtcgagtgtccgttctaatctcatcgatctcagcttacctgtggagacatggaggaacacctcgagattggcacacttcttggcaagctggcacaggtacttcacccccatcacgttcacatccagagccacgtcgtacctgaacatcacatatatatggattgatcgatcgatcgaccattcatgttcatgtctgaataattttcagatcaaacaacgaccgacctttcgtagaagttggtggtggcagctccattgacgatgatgttaaggtccttggcgagctcttgcaaggtggattcctcgaggcccaggttctgatgcatcatgtctgcagccaatggaactaccttttcatcgatgaaagactgaaaccccttgccatgctgctccttcagaagcccaaacagctccttccctatcacctgcaaccagtactccatcactatgcatatgcatgcctgtagtatacttataactacactagttttcttcagctaattatattactcttcaggcatatatatgattaattacacacacaagcaagaaagcaatcaaattaattagagaggcaaagcaattaagaggatatcacttgatgctctcatatgggccaagctgcctgcagaggtttaataacgatggaggcatgcatgtctcttggatttctcataggattcatttggtacaagtatcaaacatgcatcctcctaaggacacaaaatgaatatgacactactctggacaaaactactacaagtaaaaacctgcagtaatataatgcaattttacagcatttcactggaggacctaccgagtaaacatactgccctggccttctttttggggggtggggttggggggtctaaaatttgtagtacaaatgtactgaaaagaataataatgaatttatatttctgtccatcacattcagaaaagagtcctgctgctacggcggcaccatgttttcttctgaccacaatatagccttttggttctgtattacctgtaggctacagtagactgaattaactgcatgcatgatttcagccacaaatactacacccttcgttcgggaaaaaaaaaactactactacattgggcaggtgttccaattactatccagtaaattgtagtggaagttcagaacacagcaaattagacacatgtatcagcaaattaggctcaatttttttcttctagtcaacaattaataattcggtaatactaccatagatcaatcctttagttaacaacgtctacataacacttgattatacttcaagtacgtactccacttaaatttttagacttatatagcttgctcttattaatcttgtagcaagctccggtgagcatatgcactggtacatgtctgaaccgtgtttcccagccagaattacagatgcctgcatctgctccacattgaatttgggtctgcactgcacatcgcaagaggaggccggaggaggcaggcaattactcctgaccaaacctacgtcacacaataactactca

SEQ ID NO: 80649 - DNA, 10557 bp, Oryza sativa
tgttgttttcttttgcaatgtgttaaatcattgcagaactgttgtttgatgagaaatatcctgttgttgttttcttttgcaatgtgttaaatcattgcagagctgttgtttgatgagaaatatcctgttgttgttttcttttgcaatgtgttaaatcattgcagagctgttgtttgatgagaaatatggtagtctcctacacgtatcgttcgtcatatccatctcgccttatttgaggacaatgctttcctcattgcaatcccttttctgcgccttaattaggtattatactgttatgctgtatcgctatatgtatttacatcgtgctgttcagtcttgtttgcagctgtacaatatgagtttgtttatgatatactcgccctttaatttgttactcatgataacaaactgaaataatttactcatagatctttatcttgcatgtatccatttcgaaaagtttcctttgtcttaataaaagaaatgttgtactagtacatatctcattatatcttcatgtacctgtccatcacttcatcgtcactatatatatatatatatatatatatatatatatatatacaaacaaacaaaaatggtgttagctagaattctcttttgctgagaaagtatcttaattattatttcaggtttgttaatttgcatcaatttataataccttaacttcttttacttcaaacagggattttgttaaacaattgcaatttgttttatgtaaatttaagtacatcatttttcatttcttcgatgaatgtagattatctcagataagataacctgatacttcctttactcttctacatatgaatttgtttagttcatatcatatataaaagaatggacggagtatgttttttatggttttacatcagttgtcagtagcacaacttaagcaaggattcaacttctcttgatgtacttttttagaaatgtgcacatatacaacttaatttcatccatggtacaatttatttttagttcatttctacaaactagagttaagtgttggaagaagataaagaataaactgggatggctggtactgttatatgtggacaatcattcagccttggtagcatttaaatatgttcattttacctggtagtgagtactggtagaatccataaatcgtgcttctatcaataaaaaatcacactctataatattaattcaattttggagctgcaaggcttggtttatctaagaagttactatttataaactaacatttgtcttgattatttgttctacagctggacaatgtattgatcctttcttctacatttggatgccataatatctgattttcttactgttttctttttcagtgcttaattcctatatttctgtcaatatcaacttacccgtgttaatttgaccagggaaaaccactttcatttctcaagattactcctgcaatgttatagacttgtagtctacttggcccgtgcctttataattatgaacattcatgtataatttatgttctattttcgttttatctgatggtctgtggcctactgtggtattgatgatgccttctgttggacagtatgaatgaaatcatcgacaagtacaacacacattctaataatctggggaaagcagaacagccttcgctcgacttgaatgtatgtgaatcatcttatcatactgtgttaatagtaaatactgttcttcatatatattgcatcttaatgttgcctaactacatatagtagtattagataatggttcaaaatgggtcattttatgtccatggccttagggtggcacaatagcaaaatattcatatttaggttttcacatctggtagcattatgatcttatttctgtaccctaaaattttacaaattaaacttaaaaaaacaatcgcatatgtggatcctttcaaagttctcagtatgctctaatgatgtctgttttgttggttgtgtgttaaatatgtaaattatttgttttaattttttgttgctggattttttttaaaaaaattaatacttgcagaaacaatttacatctctcacttcctcatatttttggtgatacactataaattaacattattaaataatatagttctctatctttttctattgtatcttgagaaaaattccctggaatcggtacactatagcacaatactaattctgttttttcatggatcatgaactcaaatttagtactgttagtagtaattagtgctcaggcatgatgtaataggtgccttaaacttatgcagatatattttctaaatgctacttatgcagatagttaatactaacagttcaatcttttcttttcagttagaacatagcaagtatgcacatttgaatgagcaacttgcggaagctagtctccggcttaggtcagttcttttaaccttttttttttaaaaaaaatgttatacttgaggcatttgttctcagatcctttattcttgaggcatttattctcaaatgtatatcattggtacatgaacaaattgtagacaaatgagaggtgaggagcttgagggattgagcattgatgaactccagcagctagagaagaacctggaagctggtctgcacagggtgatgctgacaaaggtttggtgatcatcacccagactcatcacgtagctcgtactatgaacaacttattgattgctatatgattttgcaggatcaacaatttatggagcagatcagtgaactccagcggaaggtaccacctgttgctagattaaccctgaatcatcaatgtagcttggcaacatataatttgttttttcttgcaaaagtagaacctttaaagaagactgtgttgcatacaagtatccgttgctggcttatttgtagttcattctttccaatacatcactgtgtaaaaagttgatttatagttctctccaatacagagtgaaatcacttataattttactgttgcatcttgcatgactaatatatgctgccaccttctgccttttcttgcaagatggcacatgcatctgttcaagcaaatttactaaatcatcaccaccctggccttttccccatggatgagtcggaattttggactaaattccctgcccaacccttggaagtctgcgggttttgttcatgccggaaaagtccttagcgattaaaaacaatttcttctagtccttattgtttcaattttaccaaattatattggcgttttaagtcatgtcccttcttcccccaaattgaaacattgattttgactatcttgaagatcaaattagagggtacccattggataaaataactaatttaaatggaaattgtactttagtttttctgtcctgcatcatttaccatttgcccatttacatacatttaagtattgtagatgtttcttgctgtgttggaaactgatcaaacagtaccatttcttgggaaatgcaatcttatagttaaaaaaagaatctacaatagattctaccgcatccaaaatgttcttgtgcctgcttgtttttattcaaacccttaccaattgaaataagagaacattataattatgtgttgcatattctttgttgcattgcagagttcacagctggcagaggagaacatgcatctcagaaaccaggtataaatttactttctgtaagctcttggtttgttgaggacttaagaccagtccatctgaacacattcgttttcttggtactgaatacaggtatcccagatatcaccagctgagaagcaagttgttgatactgaaaattttgttaccgaaggacagtcctctgaatctgtgatgactgcattgcattctggaagttcacagtcgcaggataatgatgatggctcggatgtatccctgaaattagggtgagtttctgatcactttgtttatgtgctgaagttaaattccaattcaagtttcaggaatattggtcatatgattatttggtttaatggattttaaggatgtgattggtgactttaatccttagatgtattatcatattatcaacaggcaagataatccatttatattattattaaactttattttgtatacatggatacaaattgtgtgtcgtgtttttctgggtattgtttgagaccgagctatggccttttgctaattcttattttcttataaatccagatatgtgtacctttttttaaaaaagatacatgtatacttaatacacatttgataaatgctttttttttctcttccttaagctatactattttatttcattccgcatgtcctaatacttggcaaatgtagttaagccacatttggttctctaattgcttattttctttttcttaattaagctatactttgtttcatgtcctaatacttgtcaaatgtagttaagccacatttggttctctgattggtttgagaagaaggatggaatttgaattcttgcctgggggtgtactcaactacgtttgattacttgtatttgcccttcagtattttgttcatttcgatttttcttcaactctacaatttgcaggctgccttgtggtgcatggaagtaactgaaaggaaaaaaaaagcatccttgcagatctggttggagtcgttgcggcatccaggggagaaacgcttgtgttattcccaaacccagactgcaataatataatcttgcgttggaagcgagatcagttaacctgatttatcatccttgtggctgcatgatgcgatgttccgcttgtactgttcgctaggatcttgactaaactttgagatctatgtgccgtttaattatcccatcgctattggcactccttatgcgatacatcatatatgcactttgttgctatcttaattatgatgcgtcttttgcagcgttctaagtatgatcttgcgctatcttgcattcttgcgtaatatatatacattgtcgctgtcgttagatttcagttcttagctagcagccactagttggtgttaatagcttttccttttcctttcccttttcttttcatgatttacctgtcacgctatttcgcgggctgcaatttgttgcttgagatatgctctgcatggaagaacactatgcagatgcgctccagcattgattttcattatgggatactaacggggtatatgttgctgtgtgctacagatgtacagcgacgcagcagaaaaggtgacagctgcagtatatgtactgatctttccatttaatattaaaaaatctatatctttccgtttgctcgcatatccttctattttggattaagagcctcaccgtttgacttatctgcggaataagctaaataatatgtgttcttagcgatgtaaaagcaaaggctaaaaaaattaatgtcgatgaaaaaaccttaaaatcggcttcaaatttaaggttaaaaatttagattttggttaataagtataagcataagtgaaaagataagaccgtaaatggttggatttcagttgccagatttattcatcagctagagaattaatccatatttggttcactgtagcatcgcctttgttcatctcattggtataagaaaataagtttaatctgtatatataacaattgcatattaaaattgtctttagaaacgttttttccaatattgattttttttactatcatatcttgatctaataaaacagatcaaaatagcatctcaaatattgtaaaaataacatgcccaaaggaaagttactacctccatcctcgttctcaaaaggacgatgtaacatgtgcaatcaaaccatgatttaaaatgtgaaacttatattgctaacttcgtcctaaaatatagtaatttctaactatataatatttatatatggataagtgtttgttgggatacataaccagtaaatatatattttaggatggagggatttgttaaaaaaactttcatttagttttagttaaaaaaaactttttaatcaaagtttaggatgtacttgaaattttttatatagtttaggagtatatggaattttttatttaaaataattctatatagtttagaaaaatagtgataaaatttgtgcattagattgttgatatctcttgtgtttgatttgggggtgagataaggaccctatttttttagaatatgatggttacattatcggttagatatgagggatggaagagtctgtgacccatgtcaacgagttgagaggaattgggttggattggtccgggcccctcaatttttaatgtgtgaagccaatccggatcttagagaaatattctccttgttaaccatctcacgtaaccccaaaccaaacacctcgactcaatctgacgcatgcttaaaaactgaggtggtgtgatagtggatcttgaacagttcttcttcactctattctcaattctcataagctgacaaacatggcccacttcccagctctcccagaaagcagcaaacatctatccaaccaatgaaccaaccaacacaagtcaataacacgacatactactcctacattgctattcatcttatcatagcatctccaacaacttctccatttcactctccaagctaaattttagccattatagtaaaaaaaatgtcctccaacaacatttccaactggccaaaacccttcctccactagccaaatttggtcagccaaaagtcactaggcaaccgtgggccctacacacattcctcctcccatctcctctccggctcctctctcgcatcggctcgacaacacagttctccaagctctcggcgccgtcgcttgccgcgacctccaccgtcctccacaccgtagccagccacagccgccgctatccttcgcgccgtcgtccgccgccgtcctccgtgccgtagcctctgctaagtagctagccacccccaacgtctctctcacttctgctagtgctccgctctcctctgctgctcaactccacggcgtgcgcgtctctctcactgtcttgtcttcgcaccgatgccgccggagcgcgctgtcctctcaagccgcaccctccgttgcagatgagctccaagcaccgctccgctgccgctgctgctcccgcggctgttgaagacgttgtcggggtctggtggcggtggcaggcaaggtgccagtgtcgaggtacgtgctgaggttgtcgtcgtcgcccgctacgaccgccgccgcctccactccatctctaccccctccccattgctgaggtcgtcgtcgtcgccgcgagcctccgccgtcgttgtgagcctctgcgcagtcgccatcgccgcattcgaggtagagggcgtggggaggagacagtagtacatgaggaggaagaagagagatatagcgaaggatgacaaatgggtcccatttgtcaaatacttataatggggatgatatatggagaggctgttggagcgagtagctagtttgaatagccaaattagatggaaagttggttatataggtgtttatatagttcgatttggagaggctgttggagacagggtttcccaaatcgccggtaccggggttactgcgccccggcggtaagcacggttaccgcggtaaccgcaaaaaaccgtgaaaaaccgtgcaaaatttatcaaaaattcaaattattttttaaatttatttgaatttaaggaggttactgtaatatttatattaccgtaccctgcggtaagcccagtaaccacgcggttaccgccgtaagggaaatccttgttggagatgctctcacgcccacgcagaggtccccctccgccccctctgctgtccccctccctcatttgaatcgagtaatcatccgcaccgcccctcccccatcccacagtacacacaggcgccgtcccgcaacgacacacacagcccacgaggccacgactctctccctccccctccccctctccctcctctcgccgtgagcggaacacgaggcaacgccgccacctcgagaagcgcgtcgccctctagggttttagagcagcagcgatggagggcggtggggagggcaccaccaccgccgcggcggcggcggcggtggctgcggggaaggaggaggaggcggaggtggtggtggtgaggaacccgaggtgctacctcgacgtgagcatcggcggggatatggaggggcggatcgtggtggagctctacgcctccgtggcccctcgcacggcggagaacttccgcgcgctctgcaccggcgagaagggcgtcagcgccgccaccggcgtgccgcttcactacaaggtttgtcctggtttggcggtccgtgtgctacccgtagtttttcctggttgcagccttggagggtcgacgcgtgagaggatgccggctgcggtgcgattgatcgtagttggggggtgtttaagctatccgagttggggattgtgtggtttcgcagatgaatttgatgctgtttgcgtactagtgcgatttccacctgacgattatgatttggttgtgcgctcacagaggttcgcatgattcagtaactatcgcgttccatagatttttattcagtaccgctgccattttaactttgttacttagcgcaatttccgcacaaacctcgcggtgaacatttgcacacttgcagcacatttactgctgagcaagttgatccccaaatccaacacaaatccgtttgcatggtccatttggtcgatggaaatagtattttcaggtgtctgcacgttgcaattggttgtttcagctttagctttgatttgtccccttctgtaacaacgccattccaagtcctcgcaggccttttgttttgattcgacaactttgctttcgctgacattgttacggtgtgttcctattgttagttctcatgtttggcgctagtactttgtatcgttccagttagtgttaactgcttttaatccatatggcttatctttgctttagtactagtgatagtgatgtgcttcatgtgccactgcctacaactggtcccggtactcaaattatggtcctatggccctcctttagttttgacgtcatctcactactcacttgcatggtggcctacctactttcttgtctgatcttatgatgtacacgctgaaacataaagcaccttagttttttttttcttttcaaatttgcatgcctttactttctgtggctttattgttggcaatgttacaatgtactacatattcctgaaatgcttaagcagagcactgccatgtttagcctgaaatgcgcacgcacacgcacaagactctaactcttttgataatttcgaccatgtgccagggttcaaaaagttggacatgataagaatactttcttacagttatgtctgcactaggtggacatgatactattccgattgtagattagccttaaagcagcatctgtctgcactaggtggaccaaggtttgtgtagtatctattatttgggaagtaatccaaggacaaactatatggctgtaagagaatcatatgcggatctggttcaatatggtcaacatttttaagtgaggcttggtatttaaaagctaagcttaggttctttagtcgtcagttggaatgatgatggcaaggaaacactaagtgcagtaatagtgacaagtcctacttgactgttgggggggcgacagggatccaactgcgtaatctgtggttctctactttattttgtagtggtggggactctagatgttggctatccttccacttaactgttgtggctatgatgctaattggacagagttagcatcattcttaaccttgaaaggttacaatggccatccattctttgctgaaagaaagaccatgattagcctttgttacattatttcttaatgttcacaatagttttcctttcttttttaccattgtgaatcatcggatctttaacttccaaaaaggttttactgactgcgtcaaccaatctttttttttttcttttggtgtttttactcctccagggttcatgtattcaccggattgtcaaaggttttatggtgcaaggtggggatattaccgctggtgatggaactgggggagagtcaatatatggattgaattttgaggatgaaaattttgtcctgaagcatgagagaaaagggatgttatcaatggctaatgctggtcccgatacaaatggatctcagtttttcatcactacaacccgaacaccacaccttgatgggaaacatgttgtttttggaagggttataaaaggaatgggggtggttcgctcaatggaacatgtttctgttggagaatctgaccgtccaattactgatattgttattgttgattgcggagaactaccagaaggtgccagtgatggagttgtgaactttttcagtgatggtgacatgtatcctgattggccaaatgatctcgaagaaaaacctgcagaaatttcttggtggatgactgctgttgactctgcaaaatcttttggaaatgaatatttcaaggtatgcacttcctttagcatcctttggaaattttctttaggtcatatgaggaaattctcactgcagcattatgtcttgcattgttagaatgttagttgcatcatcgtatgttatatagtaccggatgatgctcatgtccggagcttgtagggctgcaggaat

SEQ ID NO: 80650 - DNA, 1808 bp, Oryza sativa
attcctgcagccccgctgaaattagtaaacatttcataaccgatcactgccgttagagagctttacgaccggaataacttcttgcccaaaagctttttcatattgttatgttttatcatcgggatataattatgttccaagtggcattacgatggttcttttctacctatagacaacttttttttttcatttgcattggcaaaatcctattaaagttagcaaataatactcactctgtttcatattagtataggatgttttgaatctttttctagttaaactttttaaagtataagtttgaccaactttacagaaaagcataagaacattttcaacgcaaattaaatgtaatatcaaaatacatatatttaatattaaagtttgccttatagaaaaaaaagataaaaacatcttataatatggataaaacggaggtggtacatatgatcccaaaaatgatggaaccaaacaatcatatgagacacacaggtccatcacatgagacacaatggcaaagcctgttccaacctgcggagccgtacacgtgtaccacaggccgtggaatcaaccatcctgaaaaagaagagaaaggaaaaaggaaagcgagagggaataatgtaagaaaaaaaagaaaaaaaaagctttggaatgaggaggaggagtggcgtgatccgctccaccaccggcgtcgcctcgccgtggcctcttcctcttcctcttcctccgcgtataaatagattcccctcttggggccttgcctttcgctgtcagcctcagccaaactcttctcttctcttctgcctacttcccacgccacccccaccctcgccgccgattccgattccgattgcgctcgcccatggcggccgccgctctccgcgaccagctcaccgctctcctctcctccatgttctcccaggtgaccacctaccttctccctctcctctcctctcctcttcgccagacctactgcttacggttgcttgcttccaattctagctctaattaatcggtgctctcgtcgcgatctagggtttggtggacgagcagttccagcagctgcagatgctgcaggacgaggggggcaccccgggcttcgtctccgaggtcgtcaccctcttctgcgacgacgccgacaggatcatcaacgagatcgccaccctgctgtgcgtgcccccccccctgttctttcttgcctaattcgatttctccctcgtgctgccgtgctgttaccatgggattgagtttttcccccctccagcttccacccatgtgtttgatcggtttgattttttttttttaacatttgtgcagggagcaacccgtcgtcaacttcgataaggtcgacgcctacgttcatcagctcaaaggcagcagcgccaggtgatcatccccttctacttctactctacatttggtttctttctgtacaccatttgtctgatgatgcatatcttgcctgcctgtggtttgtgtatcaaatgttcaattgacatgaagttcctgcggtgcccttttttcatgtgtaaagtagcagcataacaaaccttttgtttcgcaaacaattgtggtacaaaaccgtcttattgtttgcaaccatcatactggtagggataagtggtatcccactgctcgagccaactgttgttaagcgaacaatggtatgcgtgatagataatggctctattggtctatggctatggcatttcaactaaaattatttttgctaatcatggcaaatgatttcaatttttcattttctggtgtcttttcatatatattacaaaaaacaatagggctgcaggaat

SEQ ID NO: 80651 - DNA, 1069 bp, Oryza sativa
cttgtgctattatatatagagagagtacgagtaggtgtagatggaaaagaaaataaaaggatccaaagtaggtacgtatacacgactttgaatgatcgatacgatgatattttaagtgtgacaatagaagctctctcaggtcgtttcctcctagcatatgattcgatcaagtggttctgttggatggaattgtcaacagtgcttattagcagcagatatactcctagtcctagttaacagtgagtgaagtacagttggagttgatccccatttcgtccatagaagctctcctaaaagagacaacaagagcgagtgagcgagcgaaatacccactgccattcattctaccaaaccaaatcaaattctcgcttcttcttggacgccgggaacaccaaaccaacgaacaaacggcgaatccaagtttcgattcgattcggttcggttccaactccaatccgcggcgccggcggcaacaatggcggcgctccacgcactccagcgatctcagtggagaatgaggactgaggagtagtgatctcgaatcgtgcagagcagggctccgcctccagggcagaggcatgtctctcgcctgcgggctcccgctgctggaatgcgtctactgcctgggatgcgcgcggtgggcgtggaagcggtgccttcactccggcgaccgcgacagcgccacctggggcctcgccttcgccgatgacttcgcccccgtcccgcgcctttgacgcctcatcatggccaactacgaccaccacccctgccaccccctcgacgcccgctgcgtcgtccgccgccgcacctacgccgacacccgcggccgcgtcaccccctaccttctttaccttgaccaccccaacttcgacatcgtcttcgccctccgcggcctcaacctcgccagggagaccgactacgcccttctcctcgacaaccgcctcggcaagcgccgcttccatggcggctacgtccacaacggcctcctccgcgccgccgcttgggttctcgacgccgagtgcgacctcctccgggacctcctcgccgaccaccccgactacaccctcac

SEQ ID NO: 80652 - DNA, 7516 bp, Oryza sativa
cccagagagcaagaattgaagcaaccgcatgtatcccttcccaccacatccttgatcaaggaacggaagcactcaaatctttgctcctacgcatgcacccatcaattcatatactctattgatccaatgctgtgttgatttgcccgatgcttaatcgatcagagacaatgaagcaacacgcgggctagctagtattagatcgacaaggaggaaaatgaacaagtgcaggtctagcagtagcagtagcaatagcagggccttgtatgctctcctcctcacttctcttatactaacagtaataatattgtacctcccgcctccacctgatcctctttcccaatcccaattcgaattcgaccaactaaagcttgacgatcatccgccgccaccgcagctgcaccgccgcaggacgaagcggtgcgccgagcacctcaggtgggcggcctccctcgcctctcaacacaatgccaccctcctgctcaccgtcgatcgcaaccaggccgccggctgcgccaacttcaccaccatccagaaggcggtggacgcggtgcccgactacgccgccacacgcacgctcatcgccgtggacgccggcatctacagggagaaggtggtggtgtggtccaacaagacggccctcacgctgcacggccgcggcaacctcaacaccaccgtcgcctggaacgccacctccaactccaccggcggcagcaccgtgtacagcgccaccttcaccgtcctcgcccccgccttcgtcgcctacaacatcaccttccagaacacgtcgcccccgcccgagcccggggacgcaggggggcaggcggtggctctgagggtggccggcgacgaggcggcgttccactggtgcggggtgtacagcgcgcaggacacgctgctggacgagtccgggcggcacctgttccgcggctgctacatcaagggctccatcgacttcatcttgggcaacgcacgatccctctacgtgggttgcaccataagctccgtgcccatggcgagcgctacgggaaataaagcaagtgacggggagcgtgacggcacaggggagggcgtcgtcgccggagagaacggggttcgcgttcgtgcggtacagcgtggtgggaacgggacaggtgtggctggggagggcgtggggcccgtacgcgacggtggtgttcgcgaaaacgtacctcgtcaacgtggtgtcggcggaggggtggaacgactggggcgaccccggcaggcggcagcaggtgtggttcgcggagtacgcgtgctggggccccggatccgccaccgccgccaccggcagggtgtcctacgcgcggcagcttgaccagcgccaggccgcgcccttcatggacgtctcctacatcgacgccaaccagtgggcgctgccaccgtcgacgccggaactctacggatcgagatatactcccagctagctaggatcacacacacacacacacacgagttttaatttaatttgatattgatttgtaagacaaggatgataaaaacacaagactcaattacaataatctgactcccctgcaagtgcaattcgaatatcatataaattattaatagtcgtcatcgccgtagtcgtcgtagccaccaccgccgccgccgtagcggtcctcctccacccgctccgccacgcgatcctcaaacttgttctccaggtagctggcgccgcccgccagcgccagaccgccaagaacgccggccgccgcgccaaccgccagcccaccccccatgcccatcttgctcttcttctttgcatccacaggaggcgctccatagctgacagcggcaggttgaggtggcgcggcggagccataggcaggttgagtaggagccgctcctccataggccgacgggtatccagcaggaggggccgcggagtacggagccggaggggccccgccataggcatagccatagccaccagttgtagtgttaccgtaggcgtaggggtcacgggacgactgctggtggtagggagcagggtacgccggcgaggggtcgtagtagcgcttgggctcgcggacggcgacgcggacttcgaggcgtccatgggggcggccggaggggcgcttgaggcggagggagcgggaggctcgggcgcctatgccggtgtcggcgaggacgtctcggagcgggaggcgctcggagcctacgaggggcttgaccccgtcggtggcgttggcgtggacgacgtcgaggtagaggacggcgtcgtctaggcgggtgtagggcgggagagggacggtgagcttgtcatcccaggtggggttgtcggcgttgtcgaggtcgacgcgggtggagcacttggcgccgtcgtcgatccacacgacggcgtagggcttgaggtcgccgttgcgccagttgacgttcttgaggtcgcgcgccgaggccaccgtcacctccacctcgtagcgcgacgctgccatggctagtgcttttgctttgtgtaataatgcttgtgctccccttgctttttaatggtaaggcaagtcaggagggcaggtcagcgaggcgcgtgggtgggtgatggcctgatggggaagaaccgaacaagaggtggtgactggacgcgatttggctggtggaggagctgccatgtttgaccgactgcagcgtgggcctgcttccacttgtcaatgcttgctcacctcaaccttcgctcttcgctccttccttcctcccttctttccttgggtcatccatcaatcatccctactaaatccaattaaatatttttttgttagtttaattgcattttggactatatacataatattaccaaatggcagttttcttgcattgtttgtttccaacagcttagcccttaaggaacgacaacacccccactcattcatcgccggtttggtgagggcgtcagtttcttttttttttaacgaaaaaataaattaaggctcaaatttgactttaccttgttgaaactgtgttttttttcccactcatgttaaccgggactatgtttttttacccggaaatgctagagaccggtataccgttggtagtgatcggaacgggatcatccccattgcactatccgtacgacacacacgcgcatgcttgactagtattcgctttatcacgatcacaagacgacgttgcttactcaatgctggccccgcccatgccacgcctacacgttgcaccctttcgaatcccgatggcatcatcttgtggtttgtgtgtagtactagtacgattgttatgttgcatggcatggtaaactaggcaatgacatgttgactaagccatgcttggcaatcttttttttcttttttccttttaatcttttttagttaaatttgcttgattgcttcatttagtgtaactttgaaaatttactctgaaatatttttcatcacttatacctacaagtattatccatcattgataccttgtaagtatcatcacgatacctatcaggtatcatttgtgtacatgaaaataaatcgtcgatacactactaccctataagtatcatcccggataagtacaagtatcatcactcactgatatctcctagatatcatcacgatacatgcaaggtatcatttgggtacctatcataaacgggaatgccaggggacgggataccatcccccaacgggatagctcctcttccaacgcaattcctgctcactcgctgccgttgccgttccgcgtcgccatcgccgccacgcccatcccacaccgccgccgttgctgtaccctgccaccaccgcgcccatcccccgtcgacaccgccaccgccaccgcgcccatcccccaccgccgccgttgctgtcccccgccgtcgccgcgcctgtcccccgccgccgccgccgccgccgtctccgtcctcgtctgcaagggacggctgcaggggaccgactgcgcgtgtcgagatgctccttccccaacgggatgcccagctatatctagtaggaatcacctgatacctggtaggtatcatccaatacctcgcaagtatcacgcgatatatggtagaaatcgtctgatacttgacaagtatcacatgatacctcgcgagtatcacgctatacgtggtagaaatcatctgatacatgacaggtatcacatgatacctcgtgagtatcacgcgatacgtgattgaaatcgtctgatacctgacaggtttcacatgatatctcgcgagtatcacgcaatatgtggtagaaatcgcatgatacctgataagtatcacatgatacttgcaagtatcacctgaaacgtgtgtagaatcgtctgatacctactcaggatcatcctgttgtgtagaatcgtctgatacctgataggtatcacacctgatacctactcgggatcatcctgttcgaaaacgggattccgttatatagcagcccccttttttacctcaggttaaccgggacgatggaaattgctttatcagatttttctttttgtgcatctcttcaagaaagtaggtaggttttgttatgtaagttttttttattgtacagaagatgcacactcactatgtctggattcaaacgtaggattaggttttttgggacagagggagtacatcacattacactcacacactttttttattacatggtagacgcacacgcgaaacaaactccaccacactcgtaaatacgttccctatcaggtacataatattcgtgggtggatttaaaccctggtggatgaagtcatacatccacgtctccaccctcacgccacttgtgctttcccatcataagttttacaccatcaattacgaggcgattactttttattttgtttcaattttcagttatgtctaaattgtttgaagtaacataaacatcttactaagggtgtgtttagttcacgccaaaattggaagtttgattgaaattgaaacgatgtgatgaaaaagttagaagtttgtgtgtgtaagaaagttttgatgtgatggaaaagttggaaatttgaagaaaaagtttggaactaaactcagcctaagtttaaatgctttcaaataaaaacatttctaaagattgcatcatcatatttgatgatttcagaacgcccaaacccaaagcacggcaggaagaaaacctgaaggcgcagcatgggcacggtcgatggaggttgaatgcacgccacatttctgacatcttgtattgccggacgaaaaagaactgttttgcacgaaaggagagagaaggcagaagtggttagttgggggaaatgggctgggcttgttacttgcacagcccaacaaagtccctcaaaagggcctagcccattaagcccattggacgaaaccctaaactctttcctgaggtctttttatgccgccgagccgtccccttcctcttcctcctcatcagattgtttccgccgccgacgcgccgatctcctccttccagttccaggtgggttcttcctcctttgcgtgctgctgctttaatttggtgcgcacatatcgaaggcttttaggcgtcgagtaatcaaaaggcctaatgagctcaaagcttgtgcaagatcgatcgattttgtcaattctccatccacacctttgccgcctccattaggcatctgggatggatggatgttgtccacacttcacttgttcttctttatcaatctttgtttgcttctacttcactagtaatagcatgttatggagattgtatatatgtaatggagtagtaggagtattcgttcgatttgattaactgaactgaactagcctccaggctaagccatggcgagcaagaaccccaaggtgttcttcgacatcctcatcggcaaggccagggccggccgcgtcgtcatggagctcttcgccgacaccgtccccaagacggccgagaactttcgctgcctctgcaccggcgagaagggcctcggcgcctccggcaagccgctgcattacaagggttctgccttccaccgtatcatacccaacttcatgtgccagggcggcgacttcacccgcggcaacggcaccggcggcgagtccatctacggcgacaggtttgccgacgagaacttcaagctgcgccacaccggcccaggcgtgctctccatggccaacgcagggccaaacaccaacggctcccaattcttcatctgcaccacgcgtaccacctggctcgacggcaagcacgtcgttttcggcaaggtcgtcgacggatacaccgtcgtcgagaagatggagcaagtcggctccggctctggcggcacggccgagcgcgtcctcatcgaggactgcggccagctcgccgacgaccacgccaactgattatattagattacttacttactagagtatattttcttccttttacaaggaattttgtgacattgttccgttcttcttcttgtatcaataacaatccaatgttagaaaacatttatttataactatgctcttagccctcaatgttatatagctattgccttgctctgaaactgactgattctagccgaacaacaacacattacacactcacaatttgtgttccttgtgtgttaccctaagaagaacgcagtagctactacctgactagcacaacgagcagattcctacttatgtgttcctactttcacacagtaataattcttccaaaacttagggagaattagtccctactttcacacagtaataatttcttccaaaacttggggagaattagtcaaagtaactacaccagctgcaatgtctttcactgcatgcaacaagatagtgttaagcatttcttctctattattcttgttttttcccttacaaacacacacacacacacacacacacacaaaactgtacaacaagctctattcttctatttcccccaaagccggcagactttcgcctttacccatgggagaactaaggagcaacaaaaatatgctttcctctattgtatcgagatgacaaactacagaatagatggagattatcctgcaaaaagcttgaaaaggaacttctacttgtcatcctgattcctggggcggcagagtcttgagcacatccctcagggcgtaatatatgctttcacatttgtgatcggatatcagattgccagataacagtatcctctgaaaattctccccggcatcacctctccagagtgtatacgactcatcttctacaccgtttatatcctcaatgtccctcttgaggtaatacagagtcccaggaaggaacagatcttctggcacaaatacatcctctttactatccggtgacaatacttcactggtgctcagggggcgatcttgatctttgatggcatctaacaacacaagaaagaccaatgcgattcaatacaatactaaccccccaaaccctctcaattttccacttttgcagaaactgacgattgaaataaataaataatagtaacttacaaaattattaaaaaggcaaggggcttaccagaactagttgatactgtgacaattttagcataatcagcaagcttgcgcgccacatcttgaattgacgaaacta

SEQ ID NO: 80653 - DNA, 17498 bp, Oryza sativa
aagagtaagcaatccaacgcataaatatgcaagattaacattatcaaaaacaaaaatgaacccatgataccatgctaatgcccagttcaagagagtatcaagatggtaataaaacatagaacatgggcttttagctctatcacatttgcattttattccttttcggatttttgaagaaaactatagcacaatcgcgatggtacgcctaatcttatcagtcagcgagtgatgagggcgccaaacagtgtcatcaaatctcaaacaagttttccagttagagctcctgttacaggtagtctcagtgctatcttcagcactacttatgcgtaaacacactcagtagcctgggacaaaagcagtggtaaaacacataaagcatagaaagaacataattgatgcacccatgaacaatcaagcgtgagcattcaaaaggatgtgccgaaagctattgctaagatgataaaaacatggcatatctatgagaaggatattgcatcaaaagcaaacttctagagcaagttgtgcacattaattaagttcaagtgtagattcaatttaagcaagtatcaatgcgcatgaagagcatagcatgaacatacaagctacttaagcacgtgtaacctagacaaaagatctagcttgcataaaagtaagagatgagtatcaaaaagatgtccagtaaattgttaacaaagctctttaatgaaaagatgtataatacaatgcaagaaagtaaacatgatgcaaatgttacaaatgcatgcaaaagaaaagaactccctctcaacgcaatccacaggggtggatcacccctaactcactttgcaagaactcacatcatgctcaatagagaggttttgtaaaaatatcagcatgtcgtttctcggatttaacaaactctagcacaatgtgttgacgaaaaatccacgcccagctaatggtgccaaatctgtgttgatgcgaactatgtcgacaaacacaatgccgggagatctgcttagctgccgggagatctgcttagcttcagtgcaggtccaaaaatttggattcgaatgcgggcgtgccagtcagtttgatattgcgactgacaggatagataaattgatgatcacatagtcgatcgaccaataaggcgatatggcgataccagacgatgttgataggattttgaacacatcggctatatgtccgatatagattctgacacttagataaataatgatataaagacaatcgactgatgataatataatgaaataaatatccaataaaccaattagccaacaatgatatgatagaataaatattaatctgatggttaaagcatacatcggctgggaatctgatgtcattagaatttaaatccaaaagattaggcaatcaataaaaccttgctgcaattggctaaaaccaacttgtatataatccttataagccgatgcaacatttaaataacttatcgactgaaaccccaatgaaacattgattcatgtttactaacttaaataaatctaacttacaaccacaaccctacagggcgaacacaactggatgtagcataaggttgataattacctgatagatttaagcaagccaatatgacaccaatcaaagtgatcatgtattaaatttgactaagacagtaaaatcatcaaagagaaatttaacacatcaaataaaccccccgatgaaacattagcacgaacctatcggcttaacaagactttgattattaataacaattgaggtcggacctaaccgatgcagcacgagattgcgtttaataatctgatctcaatgagtcgataaaactttctaatgcgatggatataacaaatctatttaaaatagcattgtgattgtagagatatgtcggctaagacaagatcagacctaaccaagatagtcctaactaaattgatgcgtctctaaacacaatgcaattaaaaatacaattcaaatatcaggtaggtaaaatataccaaccgaaccagagcaatccaagaggtcaaagcgatggagccttgaacaacaccaatataaccaatacaactaccagggccggcagaacttaggggttaccccttcaccgaagatcaaagacatgcagccccgcgttaggtgccaagttctgcaggtaacaaaaacctcggaaaagagggtgttatgcgccaatattgatccagagataaatggcaatgaccccaagtgtacatatttataccctcgggctgatacgagtcctaatcggacacgttacaagtttcctaaagataaaaagaaagatagaagtcttgatcagacactagacaaaacttaaggaaaattactaaaaactacctaattattagatagaattaaactgttatgccatggtcttcacgattccttcctaaactcgatctcttctagataaaattacatcggctgcttgacttctttccttaaccaaatccactaaagaatcttaccaaattttggtaaattttggcgttaacacaatggtacatttctaaacatattttcggagaaagtggtaccgtatctcaatgtgcttggtccttgaatgttgaaccggattcttaacaatgttaattgcactgttgtcacaaaaaaaacactcaaagacaagcaaccatacaccttcacttgtggttttgaatttaaacttcaaaagcccaaaaggacatctctcataaagaggtacacacccatgggcaaatgggccggcaaagtgactctaagggactactccaaagggctccaaagggagcctactcaccctaacatccacctctctatttatagcccaagatggatgaaatccccctaagataatgtcaaaattgcccttggggcaaaacccatagctcagatgaaatctaggccatccgttgttccttctcctcaaaggaaatatctcagatgtccaaacgagccgaagcttctcatgcgcacgcactccagggtgaacccgtgattcgcgcgaacgcctcctcggccaatcaccgcacgcacttgcttgcatttgcatccttatctgtcacttggtcttgatttttcaatctcttcaaataaccaagtttgacttgcaatattatttgctttgtggagcaaaatcaaattttcaaaattttgcttgaagttgccaatgtttccatcaagggggagattgtgaaacaaattgtggttttgatttattgtgatggaaaattggcgagtgtcggaagtgcaagaaatgtgtgctgactaacacgagtaaggttgtgatatctatgcccgaacaacgggcgttttgtttacgtgtgtgtgcaggtgatcgaagtcaaccttggtcaatggcgaggaccgggactatgctcagggaggaacggaggtccgacgcagtcaagaggccatgtgacaaggtgggactgacgtcaggatccttggaggtctctctaggtcaacggcagatcgggactaaactcatggaagagttgaggtccagaagagtaaaggatgccagttgacacggttgagtacaaggcggtgcccgatgaacgaacaccgtgtcagtagtacttcgcaacgagattcacaaggtcaagtgtgcaagtgtctgagattcgcgaagagtaatgtacaatgctagacgatacatgcacttggacagcgtatgtgtactgtactcatgcaagcaagtgattgggttgcgcatatgtgcacgtggcccaatgccatgcacttgtgcatgagtctgatcgacttggcttggaggaggtcaagccaattaggctcttgcttgttgacccaagacggaggcggtaaggcgtccggctagcagccttgttggcagggaggccgaaccatgctggtccaggtgatggtccaagacgatagttgcagatgaggcctggctagatgcaagacgcagcgagggcatggaggcgaaagccgtacgggacatgcggttgtctcatactcgccgcacaagcgcataaggtcgcataggtggagcgcgcctcccagagacgcgtggtgaacgggtattcggcgagcggcaaagacgtggatcaacgacgaccaagtacgtgtggtgattggccaaggagcatacgcgcggatagcaggccccaccgtagattgctcgtgccggagaagcttcagccttcagctcatctcactggtaggtgggcctagctagcaaggtgcgcgggaggagtggttcgatgcatattttatgtggaaaatgggatctggagcgggcaacaacatggaggacatccgagttatttcctttgagaaggaacaacggatggcctagatttcatctgagctagggtttcacccagagggcaatttgaacattttcgtagtgggatttccgtcatcttcgactataaatagaggggtggatgttagggaaagtagtgtccctttagagccccttggagtagtcccttaaaatctctttagtgtcccttctgcccatggatgtgtacttctttatgagagatagccttcagggcttttaagagtttaaattcaaaacaagtgaaggtgtatgattgcttgtctctttagtgttttctttttaacacctttcgtatcaaagatattctggagttggatttaatttcagtttttgcgctacggtctaagggaattcttcgctaaagattttttatgggtattcaatgaagaatttcaatacactatatacgacgactttgtccaaaaatgccatcgccgttatcgtcgttagggttccgtccattccgcgacattaagtgctataagatgaacaatgtacttaactccgcgacattaagtgctataggatgaacagtgtacttaacagtgcaaaatagacagaaccctaacggcgatggcattttgggacaaaatcgtttgtacgatggtatttcttggaactcacacttgctaatggcattttttggatttggacgcttgtcaatagcatttcttggattatctcaaagatgatggcgccaagaccttgtcacacgttgtaagcaatccacgtcactagatggtcagctccaggaaccatccacgtcactagatggtcagctccaggaaccttggcattgatggaataagccttgtgctcttagtagccttgttggtttttggtctttgtcgttctgttttgcttttagcatcttaggacagcatcctttcagttttacttttagcatcttaggacaacatcctttcggttttgctctttagcatcttaggacagcatcccttttatgctttatgttttcctttcacctttagactagcccgcagctagcaagctatggctataaatatgtatccaacctcccccggatagtatgacttggtactagagccactctatcctgtagtctagacatctcttgctcatccccttcacgagctcccctctgtcctcaaccggcagctggaacatcggctattcctgctcatccctcttcccctgcactgacgagcagcagctcgtcagaggcaaactcttcccccacactgcaggcccccaatagcatgccatgcccgcaggacagtcttagcgctcggtcgcctcgagcgcgcggctccggcaggaggccgagctcgccgcggccgaggaacgccagcaagcggcagcagagactgctgcgatggcagcgagggcgtcaaggctgcctgcggcggaattggtggcggcaagggtggaagtggaagcagcggcggatgcagcgcaagcggcggcggcagagctcaaggctctgcgcgacaatagctccagcagctctgtctccgcctacgacatccctgctgatgagctgacgagggaggcagctcgtgagcgggtggagcaacgggcagccgcgcaaccccacacgcgccgtagcagcagcccagccgggcgtggatgcgtcggcggcgttcctggcaggagcgcgcgcggcagcggtagcccagacgggcttggacgcattggcggaccccttggcaggggtgcgcatgacggcggtgctcccggcggcaacggcttggtcgacggagatcgcggccgttgcaggcggctcgtctctccctccccggaccggtaccgtggacaccacgggattcaggccgtcatcagggaagtcagccccggcggtggttggcctgccttcaccaagaccaactacatcgagtgagctgcggtcatgagggtgaggctccaggtgcggcacatgtgggaggcagttcggtacggcgacgtcgactacgacgaggatcgacgggcactgaaaggatgatgtcctaagatgctaaaagcaaaactgaaagaatgttgtcctaggatcgctaggatgctgtcctaagatgctaaaagcaaaactgaaaggatgttgtcctaagatgctaaaaacaaaacagaacaacaaaaggcttattccatcaggcattgggcttatatacttcttaaaatattaacacaccattagaacaattatacatgtgtggtgtggtgatgagatgcctgctcttgcctcctagcaagcttagttcgaacattgggtgggaatcttttttgttttcctttttttaagtggcatgcacaccttgaatggaccagcaaaagaagactagacaggaaaaaacacccatcatgaagatttgatcacatgatttccaggaacgtaagagttcatttaaccactttaagcactcgtcaacttattatagatgatagcccattaaattcttaatctcatatgagctcatcgccaacaaaatattttagatacaatttttgtgcatcaatattgtgccatgttgtgttacgcattcctggtaatgcatatgtgagctcatatgacagttgataatgagctatattctataataagttgattaatataccaattgtttaatgacatcactaaaaaaattgcactggccaaggatcgaactcaactaggtggcaagtttagacatcttaccactacaccattcatgtaccattatgtggatgggtgtgttaatatgttagaaacatatgagcccagaaccaaagttattggcgcggaccatctagtaatgtggattttgtgccacttgtgccatggtatcaatgctaggatctttggtgacaagatattgaggatgtttgaatcccaagcaaggaaaagcatagcctagcctagcaaggagagttgcttagtattagcaaaagaaaaaaaaagtattgcttagtaaggccaactaactaccgagaaaagctcacccaagacaaaaagccaaatcggttagcatccgatggcaatttgtcgggctaaacatccaagcattgtacttttgcttttttatgccatagctttcatgggctagcttgagcttgctaggccaagcaaaggtaattgcacaatctaaatagaccatgaatattggtgctaatgatcttggagccgagattcaggtccaattattttataagttttgtcaaggtctatttataaagtaagttttcaaatggaccagattataaaagatctagtccatggtctgcttcaaaatcgagctcaatgctctttagaaatcacaacaccacttaaacaaaagcatcaatgtttatgcctcaatcaaataaacatctatagcattagcagtatgctaacaattcctaggtaccaaatgaattgtcaatgacccgagaacacttaaaaaaaccatcttcaggtttagcaacttacaactaataaaattctatcacttgtaaacatcaatccaaaacaaatctattgaatgaggcaatttcaagcaaatattggaagcgctatcctaggtcacaaaagggaatggagacaatgaatgctttaaaatcttctaggcacaggactaacataaacaggcagatacgaaaagcgaaatgtttcatccgagaaagagtaacggggcctttacttgatgccaagatcaatgtgctcctggataccgaagccgaagcatccggtgtcactgaagttcctcctgagcagctcgtactccttgaccttgagcccgctctccagcagctgcatcgccttctcccctctcaccgtcacgtagcacgcgatcttctcgttacgcctgattccgaacgaccgcacggtgtacctcgctgcaaagaaagcgccccccgcaaactctcgtcatcaccacaacgaagctaagagtaaactagagtagagagacggcaatggcggagagcttaacctacccttggagaacaccggggtctgcccgctgagctgctccagcacctgcaagaaaccggagagagaggggggttgaaatggaggttggcgagaggagggttgggagaattttggggggaggggggttggtgaccttggaggcgcgggttaggcggtcgccgctctcgccgacggagatgttgaggacgagcttctgcaccttgatctcccgcatcgggttcgactgcttcttctccgacgcctgcaccacaactcaccacacgcacgcggaagaggggtgttaggttgaggagatgaacagcgatgagtcgggaaggagggagggaggaggcgaccatggcggagatggccgggagttcgtcggcggcgaggagggaggagggaaggtggcgtggcggcgctgggataaaagagagagcgcaaccctaggcggtggctgcgaccaagaggtttctggatgggcccaattgtggtaagtggccttttgaacgacagcgaaaagaatggcccaatgcttcgatgcaaccacaaaatgggccaaaagcccaaattctaccacgtacaaatgtgcccgcttgatgagttttggattatttttgggattttaaatgttctaatggtaagaacattttattcggtatttttgagtaaatttcaaaaaactacatatactttgacaaactattataaaactatagatttaaaaaggtgtatcacaaaactacagatttaggaccgaattcatcaaagaactacatatttaaggtggaagatcaccaaactataaatttagtaataaaattatcacaacagttcatgttttgcatcatgttaagtacaaaactacacatttatcactctaacatagcagtagtggtaggaatttaagctgtaaaatatgtagttttgtgatactctagtattaaatctatagttttgtgataaattttgtgttaaatatgtagttttataatacgacgccttaaatctgtacttttataatacttcgatcaaagtactgtagttttataaaatttactcgtaattttatttgtatgagcaatcataaaaagagatatgaccaacaaagaataatctcaaaatcaaaatcaaattatattattatagattttgattgcaatccaaatatttgagggacctaagagttgtatctcaaaatacaactcaactttttgaaatcttgctctacgaaaaaattacacgaaaatatccgctagttgtaattattgtagctcgagtacatttcaatcatattagcttaactagtcgcaagataaattttagattttctcgcattgccgccgctagttataacggcatttcattctagaaaccagactagaaaatcattacaatggagaaaaaccttagatgtggtgcatgacttcactcacaaggtctaaattctgatgttcataattatgcatgtgtggatacttaactgagattgtggatgtatcaacaggctttcatctctccagttgtatgttaaaaggatgtactcgtaggtatgtgcatgtgcagtgatgcatgtacgtgcatatatattccatataattgagatcacctcgatgctttcatgtgcatatgcatacttttggacaggggcagacccaggccacgggtcaatgcctaggatttggattgaaatctcactacgtagtacaaaattccatcatgtaagttcaatcttaacccaaagtgcaatgggctagcctaggccttgaccaaggctgggtcagcccctgcctttaaatcataatgtagagcctaaatattctttctcttacacggttcccacatagaaaaaaaaaacatgagcaagtaggagtgaatcgctgggcaaatctcctttggcagatagggatgggatcaaatggaagcatcagccatatccatatccaatccatccctctgccaatggagtagttgccctgcaatgcacatccacaggctcgatctcaaccattttcctcatcagaatgcctcagatagtagtagcaagtagtattacatattgtacatattgtgattgctcgagatcgtgttggtgtgatgatgagcgaaggggcgacggcggtggcagcatttatttgctgccggaaacggcatatccggcagcacaatgctttgctgcttctccagctgaattcgagagccctttcccctttcgtcgtattgatatttgacggccgatgcggcgatgccatattgccatggaagaaaaaaaagggaaaagaaaagagagggtgaaatgccaagaatccgagttagctttattccgattttggagatagatctcgcgtctttcctggacagcctacgtggaccctgtgttacgcgacgagaggccgctgctgcatgcgatgcccagcgtttgttctcttcttgtctgattttttctttgtaaaaatattttgcagtccagacagcacatagatagagagagaaaggtaggctgccatttgtgctgtgaacagttttgcagaatgcgatgccattgttctttcgcaccaaagaggaattgccacttgcgatctcaggatgcgatgctgcctatatatctgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtatgtattgatctgacgatcaggttgtctcatcatgcccctagaggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatagatataagttatcccctatagccagtcggataactatgccatgtaggtatggggtacccataatctccacagtagcccctgagaccttcacagtcgaaaagataatcttctctcgaactagattactccaaagctgagtgcttcaatcatcttcgccatggtctccgaagtacttttaccaaatacgaagactgtggagggctgaaaaataaagtcaggtgtatcgactagatgcacctaataggtgtagcccccgactatgtggttaattgaacaaaccaagcatatagtcaaggaataaataatccaaccaaccgagtggttttaataattatagtcaaccaagcgacctgatattaatatgtagcatatgcggtgtgaatccctgaataacatgatccgagtgatataccgactgctttgtaaaatatgatgagtgtaacctaaagttggttacatcattgaaaattcacatagcaaaacagctataaagaagcttatatattgtgaataaagaaatttccaaagtattgggcatacgccatgcgcacactgctttaacagatgtgcttaagtccctaaaagacacatggtttcaccacacccggaaatatatgacatatgtggtataaaatccaagtaaataaactcataaaggatttaccaaccgcctgaaaaatgaccacaatatataatcagcctaagccataatattggtcaataaaaatgcacacttacgtggcgaaaagcaatgatattgtatctaatcaattgcttaaaaacccaaacaacaccttgacttatatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccaagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaataactgacgcagtcggcatggagatgaaatgaccaacatgaagacgaaattgctcatcagaagtaacggaagatgtcagtggtagtaaagatgccaccaatcaaatgtaatgaagttgcataaccatggaggtgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattggcggcaacagagatagccgactatgatgacgaagtttcccatcaacggcagcagagttggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgagaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccggtgccgaagataataaagatgaagtcgctccaccatgatgacaaagttgtattgccgtaatgaagtgaacacaagtcggcggcaacagaagcaaaccggtagtgaagacgcgtagttgtgaagataaaagcaccaatcggcggcagcataatcagtcggcgacggaagatgaagatgtagaggtaagggcactagtcagcagcagacgagacgaccggcgatgaagatgtagatgcccaacaacagcggcataataggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgctagcggtgacatcagtcagtggcggatgcggcggccggccggtgaagacgtagacgcccaacaacggcagcataataggccagccgtgcaggcggaaacaccagtcggcggcggtcgaggtagccggtcggtgacgacgtagacgcccaacaacggcggcataaaggccagccgtgcaggcggaaacaccagtcggcagcggcaaaggcaagccagtcggtgaagacgtagacgcccaacaacggcggcataaaggccagccgtgcaggcggaaacaccagtcggcggtggcgaaggcaagccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgatgttctgactgatccattcctggagcgtaagagataagcttaaagccatgaatcccttttatgcatatctggatctggatcttgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatgaccatcaagcaccgggagtcggcctaggcacttcccaaacatgcatatgagtgacatgagttcgtcattaatggaacaaagtttcacggatcagaatttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgatggcaacgaaggtgagccaacggtgaggacgtagacatccaacaacggcggcataataggccagccgtgtaggcggaggcaccagtccgcggcgacggaggcaggccggcgatgaagtcgtagacgcccatgaacggtggtgtgaccaaccaaccgtataggcgaggacaccagtcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggtggcataataggccagccgtgtaggcagaggcatcagtcggcggcgacggaggcaggccggcggtgaagtcgtagacgcccatgaacggtggtgtgaccaaccaaccgtataggcggggacaccagtcggcggcgacggaggcaggccggtggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattagaaatcaatctaatatatattgataacaaattgaaacgaaaaactcaagtcgagcagtgaggctggatcatgagtgatagccggcgacgtgccatgcaacatgtataagccccggcaactaacagctaactcgatgttctttcggcatgatgccatcatcggaggtagccggcggagcccatcaaccatcatacatgcaaacaggaatcgaatcctggcggcctgtgccactcctgcaacacgtccatctgcaaggaaaggaagagaggagcactcggacacggcaagggcacccaagtaggcgacgatgatggtcgtgtttcgatctcatccagtatatgaaattcgtcaaaatatcaggaaatcaaacaatgattaaaaattaatctaatagagattaaattggaacggtagacccgattgaagatttgagccatcgaaattgatgagattgatctcggggtttcttctgaagttgattccatcgcacttttcgacaggtaattcgacgcaccccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtatgtattgatctgacgatcaggttgtctcatcatgcccctagaggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatagatataagttatcccctatagccagtcggataactatgccatgtaggtatggggtacccataatctccacaatatctttgttatatttaactagaaaggtagcccgcgcattcgcgcgggcatgtatcgtaagctgcatttgagatactcgtaagtaataggctgattgtgttaaaatgtcgtatttgttgtatagtaaactataggcatatggatcttatatcgttggtttgattataaacagagcaatagttagattagaaatcagacgtgaaacttataattatagattatttatattttagttaaataggaacgtaagaggaatgaaaagtttagagcttgagccagagaggggaaggagcggctgtgtagtgatgggcgcgtgtggaggggattttttttttaatttttctaagtgattaagtgaaagccaattattagatgtaattttcctaagatttgcaagatttttttaaaatatgtgacatgccacttattaagatatatttttctaaaagtagattagatagttgaaaataatgttaataggtcatcgatctaggtgaaaaccgttag

SEQ ID NO: 80654 - DNA, 5615 bp, Oryza sativa
caagtgttagtttacatacatacaagattgttattaataataatgaataaacaatttaacttacaagctcttgatgtggtatgccacttggatgtcgacgctcaatttgctcgtagcagccctgaaacttgcttacttccttctgaatgttatcccaaagtgctcaagagagtttgcattcctatcagacttaaaatcacagttagcatggtagtgctctgcaatcctttgccaatatgccttccctggttgctcattgccaataataggatccgagctaatgctttgccatgaaatgcacagttgaatgtcctccttacgattaaagttgcttgatcttttggctcttccttttgcaccatttgttgaagtatgaaggtcttcattttgcattggcaaggaatatgcctcaacatgggtctcttcggacatcatgcacacaaaggaatcacattcatttgccatcacaatctagtcactgcaataagtagataaattgacaacttctccaatcaatctcaggaaaaatggcagatactagctaatatatgttggtagaatgcataatggtagcaaatttttccaatcattagaatttagaacaggttatgctagagctctacaaaattgaattaaaaagaaaaccatatagcaccccaaagcagcttattttttctcttttttaacagtctactcgaagaacctgcatataactaacatcggtataaataaaattgtgtagctcaggaaattaagcagcactacacccataccctctagaatatgatcacaagatttcagctggcacagtgtctcaaagtcatgcatattgaaaatcacactgaaaaccatatagcactatccaaaacttacaattcccaaaaccatattagctcgatccaatttatctttccccctgctaatttcagttacagtttttttttgtgttgaccttattactaatgcaattgtttaactacttgaaatcaatcatcattacatgagctcacctgaccatattatacatggattcagattttcatttgtcaatgaaggagttactatccaaactatgtttcctatacgcgtatgcatggctacttttcatatttctgaaactacaagattaggaacctactttcaataaattagattattcaggaaaaaatcaatcagatcattccaaagaaagtataattacatatggattatgagattaattattgtattaattaacagtcaaacatttgaggaaaacaaaatcacataataaaacaacaaaaccatctcatcgtggaaggttagttcctacccatttcttctccaaatatacattttcgtactgacaacttttctctctaacacgctaggtgctaccatataactcaatccacaaatccactggaaaaatgaaaacatgataccttcaactagcgccagggagaagggcgtcaggatccaggaggatattgccgggtgggcaggtggccggccaggaaggagggcaccagggaggacgcctgcaggggaggagggtgccgccgtgccggccaggaggaggatgttgggaaggaggaggcctaccgaggaggagtgtgacgggcagggaggagggcgccacccgggatgagggcgtcggcaggggaggagggcgctggccaggaggagcggtgtagatccgtggaggcgccgctagcaggatatttcacgcgaaaaaagaagtgcccgcgcgtctctgccgcggatgggggctgcggagaaagcccctgggactgggggcctgaggggataatttggaggccttcctattttaggggctttagtaggggtcttgttggacctgattttttagtctcaactctcaaaattagtataggggctgtgtttagaacctctactggagatgctctaataagcaaaaaggcttattagaaaataaaaatgaatttgcaggtgaaacttttataaatgtgttttttgacttaaaagccaatgttgaaaaagaaactacgttgaaaatatctcaaaattaagcttgaaaatttaaaatttagctttttctttggctgattaggccatccgatgggaacctaggtaggttccaaacgagcaccagctaatttaacagggcagcgaggcgagtcgatcagtcagtccacatcgatccatcgatggatcgtccctcgtccgtgttcgcatcaacgtacgtgtaccacttacacccgaatcgatctcgatccgcatgtgtgttgttctgttcagccagcgcaccctgcggccggccttggcgttttatctacagtagggttttatgtcttggaaacgtctatttctaagggtggtgggtgataggtacaaatggtagatcatttcggctagaaattttaaaaatggggtgaatagtaaattcggtccttgaacttttattcaggggttgaatcagtgttcgttgttatatgttatccaaatttcaaataagcccctaaacattgtcgtgcggctttgacccactgaaaatgccatgaggtcttgcagccaaagtcaacatttaaatatccattttatccttacatttttataaaaaaaggaaatagaaaaaaggaagaaagatatcataaaacaaaggaaaatgttaattctttagttactaatagttttttttttgctaatggttaattgccatactattttttgttattttctcaaccgttctttttgatttactatgaaaatgtaagagtagaatgtacatttaaatgttgactttgtatgcatagatgatatggcatgttcatgcggtttttttaagtaggtctaaggactatattaataccacaactaatcttggggatttctttggcaatatgaaccttcaagaactaaatttatcatgaagcgaaagttcaacgatcttattggttattcacccaaaaaaacattcttacgatcagaatagtgaatcaaaaagaaaatccaaatggtgtagcacgggccaatttgaattagtgcacaacaaaaattttggtagtatcaaagcttgagtaagttttgactctatacatatgtttaaggaaaaagtccaaaataacacccctccccgtgatcttttgaggtagttcgatttacatccctcaattttagtatagatattttctactaccaaactcttcaaactagacaaattaccctctctaacctacactaaggtggtattagtcctacatggcgtacatgtggcggtagtttggccacatattaatctagctagcatttgagaaaataaattttaaaaataatttcagccccacttatcatcctctatacatcttatctcttaccctctcatctttctctctcccatgccattgccacatgtcgttgccttacatgtcacatgttcgccttgtgttacttgtggaagagaatggaggggcctacattagctctcccctccaccaccatcaacgagcttactggcagccattctctgtgaatgatgagggaggctgtcacgccccgaactagtaccgaccggaactagcccgtgacgctctaaattaacctgtaaatcgataccagtcccaggaaacagtgctggtatcacaggaagacagattattacagcaacagaggtctctttattatagagtagaggtacagtcatgttgggctgcggacagatcccgagctcacaactgcattacaaaagggaagcggaagccaggacttggaccaaacaacacaggcgcgacttgggaactaggccgaaaccctaaaactcatcgtagccagcttgctcctggaagaactcctcatcagcaggatccgcttcatcttcttcagcaactggggggggaattatttatatagagcaagggtgagtacgggagtactcagcaagccaggggaaataagtgtttaatgcatgcttcaaggaaaggctgttgtttttgcaattgattttatttaaactctttttgaaaacaactaagtgagtgcttctcaaacgacacggataagacagtgcgtcttgtccggtcggagtatgtgcaatgtatcagtctttagaattgttcaagattggcacccggccaacaactttcaaacggccacccgggcctagctgatcccatcagccgcagattttccaaacatcgaacccctttccacaacagcaatttcacaagcagtagtcaaacaaaactacgctaggaatcacctcacatccgcccatgaccgtgggcacgactgttcgaacagtttgttaacctctgcagagggggtacactttacccacacgacattactaacctggatcacccagcccgtggggattagccacgtcgggagacctccaagctttcatgacaaggcatttccaaagccgacacaggtttaccatatgccgacgagaggggtcccagaccgacaacaggttaggtcccagaccatactgtgccaggaagcccaggggtcctccccgacaccaccccggcgaatccacatgtctctcgtcatcaaggctcccctgatacactagttactcagctaggggtgtcccattccacccatgtggtcgtacttgtcttatgttggatgaaattccaaggaaacgttccttaagtgcaagagcgggaaaccgtacacccggtacgttccccggtccgcggttttggaaattcatttagttcgcaagcaccgacccaggtgtcgggttttccaagtcttttgtaaaacccaagttttacccaagaagttactcagattttatgtttgaaggcggccgtcgatactcgtgcagagtgcacggtttccgaggcgcaactgggtggtcacaagggaacatgggataacaattaacaaaggaaggatcaaatgcaacaaactaggtaggtccgctaatctgccttgcagacgggacaaacagattaagtgcgatcctatcaatgcataatatttttcaagcaacacaattaaattcaaatataggctcaagatgttcaaaggtggcttgccttgctcgagatctggaggttgatcctcgaaatcctcgcactgcgggtcttcgggctccgaaactacacgcgaaacgggacaactcaacaaacggcgaaaataaaaccctattaatgacctctaagcgtgccattagatagatctcgagatttgaggaattttggaagttgaacggagtcaaacggatttacggttgggaagatattgaatttctaagattattggatttttggtctaaaggaaaacgatttaattaaatcctttttgaaaaagaaaagaaagagagaggagaagtagacttccctcgggcggctagggcgcggcccgagagaagaagcgcggctcggccgagctaatgggccggccggcccaagaggattcggcccagtagggcgcgcgggaggggaggagagagggagccggtggaccgggctcatctcgcgtggtcccgggtgggacccgcttgtcagcgctcggctcaccgtgaggagggagcacgtggcgcggcgctagggtgaggtgtggggcgcggtgcacgcgcgcggttcgcggaggacgcggatgcggcgggcccacgtgtagcctcacgggctgcagga

SEQ ID NO: 80655 - DNA, 9487 bp, Oryza sativa
tcaaggattctattggccgactacccccaatgacgcgggcgacctggttcggcgatgcagagcgtgtcagttccacgccaagcaaatccatcagccggcccaggccctgcagatcataccactttcatggccatttgctgtctgggggctcgatatcctgggaccgtttaggcgggccccgggcgggtttgagtacctgtatgtcgcgatcgacaagttcaccaagtggcccgaggcttatccggtcatcaagatcgataagcactccgcacttaaattcattaagggcatcacggcccggtttggagtgcctaaccgtattattacggataacggcacccaattcacttgtgaactcttcggcgactactgcgaagacatgggcatcaagctctgcttcgcctcacctgcccaccccagaagcaatggtcaagtggagcgcgccaatgcagaaatcctcaaaggccttaaaaccaagaccttcaatattctcaaaaagcacggcgattcatggatcgaggagttgccagcggtgctctgggcgaaccgaaccacaccaagccgagcaaccggggaaacgcctttcttcctcgtctacggcgcagaagcggttctcccatccgagctcaccctgaggtctcctcgggtcaccatgtactgcgaggttgatcaagatcagcttcgtagagatgacctcgactacttggaagaacgaaggcggcgtgcggccctccgagccgcacgctaccagcagagcctgcggcgctaccatcagcgccacgtccgggcccgatcactctgcgtcgacgacctcgtcttacgccgcgttcaaacgcatgctggattgagcaagctctcaccaatgtgggagggtccgtatcgagtgatcggcgtcccccggccgggctccatacggctggccacgggcgacggcacagagttgcctaacccatggaacatcgagcaccttcgtcgcttctacccctgaggggggggtcgggtgtcaggtttcgggctcgggccaaccccgcaccccccctcgggtgtgcagggttggccgggggctgccacacatgcacattctcatttctctcatttcagtatttcaataaaagcagtttcaatttcctaagggctgtatctgtgccgttttttcctttttgaagaattttgacttgaaatgaggtcactcgtgctcaaccttgccctcgggggctcggttcggtcagctaaaatcgccaaacggggcccagaaccgagccgtgccccggggcgtggtgaactccggggggggaatcggcaaaaacccacaatcgggtcacccataaccctcggtcaccacgttcccggcctggccagtctcgacatgcggatctccccaggcactagccccgacccgcgcttttcgaggactgggacttggacacgggcccttaaatcaagctaagacacaaaaagaggaccacggcacagatcatcctcatctcatccgcatagcaaaataaaattaacacaaagaattttttcatcatttttgattgcagattataagttgatctatacaaaaaacaggcctgaaggccttagaagaaagaaaaagaaagaaattgaagattggcgggggcctgggggctcaatccgatgcgcccgggtcgccggcctcgtcttccacgtcgtctgcaccgctggcatcgccctcctcgtcggagttgggggcgaacgcaagccgaggggccgagccctcgaagctgtggacgatgtggtcggcggcatcccggacctgcgcgcgcgcgctgtcttcagtcccaggtgggaactcgtccagcgccatccacggagagaagttggggtccctggcctggtagctcgccaggacgagctccaccgctccttgggcgaggtccctcgaggatgacttgatggtcttctcgagctcctcagggagctgctggagagccccggccatcttcgagaggcgctgggcaaggcctcccaggttggcggcaggctttattgtctgccctttccagaggcccgcctgccgaccggcgcgatccagacgggagactgcatcccagagcatgccgggccctatctcgcccgccaaacggagggcctcggcttccccggcggatgagtctagcgcgcgctgcatgtcggcgacggtgtgttcggcatctgcgaggcgggcggctaagtcgctttcgcccgcagccgccccgccgatgcgcgccctcgcgtccagctccttttcccgcgcctcgaggtcggcagcccgctgctccagtgcggctctctcggcgcggacggattccaaattgcggcgggcctactccgtcagcgctgcctcacggagggacaggctgtccgccaaccgttgcgcctcggcctcggcctttccgagagctcgctcccgctcggtaagcgcgtcctcgcggaggcggagtgcggactcctcttcggcgcaggcagactcgtgcgccgccagcgttgtctcccgggaggcgacggcggcctcgtggtccgccaggtccttctccgcgacgcaggcgcgctcctccagcgccatggcgcgcgcctcgagggcctcttcacgccgccggagcgccgcttcggtctccgtcgctcgctgctctcgggcagcggcggcatcaaggaccccctgggcggcgtcgagctttttcttcagctccgcctcccagttcccgtgctgaaggcggagggagtcctgcgcctcgttcatcacagtggtggcgatgagggcagccccccgctcctcctccacctctcgagcgatctccgccagtgccgccttgcgggcctcaagatctgagacgtgccggcggtgtgccttgcggcccgcttcaaccatggcctccaccgagtgccgcccctcctcgacacgtgcccatgcggcgtcgagctccgcacgctccgcctgcagggcctccacctgggcatttaacccatccaacaccgcggtatttgcggcggctaaggcctgcagaaggggctctgcgctcagcggggcgacggaaggcgtggggaagggctgccttggagaagatgccgcgcggctcggcccgccaatagacgcgccggccttatcgcgggccacccccggacctgtttggtcctgggcgtcgcccgaaggagtgggcccaagcgacgcacccgcggcctcgtcgcgagccgcccccggacctgtttggtcctgggcgtcgcccgaaggggtggacccaagcgaggcgcccgcggcctcgtcgcgaactgcctcggaagccgccatcgcctcagcctggcgaacccgggcggcctcctcccgagcggcttcttcggcttggcgagcccgggcggcctcctcccgagcggtatcctcagcctggcgagcccgggcggcctcccgggcggcctcttcagcttcccgtaggcggtctgcggcctctcgccggtcagattcccgcctccgtgcctctgcggccgccggatcttcggcctcggactggccggacttgggatggtgggaggaacgcgatgagatatcactgaagcagaaagaaaaaccagaaggcaaacaagatgggtaagagaaaacttgcttttgggatagaagaaaagacggtcgcaatgagcgtgggacgaacctgcgagggggtcggttaaatgaccaccttggaggggaaattaggtttccccgggatggttctgtctcccccatcttgcgcagccgcttcttcttgcgctccccctcgggctgcgatgctggcgcggccccctccgggcgcctgctgctggcgcgcaccgccccgccccctcggggaggagatgggggaggtgttcctcccagcttcctcttcccccgggagtcggtagggcggctgctccccgagcccccgacgcggggcccagaagcacgaccccctccgggggtagattgatcccctcggcggctcccgcctgcgtcgtcatggcccttaggagcctgctcctctgaggccccgaccgccgtcataatggtcaagatggaggcgcgatctggatcgctgcagagggggaggataccgtgggggatgagggacgcctccacggagttgagatttagcacccgttggaccagtatcttgaagtcctcgggagcccaatcccatctgactccctggtgggtccgcatgtagtcttcggacccggtgtactcccaggcgccccgagcgcgccgctggagcggcgcaatccgacgacggaggtagtcgccgtacaccatggccctggtgagcccctgggatcgcaggcccgcgaggcggtcgaggacggcgtcatagccatcccccagatctaccggcgcccgccagctggaggcctgcgccgggggctggctcggaagtcggaggcgcgcttcgtcggcgaggggggtatagaaccagtcgctcttctagtcatcccactttttgcggaggacgcaggggatgtagcggttcaacaccggcccccgcggcaggaaatagcagccgccgaccaccgacggtggcgataccgactgcacggtgaagaaccaccggaacagccgaagagatgggcgcaccccaatgaacatctcgcacaggtgtgcgaagatgcccaatgtcatcactgcgttgggggtaaggtgcgccatctggagatcgtagaactccaggacatccatgaagaaagaagaaaatggcggaaccagccctgccattgcaaaggggagaaagaagacggacctccccgggtagtctggcgccgggcgtccctcgcccagcatgactatctcacggccggtggcagattccggcataaagcggcgcggcaacccagcctgcttctcgctcacgatgcgggaaggcggcagcacgctaccatcaagcagtgcggagccccgtgccatggcgccggacgaagagaagatggagagcgagcgcgtgtggcgaaagaagggcgcagggaagaaggagttagggcgcaagcggcgaaggcaaggggaatgatggcgaaaggaaggaaacaaatcctatcctcagtgcctttatacccttgccaacgctgtgcccggctcctcgtttctcgcgcccattatttcgccccctcgtttctcgcgcccacgcttccactgatcccattcgcccgcttgcggcgcgtgaggtggatatgcggttgcggcagtcgagatagatcgtatcgtgcgcgcgttaattacgctcgccgaccgaagcgacattaccgtatctccaggcgaagcaaatcggctcgcccagattcattcgccgctcaggtgatgtggcagtcttgaagagaccgcccattattgacagccaaattaccataaccggtgtgcatggtttgagaccgttgggtttctgcccaaccatggagaccggtcccacctgtcaccaggctttaggagtggcgtcacgcccggccgcttcccataagaagggcgatcgccctggcataacgccgggggctactgtcggtaacatgggaccgggagtatcatgactagaggcttgaggcagacgccatcgcccacgtggcctggcaccctcgggggacgtcgggcccgagggtgatgtgtgcgcccacctcttggtctccccgagggggggggtcggaccactcctgcctcgcccccgagggccgaggcgccccgacccctcgcgtttctactccacgtgtatgggttaggtgagcacagcggggctcacctaaccgcatttattgcgcctcggttaagcgtgtcacgccgcacgaagtgcagtgcagtgcactcgattatccggtctgtgaccagtcacagaccggtcaaatcgcgggttaggtggcgacaggcggtctgacgcacgcttcgccccatcccgtcaagacgagagcttctaggcactcgtccccggctggagctagcgtgttacatcccagagatgacacgttagccccgatcgatatatgccaggcttcatcctaaccattacaagcaagatgttgtttgaagaagggcaagcatgcacgttgctaagccgacgcgtggtggacaagaatgaccgatttgtgaccggtctgacactgctcatgtcgtcagcacacagccgccttcccacgacgtgcccgcctcaggcagaagtggaggtaggtgtgtgtcgtcccgtcaggaggatgttcggaggacgaccgtgcaaatctccgtccatttatgaagagaagaaaagtccagtttggaaagagaggggtgcatgtggtatccccttgaagtataaaaggaggacctggcccatagagaaaggggatgatcttttccagattcagaacctagaacgagggagaggttggctcacactttgtagctccttcatacacagatccaccaaaacacaggagtagggtattacgcttctcagcggcctgaacctgtatacatcgcttgtgtttcatgctcttttgggaggtcgcgatcttcccgcatacacggagagcttgagatctcaccctgagcccccggccgaaccggcaaagggggggcctgtgcggtctcccggtgaggagcgccgcgctccgtcagacaccgttaactttttagcacatgtttgaccgctcgtcttattcaaaaacttttgtgaagtatgtaaaactatatgtatgcataaaaatatatttaacaatgaatcaaatgataggaaaagaattaataattatttaaatattcaaaaacttttgtgaaatatgtaaaactatatgtatgcataaaaatatatttaacaatgaatcaaatgatagaaaaagaattaataattatttaattttttttgaataagacgagcggtcaaacatgtgctaaaaagtcaacggtgtcaaataaaacgaaacggagggagtacttaacctctgggtgaatgtgaatttatcaatcttttcctatctaatctaatctgatctaacaacacacgtgtgtgtgtgtgtgtgtgtgtatatatatatatatatatatatatatatatatatatatatatatatattagcaaaaatgcccgtgcgttgcaacgggtgaaaaattctaatgataatatatttttttcatacataatcatgtcaatgacaatgtttgtattttaacgaacgacttgtttttctataaacgattttttttcttgcgcgattttctcaaaccattttttaaaaatggcacatttctttctaacagttttttcctagcatgttctttttgtttttttactgacgacgaaaaccatatttttctcccttttttgcttttcttttctcgtgtgtttttttgcatgttttttctaacaattattttctcgtgcgttttttacttttttttcgaatgttcttttttgtttttttccaatacaggagaatatatgacgaaataaaaaccgtgtaatagatgacaaaaaaaaccgatggatcctatccggctcaagcgtccatcaatttagcgttttttcgacagatttttcagagcaatttgtttttaatagaagatttttttcttgcacggttttttcaaaccattttttagaaatggtgcgttttttcctcgcatgtttttttttaaaacaaatttctgatgaaataaaaccgtgtagtagatgacaaaaaatcgatggatcctatccggctcaagcgtccatcaatttagcttttttttctgacagatttttcagagcgatttattttttaatcgacgatgtttttttcttgcacggtttttttaaaccattttttagaaatggcgtgttttttctgacagttttttcctcccttttttttaagtaatttttttaccgacgatggaaataattattgtcacgcggttttttattttttttacggaagatggaaaacctttttagcgtgttttttttgcgcttttttctaacttttctcacacgtttctttgaactgtttttattgtcatgcattttctctttttaaatagttagattagattagacataacgaagattagaaatcggaatttggttcgcccttttcattttttttctcgcgcgcattatttattttatatgaaccagctttttattttttacgaaccattttttcttcttagagaatcggacgaacttttttagatgttttttgggatttttttcatctttatagcaattagacctttttttttcctttttaaaggaattagatctagcatttttttcaccactttttttttgccttttataggaatcggatctacggtttttttttgccacttaggagaaacggacttttgttgttgttgttgtttttctttctttttctttattttcttttattgtgcggtttttctttttctttttatgcacctttctgtctttattcttccccttttattattttttaatcaaaaacgaccttaataccttatttcaaacttatatggactcaaatgtaaatataaaaattacagggactcaaatgcaaaagtatagatccaaaaattaaaatcatataaaaatggaatgctctcgaccggtaggtttcgtttttgcaaacagatctttaatccggcacatcaattttatttttcgtttttaagggtgatttagatctagagtcgaactttcttttttcctttcttatagcaatcggactttttttttatttttttcgctatttttttttgacggacaggaatcggtcgagtcggactttttttttattatttttggatcggactcttttttccgcccggtttttttccctcgtttttttttcaccagttttttttcgctccgtttatttttgttggatcggacgtttttttctttctcccggtttttttgggatcggactcttttttcgtccggtttttttcgctcggtttttttctcgtggtttttttgacggacgatggaagcacctcttattttttattttttattaagtagtagatatatatatatacacacacacaccttccgttctggttttgggtgagaagaagaaatcggatcggattgaggaatttagggaaacggagtgtgacctcggtggccgtgctgtgctctcgacggtggagtggaattcaattggccggggaagaagagaagatgaagatgatggatagccagcccagttgcccgttaaaaggccggcctgctaaaaagaaggcccacatatgctactagccgggagcccactatcccgttggttagagccacttccacgcaccagatcgaggcaagctgtgatgctgtctccgccgccgccgccgcgctcgctggccgtcctccattccattgcagtggtgccgcccgccacccttctctcagccctcttcgtctccgggcgagcccagctccttcttcgatcaggtgagctcacgcctgcctctgctcttgcctcttcattttcttcttctttaacctctcacctcgtcgtcatccatcgggaaagaacgccgtgggtggcggatgaggcataagcagaaagt

SEQ ID NO: 80656 - DNA, 3177 bp, Oryza sativa
agcatcactgcactctttccagcgtggaagaaaactctcttcattggaggttgtaccccttcatgattgaaacaaaaaaaatagtattagaaaccacagaaacaagacgatacaaagacacttttgatgagtagattagttgtacaatagtcaccccattctggaagacacaagcttggctagctggtttatcacatccttcatgtcggcagaactggacaagaagctggaagcgtaattctccagcatacctaaatcgaaatcggttcttctatcgatgagaatggcttgcatggaagaatcatctgggcggacagacttgagtgaatcaatagaaggtatgcggttctcctcgagtagatcagtgcagagtgaccagacaaaggggtccatgccatgaatcaagtaaaaaccatctggtatggtattgctgtacgataacgagccattgacctgaaatgttaaaaagagggcatcgaagagcttgagaaatgagattgatatagcgggtttaggagctcagcagaagagatagaattgctgcaggctactaggatgggtcggatagagcaatcatgcattctgatctctaatccaaatcaagctatgtgtgatggtgtgtaaacaaatactagaaatagatgggagtggtgaagagatgaggtgatcacccagaagcgatgcgagagggagtcggcagaaggcgtcgggggtgggagcgggaagggcccggcggtggcggtggcagagtggccggggtcgaggaaggcggggtcggcggcggaggcggcgtcggcgcagaggcggagcgcgagggcgagctggagctggtacgtctcctcggcctgctgcgcccagctcttgcagggggagcccccgggggccccggcggcgggggcggcggcggaagggaggtggaaggggaagtcgctggaggcggagagggagctgccggcgccgtagctgctgccgctggactggcgctggagcacggcggcgtcgtcggggaactgggagaggagggagtaggaggtggtgcggcggccggtgacggcggggaggtccatggcggcggcgaaaccctagccgtggtggtgataggtaattttggtgggaaatgcgtcgggtcgggtagggagggagagaggctggccgatggtgtggtgtggctgatcgtgatcgcatcggtggtgcggagccccgtaaagtgaggagaggtgaaagccggcgcgcgcggtcgctgtttgtctcgaatcgaatcgaatcggatcgtgtctcgctcggtcggatccctcccacaaagacgtacggctgcggtgcggtcgccttgcaggaggcagggaggaacgggtgcgatcactcgctgactctcttccaggttgcaatccatcttaggccctgtttatagtttttttttaaaaaaaaaattcactctgtcacatcgaatgtttgacacatatatagagtattaaatatagataaaaaataattacataaattacgtgtaaattacgagacgaatattttaagtctaattacgccatgatttgataatgtggtactagagtaatcatttgctaataacggattaattaggcttaataaattcatctcgtaatttacaggtggaatttgtaatttgttttgttattagtctacgtttaatactttaaatgtgtgcccatatatccgatgtgacacgtaaaaacttttcacccctgaactaaacaggtccttatatgaatttgacacatatattgttttctagtgaagttacttcctagcatttctctatagcaaagttggatagaattgaagtattctatagtgatcctaaactattttgctacctaatacacgatttgattgaatattttctagtacaataaatttaaacaaagagcaaggagtgtccaatcatataaactaggtagtaacattttcgataaatgaggtgtttgtttaattttgaagtaccaggttgagagacacctttttaatataaacatccaatcacataagtacaatgagtaatccaaggcacaatttttaacaatttgaccctttacaaaaacttattacaagaataaaccgtgtcaaaaacttatttaaaaaatgaaccacgaactcagtgccatcggaagtggcgttgagatccaacatctcagcgccactatttttggtgctaacctccatccgaggtatcataagctagccacatcatcaagggtcagcgcgatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactatggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagttgatcaaccaacaacttgccttcctggcgaggggaccgtctgggtcgatcacgacattccagggatatgagatcaatgggtacacattctacacgagagcccaagacgaagagcacgaaccaaaacagcgctgttcgtgtcgatgccatgggacacgatggaacaactgccacgtattacggtgccatcgaggacatatgggaacttgactatggtcctctcaagattcctctgttccggtgccaatgggttaggttgactggtggaggcgtaatgattgatgacagtgggatgacaactgttgaccttaacaaggttggatactcggacgaaccttttgttcttgccaatgatgtaacgcaagtctttttcgtgaaggacatg

SEQ ID NO: 80657 - DNA, 8026 bp, Oryza sativa
tgtcactgaattcatattcagaaatggtacattttcatgatttctttacctgattggtgatgtgatcccatgacaatggtgaacctaggccttcgagattttcccggagtgccttccgcattccaatgattcgatcagccataccctgagacaacccagtggcgatattaaactcctttccatgcttcacatagattaatctattaggaacttacgtagttaagacttcttaccttgacctctttcaaccataaactctttaattctggatcattaaggattatggagacaaccagtgcaccatgaacaggtgggttgctgtacattggccttgcaatctgttgcaattggctcttaacagaaactgcttgcatctcatcctcacacagaatactgaaacagcaatacaaaatcagttttatgatcattagagtatgatcattgtttaaagaaaagataacaaattggatcactcaattctatttgatgttatatactcttccccttaatggaacaggagggcttcctgaagggaaaatatttcagtctcgctagatatgagttccacttgcaaattccttttttttttgagaaatcaaataactaatgctctaagacacgtttcattttcaaggaccatgcatggaattagtcatgcaatacagagagtagctttgctatgctctccctgaagaaaacagtacaaatcctgaatcaacagtagttaacatgatgtaaattttgtgcctcttaattatatccagagcataggagcactgcattgcacaactatataactttcaagcataaatgacactaggcgagtgaatacctcaagcaccctgccctttgcccatacagtcccatgttctttgcatatgactgagcacatccaatttgatgcccatcttcaaggaagattcggattgccttagcatctctctctggatcaccgctggcaaatccttggtatgccatgtcaaagaatgggaaatgattctttatctgtcaaaacacataaggaaaatgtgatatctgtcgttggtgataacaccaacaaaaagccagtccttttcacttctgctaccttgaattggtaggatatctctctccattgttcttctgtaggatcaactccagtaggattatgggcacaagcatgaagcaaaaagaatgaaccatttggagcgttctgcagatgagaggaacaaaaataaattaaaaggagctataggaaacccatcaacaggtcagaagcacctataagaaagtgagaaaaactaagtgtacctaaaacttatcatttatcaatgagaaagaaagctaaatcagtattgactctacaaatatctaatttcaaacaatatccatgatcttgctacagataccagcaacaatgtaataattcctaaaagtaagatatctttctaacaatactggagaaacgaatcaccttaatatcatccatcagtcctgcgaaatcaagccctcttgactctggatggtaataggtgaatgtcctttgaggtacttgagcatccctccaaatgttatgatgactggagaagttacacacactgaggttagaatgttagatactgatgatgttaacaatattggagagcaagaatcacaggtgcctaccatatcatgtagagacagtaatacacaccatctacatctatgttttctcttcctatttctttctttaagagatttttcttagatgtaaagaaaacaacaacaattcatgtctcagcaggattccaactcacttggaccatgtaggtgtaggtatgtagatctgtgaatttggcaagaaacgcctctggaaatcggcaaagagccggcatgcacctgtgcctgaaagagcctgcaccgcagcaatcctcttatctttgatgaaatcagaatcctcaccatatgccagctttagtgactcttcaatcatctttatacttcctcccattggaaggtactccctgttttacaaaattagtggaaattagaacttaaggcaacctccaacggtccagcactaaaacaggtgtagcatcaactgcaagacagtattatgctttagttgatcatttttttcaggacaaaaaaaaaaaaggattggagtgtctaatctgtactgcaatgatgtttacttccacaccacaaaagagcataaagaagcatctggaaaccattttaccacagaatgcctacaggaggtctaaaccgcggcaggatgggacaacaataattttttttttcgcatcaagcgtacatacattgcgtgattgaagaaggaaaaggaagctttacacatgatccagatcatgtttgaaaacaaaatactagtgatagatcacgcttcagaacgaaccagcggtatcagcatgcttttatttcagaatggaactaaaaatgaatcaagaaccaaagattattgaagctcatatctacaaaacacagcaggtatagctcagatccgcacatgcacaagtaatcaagcattgaagctaactggaagagacagggagggatctcgttctgacatgttgaggttgccggcgatccggcgctcggcctcgcgcacgcactcgagcacgacgggcttgccgttgtcgtcccggtaggcgccctgcagtttcagcatccccgcccaacatctccgtcagaatcaagcgagatcggggatcccaatgagagagagagagagagagagagagagagagagagagagagagagagagagagagagagagacgtacgacgccgacgttgactttgtcgggggaggggtcggcgaggaaggcctcggtgacgccgaggatggggtccttggaagccggctcgacgtggccgaacagcgacgccatcgccctcgtcgcgtgcctcctcgccctcgccagcgccccgacccgccgcccccggatcgcggccgccgagcgggacgacgacatcgccatggctggcggatgggcggcgcggcagcgaggaggaggaggtggagactggagagcaaagcagtgagggggagaaaagctgtgggtgtgtgggttttggtttggtggttttcgcgaggaaggaggccaaaagaaaaggtgtctcgctttgatgattccttgcgtcgtcctccgaagctttttgatgggtgcgtgcgtgatgagtgacgctgacacggatggacggatggctgcgaataccagtcggcgcggacgcaactcttttttttctttctttttcttttaccgttttactgctagttccacagtgtgggagcacctcgcgaggaattaaatttaaaatataccattcactttttttttatttctcagaaatatacttgatgtaattttatttgcataaaattagcattggtctcgcacgctcaatgagcgagaccgtcacacttgccgctaatcaacaattaattagtgattaaataataagataattaatcgctaatcatcattaattgatcgctaatcttttaattttggcaaaatttgctacatgacactcaaagaaagcggtcttggttaggggtcatctcgaaaacgtgaatttgtcctatgacactgaaaaaacatagtaatttaccacgggacaccacgagcattaaaatacaatattcaattagttgaggagagagaaatcacataaaatgtctattctaccctcgtcttcttcttccttttccgtttcttcctcctacacaggttgtgcgaagcagccgtgagcaacgatgaggggcaaccgcgacgggcggtgacgaggggcagcgtcacgaccgtcgacgaggactgcagatccacgacgagccgcgaccgagacggatggttggatctcgcggcagaggacaacggctgagaaccgacgaggtttgatggcttaccgctgctctttgtttgctgcgagcttgaagttagcttgctgctgctgctgttgcgagcctttgaacaaacggatggggttgccgccggcgaggatgttggcttcgcagctgctgttgcttcataaacagagacaaaaatgctactcctgttgctgttacttcacaggctggcgacggctcgtggcattggacatcgaggatgggtcgcggacgaatgattgaaggacgaggcgccgagcggcggtggcaaggacgccgtcgcgatgggcagacggacgactttccacttgctgctgctctttgttgtgaatgaatggatggagttgtcgcccgcggggagaacacaccgtgacgaactgctgtggaagatggcgggggtggacaaagcgacgggcagcgaggccggttttggtgctgagtcgaccggatttgatccccgtcgacgaagattggtctcaggggcaaaagtgtcattttgtgaaaattctctctctgtaatagcgaaaaattataaaataatacgtataagtatctatcaacaaattaccatgttttttaagtgtcctcaagcaaatacacgttcttatggtgttcctcagcaaagaccatatttttcgagtgtccaagagcaaattttgcctttaattttcgaaacactttcgtagacttgttgcacgagaatgctcgcggtttgacacgctcgtcgctcgacaccgcgcggtctcacgctgcccctctacaagactgtctgcatcttcatcccacgtcaattttgcacaacggttcagcaagaccaacggtatatttgtgtccaaagatttgcatctaggatatttttaagaaaaaaaagatatgaacggtatattttcaaatttaatttcctcatgagtaccatcacggtgtaaaattttaaacgggaaggctaaaggacagaccctaactcctcgcttgtgtgtaggcacccacattgacgttgcctcactcttgatgcggcagactagcacgtcatatagatggccataaggcccgaagctaggctagacggcccggcccatagcatggctatttggcccggtctaagcatggcatgccatgactggtgtcgagcccatgccggcctagcccgatagttgggccgtgtctgggttgatgccttggcatggtggactggcccggcatgacacgaaccaatgagcacgaaagaaaaatatggtcgagggattcaaaacagacttaattcagggcatgataaaagagaatagggatgcagaatagacttattctagaaatataagatggcccaaagagatgagcgagggaacagacttgtggaaaaagtatacttcgactccctcaactatggtccaagtatgacttaaaacctccaaacaaaaaaccgggtatatcgactcctccaactatcaaaaccaatgcaaaatatatttcttagtggtattggaagcggttttggctgacgtggcgcctacgtgggagtgttgacccggtcttcatcccacgtgtcattaacatgtcgcttatgtcgcattttagtgtaaaaacaaacaaacaaaaatacatgggatagagatttttataataccggcaaacaaacaaacaaccaaacaaagtaccagcaaaaacatctttaatttttataatagtggagatagagattgttcggtttttggcattaacttgtgattaatcatttcgctatgattttgttcaaattaatccatccaaaacttttctaatactttaattctacatactatttggcgcatggtgattttgcctacatgaggtattttggtgattgataatttttatgctataagagaaaattcgtctcaaggtagcgattgttaaatatgtgatccgaatttaggtctacactatattcagattaattttcgagtaggacttgatgccttttcctgttagttattttttcttttatcttctataaatactcttgtaaaccgtataggaaggttacgttcactgctattccccgacgtttgtaattaaactcaacgatagtgatcatttgccggtcgattgccggtggaattgattcagggtccgttcttttcagattttcggatgacgactctagctgcagccgtggcagctagactaccgttcagagtattgagcctaggatcgattgatcaccttgcacccactggcactagtactgcaagccacggcctctgcttgcccggaaacattggcctaatcgcttgtgtttttcatcgcggtactagcttgcccggaaaccttgccttaatggcttgtgtaccgtacgctaattgcaggctcggcagatgtgtgcatttgtccacctcaaaaaaaaattcacctcaaaaagatgtgtgcgtgtgtaccatacgcatgatatgtacgctgttttcttatgttccgtggaagaaaaagttgggtacctcgtacggtgccaccgccacagagcaagtactcccttagttttattcacataaaaagtctttttaaatttttttctaattaaagttttttaagttagactaaatctctacaattataaaaattgaagatgtttccgctagtcatatgtggctgcgtttacttcacgccaaaattaaaagtttggttaaaattggaacgatgtgataggaaaagttggaagtttgtctgtgtaggaaacctttgatgtaatggaaaatttggaagttggaagaaaaattttgtaactaaacatagcctgtgtttgaatcggttttagttttatgtttcggttttaattttatgtttttgtcaagtaaacatctaagtagttcccaaacataattttttacactgtcacaatcgaatatttggacacatgcatagaatattatatgtagaaaaaaaccaattacacagttcgctaggaaattgcgagacgaatcttttaagcctaattgcgccacgatttaacaatgtggtgctaatgacggattaattaggcttaataaattcgtctcgcagtttcctggcggaatctataatttattttgttactatactacgtttaatacttcaaatatatgtctaatatatctaatataacaatcaaatctaaaaattttcctcaactaaaccaggcttaagtataaccacgtatctctagttgcctacggtgcgccgtctcttcattgggccaacataattttttcatttcagcccttgttatatataatttgttttactggttagatcttttacggaaagaaccactgcgtttttaagtgactacgtatgaatagacttccctctattctatgctagggaattctatgctatagcagtagatagttggttttaatattatatttcttactattaaatttgagttttaacattcgggttgactaaatgtatttaagaaaaatatagatcacacatattataggcagcgaggtctagaatatatctactctatttttattgattgataggtaagtacgtataacaaattgcgttagatgtgaaccaattaaaacaaggaataaaacacatctattagcagtaacctttatttagatttgttaaaaataagagcccaaaacattcaattaaaaagaaaaacaataccttactttttaatttagacttaaaatttaaacctaaagatttacgtcttcttaaatgattttttttacgtgaaacagcaggagcaggagaggctcctactgcgctatattaataataaataaaaggtttacaatatttacaaaaatacaaaacaattaagagagagagaatcaatccatgattgcaggatgggtttgtctgcttttttactctgtgcatatgcagagcaaaatccttcttgaactctgatttccacttgactaaactgatagtcacattgttgaaaataaaatcattccttctacaccagatgtgccaacaaccaatcgcctgagcttcaaagaagaagttgagatgaaaagatacttagctgttgtaatcatgttcatgagctccagcgctagatttcactgaatgcctatttgctgccagcattgttgtgcaaatgtgcaggagaagaatagatgggtcatgctctctacaatcattgcttaaatatttgatatatcttactattaaatt

SEQ ID NO: 80658 - DNA, 4987 bp, Oryza sativa
  unsure (1)..(4987): unsure at all n locations
ccgatcgatcggcgtgtcagcagcaggaacaccgtgatgtgtcgctcgcaatctcacatgcaaaaatacggcgagaagcaaacggctacgtgcaagaggctaaataagagagaacgcgcgaagcgtccagcgacgctcactcacgctccaaaatcgttgccgcatccctgtcgccgaggagcgtacatacgtagttttcatgtcgtcatgtatgtattgtatgctgctaatcgccatctgaatagggaccttttgttttcttttctgaaaccggtattagcttctccaagtactgaaaaaaaaagtgttgcgatatctgggggttttttgcgttgaagttgcacctcctgatcagcagaaattctcttgcagatagtcatctgtaacttaaaatattcttttaagataatggctctaacttaaaatgtagagtgatttgttagttcttaaggaggtatatcaagagatatcatattttctattaaaattttatatctcttggtacctccgacactaggaaatacggaaatttcttttttttttactttttagtacctctcgaagattataaattttttttaaaatataacattaccaatttgctcctatggctgaagatacaaaccattttcattatccacaattggaaaatttaattatttgtcgttctttagagcatgaccgactgttcctctaaatccaatctcctaaatctcttttctttaaaaaaaatctataatgagaatttaaggcatgaaaatatccttctcttcaagagatatcctcatttaagtccctgaaatgaaataaaaaaggtgagctcccccaattcccgcactgcgatatctcttgcagctggtgcttagattccacttctctttgcacggtgggaagaagctacgagcgaggaatcgggagcgagcacggccccaaacttgtggggaccgaatttgaagggaaaggaaactccaattcttaagcagatggttagagcatcaccaaaagtattccaataattaattccaaaaactatgtgttttggattttctaaactgaatgtagaaagcgagaaaacctatctctcccggagaaagactaaaattgaattcctataatgaaaagtggaccctccctttaactaccaatagagaaaattagtttttctatgcacgaaccgcgttatttttcctctgtgcgcggttatttttgctccttgaagtggggaacgaggtatcaccgcaccgcctctacgcgcgaactgcgttattttttctccgtgcgaagttatctttgctccttgaagtcggaaactctaatgggcgatcgatcaccctgcccatggggtagcgatcgatcccctcccccctccctcccttcacccctccacctggttttcttttttggcaccgcattactttcctattttagtaaatttatacacctcaagtttacacatctaaagtttagagaccaaaggtttataacttaaaagtttatatatccgattcaaatttgaatttgaattcaaatattttttatatatagtatttctatacatttaaagtttatacacctaaagtttatagacctaaagtttataagtcaaaattttatatacccgtttcaaatttgaattcgaattatatccgattcaaatttgaatttgaattcaaatattttctatgcataatatttctatacatctaaagtttatacacttttgtttttttaaaaaaaattgtggtgtactgtagtaggaagagaataaggggagaaggaagggaagaagtgggaggaggggggcggatctgatcgttgggcgatcgccggaagtgggtaacgagatatccggagttaggaacctgtattattggaagacaagttgggaatctattatattattaatggaatagaaaacgaagcctccacgttcgctgtcatggcctagaaattctcacattaatcagagaaaaagaaaatgcagagtccatatagaaatacaatttagaaatagctgaaattcggaattaaaaaataaggaatattagaagaggagactagagtccatgtagaaatacaatttagaaatagttgaaattcagaattaaaaaataaggaatattagaagaggagactagagtccatatagaagtacaattaggaaataattgaaattcggaattaaaaataaggaatattagaagtagagtatagagtccatatagaaatttaaaactaactaaaattcggaataaaaaggagcctccacgttcgcttttatgacctagaaattctcacattaatcggagagaaaaaaagcagagtccatatagaaatacaatttagaaatagctgaaattcagaattaaaaaataatgaatattagaagaggagactagagtccatataaaaatacaatttagaaatagttgaaattcgaaattaaaaaataaggaatattagaagagtagactagagtccatatggaaatataattaggaaataactgaaattcagaattaaaaataaggaatattagaagtagagtatagagttcatatagaaatacaattaggaaataatagaaattcggaattaaaaataaggaatattagaagtagagcatagagtccatatagaaatacaattgagaaaaaaaaagaaattcggaatttaaaaataaggaatattagaagtagagtatagactccatgtaggaatttaaaactaactaaaaatcagaataaacataataaaatgaaaagtagtgtttagagtcccgtataaaatacaatttacaaataacttaaattcgaaataagaaaaaaataggaagaagagtttanagtcaatataggaatacaatttagaagtaattgaaatttgaagttaaaaattaaagaatattgaaagatgagtttagagtccacatagaaatacaattagaaataataaaaatttagaattaaaaaaagaaatattcaagacgagtctagtgtccatataggaatatatatataatttacaaataactaaaatttgatattaaaaataattaataactaatacatatataaaatacaatataaatattatacattagtagtttcgtaaagttattacaaaatttaaaattatgttgtcatttaatatattttaataatataatgagaaaacatatatgctattatatgagagaaaatgtaatgatactagcggcgcaatctgcgcgggccatcatgctagttattagattaaggagggtgttggtcatgctactaaggatcaattggaacaattttttttcacctaaaaccctctacttttaggtttgggaggaatttaggagaaatattggccatgtacttaggtcggggatttgatgatttgccatgctaaaccactcgttactgattcagagtcctgcgtgccattggcaaggacgcaaggtaatctgttgaggggcaaatttggctctaaaatttgacacaagctctactaatttccatgcagagcacaaacaaaagccacagtggatcgagtatcttttgtacactagcgacattatcttacgctgcatgtagatgtaggagtactttacaaataggagtaattttagcaattccacatgttacacatgtgcatgacgggattggaaccctgagtagtagacagaaacatgtacaatcatcatgggcgtctgattactgatgcttcccttgtctgatctcgtgcctcttattgacatcatcacacaccatctctagtcaaattgaactcaaagataaccaaacagtgctgatgattggggtggatttgtaaatccgttctagtccaaaatctgggggaatatgtaaatgtttatgactccgtacattgcatggctccatccatgcatgggaggatggaatctttcttggagtatcttgcttctaattaagtaccccccatttgtcagtggactattggttcactgtacttggccaaaaactgggctctgcctacatggatccataattagtgaaacaaagatgacaaatcatgttcattgttattgtgttctgcttctgcactgctgccccgacagagactcagcaggccaataggttaacgggtcagtgttttcgcactgttcatacagaaaccaaatgttcagttttctgaagaaaaaaaatcaaccgacttttcgctcgtgtgttaggaggggatcaaatgttcaattttctgaaaagatccatcgtttttttttctttgctcgtgtgttaggaggggctacgatttttttagtgtccaataaggtcgagccatgttgatccttcatgtggtttcaaaatgctcatgaacgttactgcgtgcggggttttcttttctagatttgttgtactgtaagatatctatctaaggttaatttttgttagaaacacaccataaatatagacactcacccatataaacgcacaccctacccctatgaagacctccgaaagactaggccgacatatcttgagatcgacgaagtcatcacaggtgcatggactggcatattttgagatcgacgaagtcaccacagacgtctcgctgtcgatggatatgtcaccaaccactgaaaaaataattaactataaatacgagtatatgtgtcaagtctttggacttgaatatggatggattggttttaaaaaaaaataaccaattaagttacgcttacttcgtaaggtggtttattttgagatggaggtactagatgaagcatccagcagaagccatgccgaggcacctgcgacagaaaggagggccagatatagcaagcaccgatggtggcggatacgacagagagtacgtacaggagaaaacggcaaggaagcaggcaatatcatatcccggcaagtgtgaggtgtggaggatggaggccggcccgtgccgtgcgtggtccaagccgtgctagcgcctagcgcccggcccgatcgatcgatcgaaaccacgcgcg

SEQ ID NO: 80659 - DNA, 2259 bp, Oryza sativa
tcctacaagcactcttatataacaacagaatccgtttatacttacctaataaaagagtctgcataccgggaaaacgtacgatggggccggaaaaaatatacctttacgtactatattcatttgaaaaagtacgtaccgtttaccgatggaaaaaatacatttacctactgttcatttgaaaaaaaaaaggacgtacgttaaacaagctataaaaccctaaagaaaaatatatgtacatgtcagaatcatcattaaaaaatagacgatctttttaaaataggattttctataaaaaaaataaaatttattacttcacaaatatggtcacgtgatgcttctacaagcactcttacaccgtcatgtggcactgtgtaatctcgccatcgatttttatttaaattgatagacatgttatgaacaataggtgacgaaaataaactagatgctaaaatatatatctttatcaaaatataaatattgatatgatactctaaagattgttacggtcgtatgtatgtttagcgatacatttcttaatgatcaatctcactcatttcaaaagaaaatattttatctattccataaaaatttaagcagtattgattaacactgtaaacaaattgtctctactcaaaacgtaaaaaaatttatggaaagaattattttcatcacatctatcttctctttctttcttgaagggcatcgagcagttagccagttaacacaactataggagggacgtaaatatgattgagttgagacagactcaatggaggtcaccgttgacaatagtactcaacttcctacatactaatgcaataatctttgagggtgctgatagtgaaataagacttagaattatgctccacactggctttgagaggcacaagtacgtcactgcgaaacccatgtttgaaggcactagagaaataaatccttggtagctctacccattagagggtatattcatgtctaatttttaacattgttatccctttaaccaatagaagcggtatttttagaatattttttttatagatttagaaataagagttgacataaacatttaggtatgtagtggagattaatgttttatgtattaatgattaataggcttactttggtgatacatatgtagttccatttattaaaaaggcatcaagcaacaatgataattagtaatggtgataataggcgaatttacgtgtaatctagacaaaagtgatttttgcttgaatataagaaaattcttatcgtttatcaaagtctagggtcaatttagcgacaaagacttttttttaattataagttgaaatctaccatttataatatgcatagtgaaatatgacttaattctattaacattatttctatagataataaataaggtgcccgctcatatgcgtgggctttctttctagtttacataataatacaataaaaaatttgagcaaacccgtggaactcgtcgaaaaggttttttttttttaccttctgattaacctctggtaaaacctctgtaaggaaaggttgaattatacataccatttagaattaatttcttggactgaatatcatactattttataaaatttgcatgttagtatgttactctaaaaaatcctgctagtcaagggtctgttcggtacccataggtatggttggcgctgcaacagctgctacaatgaatcgatcgttcatttgtatggcgttgcgcggcagcggcagctctggccttcgaacatagcccctctccctttgttcatgtagttttagctagtggaagacacgttaagaaaatgttaaaagatttctatgtcctcgttaatatagcaatctagtactacatttgtatcaaaaatataagaatcaaatggaatattcttagtacaatatatctagatagggagtaggtaagatcacatccgatcataagttcttatattttgagatggaggtgggtgatagatgaaattagtattagtataactatgatgtaagtatcagttttttttggacggagggagtaataagacgaagggagcgttgtcttttgagacagagataggccctgtttagatcccaccctaaaatttttcaccatgccatattgaatgtttaaacacctacatgaagtattaaatatagggtaaaaaataactaattgtacagattgcgctaatttgccagaccaatctttttaagcctaattgtgccatgatctgacaatgtggtgctacagtaaacatttactaatga

SEQ ID NO: 80660 - DNA, 11298 bp, Oryza sativa
aattaagccgctttattatgagtggaacgcatgagcaaatgcatatggcgagcatgcattcctgaaaggcaagattctgcgaccaaagtgtacattctgaattttgtttaggtggatgaaacacatagtatatttcatgggaaggagggaaactggaaaacggtgtgctgctgctaggcctgactctttgggcttggacgcttcttctctctcgcttctgcaaccagagcatataccccaatctgccacgcgtgccggccgttactaatccctcatcactaattgtatgcatgatctactgatgcattgcatctctgttctgttcttgaccagaccgtactctcgttttggagaatgagaggtcaggaattgaagcagctagctagagaaagaggctgcaggggagagtccaaattaaaccaaccaccacgttgttatgtgttgcttgcttggtgctagagtgctagtaatgcactagtccaaattaaattcttcatgtattttaggatgtagtatatgatattattaagtttattgatggtgattttctggatggttgaatgcatctgcaaactgaaagagtggccggtgtgaatgcagtgcttaattggaatccgacagtgggtaatggaggagatgggccagtagggttggtgactgttagacgctagcacatccaggcgattaatacgactactgtcatacgtactgtacatgtcatgctacattatatcgatctgtacattctcttggtcatgcatattacagcgccatatcccatatatcgtacctacgaccaaaattaaactaaacgctctctgaaaaaccaatcaacaaaatacatacaacctcatgttcatgtaggggtataaactataattaatgttcatacaaggagtatcactatcgatcaagctgctgctatgctaggtggaggatggcaatattgcattgatgtcgcccgggttcgttgggccagtggctgctaaccgaatttaattccatcctccgctgctgctgcgccagcccggccagcctcccaagaccaaagtgaacatatggccctgtctagttccttaaaaaacttttcgcaaaaacattatatcaaatctctgtacataggtatagaatattaaatatagataaaaagaaaaactaattgcacagtttatatgtaaatcacgaaatgaatcttttaaacctaattaatccatgattagtcataagtgctacaacaacccacatgtgctaataacggcttaattaggctcaaaagattcttctcgcggtttccatacgagttatgaaattagtttttttcattcgtgtccgaaaaccctttccgacatatgatcaaacatccgatgtgacatctaaaattttcatttcatcaactaaacaggcccatatatgtactggagtacgtgccttttatacagacagactactactagtcactcattttacaacctgcacaatggaaatttaccactcaaaatttttcataggcagactgtacatcattttcgtttctaaccaaaatatatataggtgatcacaaaaatcacaatgataggcaaataggagtaactaactaaaagaagaatctttgcattatattggctctttttcgcggatggaaattgactcagttcatcgcatctggataattcattcatcattcattcattctttgtttgttttttcatgccgacttaactgaccgcacatgcataaaagcctcaggctgcagctagtccatgcctgcactgcatagtgacgacgtctgtattattctctttctttttacctaccctataataggtctccaaattagcacgccctgtcctattgttactgttattgctctcactcctcgcttaattaggcttgacatgtacatgtccaaaacataaaacacatttatcaatcgaaccgacattttggttgcaaatctagtgaacaactaagcaagttatggtgaggcgtcacaatcaactgtaccctgcccttcaaaacaataactaaggctgtgtttttcagcgcaaagtttggattttggttgaaattgaagatgatgtgattgaaaagttgtgtgtgtatgacaggttgatgtgatggaaaaggactgaagtttggatccaaactttagatctaaacacagcctaactgtatatcagtaacagtcctgtcgcgcgccgtttctgaagagatgatatatagatcctctgtgtttaatttgcattcagcatttatcagttttatctaattaattgttgtcttaaaagatgtactaaaattaaactggctagtatttgatgaactctctctttttctatacaagtagcacttgtttttagaggtaagttccttcctagtgttcttcagactagtttaagaggttgagcagcattcatgtttagttgcagcctagctattggaggcaaactaaactaaaagctgaattcgctctcacctgctctactgacgtgcgtatgttccataccgcatctcatgtgccggcagtattttatttatttttaatcactctctcaacaactagtaaaagctaatgtatcctgcacatttgtagagagtaattaaacagcacgcgcgcgtgcgtgcatctatcatgtcagataatgtgccatacaattatctggctgaaagctaaccttaaccattaaagtattttgcagtgtttatttgtttgtttttataacagagataatagtaataaggttttaactggtacgtagtatggttgaatttaaaatattggcgggtgcagcttcggccgttggcatcgcgacgccggtggcgtacaagctgcggcggcgcggcgggcacggcggcgaggtggcgtcgcgcgggatgaacttcgcggtgggcgggtcgggcgtgctggacacgggctacttccagcgcaacatcagctcgcagatcgacctgttccagaagcagctgcgcggctgcggccccaccggcgtcgcgctcgtcgtcgtctccggcaacgactactccgccgtcgtagacaagaacaacggcacaagcgtaagctgcaattgcaatacaaccacaccggccatctcgatctatatatcatatctcctctctgaacatgcatgtatgaacaggaggcggcgatcgcgtacatcccgacggtggtgagggggctgcgggagcaactccggcggctgcgcgacgaggtagggatgaagaaggtggtggtgaccaacctccaccccatgggctgcaccccgtacttcacgcggctgctcaactactccggctgcgacacgctggccaacgccgggtccgaccagcacaacgccgccctccgctccgtcctccacgacctcgaccccgccaacaccaccttcctcctcctcgacctccacacccccttcctcaacctcatcaccgccgccgccgacgacaagttcccggtgcggctgcggccgtgctgcgagacgttcacggcggacggccactgcgggcaggaggacgaagccggcaacaagcagtacacggtgtgcgacgacccggagcggcacttctactgggacgacgtgcaccccacgcaggccgcctgggccgccgtcgcccaagccttcacccccgccatccaccgcttcctctccacctgaacgaacgaatgaatactcaccaaccagctttctcatttccgacgaaattccgcgaaatttcgacgtttctatatggctcggaattaagtttcgattcgaatttcgaaggttaaacagtagatttgatcgaaattcagtagatttgctccttgcacttcttcttcttcttcttcttcgtcttcttgaacaactttttttggggcctatctaatttattattacctttggatgatgatttgttgcaactggatagcagtattactgatttttttttttgagcaaagggcgagagccctccatttccattaatagaaatgaaaaagtatctaccagtctacagaaagcagtaatactgatgccggaatacttcaaccaattaaagaaccctataaaaaaaccccaaaaacattgccttttggaacccataagcaaaaaggacattaagttaatcgtctgaccttctacagatttactgttacacaatcgatcaccaggaggcctccctcgctcgctttctttctactgttacactctgctcgcgttacaactaacgggttgtttggctgaggtctcaccctttgctattaagaagaagatgaacacaaaggctctagcagctacataaatttaatcaaccatgggcaattctcaaaacacatgatagttctatgttgtatgcacttgattgtcctatgcttacccaagggggtgtcagtaataattctccagcaatcccaactgctatgaggcaccattattgttgccttctgttgctgctgctggtggtggtggtggtggtgttggtgtcacgtccatttgctcgacgtttgtctcagcagcctcgtactccgaaaggaggtccatgaattcgtttaacagccgttggaccttgcggttcgtagccatggaaggtagtatatcttcccttaggagtttgtgtttcttcattccctgcagatttaccatacttgagttcacaggctcaaagtggtaaataaacatcacgtccaagaaaacatagaattatcaggccatctatcagacagagagccttacaagaacatcaggatcccatgatggatttttcaaatcagcagatgatgcagcgtcaaccatgcccatcggaggaccaagaaagctctcacaaacttcacgtagacgagattcatctgcctctctgaacgaaacaaagaacaagcaatataatcatttccgcacagcatcatagactgttctcatcagatataaaagaatcacaaactttctcagccaattaaacatatagagctgaggttgcaaaaaagaaatgttgctaagcctcagaaaaggagactctgtagccattgtattgaattgataaacaaactaaccttgccagaaatcttatgtaggataagaggcattggcgatattcctgtggagacttcaaagccaatgaagctgccagctgggtctctaaatgggagcgtgtctgcaccccatcatcggtaaccctgtagtgccaacagtcaaacaagtatacatttagagcaaattctgctatgttagtacactagcatgtcatgattctagtttcaaacgctcataagacaagagcaacaatggaagtgtgcaaacctgctccaaataggctttctagccatgaattttcctatatcgatctgcaacttgcctagctctccaccttgagtagaactaaatgagctagcaaaatttgatgctggaaagcaatcatcagctatccttagccagcatttcaggctggtgtcataaagaaaagcatggcgactggcaagcacaactaagggcgagccacatcttgaaaatttagcagatataacctttactgtacctgtcatataacaaagcaagatcaacttgcaagaacaagccattttggtcaacatcaatttagatgcacaaaagttcagattaacactacatatgaaatatttaccggtatcttttccagctgcctcatctggagatgttaccaaagaagccaaagaatcatgcaaaacgcaagtcctggtatagaggtcccatatgtacatcaaacccctccttgttacaagaagcaatttccaacactcatcacagtctataaaaacagctgctgatcccatcatcatcgctggcattgctcgccttccacattttgtgtaaacctgaacaattagaccagttgattcgagtgtttaggctaccagattgtcagaaaaatgaatgcacatgaaggaataaataaaatcatattccagcaattattgatagattttgtaactattccaaactaaaacatgaaataaatctacaaggaattccactaaagggatattagatacctgcaggcaaccatcttcacagccaactgcccagaaattcgcattaccagccaagacagtcaccttggcagagatgcgatctgaccaaagagtttctgttcctcttgtacatgtaatctcagtttcttttgttgaaaaagcaccaccaagcccaatcatgtctcctgcagaacgttctacaggctttgcttcaaggcggaccggtaaagaatcctcattgtctttcttattgaatacatggatagaaagtgaagagcaagaggccaatgagcctggaactacagatccagactgttctatgctcaaccttccatcactgccagcaccagctgaagctttttggattacaagactctcactaatgttagttcttgcagtaatgccagagcgttccctaactccacaattattacagttaccgctagcactataagatggtcttgttccattctctccaaggatcattcgctgatccagggatgaaaaatccacaccttgattctgagaacggttggacatgtcctggttggaaggaaatccaactgcctctggaataatccttttccggccatcaggacgccggtattctctttgtttcactggactagataaacgaggtgctttatttatgtcatcagcagtggaacctgcagttttcttctcatcttcaggtaaagcttcaggagctttctgatttggaacgcttgtagacgggttaggtgcatctgtagaaactttggggggtgattgaaattgctggacactggaaacctttttgcttgcagattgtttggccgatgcttcttctagcagtaactgagcagggctttcagctatatttgattgcctccctctaacatcgccatatctattcttcttcaattcatccagttcagcatcccttaacctgtatccaagctcctttgcttcaaagtgaaaggtagcaactgaaccatccaaagagcaggcaaaaagtgaatagccatcaggactcctgtcagggaaaaagagcagttgctattgagcttgcacatacacgggatactaattatagaatatgttatatggtcaaattcacataccaagataaatcaaccacactttgagtgaagaaatgcttggcaacaaacaatggccgggcactcgctgtcgtccagacagtaatagttcggtcctgactcccaatagcaataacattatatggttgatgttctttagatgatgcttttgatgctccattggcccatccagctggtgcagcctttgcgtcttggccagaagataaatgcttacggaacattgagtggttaaacttaaccactacaacaggtgcgttatgccccagaaaatcaaaggttgctgaccattcaccccgttcaagcacaggggctgagtgcctaggtttctgaaaaccatgagttgtggttatgaagtggccacagggagaccaagcaagtcgcctaaaaaatgtcgaaccaagctgcaaacacacacacacacatagaaaatatttttcagtaaggaggctttctgcaaacaagatatgtgaaccacagaaatgtaatgaccaagtccaaatacacaacaatataacaaaaacataccgattttgaccaatggccttctgtcctgtgagcaagactccagtcactcgtacgccatatgataacagtcttgtcatctgattggcttgcgatgaaagaaccgataggatcccatgtaacgcctttaactaaactggaatgccctcgcaagacagcagtgcatatgccattggccatgctccatatgtgaacagtattatccaaactgccgctagccaatgtcgagtcatcaggggaccaattaaggtcaacctactttacacataagaaatataactgtgttcaacaatgaatcgataaggatcatgacagttttagtaagagatctaagtaacaggtgacagattaaaatctaattatgttaagcatgacatgactgagattttggcagataattaccacatcggcagtatgccctcttaaggtcataacaaccttccagttttctacatctggaggttctccacttccaaattcagatgttccagtgccagcttttctttcatgaatttggataacttgatcgtccgatcctgaagcaagatagcggccatgatgggcccatctcacacagtttactgttccaaaatggtctcgaattgtagccagcaacctttggctggaatcatcactgtcattgtctttggccactgatttcatgctccatatgcgaatctattgtgagaacaaaaatgggatattagcaaagagcaggctgcgggttcctcaatgatggcttgataacaaattaccagcttccacactgacgagcccagacactaaaaccactaaagcactgatgcaaagaattccctctaacataattatgaatatagtgaactatccttgatacatcgaaatgtaacggtgctgcctaaattccctaccttgtacaggtcaactctgagaaggtcaatttatcacggggaaaaatagcttgacagtaaaccagcaaaattttacacttgacgagagttataaaaaaaaaaaatcttaagtcaccttctggtcgccgccgccggtggcgaagcggatgccgcccggctggatgtcgatagagaagatctgcaggccctcgtggcgaatccagctcggcttctccgtaatcatctcctcctctaggtggcttgccgctcgtcactgccgccgaaccgcagggcccatgccccgagcaaaggacccaaaaccctagaaatcgcgcggccgcccgcgggaaccctaggccgcctcgggacggctcctggtaggggggaggaaggttcgagaagcttcgggagggagggggcggggggggggtggggcgaccgatccggcggcgcccggcggcggagcgaagaacacggcgaggagggggatgaacccaaccgctcgtgttccttcctgagagaaaacgaaatcgaatcgaatcgaatcgaactcgaactcgaactcaaacgaaactgaaacgaaatttaaataaaaatctcaaaaaaacagaaacgaaaaggggaaaggaaaagaaagattcgagagcagcggcccagatttcatcccccttttgtctcttcgtttgcctgctttgagattcgtgccggtttaattcgttttaattttactgaattgctcctactggagtagtactacgttgttgttgtgttgtgcctgcaactgcaactctgcagccaatgtgcaagtctggttagtgtcggtcagtcctgcacctttgttgccacttgaaacaatttgagttcaaaattctgaaacttgcttgtcagctttatgaaatcaagcgtacaggcagcctagcagagtggtcacagcgtttacgtgcgattcatagagtgctggaagaagaagagccagcagcaagcaattggtttgtttgtttcttactcatccaactggaagagacacattatccactcatccaacttcgtttgaacctggagtagcattcagaattctcaggtctcaaactgacgactcttcaaatcaaccgcaaatattttagattttgagatagtagttgcagcagtagtagtagtagaaaacaaaaattcagtagagatttgttgggacttaggaggaaggagtgaaactgtgggcggcgaaactgataaacagtcggcaacagagtcagagagacaagtcagaaaggcgtttcttttcatttcgttttctttagcgggagaagcactcacagcttgggcctcattatcatatgggctcaaattttacatttcggcccatgtttgcgtgggccaaattatgcaccagcccaattccaagtaagtaaccaaattgggtaaacgaggtttgcgttattctgataagtgacaaaattgttcttcggatgctcaactgaagcatttttcactcaataaccaatcaaggaaatccaggattatgctgtgacaaacgtatatacgtgtacttacgacagaagaaataacacagatcatacaggcagcaacaagagtatggatcgatgttatcgaccaagagcaatcttaattaataataagagaaatgtttaacaagatgacttgatttgtttcaacaataaataaaatacctcaccaccactagcagcagaagcttataaatcgattctgtgatgaattataagcataacttaacacgtacgtacggtacggtgatcaatcaataatgttggatggatggatggatcgagtatacaatcagctagctagctagcttcttcattgtaagcagcagcagccaggtagaagaagaacaataatcttacgtatgatggatggatggaatggatcacttgttgaggacgtacttcatgacgccggggatgtggatcctgtagaagtagtcgtcccagtcgatgttcttggggtcgaggttgaagagggcggcggcggcggacgacggcggcgtggccatggacagccgaagcttctccatgttgaggtcgtcgaagcaggccttgaagagggcgaaggggccgtagaggtcgacgagctgcatgacgaaggagtacttgcgggagaggtcggcgtagcggcgggcgaagaggaggccgaagcagaggagggagaggaggcggaggagctggagggggagcgcgtaggccaccgccatgaacgccctgaaggaggcgatggtgcggaagaagtagacgggccgcgtgcgcaccgccaccccgtccttccccaccctagggttctccaggaagtagcgccaccccgtccggtacagcaccgcgtacgccgccgggtgccgcatcgacgacgtcacgtggtacaccgccatctccgacgatgaccccctcgagtgcgccaccatcgccgccatcatcgcgttcaccaccaggtcaccaggcacctgcaatatgtatcagcgtcagagatcgatcgtcagagatgttgaaggatgaattgaagctatggatacttactacgtccatgatgaggtcgaggtcggcgaggaagcaggagaggctctgcttggcgtagccgatgatgatggcgtcgatggtgcgggtgccctcgatccagccggggagagggtccctgtggacgctggtgatgatgctggggcgggcgatcaccacggggatcccgtggcggcggccggcgccggcgaccagctgctcctgaagcatcatctcccccatggccttggtgaacacgtaggtgttgggccacccgaagtggcgcgccctggctaaacccagatccttca

SEQ ID NO: 80661 - DNA, 10938 bp, Oryza sativa
gccgccgtcgccgctccccactgcgtcttcccccaccgccacagccgccgccgccgctccccaccgctgccgctgcctctccccaccgccgtcgtcccgagaagagagaggccggagggagagagaggaggagggatgatgacatgtgggtcccacaatttttttttcgaatgacatatgggtcccacatattttttttatttttattctaatgccacgtgagcgtcacgtaggacaaagacttggttaagaccgccacgtagacgccacgtcagccaaaaccaccgagaaatattgtttgcatggttttaatagttggaggagtcgatatactcggttttatggttggaggatatgaatcatacttgggcgatagttgggagagtcgaagtatactttttcccgtcgaaaaacaccttacgtgagtttggatttcctttctcggctgggccaaattctcttgggcctgaggattggaccagactctagagggcctaccagaaatggccgtacactaatagtctaattccaacactggtcaaaactctctaatggtcaaaaccgatccagcaactgtcctctccctctcaaagaaacagcaattatagcatatatataatcgcgtaagagcaaggataatagtagagctcactatctactattagcttattttatagccaacacatataataaattagttataaagttggctacaattttcttctcctatctctatctctcacttatacatttattatttttgttttggagcttgtgttaagctagcttttgcatgagagtcaatacctttgactttttttttgttacatctctcctccacataagtttatagtaatcttatagctcactattataattgctgtaataaaggtttgtttccaaaaatcgttcataccgcggcatccctctttttgctcgttttcacaacatgcgcacactgcaaactgcgaaagcaaaggaaaacgcgtgatcgtaagcaaatcgttctcccgttccgtgctactcgtactagagtctagtctagatacgttggtcaaccaggtccagatatgcccttcccgatatcaaccccagctgatcccgtacaagtcgcacgttcactcggatctgcttccgccggttcagagttcgccctctccccttcgcgctcccgcggaagaaaacggcggtatcatcttttcgaaaatggatcggtcataaacagatcatagttacttcctccgtttcatattataagactttttagtattgtacatattcatatatatattaatgaatctagatatatatgtgtgcctaggttcgttaacattcatatgaatgtggacaatgatagaaagtcttataagctgaaacggagatagtacatattataagtcattttaattttttagagcaattctacggttgaggagataccataagatataaatatttagtataaaatttggtacctcatagtataaaagaaaaagtggtacctcgtgtagctccttaaggatcgtaaaattatttttaaggttgtaataagtttacagaaatatatagcaatatttttaatacaaaacaaagaaactatcaacatatattcaatatgttagatttaatggaatcaatttagtgttataaatattactatatttttctataaatttggttaaactttttgaagtttaactctaaaaaattcaaaacgatttataatgtaaacaaatgaaataatgtatttttttcaatatcaatagcaatatagttgcgaagtgaacgtaactcaactggttagtttcctcgtggtggaaccaagatatactggcggctcagtttttcgaaggtgcttataggggtcccaggtaggatatgtgtatgtgtttatatgggtgagtctgtgtttgtattgtatttctcaataaaaaattagcaatatactccctctgtttcaaaatatttgacactgttgactttttaatatatgtttgactgttcgtcttatattaaaaaaaattatgaaatatgtaaaactatatgtgtacatgaaagtatatttaacaatgaattaaatgatatgaaaagaataaataattgcttaaattttttaaataagatgaatggtcaaacacgtattaaaaaattaacggtgtgcaatattttaaaacggagggagtagtaatgttgaaaggacttcaatttatgcaggtccagaattatataaacggcagaaaaatgatttcaacctatattccatttccacctatacggcgctcctagctttgggtagctaacaaacgcgtctcccctaccgttagtcccgcgtctcctcccccgcgcccccgcgtcgtgccgtgctcccgcggctaacctttaggctttagcctagcccgaccgaccggtaaacacgcgccccaccacatcgcccctctccccgcctatacacacgccaccaccaccacgcgcgacggacacgctccccctcactttcactccacacacacacttcacggttcgcgcgacgaacaaacgggcagaaaaaccctgccacgacgacccacgactgagccgagcgtacgcacgcacccacgcacgccatgggggcgctgcggcggtggctgccgtgctgctgctgctgctgtcgcggcggcggaggaggtggtggtggtgggagcgtgggggatgggctggtgtgggacgtggccctgaaggcgcacgcgtcgggggactactccgtggccgtggcgcaggcgaacgaggcgctggaggaccaggcgcaggtgttcgtctccccggcggcgacgctcgtcggcgtgtacgacggccacggcggccccgaggcggcgcggttcgtcaacaagcgcctcttctccctcatccaaggtctcgatcactgattcacttcctcatccatcctgatcaaacgcgcagtacgagtaaattagcaataaagagagatgtatcgatcgatttcgtcgtgcagagttcgcggcgcagagcggcggcatctcggcggaggtgctcgagaaggcgttcggcgagacggaggaggagttcgtggcgtcggtgcagaggtcgtggccgtcgcagccgaggatcctgtccgtcggctcgtgctgcctcgtcggcgccatcgaggacggcacgctctacgtcgccaacctcggcgactcccgcgccgtgctcggccgccgctctgccgccggcgccgcccacggccgcaagggcaagaacagggtggttcccgagcgcctctccagggaccacaacgtcgccgacgaggacgtccgccgcgagctcaaagagctacaccccgacgactcccacatcgtcctcaacacccatggcgtctggcgcatcaaaggaatcatccaggtaatataatcaaccaaacatcttttttttttaacgattccggtgcgaaattctattgatatagcagaagaaaaattacgagattataacctagaaagatcataaccactaatcaaccaaacatcgaatcatcgattctttctttctttctcgcaagatcaagctgctgatcgatgcatatgcaggtgtcgaggtcgatcggcgacgtgtacctgaagaagccggagatatgcaagagcaacccgatgctgcagcagacgatctgcccgttcccgctgcggcgaccggtgatgagcgcggtgccgacgatcaagacgaggaagctgaggccaggggaccagttcgtgatcttcgcgtcggacgggctgtgggagcagctcaccgacgaggcggcggtggcgatcgtggccgggagcccgagacggggcgtggcgatgaggctggtcagggcggcgcagctggaggcggcgaggaagaaggacgtgaagtacgagaggatcaggacgatcgagaaggggcagaggaggcacttccacgacgacatcaccgtcgtcgtgctcttcctcgacaagtgccgcggcaaggccggccgcggcgacgagatcgacggcaccgacggccccgtcgacgtcttctccctcagccccgacgaccgggaggacccgaccaggccagtgctccgttgatcgacggcggccggagcttcaattccagccgccgccggtggtgtgtgtacgtacatacgactgttcttggttctttaatttgctccccaaatcgaggtttgcatttggcgcgaaattggccgtttcagccagaaaggtttggttttttaagttgccagttgccacgcaggtctggtgttcatcaccctcaaatcgttttctggttcaaagcttcaaaattcaatttgttttggttggttttctagaaataatgctgcaaccacttcatcggagagaactacgtgtaatttagttgtgaagagtagacagtagtagtactgtagtagtgtcgtgtcttgtaaattctaaacataacaagttgctcaagcttctccattggagagaggcatccaaatttgttactccatctgttctgttagtgttcttgaatgcagccaagccaaccaaagcagacattgggtctcacaattcacaaaattcagatcgagaagctcaacgaagtccactgtgcatgcatgcaacaccgtcatcactcatcagcggcaaaacatgagtcatatagtcttgctgaaattttgcatgaaattttgaggataagagggcagccacaatcttggatcggttcaaccaacacttgtgagctgtgacttcaccggtcaacatgggtgctgtcctctcttccaaactgcatttatttgtagagatgaaaaagatatctgcgaagaaatggtagatgaaaaagatatttgtcaagcaagtgctttgaagatttcttggtagtgggttggatagtttccaagttagctgagccgtgaaagcgaaagcaaatttccagttctgcaattgcggttgctgatccattcaacgaagaaccatagtctaccgggttcaaacgcaagtcaaaagtacactagtgctataacgcgtaggactgtccaaatggcattttttttctttttaatctgaataggaatggaatccttattatacaaaaaacagtgaacacgaatgattcgggaattcctactgcttttcaatcctgaagtttctgaagaatctgatacagaggtgatggcgtagtttttagctgtagcttgaccaaatgaccatgtgttttgagtcctgagtccaggtctctcattctggtttttggcttttgacttctgaatcacttcattgcaggtcatcgcaggtggttagaaactttactactagcataattgcatttgcttatgatcaacttgactttgactccagctacaaggcgacctgacaaaaccaatggggcgtgtcagtttgttgtttccatgtgacttgttcttgcaagtcattttatttccctctcgacaacagttaccgggagacaatcatgcattaaattgctagttgttggtaccggtttacgccaaaatcacaccatcacgagtttagcctgaaaatatcagaataactagccggtacccccgcgcttcgctgcggtgagctaggaagattgctcatgttccagtaataagactataattaaaatcttgatataatcaggtcttgttgaatggcatgtattaaagaatgataaaaatatatagtgaacggttaatatttacacggataaatgagctagtgtgtcggttggacatcacatagcactattgcttatattggcagcactgcaataaacatactacatgaggtagatatggataaaacaatggttattgtttggatggttgtgtagcatttccttccccaagttacatgatgtaaacaactacctgcttgaagagctttcttctttcaggacaaatggaaggcataaatttttccaagctttatccctatctagagcgaactgctttcatcctgtcgcaaagctgaacgtctattaattgaaattgtagaagtcattgcggttgcctttcttcgaagagtttcaacctgaatatatgttgatcgctttgctacatgggtgctatatgcactaatgcatcataaaaataaactgataaccaccaatttaatactttgattccccatgaatcaatggaaacaaatgctatctgtccatgtgaccagcactaagaaaaaacacaaactctatagttacctgctggtgccatttaatttccgtggtacattgggaaataatttgttcaataagtttgacatcatttgatttaacataaacactaaaagcctagcacaagaacactatcatccatcatcagcactaagataaaatcaaaacatttactgatgctgaagacctctaaaatcatgcacttaatttggaactgaaatgctgcttaaacaggtattttacaattgtttttatgagcaggtataattaaagaaataaaaaatggcataccatgcattactctctattaatgctctgatcagggtgcacaaagccacaaaaagctggggtttccaccaactatatttggcaagtgcaataccaggatatgaagataataacgtttagcctgaaaaagatattagaacatatcccttgtttaagaacatatactaattatcaatctgataagaaagcaatgagaagaacatttagttttacctgtcctctatttacgaattactcaattattctatgcttgtctttggtaatgattattgatggattataaaccaacctgccaaaagtggaaataggaaaggaaacaaaccatcttgagtgagtatacaaaaagcaagagcagcagaatgaggctatagaaactgttaagatataaaggctacagttttgctatccaagattctaattaggacatgcttccaaaaggtttccctaaaaaaagtgctcccaaaagcttcaccgtttaacttgaaattggtcagaacacctgcgctcaaagtttctacttttaatgcagatgaagcccatagcagggaagagatccccattttaaaaaaggatatgaaagagaaagaggagcagacaacaaattgtaactgaaagaagctcatcacagcaactgaattacctccaaagacctccaataagtaaggagtaggagttcggcattcaaattagcataccaagatggcatctttaatacaaattggcatggaaatccgctcgtctaactgcaagaacaatggatgaacatataggaaacacgccaagctgagatcctgccagattacagtaccacattgtttaaccaagctaccattgcaaatcccttctcagcagcaaacaaatagacagagagaactgcagcaaaagaagtacatgcagaacatcattttaatagtataagctgtgaatttgctgatttgcaataactacaaagaatcaacctgctcctggcaatgcacctcaacagctacccaccgtcgaacagagcaccacttttgctccctctgagcttcagtgaaaaaacaaatttgtagatcataaaattgtgtggtattggcctattgagggcttcctatcgttcccaacatcattgagtggctccatcttacgtactctcaccaacaaaacagaaccaccaccaccagtaatgcatgaaagcatgagacagtgggccatggccagggagacaacgtgggcacatcaagatcagctggtcatggttagcattgaacaaaattagagaacataatctcccaaccatggtaggacacagggaatgcggtggaaacaaatgttgtataacaacacaatgaacgaataattactttactgaaggaaaagtaaaagcatacctagcctggtggagaaggaaatcaaagcggctagccagaccatagtgtggcagcggtttgagaaatgtcacactgttaacaaccaaatttggtaaattctatcactatgggcatcgaaggtgaagatcagatcgaagtggaatccaaaatgaagatcgttgcggaaacagagtaagaatcggctgcagtccaaatcggctaaggtcaggtcggcagagttcgagtcggacggggctagccgatacagccgattccgataatatgactcggcgtatgtcgtcgggttcaagttgatgtgcttcaaagatgattgccacgcatggatagagtcttgggaaggcaatcgtatctattaattaggatattctgtataatttccttagagatatgtttgggcaaaagtctgccgtaaagacttatggtatcttagagtttgttagagataatagtcgtgtccgttatggacgtatcttgtaattctcgggtataagtagacccgagccctatgtaaaaaaaaaggacacacatccaatacaatctcggcgcatcgccaccctttttgctttacttttcgacgagttcgtgctctcgggttgagctgcatcggtttcgatcttcaacaagaggtaaaacttgtcatgacgatttatattctcaggattagtgcttccatctttatgatactctaatcttgtctatataattcgtcgagttatcatatatctcacataatcttcgataatatctctatctaacctataaccggctaacatctgttaatggaaggcaaccgattaggttagacaatgatgttaacttagattatgtgatatatctaccactctatgaaacttccagcggcttgattgtctagacattgttcttcttttcatacttaatgttgcatcagttgagtttgatctattaagtcgtgcttagatttgcaatctctagcctgctttctggttgccgattagggtagtatcggagtttcagccgatcttatctgatttaactacttttattccatatgcttaatctatatgttaaatctgccctttatgttaggatcttgtcgcatctaggtatattaggcttctgtttggtatattctacttgctttaacatcttaatatagagtggtatcggagtattagccgatacatgctagatccatttgatcggctatgctataaatgtatataatcccactattaatatatatttcgatctaagtgatttatactgtctcggcaaggcgaccgatctatcccaatcacttgatttaagtatatatcgatataaggattatatatcattaatatctacagccgatcgagtagatttagttctgatttgcttattgatatttgctgatcgatgtacgcatgacatcggcttgaaataaatgatatgtcatcggcacctagccgatcggctatcatttataggattaattgcggtttctttgttctatttcttgttgattgcaggatcaaatcaattggcacgctcatacacccgaaggcgagttttgaacctgcactggagttaagcaaatctcccaggcctcgtgttttctgtcaacacacacatctcatcctgccatttcgtcaagcataacaaaattatacttaaatttaacatccctgaaatacataaaagcttaggtccttagagcaatgcaaggaacagggaatcgaaccaaaagctaagcacaaaaggcacagaagaggaaagagggaaaataagaggtgcagacgtcgtcgtacctgcggaagaggaggcaacgattggggatccactgagccgataggaggcgaggtcaccgctggcgctgaagatggaagggttcgcgagagggcgagagagggtaccgccgggaagcaacccatcgacggggaggccactcgccgtcggctcgaaaaagaggagcgggaagaaagaaaggaagaccacaatgacggcggaggcggcgacgacgacagatgcgcgtgcccgtgtacgggacgaaggaatcactccgcaagaaggcggcagcggcggcgacggccgggcctcactccgcaagatttggggattttaggaagggaggagccgtggatgtcgagatggtgccagccacgtcaattggttcgcctagcgtgtgtttggttctgggactaggtgggatgggatgaaaccatccccgatttgaggattgggatgattccattcggatgtttggtttgtagaataggacgatcccagttttttgtttggttcaaggaacgagggagggatgggatgagcgccatttgcaaccaccaacaacgccgtttgcaacaaccatggccgacgccgcctctgcccgcacctccggacgtggtcgccaccggcctccttgatggcgtcgatgagcggctgcggggggctcggcgacggcggcggtagacggctcgggcgacagcggcggcggcgggctcgggcgacgtcggcggcggtgggctcggcgacgacgacggacgggatgacccaaccgagcactggcggcgatggtgtcggccttcgcgcagagcagccgcggctcggcgatgacgacggcggcgaggtccgcgcgggagagggagagggagaggccggtggagaggagggcgagcacgaccaccatcgcggtcgggcgggcggagaagcgcgacgacgcacggtcggccttcgcgtagagcagccgcggctcagcgacgatgacggcggcgaggtccgcgcgggagagggagagggagaggccggtggagaggagggcgagcacggccaccatcgtggtcgggcgggcggagaagctcgaccacacacggtcggccctccgccgagttccccgccttcggatccgtcgccacaacctttcccatcggcggatccggcaccgccgcccttcacaccaccggatccgtcgccgccggcctccccaccaatggatccgccaccaccgagtcccccgccgccgctgtcgtcgaggccgccgccgccgccgtcgtcgagcccaccgccgccaccgtcgcccgagccatctaccggcggcgtcgccgagccccccaccgccgccgttgccgagcccaccgccgccgtcgccgagcccgccgccgtttcccgaggaaga

SEQ ID NO: 80662 - DNA, 20314 bp, Oryza sativa
caacccattagcaggcttatcctcaactacccccaacttctaactttccatcacatcacatctaaaacttttttacacatataaacttttaacttttattttaaacttttaactttttttttcaggaactaaacacagccgtagtaaacgttacaccttcagagagctaatagtgaacacataccttgctgccgacacagacgagcatactcacatatacgcgacattggatacccaacacacacgcagagacttttgacaacgtatctggccgttgtcacgtctctgtcaaccacggcaggccgcaactcatagatgccaatggtatcaccgaatttgcacctctaatgttttggaatgttcgaattgtttgcgcgcgtcaaagaacaattaacaaaccatgaatctcagctgcttatggccccgaacacacacacacacacgaggagaggacggtcttaacgcatccgggaattcagaatcgacatggcctctctttcaagctggtcagctaataccaaccgtccgaattaacaaactcccacgcaattggtaatcaaaggggcttggttaagctaactggcttttgtaaacacttacgcttactttactgtattctccagacaaaagcttggcagactttgctttactgtttttttttctcatacgagatggctgcagcaggagcagccatccacagtactctagtatagtggtctcctatcaattattatagccttcaaaaacaaataaagcagatctaatcatgacgccgttttattggaaaaaggaacgtctgacaaatgtgcctaattaggccgcttaaacgatcatatggatgagctattgacaaatagaagatgaaaccatgcgtgttgctacggaaaataaataaacaaagcaaaatcaatactaattgggtaaatacctacagtttgataggcaagaataaacataaactgtataaattagattgattggttgagttttcttataacgtggcctaacattatactccctctgtatcaaaatataagggattttggagggatgagatactttttagtactgtctagatttgtggtactagaaagtattacgtcactcaaaaaccaaacctcttgtattataggacggatggagtaagagtaaatgttatcaatgtgttgtatttatatagaaagaaagaacgcctaaagtacaacatgccgcctttcatcacaaattaactgtagtttaacttgccacattttcagaattgaatttttaaccctgatttgttttcccaaaatttagcgtgattacgaaagtgctgttcaataatacataatagagtatcagtttgacagcaactcttgtggctgacaattttgagcccgggcagggacaacagtatcctaggctctaatagcagaatcacagagccatcggaacctgtcgttgccaatggccggataggtttagtttttagcattaaaaaccactggagtagctaggagtgacatcgacttttatcaagaggagctaaaggcgaaaagccagtccaacgaccgaaagctcagaggatttctttttcttttttaaaagatgaatacttacggcttaagttactgattttagacgttaacaagatatcagcagtgatcagtgcaattagttgaagtgtgattcaatcattcaagggagatatatacttgtaggagaaaaaggaggcaattattgatgtgtatctgacagtatgaagcatcgcgattggagtgtcctcagcaagcaccgaaaactacagaacaaaacactgtacttacatttacaataaggcgatgttttttcttaaaaaaaaaagaggcgtcaaaaccattgtaaatcattgtgtgagtggtactcagagaacataatttgattttctaggacagtattaagtggctagctttggtcggcagtcagtcaatagcctaatagtataacttggcataatcaattttaaagtagcaactagcaagtgtccatacgagatcttttaatccccaactcacttgttccaatcttgataatctttttctgaactgttgagtggcgcctctgcagactggagtctgaacaagcacgtttcaggattgaggtttaactgagtttcgatcaaatcttcttcttctctttcttttagcaaaaggaactaaattttaatcctaacccaaacgtttccggatcagagcaccatcaaaaactaaaactagataggaaattcaagatgaaattgcaaacaagaaagtagtaataatctgaaacagctctgttcattcacataccccaagtatcatctaggcggatcgatacaagaggaggaatcgattactacatctcagagcccagtagtgagacggagaaaagaaaaaaaaaggaagaaaaaaaaaatcaaagagaagtcgcgaagagaagaggacgagctaagccacagccacaagcccacaagggagaccttctagaagcccgcgcagaggcagatgctctcggtccacggccgcggctgccggaaccggctgtgcctcctcgccggcggcgccgcccgccccgcccccgcccccgccgtgctggtgcggctcagcatctcccacatcacgcgcacgtcctcgtactcgcacgtgctcacctcctgcctcagcctccacagccctgcgaccaaacaaacccaaaaaaacatcgccggagttagcccccacgtacgccgcctccgcctccgccgcccaaccaaaaaccaccccgtctcgccgccttacctgtctgccgaaccccgaatcgggcggcgacgccgagccacgccctcctcaccggaagcacgacgcggtcccaccagtaccccatcgccggcgatcgatatcctcctcctcctcgtcgtcgtcggcgaccaccgcacagcctcgcctcccctcgattggggcctggtcgtctcggcgtcccgaatttgtacacgcgggttggggggagaaaaaaaaccaacccactgtaaccacaccctcactcacacactgacgacgcgggcccaccctcggaaagcttctgcgggcccggggtgtcagtggcagaggtaggtacggtggttgtggggagtttgttacgggggtgggcggcgtgcacgtgcctgaatgcggtaggcgatggcgcacacgtaggcgcggggatgggggttgcttgctgataaagtggggcccaggtggattcatgcgcagtcgtaactgcttggtatgtggcagttgagtggtggttacggcggcgtggcagtagacagtagtagtagtgtggaagtggacggagttaggtcacccgcgctgggttggggtgacgctgcgaagctactgcaccctgccatcatgatctatccaggtttagtatccgtgcggttatcacagatatcgtatgcggtaatctttttagtttttaaaatcatactatatcttacgataatcatcaaaagagtgatgataacttcactcaaaacggtttggtaaatttagatccatctctactggttctaaagtacaaaacacggtaatcttctcagtttttaaaattatagtatatcttgcgataatcattaaaccatgagagtgacggtaacttcaccaaaaacggtttggatccatctccatcggttcaaaagtacaaagcattttttaaaattttaagtacttataatagcagtgagccgtgattttttaatgatgattctgagtttctgactactcatattattgttgccgggtcagaaatatttcatctcttgtaaaatacaagcatttatgaaaactttagtacaaataaatattaagataagtattggttaaaatgaaaagtaagtagacaaattaaatgggaaagatgaccatcggttgaaatgagaaaactgatgcttgtattatagtataaattctaaattctaaaaatatttatattctgtaacaaagtgggtagcaatcagccaatcactacggcactagtcacctctcttgccgtcttctatttcgctttgagattcgtgcacaaagttcacgtcgcatttttaattatctggtgttaactcgtaatcaactggtgatacgcaaacatcaagctgatcgttgagctgagcagaggcagggaaacatttggttaaggcccggaaattcttgacgtgcgacgagatgaacggggcggcgcttgttgcaggtgagcagtcgcatgcacggccatacctttattgctaaaatgacaacttgtgcaaattgcgactcccggatcagtgtatataattctgaagaaaaagcctacaaatcgtcacgctgcttaggcaaaaagaaaataagaaaaggaacagatatctcgttaagccatatatataaatcgatgggacattttatacaggttgatctagacatgataacaattactcctaacaaacaagaacgtgaacgtgttaacgtgagagttgagaatcgcgtgcggaacagttttggtcgtcgagctgaaaggaagatcgatatatcaatcacgcattggaagaaaactccaaactcaatggagggaacttggaaaggaacaataagattgaccgtatagaaatgcaagggctagttggtctaattctgtctactgtctactggctcccgttccatccacatgtttattttttttctagaactccatccacatgctggaaacgaagttttctacgtactcctacttcaaaaagggaaaacacatatcccatatgagtggctaaagcagtagtcagatctaccaacaagtctcggaacgtgagattagactgactttacccgttgagttcgttaattagatggttttatgggtactggttagttggtgcagttcaccaagcctatatctgcatgtgtttagttgcagagtactagtaataccagaacatcaccccatatacatgtgtggttcctggagcctcagcgaaagcaagccgaagatgcaagttggacctttcagatttcgtgctggtctctccagaccgggcacatttcttactgtcaagttggctctacaaacaaaacagtgccatatggccaattgtaaccggacacccctgccctcttgtattctatttttatacctctaaggtcctgttcttttctccaacaaacgttggattaagattaagatttttataacacgctttttaaactgctaaacgatgtgtttcatgcgaaaactttctatatgaaagttgctctaaaatatcatattaatctattttttaagtttgtgataattaaaactcaatcaatcataagttaataccatctcattttacgtaaaaaacttcatcttcagcagattcaaacagcacctaagtctgataccacatacaaacagtatgtattgtatgaccataatagtatgagtcttaaaaaacacagactggttggactcactgtaggcctgtagcctgaccatcggtcacgcgcgctcgtgaccaccgcgaggccaaccgccgccccctggctggaccactccaccgcacccactcgcgattcatcagggtatatttaaatattcaacacttttaaatatacttcttccgtttcagcttacaagacattttaactatggtcagagtcaaaatactttaaatttaactaattatataaaaaatagtaatatttacaacactggtatattttcattaaatctataattgaataaatttttataatatatttgtcttaggttaaaaatattactattttttctataaaatcagtcagtagcttgattttaaccaaagtcaaaacgtcttataaccttaaacgaagagagtaacatttaataaaatatgtctatgttacgtgagttttggcaaattgttaaacaacgcatctaaaaaattcaccactccattactcctcatttatatgctatgaacggtaaacagtgcattaaccagggcaaacctgcgcgggtacgtttttgcagtagcggtacgacgaggggaaaatcccactgacaggtgggtccaggcgaatcagaaagcgctgcccggtcggtggaggcgagctgggcccacgccgcagtggcggcgtggctcccccgaaactaccgctccgctttttgcccggccaaaaggagagcaataaaataaaataaaaaaggaaaagaaaaagaaaaaaaaacacgctctctctccctcgagggccgcggcctcgatcgcacgcacgcactagccgcacgcgtttggctgcttgctgcggttgctcgcactcctccacctccaaaggctccaacaagaacaagaacaaatccaagtgaggccctcgcccacccaccgactccgcggccaaattccggcgagatgttcgcgagcaggccggcggtgcacccggtggaggcgccgccgccgccggatccggcggagcagccgaggggggtgctgatgaaggacctgcccgggatgcccgggacggcgggggggctggggctccgcctcgcgcagttcgccttcgccgccgtcgccctcgccgtcatggcgtccaccaacgacttcccttccgtcacatcgttctggtgcgtgccgcgcgtgccccccctctcccctcccccgtctctgtttctctttccgctttatccgctccacgtcagtattgaggtttcctcttttaggatttgaggttttgaattgttgctttagaaaggggggatatagttgtatgtggtggtgtgtgaagaccacacgttttttgccttattgatgatatctgaatgaacagagacaaatatttctgaaactggatattgtagattattagctcagcgatgagatactaaatggcttggctgactgtggtgccctgtgcaaacctgtgctatataatcgtccaattttctttctgttgtatggagtagttcactagtttatgcttgtttgcttaactccaatgtaaagatggtcattatctttagagtgcaaacttttgaacttgaatatatatgcatcatttgccgatgatgaagcatatacgtgatgctaaaaaaatgtgctatattatcaccaagtcagccgccatcaattgtttgaaggtttgttaatacataagcacgggctcttatcatcacaaatttgtttttagctaattagatgtgcaaccatactatcccatttcaaatactcccttcctttgtataccacatttatattttgtactttctgaaatttggataggggtacaatagctcataccattatcagaaagaatgacacatatatcccaagaacaatatcgttttcatccatagttctgagctcttctttagcaagttgcaacacaaaaattcaatttggcaaacacttggggacaagcagcctcacttagcatcttcctcggtagaataaaaatagtattgttgtgctgcattacctcatatattcagagatatcccgcttcaaatttggtggccatctttattatgtgctagtattgtgtgtgtctactattagtactggttttgagcctacatgtaaacctgtcatcaattcaagagacacacgcatatgctaataaacaacaaggacagagacaagatgctgattcgaagagactgttgatgagtaggaacagtgtattctgtgcaactatagtaattaaaagagccatatatattgtgttcagtatgactattaattaaagcctattaatggctgcgtagggtatacttactttctgatattccctaatttaatacctaaaccttcttcttgttatgtaggtttatccactcatattactcctatgttaattatatgaccatgtttgcccttgtttctttgggtggtgggggcatatgctctttacaaatgtttggtctttcttttagtcaacctcagttctattatactcagtttaattgcatgaataacagactaatgaattaccgttttggccagctttcttgttgcggcagccattttgcaatgtctctggagcttttcactagcaattgtggacatatatgcactgcttgttaagcgttgcttacgaaatcgccgggctgtttgtctatttgcaattggtgatggggtgagtgcaagctgtctgttatcctctttctactgcttgtgaaatccattcagtcagtataccttcatttattttctgtaagtaatggatatgtgttgttgataaattcattacaagtccttctagcagtcaacttgttcatgataacactagcatactatactccctttggtcactagaaaagagtgccctttgcggctgattccaaaagttcaagaatacaagtcgttttggttaaacgagtctcctacctgctataccttcaattaaagtcctacatgcatgcacatgcacttttactacaaaccaagagaagttgagaggcaacaacggaaaaaaacatggagagagaatgatgcataaacgggttgatggaccttaataggggtacaggcacctgaaatttctctccttggttttgtgcatagtgctgaaaactacttttattcttgactggagagagtactttactgtgactattcattcttctgcaactatagggtgcattgtcattgactttggtttttttgcagatcacagcagcactgaccttcagtgccgcatgtgcgtcatctggcatcaccgtgttgattgataatgatctagacctatgctcggaaaatcactgcgcaagttttgaaagtgcgacagcaatggcgtttcttagctggtttgctctttcgccatcctttctattgaatttctggtcaatggcttctggatgaatgaaaaccaaagaggaggttagagcttgatttttgaatgtatcatgtgcccaattcaccaattgtggttagtgagaattggatagcgtgacgcagctaattgtattagagttgaaagctgatgtgcggtcttgggatcatatgtttctagtataactctgtaaaaaaagaataggggatggcctgttttgcaagtgttcaatgtggaactcagtaaaagtctcttaagcaaggtgctttccgtataagacttccagctggttgagtttttgtgtgccatcatttatgcatacaacgtgttgattgtgctgatgaatcatacagccacagcaccactacataacaagggttgtgcctaatttccatggtacatttcagttgaaagtcgttctgaaagaaccactgaaattggtggagaaccttctatcgtcggctgacattcttgtgtgcaatacccatccatggctactggccaagagttctgcactcaccagggccaactgtggtgccgtaatctaccacactgacccatccgtagatggcactcttcttttttcccattgaatgttctttcgtagtagtacctttcaattgttccctcggtttcttagttgtttttttccttaatatgtttgtactatatgcaatggacaaaagccatgtcagataatgttctagatgtcagttatcacttgttaggagctggagatgagatgcactcctagccatgaaaacatcatcgttatcgtccggggagagacaggataataccgagatttcattcgcgtcgttacttggacttggctggcacatctcatcttcttagaatgtaaaaataaaacttttttttttggaatttgtaatactgtttgagattcactttggtccatcaaaagtacctcgagataccggtacctcacagtatcaaattgtttttatcattggatctagctgggcaggaaagacattattagatctaatgatcgaaaacgatttgatatctcgaggtaccggtacatcgagatagattggagcaaatctcactgtttatacttcagtgacatatactttacactgagaacgacttcgatcaaatcaattactcatctgtagactacaccagctttgtactaggactataccaaaaccttacattgaaatgagttcaaaatttgtgttgtaagttgtaacacaaatgatacatttacaaggttacatactaaaatactacacacctgaaatagtactacctccatactatcatgcttatttatgttcattgctacatagcgatcatgaaaaatcaaaagcaccatgaagacaccagtcatgcatgatcactttgatcaaggtctggttggtcaagaaatggagtgcctccgatccttgggcggcttcgtccgcaccctgccgccgccgagcacgtccgatcgcaagaacgggttgagcctcccgagcttcttggacatgctgttcatgaatccgccgctgcttccgccgccgccgccgcccggcttcttcggcagcggcggcctaccggacggcgggactcctcctgcggagaacgccacggatgggtctctcaggcgcatcttcatccggagcagctccatcctgagctcgtcgttctcgcgctgcagccgggacacctcgtcgggaacgcccggccggtgccggccgttgaagctcggcgtcggcctgtacgacagcgccggcgactcgccgccggcgtacgacggcgcggcgctcggcggctgcgatggcgcgcggaggcgccgctgctcgtggtacagcacctgcaccaccgtctgcaccggcaggcggtcgttctgcgccgcgtgcgcgcacgcctcgcgcgacagcttctggcagtccatcgccctgcacaccttcttcctctcgccctcggccagactcggatgcgcctatcgaatcaatccacataagcatttagtggagcgattaacgaaggattcaaccatttcttttagtgatcgatgttaatggtagcttctaaccttcaagtagatgtcaatggcgcggtacatgccgtcctcgttgaacctggcgcgctccgggatgagctcggcgagggcggtgaacttgtcaacggacaggttctcgtcggaggcgatctcggcgaggtagctatccatgagcctgccgacctgggcgacgtcgctgtgcggcggcgacgccgccgagctgaagtcgtcgtcggtggtgtagtccagccgtggcggcggatccgtggtgtagtccaggtcgaggtagccggccaggatcctctgcacggcgtcgatgtcgtaggccgttgtggcggcggcggcgtcgggcgaggaggacgggatgaggaggtcgtcgagcacggcctggccgagctgcgccgccattcgcttctcgaggtcgagccggcacgccagcgtcgtgtcgaggtggatcgcggcgcggagcagcatcgacaggaagctcaccgacagagtgttcctctccctcggcagcaggctcacgatcgtctcgagcaccacccgcttctcgtgctcctgcctcgcgcccatcttcttcctgtccctcccgtgcatgtcctgcaccacgaaccacgcgccatggtcagatgatgatccaagaaacgaaacgaccgatcgcgaccattgccggcgacgcgcagagctcagaaactaaccagccgtcgaagagatttctgggcgtagagcatgatgagtgtccccatggcgatgcccttgaagcccctcgccttcatcgcgatcatgacgcgctggaacgtgtcgatccgcagcgccgtcagctcgtcggcgcaccagtcgtcgacctccctcgacgccgcggcgcccacgccattgtagccgccgccgccgccgccgccgggggtgcccagcgacatgctgaactggccgtcgccgccgcagacgatggacgcgacggcgtcgatgcacctggcgacgagccgcgccttctcctccgacgccgggaggagctcctcggccttgcggagcacggcgaccgcgccctcgaggctcgccagcgccacctcctccaggtaggcctccgtcctgccgaccaggttgcccggcctgcactcctcggtcatctcgaggtgctcgccggcgcaacgcagcatggcgacgttgtccacggtgatctcgaagttgacgccgtagcagaacttgacgacgagctcgaacgacttggagccgccgggcatgccggcgatctccaggtgcgtcgccttgttgccgccgactcctgacacctgcttcttgatgtagccgcacctggatgccaatggaagctgcagtaacaattaaacacctgtcaaaaactcagtttttctttgctagaacacgcagtgaaaactgaaaaaaaaaacaaatttgggttgatgaaaatcaccttgtgcaggttgaaggcggcatcgtcgactttgatggtaatatcgcttgggagttcttgcgaaagtatcctgtagcaatgaagtgaaatttttgttcagacttgtgttcttgcatagttcggttacagtgttgtgatttgtgactccgaactaaaagcaggatgctaccaagctgtactgtgtgttgatttagggaagtttttgtgctgctcactttgaagcagcactatcacttctaattgaaaaacaaaacagtctccaactaaatgaagagcaattgaaacttttttttgacaaaattacagttcatatcagatagaaacaccatgcaaattaaacatgcaacaaccacaagaggaacagatgaactcgtagcaggaaggtgaggaggaggacgaagggcggcaaacgtaccagtcgctggttcgcttcatcgcaggcgagacgaaccgagcctcagcctgcatccctgaccttctctctctctctctctctctctctctctctctcctcctctcgcacgcagaagtcacaattttcacacaaaatattctctttatcttggcccaaacgcgcgtcgccgtcggaggaaatcacgggtgcagtgagtgacgcaggtgcggcaccctccggattgagccgcggttgccattggacccgcgtggtggctggacgccacacaatggcaattcgtacggcggcttgtggatggaatcggtcccgaatggcttgtgcttgctgctgccccacttgccctttttccgctgttcttttctctgtcagactcaaaattgtcttcggggagagggagacgggcgggcgggcgcgcgctgcgccttggagccatgggcctggacgaggtgggccgcgtcttaggagataaggggcgcggcccactgggagatcggtttcctgatggaataagttcacttttagccccttaactagtgaccgaatctgattcttatcctcgaaccgcaataccggatatctcgatcccctcgatgcaatctgattcgtatctcgccgcatcaactgaggtggaagcggagatatccagtattacggttcgaggaaacaaatcagattcggtcctaagagagtcaaaatgaatttattcctttcctaccgggtgaaatttccggtgacctactgacctccggtccggtccggtcacggttgctgagttgccggttacggcgccgttgggttgaagtaaaccttcccggtttgtttgatttgttccgtggagaagctggctgattgtcgtggtttgtaataattgaattaagattgttgaatcgtaatattttcctgataactaaagagtcatctttttacaaggagcaaggagccaaggaaacacacacaaaaaaaagtaataaataaaacatatattttgatcatgtactctaattcttattttgaaaatagttctcttaagacctgttcactttgatgctattttcaaccatatcttttttttttggcaaagttgctaaaaaaatatctatgtttagtttgttgccaaaattgataaatacataaaaaatcctactaaaattttggcaatattgctatcttgccatgctaaaattttggcattgccaaaacttggtaaggtttattttgactacaatctgaataggtccttaaaaatgctaataatggcatgtccacatgtgtacaaagataaaagaaaataataggagaaaaatattgtgtttgttcatttctttcttatattcaggagcatacgacaggattgtgttttctactcaggccttaattaatctgcgtgtcctaaataaccagagtatatgaatggataatgtccctaatattttttttactagcacttgcaatatgtgctgataaaaaaaatagaacgtgtcaatcatagtattagcatactgtacatggctgcctgtcattttgacgtaggtccaatacaggagcataaaatagcaagaaaacaattaaattaagcgtgaaaaaggaagggacgaagaaaaaggggaggaagaagagcaaagcggagacgaccaaccaaatccttgtcccgtccgttcggtcgccgcgtcgaggaggcagggagctcgcggcctcgcaccaccgccgccaccccgccatgacgagcgcctccgagctcttcaccgcccgccgcgcccgcgccgcccgcctctccgaccccgatccggacccggatccgcctgcggacgcgctccatgacccgcacggcctcgccgatcgccgcggccggcgccggggctgccgcccgcgccgccagctcgacgccgccggggacgtccgccagcacctgcacaccggggccccgccctcccgccgccgcgcttcgtacaccgtgagaagcacatccccccgcctcatcctctctagattttttttgttcatttttttattatttttgtgtggatgtgattagatcgaaatgatttagctcatactgataaaaatttgggaggattagggctcctaatttggcttgcgcaatcccgattggggtttggatgctttagattaggttatcctcgcctagtttatggtgaaatggggacaattgttagtgtggctagcctattctcttccatttttttttctgttactgcatcaattgtcacgttgagtactaatcaatatcgtcctggcaagtactagtacttgcacaaaagactgaaaccaaacccgatcatgctgtttggtctgttcaactgaggtgttcttctgctatgcacttgtagatcattacggtccccaaaggggcagtgataatatcgtgcagtgtatctcgagaattcgttgcatcctgtaaaggcttgattttcgttataaacattaagttgaaggagacccttatcttcatttccatagaaaatataacatatcaaaatggtgtgatggtgcctcatctttcttcactcactcctgaaaattgaaatggctaggatgtatgtttagaatattggctacgcttattagaatgtcaatactcagacctgtgcatttagtattccattgccttttcttcttcttctttttgttccagttccacttgaaattcttattatgaattgttatggatgaacattaaattatgacctaggatgcatagtggaatttataactgtacagcattctgatctatttatttcaactaagaaaacgtaaatttagattgatgtttgttgtttctggtgaatcaaatgaggatattcggtctcttttgttgtctacaggatcgtgtcttatcatacatagacaatagcaacattggggactctgcaactaggaggaaccgactggataggctgatgttcagaacaaatgagcggcttcctggtgctgtactgcaagcacaagcacgtgttctagagagactgagaggcatttctattggttcatctgtgtcaaggccatctatcacattggatgaattttcagctactgatgtgtttagaatcattgacttcgggaacagggatgctccatatgaagcaaataggtccagctcatcattggcccatccaagtagcgagtcagatgaagaaaggtcacccattgacaccagttccttaaaaagatcacgtgggctgagcaaggcggccttccttcggctacagatagagatttttgaggcaagcaaagatgacaacagggaggcatcaccagaatgctcgatttgccttgatggattctatgacggagatgagctcataaagctacgttgtgggcacaggtttcactcgaattgcctggagccatgggtacggaaatgtgctgattgcccatattgtcgaacaaacatacagtcacgatcctgactaccttagttctgcattggcagtttggcactctcattagaactgtaattaacagtaagatgtattgttgtaattcagtgttatgtgcatgcctgttacccggagttggtatgacatcactctattgaatttcattgttgccactggagttgtgctgcaaaaggattgagaattgtgtgcaatgactgatagtatatggtagtacattttttttcctttttgtaaatccgatgagaaactgacatacataaccaatgttgtttcggttgatatgagtatggcgtaggtatgaactgctgagatgctttgaaatccttgaatagtctggtgtggattgtgtcgtcaaggcagtatcatgatctttatatttgggaaattttcatctataccatcatcaggattgcaggtaacagcaaaacatgcatcagtgtagcgagttctcaatggtctttgggagttgggaggtagaggtatttatgttatttgaaggtattatacttttacacaccttctgattaacactacaagttatatatacatcctcatattttcctttttctttgatattttcctttttctttgtgaagaacaataatctagttattcttcttgtagttttcttttcttttcttttcttagaatattagtctagattttgtgtgaattcttttgtgaagcgtaacgttcttaggtatttttcttcttgtagttttctttcctttccttggagtattggtgttcaattttgtgtgtatgcttgcagctgttctgctatggcaccattctttcccattggatttctgctacctaattctttttttgtgctgctattccccaggataccgacttgtttaatgtttatgaatcgagaatactcctacgtcttttagagttttgacatccattgcgatccattgtgtaatttgtatatcatctgtaaatatactgtactccagtcaataccatgttctttggatggcaatatttcttttgtcaggaatggttcttgaagtaagggaagagtgcatccttgatgccatcctcctcccactccagctgctgccaccactcgtcgctgccctggatctcccgtagcttcagcggccgcacgccgtcgagccgccggagagcgtaacattggccgacctcgaggatctccagggccgggaagctgatcgccgggacgccccggcacaagcacgcaaggctccgcatcccgtgcaccgccagagtcttcaggcaagggaacgtcgtcggcgtcctccggtcctccgccgcggtgtcgccgccaccgtcgacgatcgcctccatgtcgtggcagtagtgtagctccagatgctccagcgccgggaggtgcaacacccagttggcgttcttgagctggaagcagttgaggatgttgatccgccggagcgccgggaggacatgggcggctgccgtcgtgtgccggaatcggatcgtctcgaggtgacggacgctcaggagacggagcctgtccagcttcggtaggcggaaagatcgacgcagctcgtcgtcggagtcgctgccgctgccgctgccggcgtcgatgacaatgtccttgacgccggtgcagctccggatggcgaggtgctgcagtctttccagcatgtcaaggcctcctagcgtgtccgatagcgtggaagggagcagggtgagcgacgccggcccggccatgtccttcaggcacagccgcctcgtcgagacgttggtgaagccggagagcttccggagtgcggcgacgctgctgacattgatgccgaggaacttgatggacgcgttcctcgcttcaagctcatcgaggctcgcctcggatgcggtggcggcatcgtcgtcgtcggcgttcagcctccatcgggtgtacctgctggcgaagacgtcgaggatcttcagcttctggaggcccaggatgacgttccttggtatgctgtcgagcatgttcgtgtcgctcaggagcaggtgttcgagctgcgtgaggtgcagcagctcaggcggcagagcgccgatgaaggtgccggacacgttgaggtatctgaggccgacgagcgagccgatctcgccgggcagcgccatgacgatggtgtcggagagatccaggtacgtgagcgccggcacgcaccggaggaagctcccggggatggcgcgcagcgacgtgttcatctgcagcatcagcgccctgacgccgcggcgggcggggagccgcgccgggagctcctcgatgaggtttctcatcagcgagacgcgctccgtcgacgcgcccgccgccgccggcgaggtgcgccactgctcgttcagcttcgacgcggtcttgatgccgacgccggcgcgcaccagccacctgttcctcgtggcgccgcagtcggaggcgatccagatggccatgtcgcgtatcatgtcgtgcatcctgacgccccgcgtgtcgccgacgacgtcgccgccggactccagaaggcggacgtccttcagagcggcgatgatccgcgcgcccgtctcgacgtcgtcgtcgatgctgctggagccggcgatgaggccgagcccgagccagcactcgacgagcttctccctctcgatcgagtaatcctcaggccagaggcagcacgtcaggaagcactcctgcatcgtggtggtcgggaggtagtcgtagctgaccttgagcacgcgcagcatgccggcgttctcctcctccatgccggtgatctcgtgcaggtgcgcgttcctcagcttgtcaatggcgtgtcgccacagctccgggtcggtcttggtagacagagccttgccgatggtgatgagcgcgagcggcagcccgcggcactcgccggcgacctccctggcgagcccggcgatcgccgggtgggacgtgacggccgcggccgtggcgttcatctcgaagagcgtccacgcgtcgtccggcttcaggcactccacgttgagaacccgatcggccttcatgttgccgcagacgatctccgacctcgtcgtcagcacgaccttccgcggcagctcgtcgccggcgctgccgtctggataaggaacgccgatgagcttcagatcgaagcattcccacaggtcgtctagtagcatcaagaagcctgtgttcttgaggtgctcggcgatcggcagagcacgttgctccaagtcggcgtccgagtgttcgtcggggaggctcgccaatggcaagccaagtttcttcgcgacgtcgtcctggagccgatcgattctgcattccttcgaggctactgcccagacgacgtggtcgaacaccttgctgctcacgcggcggctgccgcgcggtgggaaggaagctgttgttgatggcgcggaggagggtggtcttccccacccctcccatgccgcagacgccgatgactccaacggcgtcgtcggcgatgtagccgagcgcctccttgaggtaatcctccgtcccgacggcggccgccgcgggcgtcggcgccgactggtgcgtcgtggcggcgaagctgccgaccccgcgccgcgcggcgcagatcgcgccacgctcctgcacgagctgctgcgcctgccggagcgcgcgcgacgcgcgcttgccgatgcggtagcgcgcgacgaggcggaggcgtggcatggacagcgcggcgtagtccgccgcgacggcgttcccttgcttctcggcgacgcgggcgcgccccagccagttcgccgcctcctcggtgcaccccaggcggcgcagccggtcggcggcgccaccgtcttcgccgtcgtcgacgcccacgacgcgggcgtccacgatagcgccgtgcaagctgctacgctgcgcggcgagctggccgacggtctcctccaggcggcggacgttcctcgccacgtcgagcatgtcgtcgagttcgctccacaggtggatcgcgcagcaggtggacgtgctgtcggcgacttgttggtcggccggagcgtccatgtcgccgtcgccgccggcaatggcgtctgatcgtggccgagtagtcaggtgagcggcgatggcagtgtcgaatgcttccgtggacggactagatcaaatttgtgctagacatatataatggatatatgaattatgccgccttgatgataaatttcgtataaagataaactttgtgaatttgagaggatattgaacacgtgctagcagttggattgacccagtcacccagctactccctccgttttttaatagatgacgccgttgactttttctcacatgtttgaccattcgtcttattcaaaaaatttacg

SEQ ID NO: 80663 - DNA, 2498 bp, Oryza sativa
atgccattgttatcgttattgatgcaatggtttctcaaggcacgccactctagctagcttgaattttagcgttgtttaatagataatctttgcttctggctacacaacatattcttcaaacaattgaaggacgatgtgacccttacatctagaacattggtcagtgctagtgattgggaatggttctgggattatcttggctcacatgtgttctatatgcctccagtcgctcgactgcatcttatcaaagacctctttgtggctatcaaaacattcaaattgacttgggtgaaacctttctccactgtacttctagattttactgaatttggtgattggacaattggccccatgagtaagacagatgggcaggagtccatctattacaaggttttttggcacaaggttaagccggaggatattgatccaaaaaacccaaagtactggcccaattacggtgacctgctaagttttatccgtaatctgattgaacatttggatgaacacaaacacgtatgctctctctctctccctccctctctctctctctctctctatttgacagttgacactgttgtgtttcgacatctgtaggaggagaatattactgatattgttgacgctgagctctttgcatccaacagttaccaagattttctcccacaatttctgcagcgtgtttcttcagcctgtctaatgcagggcaagtaagttctgtttttgtgtgtgtaccagtattcatctgaacttgtttatcaacaagttatatgtaatttttgtaggtttaaatcatcttgggatgccttcaagggttccggtgagactaatttaaatatttttgttctcttttgaacaagctgcattatattgcttctagattattataaataacactaacatgttagtttatgttcttgctacaattgagtaatctcaggtcgatgtgatatttcaggcaacgtcaacctggctgcataggttgtgatgacaaatcgactactaagaactgaggaagtgattgatggaaaaagaaactaaattgctcatgatactttttttggccatagtgagatgaagtgcttttagcaatgaaccttgttacattttttggatgtaggattgatagatctcttgtggcttatgtcagactcaacatgtttagaatgataattgattttcacacttgacagtgacgactatggcttacatgttcagactggcaattgatctggccagatatgtcatggtttatatagaagagttaacatgttcatgttgacaaatgatgcagccattaggcagttgacgatggaggtctcacttggtataacaagagagttggatgattgctgtaggcccaagcttccctgtgtagtatgctcttttggctgttgataagtcgggtactggatcgaaagctgaaaatcccagcatgcaaagaccttgttatgatccttctgaaaagttggtccttcgtactttgtggatattaggaatagttcaagctgataccacctccgtatattatagggcatttttcttttggaaatatgaatatattaatatagtttttttttagagaaaccgagagatttatattaccaaaccagtagaatcactaggtaccagccgttccagaccaggtgggcaggcgggcagcctgcccaggaagacacggtctggagattaaagccatacgcggcaagctcatgcgccaccttatcaatactagatcttggggcgcgcctttgcgcgccgcctgaacgtgcagcgaagcaatcaagcaggaaacagtagtgacgctatgaacgcgggcatagagcattatataaacacttataaacaggtgcatcagcacaacctagcagctagcacacaagtgttcatacaggtattttactggtctaatagtaataagtacatatatatatagatggtgcttgacatttgtaggacagcacaaactacatgataagcacgtaaggtgcagaactaattagcatagtaatagtgctaggggtggaaagcggtccatgtccattgtgatcaccgtgtttactggtaacaaaaggatgcatctaacataaccatgagtattgttatgttgtttagagaacatcgacattagcttgcaggcaagttgttttatagaagtggaagatgcagactgattcgagatatatgtcattgtttggctgcgaagtctgcccatcctttcatcaagttgcagcgaccgtctggtgacgtggaaaatcatgttggttgaaatacctcctgctacttgaactttaatgttgatgggatagctatacttcagtgttggaggtgtctggtacccctgcatttaatagttgattagtaatatatatatttcattatcacatccacccaaaatcccttatatttatctagttgtattgacaatgataaaaaaaaataataattactaccgcatagtaatcaaatatggaaggtaaaatgaaacagattagtaaaga

SEQ ID NO: 80664 - DNA, 6092 bp, Oryza sativa
  unsure (1)..(6092): unsure at all n locations
attttaagcaatttgtcccagaaatttaagatacacacatcaactcactagcactcatgatcatcaatacaatatatatttatcttctcagtacaacatatattatttagagataattgcacaaccgtttattttaataaaaagaacacgatgacaaatcaaagttagtttgttgctaacgaacagcaacacatctatctatctatctatctatctatcttctattatatactaaaagtccattaaactttctacaaacgctctcaatccgccacgtgtcactcctacaaacactcctagaccgccacatggcactatataatctcaccgtcgattttcacttaaattggtggacccgatattttagaccattggattagatctattatttaagaaagtaatcccttcctctgctgtgggccaaaaaaaaggaaaaaaaacgtacgtacgtacgtgtggcttaaacttcctacatacgctttcaatctgccacgtgtcactcctacaaacactcctaaaccgccacataccactgtataatctcaccgtcgatttttagttaaattggtggacccaataaagtaatcccttcctctgctgtgggccagaaaaagaaaaaaaaacatacgtacgtacgtgtggcttcgtataaccgtgggccggaaaaagaaaaaacataagaacttagtacgctctccctgtctcttcctcttcctattcttttatatctccatctctttctcttcctaattcttttatgttatcaaattaaaaacgagttaagttgaccatttaaaataatttaaatgtacatagctaatttatattctattaaaacgttgctctatttataattaaattgacaattttacatccaatgttttgctatatataagcaatatgttattgtggtatagactgtgcattttgcaagtttgcatgccatctaaataaattaaatacttattaacaacatatattatatatctatctatctatctattattatatactaaaagtccattaaacttcctataaaccctcttaagttgccacgtgagactcctataaacactcataagccatcacgtggcactctaataaattagaaaaaaatatataacttgaactggtgggccaattggatttatctcataaaaaaaattcttcctcaactactacagtacgttctcatctccttcccctcaatcccttctcctcatctctttccttttttctgtatggtagttaagatttttgttttattacttaataattaatttcttcacttctatctaacgagaatggatgtggactcttgattgcatgtcccatgcctaaatatataaatgattaatgatttgatgcatgcttttataaataacaaatctatttttaactaacaatttagaaaaaagataatagttacatagcaaaataatcataattttaaaaagttactccctctatatcatattataagccattttaacttttttcttaattaaatttctttagatttgaccaaatatataaaaaaaattaacaacatctatcacacaaaattgttttgttagatataacgttccatatatatccataatatgttttttttgaaaattttactatattttctataaacttggtcaaacttaaaaattgacttaaaaaagtcaaaatgacttataatataaaacggatgtagtatatctgtttttatttagtttgtttgaacggttgtttcataactagacagctaaataatttaaaatcaatattaccaatatttcactataaaaaataaaatatgttatttgaactgccacctattctttacctgacaacccaaataacatcctatttttaatttatttgaactgtttatttatgttactcatattttactatgtaaaatttaaaatacgtaatttgaacatacaccaacaagcaaacaacactgaaacattgaaaatttgacaatatgtattatgtcatcttaatcattctacataataaaaaatagaaaaatacaaagtcaccatgtatgaccttttagatacatgctaaattaccaagtgtcacattttaaaaattagtaaaatcttatatattaaaagaaaaaaaataaaacatctagctaacggttttcacctagatcgatgacctattaacattattttcaactatctaatctacttttagaaaaatatatcttaataagtggcatgtcacatattttaaaaaaatcttgcaaatcttaggaaaattacatctaataattggctttcacttaatcacttagaaaaattaaaaaaaaaatcccctccacacgcgcccatcactacacagccgctccttcccctctctggctcaagctctaaacttttcattcctcttacgttcctatttaactaaaatataaataatctataattataagtttcacgtctgatttctaatctaactattgctctgtttataatcaaaccaacgatataagatccatatgcctatagtttactatacaacaaatacgacattttaacacaatcagcctattacttacgagtatctcaaatgcagcttacgatacatgcccgcgcgaatgcgcgggctacctttctagttaaatataacaaagatattgtggagattatgggtaccccatacctacatggcatagttatccgactggctataggggataacttatatctatggaatatgtaacagatcatgacttgggtattacgtttccctgtatattatggaacggcctanagtcctggtttgataagattgtaaagtagatttaggaaaccgataccggattggttaaggtttctatcttgtaaccctgccccccaacctatataaggagggcagggagcccctctagggcatgatgagacaacctgatcgtcagatcaatacatactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtagggggtgcgtcgaattacctgtcgaaaagtgcgatggaatcaacttcagaagaaaccccgagatcaatctcatcaatttcgatggctcaaatcttcaatcgggtctaccgttccaatttaatctctattagattaatttttaatcattgtttgatttcctgatattttgacgaatttcatatactggatgagatcgaaacacgaccatcatcgtcgcctacttgggtgcccttgccgtgtccgagtgctcctctcttcctttccttgcagatggacgtgttgcaggagtggcacaggccgccaggattcgattcctgtttgcatgtatgatggttgatgggctccgccggctacctccgatgatggcatcatgccgaaagaacatcgagttagctgttagttgccggggcttatacatgttgcatggcacgtcgccggctatcactcatgatccagcctcactgctcgacttgagtttttcgtttcaatttgttatcaatatatattagattgatttctaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccaccggcctgcctccgtcgccgccgactggtgtccccgcctatacggttggttggtcacaccaccgttcatgggcgtctacgacttcaccgccggcctgcctccgtcgccgccgactggtgcttctgcctacacggctggcctattatgccactgctgttgggcgtctacgacttcaccgccggcctgcctccgtcgccgccgactggtgtttctgcctacacagctggcccattatgccaccgctgttgggcgtctacgacttcaccgccggcctgcctccgtcgccgccgactggtgtcctcgcctatacggttggttggtcacaccaccgttcatgggcgtctacgacttcaccgccggcctgcctccatcgccgccgactgatgcctccgcctacacggctggcctattatgccaccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgactggtgtcctcgcctatacggttggttggtcacaccaccgttcatgggcgtctacgacttcatcgccggcctgcctccgtcgccgcggactggtgcctccgcctacacggctggcctattatgccgccgttgttggatgtctacgtcctcaccgttggctcaccttcgttgccatcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaattctgatccgtgaaactttgttccattaatgacgaactcatgtcactcatatgcatgtttgggaagtgcctaggccgactcccggtgcttgatggtcatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaagatccagatccagatatgcataaaagggattcatggctttaagcttatctcttacgctccaggaatggatcagtcagaacatcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccaccgccgactggtgtttccgcctgcacggctggcctttatgccgccgttgttgggcgtctacgtcttcaccgactggcttgcctttgccgctgccgactggtgtttccgcctgcacggctggcctttatgccgccattgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgttttcaccgaccggccgccttgtccgccgccgactggtgctt

SEQ ID NO: 80665 - DNA, 20141 bp, Oryza sativa
  unsure (1)..(20141): unsure at all n locations
tttcctctcttctcactctaccgtggccttggtgcatgggcctgaattccggcccatgcaccctggcggatccaaaccagcgaggcccaggagggctctagctctaagtgacagcattcttaatatacatcatctattttattgaatctgatggactataatgaacttcctccctctgctttttatattataggccgtttagaatttctttttctaataaataaaacttttaaagttaaccccaggtttaatagaaaaaaaaatcaatgcgacttataaatatgaatttgagaaagtaccaccaccggttttatatttttttcatattttatacaatgacaaggatttcaaaatatatcttttgagtatgtttttctattataatctcttctattataaaaatttaatgtgtttctgtaaaaaaacaatccgtatttttgtccatcgtcgtgtcggtttatttcccacacgacgcagccgcgctcactcagccaatctacgcattcgcttacagacatacgcatgcccagctgaccatctgccccttacggcttgtttggcaacttaagggaaggggattgggagtttacacgagggaattgatggtgagattaagatgggaatttgatttttcatcccagtctcttgtttggaagaggtggtggaaattgatatggagtttaattggagattaggtcattaatgaaaacggatggctgagatttgtttaggcgaagtaaaggaggaattccctgccaattaccaacccctacccaggtattgaaaaggagggagttcattcctcaattcctcatctctatcccactaaaattcccatgtctcccaaccaaacaaaagagttaatagcctcatccctctaaactcccaatccctcctaaaaactctccccaaccaaacgggccattaggctcttagctgccgcagctggccaatggccatgcctcacctgagccaaatggtctaatgggtttttcttttttttcttttattctctgttttcacctactcactttgatatatcttagtataaataaattggatgagatattatacaatatgtatggtagtatggtaaatcccataactttatcaagccatgcatttttcatgtgacgtttgtgttgtgtatttttttttttccactaaaccacttttagttactccctccgtctcaaaatataagcatttttagcatagtgccaagtcaaccatttttaactttgactattgaaaggaaaaaataaaaaaaagatcaataatgtaaaattgatgttactagatttatcactaatcaaactattataatatgcaactctttttatttaaaacattttatttttatagatattattggtcaaagtagcatctcgaagactgtgtcgagatccaaaaatgcttatattttgggatggagggagtattgtttaattttcttatatagtcatattgtatatataggtgatggactcaataaatatatttgggtcagatcttcatgggccaagcctaaaggtttttcaacacttttgtccggttgagtgatacttatcggcctcaataaatatattgtttcctagtgaagctactttctagaatttctctatagtggaggtgaattttcatcccacgaggggacatccccctcgttgtttgcatgtcatcttggcattcgccgccgccgccgctttcttttgccgacggagtggccatggacaggaggaaacagggtggcgtacatgatgcccatttgcgccatgatctgatcgcctcctggttttcaagcagcagacgactggatttatctcgaaaatgctttacaacggacgttcgatacgacgcaaaaaaatcggacataccaccgagtggaggcgtcaaccactcattcttctctctttctatcccctcaataccgtagcactgtatctcactcgtgtcttcccccttcttcgccggacgcacgcctcccctcctcctcctcctcctccacatccggccatcgccgcctcccatcatcctcctcctctagccgccgcacctcccccctccccctctccttcggccgacgccgccttccctcctcctcctcctccggacgccgcgccacccctcctcctactccggctgccactcctcttttcccattggcggcggcgctcccttcggctgggcgtggccggcgagcttccgtcctcttcgctggatggggtggcacgtgtagggcgacgagcttggggggcgtatctcgcggcgttggctctccccccaccggcgtcccctccctgcaaatcgaggcgcagggcgacgtgatcccctgcggcggcgcaaatcggctgcagccggcgcggggcctatctcgctctccagatccggccagacgcagagcggtggtggtggcagcgggggtgttcgctcgccgaagccatgccgcgcgaggacggcggccggagttgagggtggtggccggagttgaagacacgaaggtgggtttagttttgtgattcactttgttgtatttaaggtgttttattttgttttgattcgatattgcatatattgattttacatgttgcaatcgatatgttttgattgaatttggttgaaacactttcgtctatgcgatgaaacatttttctctggttgatgaaacatgtgaacatttttcaatgaaacattttgcaacaaccgtatgatgtttcagctttttatattttttgttgcactttattgtattaaggtgtttcattccattttgactttgatgtttgcatgaatttgatttcttggtgttacaatgcgccagtccatattgttgaatattgcatttagttgaaacaatcttcctcaaacgctgaaacatttttctctgggagtgaaacatctgaaacattttcattgaaacatttttttctgagggatgaaacatgtgaaacattcctcgataacatggtgcaacatcgtccggcgatttgcaccagatcggacatccgatccatagcagcctccggtttatctgctatctatctgcacatgtacaataaatagaagagaagagcttcaatcgcaatcggaatcggaatcgagtccgagccttacggcgtaccggagtgaggaagagaaaggggaagtggcggcttctatctctactgcggtcttaattgattgatgcatgggcctctgttccagcccatacacccgacctgctgagatacaaaggaataagctcatttgaagtacctggatgtggattttcttccctcgatgggacgtcccctcgttgtttgcatgtcatctaaatagttattaaaaaatttgaaaaaaattgatatatttcaaattaatctatgttaccaaattgtttttcatattttttttatgtctatttaggtgacatgcacgaaatgagaggatatcccatatattccctcgagtgatgatttcactttccggaagtaccttaacttctacagtgagaggaggaaaaagaacaaaatcgaacaaagctgcaaagtttgacagattaattaaagaatcatcattactgcgatgcgaccattagcgttgagtattacatctctctagccagcgtcgccgatcatcaccggcggtagcactggacgtgcaggaagaatcctccgggaggatggcccttgctggccatcacctcgtgtgctacaagtgctacagtaatctacatttactaatgacggattgattataatcttttgtgtatgtttttctattataaactcttctattataaaattttaatgtgtttctgtaaaaaaaaatccgtatttttttccatcgtcgtgtcggtttatttcccacacgacgcaaccgcgctcactcagccaatctacgcattcgcttacagatacacgcgcgcccagctgaccatctgccccttaggctcttggctgccgcagctggacaatggccatgcctcacctgagccaaatggtctaatgggtttttcttttttttattattctctgttttcacctactcactttgatatatcttggtataaataaactggatgagatattatacaatatgtatggtaaatcccataactttatcaagccatgcatttttcatgtgacgtttgtggtgtgtattttttttccactgaaccacttttagctactccctccgtctcaaaatataagcatttttagcatagtgccaagtcaaccatttttaattttgactattgaaaggaaaaaaataaaaaaatatcaataatgtaaaattgatgttactagatttataattaatcaaactatataatatgcaactctttttatttataacattttatttttatagatattattggtcaaaataacatctcaaagaccgtgtcgagatccaaaaaatgcttatattttgggatagatgggatggaaggagtattgtttaattttctttcactgattcacctattgcatatgtaatacttctttttaagaaaatagctggcacatatttttcttaattatttttcttttttgttttccttaatttttggtgcatcttacgtttgtcgtcggcacatcccctcttatcatcgtaatattttctctcttttctcgctctgtccataagtcttgtatcagttttcttccagagttcttgtggacaacacatgaaaagagatgtcctgtacataaaaattacaactatgcctataaaagcccaagcattatgggcaagaatatgtagtacattttgattttctatactcactgtgatgatgcaaaaattgatttccctttggacttaattttggaattcaggagagagtgccatgtccccgcaaaaaaaaaaagaaaggagagagtgccatggaaatggtgtccagtgttgctcaatgctgatagtgttctttcaacggcaaaatgtattgtgtctttttgccagaggtcgacgaaaaccatgaggccaggagattggtgagtgaggttgatgacgttggttgtgcgatggtcgaagtaggagagacctagcaatggtggcactgttgccccaaggttgaagtgggtggtggtccattgctaggtgtgggagttgtagaggtggagctcgtattcccctggtggcctaaacctgttgacagaaagcgcggtgacgatgtagcgttgtttgttgctgatgaggggttcgttaatgtcctgaggttcagggatgtagtgcaggatggagacctcgtggttagtgaaggtgatcatagggccgggatgggtgatgcgcgtgagagacggcgggatatcatcagcaatggaggccgcctatttattgtatgtgtagcagatagatagcagataaatccagtaggctgctagctacttgaaagccaggaggcgatcagatcatggcgcaaatgggcatcatgtacacctccctgtatcctcctgtccacggccgctccctcggcaagagaaagcggcggcggcggcggatgccaagatgggtactcctcgacaagctcgcctacttctctgacgccgacgtccgcaacgccaccaccgacctccaaaacaagggagggccatgaaatccaggtcaccttgtgcaccgccgcttgcccgccgctcgtctcctacgtgtgcgtccactctcccaccctcaaccctaaaaccaattacttcgccatggagccccagatcatcgccgcacacgatgacctcctcctcatccgcctcatcctcggcataggtaacaggttcaccgatccctcgccgactacttcgtcgaagtaacagagcttcaatcgcaatcggaatcggaatcgagtcggacggcgtccgaaaggggaagtggcgggcttctctctaccgcggccttaattgatgcatgggcctctattccagcccatacatccggcctgctaagatacaaaggaaataagttcatctcaagtcccttaacaaagttgcaaagtttgatactagattaattaaagaatcatcattactgcgatgcgaatgcgaccatcacacaccattgacatctctctaaccagcgccgccgatcatcaccggcggtagcattggacgtgcaggaagaatcctccgggaggatggcccttgctggccatcacctcgtccatccacaccctcccgccgtctccgtctccgtctccgtcgcgcgccttcaccatgaactgcgccccgccgccgccgccgccggcgaaccaccagtcgtgcacgtcccacatcacctccaccaccgcgccgtccccgagcaccgccgtcctgttcccccggaagttccacttcacccgccgcgcctccaccaccttcttcccgtcgatgctcaccgccacctccccgtcccgagtcccccactcctccccgcggcacaccaccgccacctcgtgctccgccccgtcagcccggaacctgcacctctttctttgctccacctcctcctcctccatctcctcctgttaatccttctcctctcgtatctgctccctcctgcttatcaactctctcctcggctcatcttctaatcttcgttctatctccctctcctcctcgccccctcccattatgacctctatctccccgtcggcgacgacggcgaggtagtagtcgcgcgtcggctccggggacgacgacccggcggcggggtgcttggcgtccgtggtgtcccagtagatggccaccaccgtgccggcctcggtgacgaacgaccgggtcccgcgcttcttgtgcaggaactgcggcgagctcgccagcgcgacggccgaccggcgaggcgtcgctgctgaagctgaaccagcagcgggcgagggggacgaccgggaggcctcgtcgacggcgacggcgaggccagtagcaccgccgggcgcggcaccggcgacggtcctggtccacatgaccctgacgaggatctccttgcgcgaagacaaggcggccttgtagacggtcgccgtggccgcctgcagcgagcggtcgagcgcggcgcccgccccggccgcggcagctgaggccgcgaggctgacggcgccgtcgccgaagcaggagaagtctcgcattgctgccagctcgacggcgacagcgagctcaattcggagagatcgatggatggatggtcacaatgggaagggagtctgcagcagcatgtgcagcgcaagaatgttgatcctagtacttgctactagtaaagaagaagaagaagagaagaaaagagggcaaatttaatggcaaaggctcatcttttgggcggatttgtgtgacttggtgattttggatgtttctgccatgattatgcccatgcatcagcatcaccgtgtttcttctctttatttttacctttctttttcaggtgaagttgcaattgcaaatgcaaatgcaattgaagtcgatcggggtagaagagcagatacaaggtatggttggttgggggagaaggcatttaaggtgagcatgtgtgtgcaatttgaccagataaccactactaccatccgacccgctgttgctagtcatctgcgtcgtggcagccaggaacctctttttcttccttgcaaaaaaaaaaacaaaaaacaaaaggatggctttccacttgattaatcaagataattgtttgcatcaaaacgtttattaagttttgcaataaacagaagaacaagtacaacaagggaaactcgactgtcatgtcatgatgattatcttaggatcaaatggccacgatcgatcgtgtgaatggaccacgcaatgcaaggaatggaacagattgaactggagcaagtactcctgctatctgaaaactgaaggggcatccatccatccatcatgggcatcacgaagtgagccaggtgtcgatgggtacagttgcaggtcacaggtgtaggcaggctgatggatgctgcattcggacacgcatgtcgcattggcaaaggagagcccccggaccnccctttgggttttttcccccttttaaaaattttttttaaaactgcattttatatggatgttacatcatactcttatcatggttgagtatatgcttgcttgcctgatcaattcttatcatggatgtttcatcatacattttatccatgtatgtaagatcacactactctttgtaaatggatgtagtagtagtagtatttggttgaccgggtctgaccgggatgaaaatggaaattgaccgaagagagaagtaattactggtcgagggaggagagagtcaagcacgaagcagacgtcgatatggtcattagtgatcgtcgacgacgatgatcctttagtccactgcagttttaattgttttggcctaacacaaataaatggtgataggagagtccaggtctgacgtgttcatgcacgcgatacaatgccggtggtattgcagccccgtagactacttcacacttggacatactcgtgcctactcctacacaaacatggtcgtcattgcagtgccgcggttatctcctcgtcgtcgtcctccattaatatttaatcatagtaatcagtgacgtgaataaagtataagtgatgtgatcaatagtccagagaaatatacagtatttgtcaagaaaaaagaggaccaagagtaaagtattaagctaaattaagcataactaagtatgtaatgtgttgtttttacgaatttttgggtggggaacccctatgtctactagtgatagtaactaacttttaaatttaaagaagtgcttgtttaaatttgtagtttaaaattattatatttcgtgactggtggtggagtataaagcagcatatgcatgcgttctgatgcaaagttgagtcctcccttgaaagactgaatgaagccaatggcatttacttggactgaagaagcatcagagcacccgcaatggtaaagtaaggtgctctctataaaacatgtacatctcagcaatagactcgattaatagtaaaccaccttaatagtatgtctacattggtatctatagctctctcatacattgcctcgtttttctctatagactatctctaaattagtagatagctttgctctctctcttcatttaatacctttcaagtagaaaaatatactgacatagatctcttgtagagagcctatagataaccattgtgggtgccctcagagatttcagtactaactctacagtagtacagtggagtcaatgaatggtcatctccgttcccttggaagtgatcaatcaattcaattattcgatgcagatatataaatgtttacatagagtcatagacgtagagacacgggatggactatgacactgttacgctgtaatgctaaacaatctctatctttgacactgatgaccattattgaacaattattatggatcgagtactagcttaattacctgacagttaattagctaggggaagaggagtatacactacagttagaatggaatggaagttaattaggagtagtagcttgatcatttgggcaacataattaacttgatggcaacggttggctcgattcgtaatactcaagttgcgacggccggaaacgtggaatagtggaaagagatggtagcaaagcagccatggcggcggtggcggtagcgcgcatctgatcttatcaagatgcaaacaaagagcagtgcccgcgaaacagcttgcatatatctctcccaaaaacatcagatatatcagaatcagcagctgccgctgcatgccggcttccaaaacacctgctacaattcttcatacctcttcttcatctctccaccaaaacccttttttaccctacacagttccgaagtgcctcagtcagaaaatgaaaggaattagtttttttttctatggaccaaaggaactagcttcttttaagcatagttacgttcttatttttttctagttgattgtccatgcttttcacttgtactagtactccaatactacttactccgttttatattataagactttttaatattgtttatattcatatatatgttaatgaatttagacatctataaagtcttataattttaaacggagggagtactgtacattcatgaaggttcttgtgttaattactggctggcttgcatctgcacgctcgtatgataagatcgagtaacctgatcgatctttgacagcatacaagaacgtttagttatgtgatgtcggtgtccgtgtggtgccagatgtgaatcggtgaacagattagggagaggaattacaaaactacagtgattcttccaaaaataaaaattaggaaaaaaaatctactagtactactggactgcaataccattaattaggtgtctatctccttcgtctaactagtccatgagtttgttctagctcctccgcacggcaacaagccagtagcagctcagctggcctctagcagccccatcgcttggctgataacggaaaattgcgaaatgagatatttacaaataaaaaataatccatgaatgaactattatatactgttcgtaatgatctaaaagaaaaaaactaaaaaataagctacgatgaactaaaatcaactctaaatatatatttcttttaaaaaaaaaataaattttggctaataagtataagtataaatgaaaagataagcatatggaaatttggctgattggagtgagccccatcgattagcctaataagctaaagcaaaagccaaaatttaaattttcgaatttaattttaagatattcaatgtaatttctttttagcgaataaacatataaaaattttgtctataaattaatttttatttcctaataaaccgtgttgacttattgtgaatacgtataaccgatgagtgtcagtactactatctttgagcggctgtatatgtgatcgattgttcattcgattgactctaaagcagggagagtggtaagtggtaacacgagtatgtgtatgcatgcgtccagattgttctagaacacttttataaaaatccatatttcagaggacaggactgcactggttagtacctgctcttccgattccaaaaccaaaagctggaactgaaacctctggatccatccatccatcggacgacgtcgcctcctcatccatcacaagtccggacggccagcagcgcgccacgtgtaaggccacgccagagaccagccaataggcaggctccaccgagtcagccgtcgttcccttaaatgtgcagtcaccgacgggtgggacccgctcgctcgtgctggcccacatatcagtgtatgcacatagagtgggtgggaatctccatccgtttgggaacacacaacacaacaactaccacccccactccgctccttccttccttcccgcatttggatttacccccaaatcttctccaagtccaatcgacctcatttcattcgattcatcgatcgctcggcgcggcttagggtttttggcggcagcgatggcgtcggagaagcacttcaagtacgtcatcctcggcggcggcgtcgcagcggtctgtgccctctctcttttttcgcttgcgcctcccaaatttgcaaatcaccttccttccgtccttctcgccctgccgccctgggaggggagtaggctgcgggagttcactgcaagatcgatgtgggattcattcgcttggatccttttatttgatcttggtctgttccggatctcgtcgaaagtacggtttttcctgttcctaatttctctctgaatattttgcagggatatgcggcacgggagttcgccaagcagggtgttaagccaggggagctcgccatcatctccaaggaggccgtatgctctctttctctctcacacacatacgcgcgcgcgcgggttgacacacaaaatgctctcttctgctctctctctttcaataggttgttcaggtgctccatatccataactgtagtacaccttcaatcgagttaagatgtctagtatgccagttttttgttatccacaaagcataacaatggcaaatgagttgtgcttatgcaatagttgcatacatcagtatgttagtggcaggcctcaactattatttgtttgctaattactgaatccacatgtttgtactaaatcttctgttgcctaggtacttttacttactggaaccatacctgttcttgttgtaagccacttgtttaagcatgtcgcaattaaccaaccttcaatctattgctggaattttgcctacaacaatgctttgctaaaaagaaaaactttgtattatggaagttgcttctgagggccaaaagaaacaattcttgtaaagccattttggcacagcaagaaatagtcctaatttgccctttgcaagttctgtcattctgtcaatttttacttgcttgttcaccaacacagcattgtgtttcttatcaaaagttctctttcaggtggctccttatgagcgccctgctctcagcaagggatacctctttcctcagagtaagtccttaacttaccgtgttctgccttttcgtgtctgacctgtgccagctctatgtcacatgtggattgatcaatttgtacgatcaaagtaacaccatttgcattctctgcgaatagatgctgcaagactcccaggatttcatgtgtgtgtcggcagtggaggagagaggcttttgcccgaatggtactcagagaaaggtattgactgccattttgctttctgcaccatatcatcttttaatgatttatttgtcattgttgaggttaattaccatcaatttgaaattcttatttttgctcaccttagtggaaatacgtcatgtaatgatttttttttattctaagcatactcctgaatcatgattgcatctgttggcaggcattgagttgatcctgagcactgaaattgtcaaagctgatcttgcctccaagactttgactagtgcagttggagcaacctttacatatgagattttgatcattgcaactggctcctcagtatgttgtgaactgtgaaatttgtttaatatcggctcattgctgtcattactatcacttgttatttacatgctctttttttatccgcttgtcaggtcatcaagctatcagattttggtactcaaggagctgattccaacaacattttatatctaagggaagtagatgatgctgacaagctggttgcagctatccaagcaaagaagggtggaaaggcagttattgtaggaggaggttacattggtctagaacttagtgctgcattgaagatcaatgattttgatgtcacgatggtgtttcctgaaccttggtgcagtaagtgtcaccactcatattttcgctaaccactgttcaactacctactacgcatcagatgaaaagaatcagttttgcccatacgattgacatgcagttatgatgtgaaacgaacttatagtggaaactttcgtgatgatgggaatctgacattgtaaaatatcttcttgtagtgcctcgtctcttcactgctgatatcgcggctttctatgagagttactacactaacaaaggagttaagatcgtgaagggtacagtagctgttggttttgatgctgatgctaatggtgatgtatgtacatcttccaaatccaaaatagctctgtagctctcagtgtgaatgcaaatgactgtctgctttccatcggttccctatttactaggtcacagcagttaacctgaagaatggcagtgtgcttgaagctgatattgttgttgttggtgttgggggcagaccgctgactactctctttaaaggtcaagttgctgaggagaaaggtggaattaaggttagtttgcttttaacctgtaggcttgaccacagaaggtgctagggatgtttctatcaaagaaacagtgtgtaaacaactggacgtttctttatcaaaaaacagcagctgtgcatttgctatttttcttttttgtgcaagcaactcgtttatagcatttggcccatcttgattgcattccttgaaacaattgagcatgtgcattattgtttataccttaatatctggcacgcccaaaattgtatgcagaccgatgctttctttgaaacaagtgttcctggagtctatgctgtcggtgatgtggccaccttccccatgaagatgtacaatgagttgaggagagtggaacatgttgaccatgctaggaagtctgcagagcaggctgtaaaggtgaggccattccacttgtgtttctctgaaatacagtagttgtgacgactaacaccacatagtggcctgcacttggatctgacttgatagtgatctgagttaagcaattattgaattgctcggaaaaccaccaaatgcttggtgttcatgagtatccctgattagcatggtagaatttgatcactgaaaaattctttgcactgtcattcaataatgatttgaatatattgcatgcaagaataacgttaaactggacgatgtaatgtattgtcacatggaatagaatgatctaatgcatagtcatctgataatgtattatgaaatattgaaattgcactaaagaatagtgcaaactttgtgttaatttctttgagttgtctttgcgagcagtgaaatgtcaaaaccttggagttaccaaaccacttggaatccaaaaacttcgcttgtgttgattctgattaccaacaggcaacagttgtggctacttaactcggaatagggttatcatatcttagcttgaaccctgcatctttgtttcaggcaatcaagggaaaagagtccggcgagtccgttgtggagtatgactatctgccatacttctactcccggtcattcgacctgggatggcaattctacggcgacaacgttggcgacaccatcctgttcggagacagtgacccgacctctgccaagcccaagttcgggtcctactggatcaaggacggcaaggtgttgggtgccttcctggagggtgggtcacctgatgagaacaaggccattgccaaggtcgcgaaaactcagccgcccgttgccaacatagaggagctcaagaaggaaggcctccagttcgccagcaaaatatgagatttttgtagttttgatgtacatttccacatggtactccccctattggttttctgattgtgatgcgtctgtactctgtactcctcttaaatatgggcacttgctatagctgctgagatttgaataaagaagttttctactacagcctttgcctttcacggttcaaagctactggtattgttttgtggaatggcggcggctgctgggctctcgcccaggcttgttgttacgccggggaggagaagccacagccatggacggcggcggatgtgctgcgccgcggcggcggcggcgcagggggagaggaagacgacggtgaggagcaaggagggagacgcggtggagttgtgccgggtggtgaacggcatgtggcaggtgagtggcccgtcgtggggccgctacgagacgcccgccgccgtggacgccatgctccggtacgccgacggcggcctctccaccttcgacatggctgacatttgtaagcctctcctcccgccgcattctggatacctcgcaggaaactgacacgtggggcccactcgtagtgacacgtactgtagctgcgtgaaatttaccccgtccgtgccgcgacgaatcgaggccagtagcgccttatctccctccctctctctctctctctctctctgtgtcatgtcgtcgtcgtcgtcggcagctcgcaccctcctctcgccggcggcgcctcctgtcccgcgccgcggcgtggtgcgtcccgcgaggtgctccgggggcggcggcgcggcggcggtggagacggccgcgtcgggggcgaaggtttgtacggtgagcaaccgcggggactccctggcgatatgccgggtgctcaacggcatgtggcagaccagcggcgggtggggccgcatcgaccgcgacgccgcggtggacgccatgctcgcctacgctgacgccggcctctccaccttcgacatggccgaccactgtatcaatctgcccctctttacctctaatcactctaaaccctatcgtcggcatttgtgcgaacacgtagcgtgcgtaacattgttgctggtactatgcatctactaggtgctatgcatctgttggtggcacttagttgttgctcaattgatgcccataagctgtacacctgtcccacggttatgagttgatgctattcgattgaaatcgggaaatggttttgtttcactttgaaaaaaagtttgcttcaaaaaaaaaaagttcatgtctctagctatgttcagttcagaaaaggttcatgtttcattgacgtatttagctgcacggcgtagcaagtgtaaatatatgagagttgacactaataagaataaatcaatctttctcctaatatttaatctaggagcactgagcatggtatcaacttgattttaaggcatggttactgttttggcagatggaccagcagaggatttgtatggccttttcatcaatagagttcggcgtgagcggccacctgagttgcttgaagaaatcaaggggtgagagcgatttaccatggtctttatgccactcggaggtgtgtatagctgtttttccgctgcttctaattgttattttattaatctccgcaggctaacaaagtgggtaccacctccggttaaaatgaccagaagttatgttgaggataatattaacagatctcgaaagagaatggatgtttctgccttggacatgctgcagttccattggtatgtttctgtggatttgtgtgctacttattagttatagtaacatttggatgccatttggtttattgctcagttttattacatttactgctaatcgcaaattaactacattcttagaatgttgaactgttttgttgctaaacaataaggaacctcctgtctcaagtgacttttatatcacagtttcttgtacgtttgcacaatcaagtttctggtgatctatcatccagaaaagattgtgtccttccattgaccattgctcttagcttcgtagttatgctgcagtagagaccagtttagagtactacagatttttagttttgagtgtactgtggaaagtcctaaacttgagaggtgttatgataaaaacctgcggtatgtgtaatcagtcgaggaaatgcagcaatgttttatactataactactgccataatttgtaattcagctgaccttttatcataatataggtgggattatgcaaaccctggatatctggatgcactaaaacacatcacagacctaaaggaggaaggtagtattttgaacttggatcagatttttagtctacttatgtgtttcctttcgcatgtcatggtttttcagtactgacggattctcgcttcatgccttgttttgttatgtacaatgtgaaggtaagataaagacagtagctctgacaaacttcgatacagacaggctgcagataattctagaaaatggtatcccaattgtcagcaaccaggtatattttcacctaacccttatggtatatttgccttttatttgtgttaactatcatatggtccactcaatgaagtgagggatgttgtaattgccaggttcaacattctattgttgacatgcgtccgcagcgaagaatggcagaactttgccagcttactggagtaaaacttataacgtctactcctaaccccatgtcccctctccctgttttggcataacacatagttttaatgcagtattactgatgcaggtatggcacagttatgggtggtctgctgtctgagaagtttcttgacaccaatgtatctataccttttgctggacctcctctgaataccccatctttgcagaagtataagcgggtgagcattttgtatatcctatgtttgaacgagttacctccttcccaattcttgctattctcattgttgaagctgtgacagatggtggatgcctggggtggctggagcctgttccaggctttgcttcagacgttgaagaaagtatcattgaagcatggtgtttctatatcaactgttgctgtgagatacatactgaaccaggtatacatccattcaatttatcttgagatttgtctttttcttatatatatataaaatagtatcagtgaagcatttgccataactaacatgtgacctttgtcattttggttgtttatgggaatagacatctgttgcgggttcaatggtgggtgtgagactgggactctctgaacacataaaagacaccaacgccatcttctcgcttgaattagatgaagaggacatgaacagcatcactgaagcatcgaataagggaagaaatcttatggatataataggcgattgtggagacgaatacagagcataattgtgcagagagataaagagagagagaggcagagggggtagaccaatgaggcgtgtgcctgccagttttctggagttctgaaatctgatctgttttgtcatgaacgtagtgtgcagcagctatctgatcttccagtatactactactccagatcagtgtgtaaaccaacctcccaaaagaaagtggcattttataagaactgtacatacacaagacagattataatttgatatgcccattaatacggattcgatttgcgcagttagccaattaaggagtgtcgcatatgctttggttggtcatgtccagggggaggcactgcactatttcatcagcaatcatccacggaaagtggtggtgacagaccgactggcagaatcgtgccctcaccgaaagccacaatataatgcggtttgcggccaggaacagaatcttcgttcccagcataccatatcccgatcatgtaggcaaggtaccctccttgccttgcctagctgctcccatccaccatgatttgtacttttccttcatccttaccgtttatataaataataaaaaaaacggcatatattaatcagataaccaccaaatttcatgccaaataggctcctctaagatgtcacgtaaaactgccatggactgatgggcgcatacaaaatccatatcctttttctcccatattataactcaatctcatccttattagtctttgctccataaacagtcatactgaaaaaaaagggcgcataatatgatcgttcccggtaagattatacaatgtttcacaatataacaccagactgccagcatatatagtcttccaaacgtaatatcttcttgctccaaagctttctgaatattgtattgtaatacatcttgtattcccacaacaaaatcaatattgcaatacattttgtattgggaagttatttatgttttgccttgcattatgataggatctttttttttaaaaaaaaacttatggatggtaactaatttgttcgtctgtatcactgtatggtacaaatgattaagaactaaacattgccaaccagagctttatgacctgaataacttcttgccccaaaaggcttttcaatgttgtaatacattttgtattggaagtaaattttgtttcatctggcatgcaatgaaatcactcaattttccctactaaattagtgatgatttattaggctacattggtaaaatcatagaaaattagtatctattatatagccgcataacaaatttacaatgtcacatcgtgatgccatcacaatggctttacagtcataataacttcttgcgccaaaaggcttctcaattgtaatacattttgtattggaaaagtgatttacattttgtgtgcactatgatggaatcgcttttttttactacttatggacaatattttattcggctaccttgagaaaataccgctgaaattagtaaacatttcataaccgcatcactgccgttagagagctttacgaccggaataacttcttgcccaaaagctttttcatattgttatgttttatcatcgggatataattatgttccaagtggcattacgatggttcttttctacctatagacaacttttttttttcatttgcattggcaaaatcctattaaagttagcaaataatactcactctgtttcatattagtataggatgttttgaatctttttctagttaaactttttaaagtataagtttgaccaactttacagaaaagcataagaacattttcaacgcaaattaaatgtaatatcaaaatacatatatttaatattaaagtttgccttatagaaaaaa

SEQ ID NO: 80666 - DNA, 68962 bp, Oryza sativa
aacggtatgattagaattttacaaaatttcagtatcacctagccaatttcatgtatagcaatgccattttttcaatgtggcaaatttacaaaggcataggtcatttaaccttcatactaagcccctctttagtgcctccactttcctttcaaaataatttaaaagttaatgtataaactaaatcttatagtgtaattaccgcctaagttttgatttttacattgtaattacaatgtaagtgtacgtagaaatatatctattaatctcattttcatgcacgacagcgctccctttaacttatcaattaattctacgagattggagaaagcagttaataactaataatgcctacattctcatatatatacatagattattttcctctccaaatatacatagataatttgatgatgtcatagaatatctatgcagccaaaccacaaaatcttaaactgttaatatagacagaaacaataggatttgtattgatatgtaaaaatgatattaatagattattcattgtgaaaaaaatatttcatatagttatattgtaataatttttataaatagtttccaaaaacaatagagaccgcgtcgatgcctatctatactttctataaagttaaatcccacttagtctaaaactcaacatgcaaccattccatatcatcgaccaatagcaataatacctcatgcaagcatacaacattatctacaatttatttaattctacaaatcaacatgcaaacatatctaatcatcatctctcatatcatttgcacaatattttaataaatatatctatcacttttacaatatttaacatatacttattaatgtgtttaagactaaagcaccagtatcatttgacagataaaccctaatatttttttttctttttactcctagattgattgtcaaaaaaaaaatttattgagaattgcatacgcagtcaagcgcggggaatcagctagtaacgtcaaataaaaaataacggagatagcagttcaaggaggaaattagtaattacagtcactctctttgggatcacgcgattggcatctgggcattcctgtccctgtccccggttaatttgtcacacgcggacgcggtccattaaatattcgcaacaacaacgtatatatacaatctcaaagctcttttaatttaatttggtcggcaatccaatttacttttgcacttttgcatttgaaatgagtggcatttgaaaaacaaccacttaattatttgttggcctttacggagcgaataatcatcctttttctcgggttggtgttacgttttcttctgtgttaattaactttgtttgtgcgcagggatatgtatgattggacctttttttggtcatgcttcatccagtgcttatgcattggattttcatggacaaattaatatgtatgttattgtacgcttgaggagtgaggacaaacatatgcgacctgtacggacaataatatgcatgcacattattgtggagatcaatcatgcattcaacatttacagaaacctactccctccgtttcaaaatgtttgacaccgttaactttttagcatatgtttgaccgttcgtcttattaaaaaaaattgttaaatatgtaaaactatatgtatacatgaaagtatatttaacgatgaatcaaatgatatgaaaagaataaataattacttaaatttttttaataagacgaatggtcaaacacgtacttaaaaaatcaatggtgtcaaacattttgaaacggagggagtatataggtagatactaatctagcatcaaaccagagtcaagcacgcctagctagctatctgcatgtcaagccaaatcgatcaccccccaaacatgagcatatatgcacaatatatatcatccacctaatattatcctcgttttccttatacctaacatggctatatataagatgcaatttcacctttacatattggaatttttaattacaatgtacaccatcttcaaaaaaaaaaacaagttctagttatgaatctagacattgtctatccaaatttataactaggaaccttttttctttgaacgaagggtgtattgtctatttttaaatttatgatgttgtttacttgcggatatattgaccagctgtcttaactgtccataaggattatgtatttttttacatgtttttatcattaaagacactttaaatatgacgtaatttttatatttacactaattaaaattttagaataagttgaatggtaaaaaacgctcatgagtcgattgtgtcatatatttataaaacagatggagaaccaataaaattataatgcgtatgaaaattttaaaagtgagtcaattcgtaaccacattaaaggtgtgtttggttgctggttacactttaccacaattaaggttagacaagttgtggtagccacaaaaatgtggtggataaattgctatgccacaaaagtgtgataaagttggcaaaaaaaaagagtctataacttgtgggacaatgttattgaaaagtgtggcaagccacaattgtaatataaaccaaacacatgtctaacaaactgtaagtacctaaaagtgtggaagtgtggccataaaccaaacatcccctaagactatgtctggtttaggtctttaaacatattatttctgcaaattatttactcaagaaattaacttaataaataacttaaaacattggtgtaattaatgaaatagaagaaagtaaacatagtttttaaagcccgaagcgataattaatctattttaaacctggcttaattaagatagtttttgccttatttgtgatcaaactaacccctcatataggaaaagattgacagcatagattactaaataagaacgaagacattatatataaacaaatcattaaccctcatcaactagataattgtctttgatctgtaattaacgtcagtaaatcatgcaattagcttcatggattacatggggacgctagcttgccggcatatatataactggaaagatctgctcatctgcatgccttttctgacagggactcttgccgtactgtcgacgagcaaaactagggtgccgacaaataatggggaggacattatttactcagaacatcgatcgaaactccagtaaattatagatgcattcaactactttgcttaagcaaatattaaaccgatgaatcgcctgggcctgcaagttttgataagttaattaattgccaattaggtctatatatatatatagagagagagagagagataagttgacataaacaagaagttctttaattcgggctagcaaccagtacactgtcaataattccgattaattcacgaggaatgatatatatcaaccattactatatttaagaaaaaaaagccatcgaggtgctgtttatttgtgacattattaatgttttagactaatgtgaagttcggactgtttccaaaacatattaacagtccctgcatccgtgccaattgctctttctgaattcaaggacttatttagttgggaaaaattttgggtttgattattgttacatcaaatatacggacacacatttaaagtattaaacatagtctaataataaacaaatcatatatcccgtcaggaaactgcgagacgaatttattaagcctaattaatctgtcattagcaaatatttactataggaccatattgtcaaatcatggcgcaattaagcttaaaagatttgtcttgcaatttacacgtaatctgtgtaattggtttttttgttttgtctatatttaatactttatgtatgtgtacaaacattcaatgtgatgatgtaaaattctttgttttgataactaaacagggccaaattaaccgagcgttgttgacgtacgctgacatcacgacacacgtcatcatgccagaggaagcttgctagctaggctaggcggccatgaaagaaagagaacagaatgggttgtcaggtcccacttgtacaccgtcaaaataataattctcacagtggtgatgctgtttaactaggcaggcatgtacagctagtacagaataatttcatttcagattcttcatctgcaacagctgccgattcatgcatgcatatatatagcgcatcacatgcatattttggaaattaattactgttgaatccacgaaccacatatgaagtatagctaaattcttttccctcttttagaggacacatttctcttttttaaaattttgaagacaagattatacttatacagctgtggtgtctaattgggccttaggcttttggcggcccagtagtaggttgagattctgcttgatggattctttctagaatctggactttctagtcattctaattaattgattactgtatcattatatttataacagaggtccttttaaggggaccatacacacattgtagcaaaggtcaatagataaggttaattcacagtgtgataagttaatctgtctactaattatttgggaatcaatcacaattgtttgtagtcttggcagaggaaggatgaaatcgaccagtgatattccagttctgtgcacaagcagagataattaacccaacatggatattgatttatacaggtagatgtataaaagtgatcagaagctcctctataatgaagtaaattacaggcaaaatgtgggtatatgtggtggttgattgtttgacctgcagtcaccaccctagctaaaataacttatcgtgtggtttcataacaaccaagccacatgattcctagtttatttatcatggagataaatgttacacatttgtttaccagcatacaagacctggacacgtgcaattggggatcgtagtacatatctagccagatctttctgctcatttagtttcatggctagattttactatgagttgctttatgaatcaaaccagaaattctgtactgaagtatttgtgaatgtgtatatttgtcatgtagtaaaaaacacgaatattagggaacgacctaatatgaaataattagaaggggtgagacttcgaacccagatcatttagcccgctatcttgtggagctagccggaagacgacccatgggtgtttgtcgtatttgtcatgtagtagtgtttatattctccattattttttaaaatttttttaacattagttaatcataatttgcatttttttttaattatgacgcattcagctagtatatattcaaccaaagttacaacatttccatttttgtccgattaacgagggaaccacttatgtgctagtagtatatatataatataatacacgcatgcatggtaccagaccagctcataattttcaggtactttggtatgtcattcgtgtttgactcggtttttaaattcactcgtttttaaaaatacatatatgtgtttgagtcggtttttaaattcaaatgcttttggaaatacagaagaagagtcgtataagaaatctctttaaaaaaactcgcatgctaacttgagacgatcagactcctaattgccgctcatgattctgtaaaactaaacaaatccaagcgaattctcacggtgaattttaccttaactaaaccatataataataatcaaaagaaacctcacgcgttgcaatgcacgggcattttttctagtctgattaaatatttaaattgccacatgaatgcatcaagagcatgaacttggtataaacagaaactaaatccgaagttccgaaccaaaccaaatttggcctattatttttagaacctcacttatgaaatatttcccttgcaattatgtacgcgttcctaaaatccttgcgttccaaattaaggaaatcgctgtgtacacaaaaattaaatccaaaattagttgcttaattattacaggtgatcaaaagtactcccttcatctcaaattacttgttctagatttgtccttaattggtcaatgatattaatctttgaatatgaatttatataattaaacttatatagtttgacacatcacaagatttatatatttagatttatcatgagaaatcctatcataatgttgccaaaccatgcagattttcaaaaattaatagtcaaagttagctagctagacacatttgatttataataactaatccgaaacgactagtaattaagaccacgtttgattcagtttaggattatgataatctgaattattaggagtaagctgaaacaaacagatagcttattatgattgattattataatctataagccggattattataatatgataatccactctaaaggtgctttttctaaattattgggtgaataacagctaataatccagagaatcaaaaggctaacagcttattctatgtcagtttattataatccagcttatagtaatctgatttaataatctatattataataatcttaagctgaaataaacaggcctaagttgaaacggagagagtacgtagcaaaatcaatcagagctgggtgcatatgcaacgaattaaatcggagatcgaacggtcgatcgaaactaaagcagtgtactgcatgcaacggcttgcaatgtgtgtaccagtctaaccacttaggtacttaaaccaaccaaaaaagtgtaagcaacccaacgaatccttgcatggttcgtcaaccgtacgtacatcaactccaaatcgggtccccgtaactatacggcattatggcggcgctatatatttcttctatctatctactctctccttctccagatattttgacgccgttgattttttaaaacatatttaaccgtttatcttatttaaaaattttaattaattaataattcttttcatatcatttgattcattgttaaatatgctactaccacttaagtttttaaataagacgaacggtcaaacatgtttaaaaaagtcaacggcgttaaatatttagggataaagggactaattaactatagattatatatataataagatttacttcggttcaacaaaaaaatatctcgagatatcggtaccaaatcattttctaattgttgaatctaacaatgcacatcctgaccagctcgatccaacgatcgaaaacaatttggtaacgtcaggtaccggtatatcgagatacttttcgttggaccggaaaaaatctcatatataatagccatagttagccacacaatgatgggttgcagctgacacacactgccagtactacgtggttatactgctaatgcgtcattagctcagttaattagccattgagaggcgagctcgatcgaggtgaggaggttagctcagctgtcgctgtgaacacggagctctctctctctctctctctctcctctctcctcttcacccgctgccgcccactactactaaaacgggcaactcatccacctcctcgacgcagcctcactcctcctccattgctacctcaagctccagctcgagctcgaggctttgctttggccgcaatgccggagctggaggtgtgtagccctgcgtcgtcgggtggggcgtcgccgccggagtcgccggtggaggggaggaggggaggaggaggaggggagaagagggggagatcaggggatggcgggaggcacccgtcgtaccgcggcgtgcggatgcgggcgtgggggaagtgggtgtcggagatcagggagccccggaagaagtcgcgcatctggctcggcacgttcccgacgccggagatggccgcgcgcgcccacgacgccgccgcactcgtcgtcaagggccccgccgccgtcctcaacttcccggacatggccgcctcgctcccgcgcccggcctccgcctccccgcgcgacgtccaggccgccgccgcccgcgccgccgccatggagcccccccagccgccgccgtcgtcgctcaccgtgcaggccgactccgccgccgccgcattcctgacgcccaagaacggcggtgtcagcggcgccggcgcggcggacgacgagctcgaggcgatcgtcgagctgccgcggctcgacgagctggacgccgccgagctcgtgttcggcgccgcgttccaggacacggcggcggaacacccgtggtgcgaccccgtctggatcgacggcggctacgcggcggccgccgcggcggcggcggcggccgcggcgcacgacgacctgttcggcctcgacgccgaccaccatggatgggcccagtcggttggtgccctcttatggaacctgtgattcgatcataataataattaatctctaattaattaccaagtaattaacagctctagcttctttaattttaatctctccttttttttccagcttcctaaatctgtacataggtttccagttttttttcttctttttttaatcttttttcaggcaggcttaatatatatttctgcttgattttttcccctttcgtttcaagtgtcctgtagctttgcctttttgttcagtttggggctcttgtcttctgaatttgtcttccctcttgcctagtggctctacctgcagagtgtcaactaagctaagtcattaatgacttaattatgtataataaaaatctttacatgcaagcactacattgttaatttggccatcaatggtccataattgaatcctcctcctcctcaaccattactatattatcattatatactccatccgtttcgaaatgtttgacaccgttgactttttagcacatgttttaccgttcgtcttatttaaaaacttttatgagatacgtaaaattatatgtctacataaaaatatatttaataatgaatcaaatgataggaaaagaattaataattacttaattttttaataagacgaacggtcaaacatatgataaaaagtcaacggcgtgaaacatagggagtatatgtacaactcctagctagcagctaggttcctgcatgcatatatattcagtgcagggggcaattgattaagcaacaacttcaaatgacggctttaatttagtaccattgctatcaattgggtaattaactagctagtgttctttgatcactcatcctaattataaagtgtaaggaaaaagtagccgaagcactactgactagtagtactgaggcagccatttttgtgcgtgtggtgaaaattgaacttaacttaatttgatcaaaatgtaactttctttcactgctttagtaattatttggtcagcaactagtccaacgggccatcttttggcttattcaaggaataagtaaaatggtatatttgtaaacgaaaaataatttatgaataaaacttttatatacgcgttcttggtgatataaaagtaaaggttgaaaaataaaactacaattaaaaaaaccctagaatcaactctaaatttaaaattaaaaatttaaatattggcttataagtataagcgaaaaaatgagattgcaagtacgctgccgtagctagctacacactttccgtcctaaaaataattaatttttaaggatgaatttggccgtacctccggaagttgatattttagggatagatgggtataggtttaattgtgtgcttaattgattaattaatcctatatatatatatatatatatatatatatatatatatatatatatatatatattgattattatttgagagagggacacacacttcagtacatctctctcacggacacgcaaaagcaattaagctagctagagagttgtctgttgtattttttggatggtgtgaaattaagaaagcaacaagatatatggctcaatccatgtaatgcaccccaaaaatatcgccatgcatctatcgtccaaatatttggttgtactatacctttttttttttttggttccatccttttgttcgtttcttgtcatttttcttggacagccactgattggaagagagccatttccagtctattatatagctaggttgtggttgggagagatgccagctccatctgagtaatgactggtcagaggttttctccaagtgaacagtgcttcttggtgtgcatgtcaatatgcatgtgtgtggttttttcagaatattcagagttttgtccaggtccaagtacgtcatgctgctgctaggtagtaaggcttgtctgcactgttctggagtgagctcgattaattggtcgcaaatgtaatccttcagacaatgcgcagagagtttcacaggaccaccacatgggagagaaaaacaaaaagacagatatattactccgcttaaaaaaaacttaatttctgattgtgtaactggacaagtatttaaaaaagttaatgttttcttaaacaacttaggaggagtttttattagctttttgactcagctacctttctcatctatcataaacacgtttttcaaaccattaaatgatgtgtatcgtaaaaactttatatatattcttttaaaaaataaatctatttttattttataatagttagtacttaattaattatatactaatacctaatctcattttatatgccgctaaaaatctcgacctatatatccagctatatatccccacattcggacaaagccaaattgagaggagggagtactagatttgtgtgatgcatgggcatacgcaacacacggacgtgcgcattcagggattgatttgtacttgtgaagggaaacaacacaatgaacgggtaaagaaaaggcgagtcatcatacagggtgtagggatatgcaacaagttgtgaaagcaagagagatgtgtgtcaggtgatcaggaccagatcaatgtagtacacagggtgtgggtactcctgcatcttgcaaaggacaggattgactgcaacagtgcaagtcttcctggtaaaatctgatttgggaatgaaacactggaacatgccgagctagtgtacgtactacggattacggatcaaactgtcgtgtactgtagtactccctccctactataaaatatatgtaaagcttttcactatttatatgtccaacgtttgatcgtttattttatttgaaatttttttatgattagtatttttattgttactagatgataaaacatgaatattactttgtgtgactaattttttaaactttttattgtaaatttttcaaataagatacccacggttgtacttattttagaacgaaagtagtactttgttatactactgcatactgtgtcactgaaacgaactgagtaacacagcaacttagttcgaagttaattagttttttcctataatattgtggtaatgcctcttttcagtgtcaaaaccaggacgggttttgacaataccaaatttattgaaatacaatttgtattagtatgagcaaaaattggtagcaaactaaatacaactgagcttgtcatactactgaaatggccaaaaaattggtacgataaaattttggtttcaatctaaataaccctaatatgtgacacgaaatttgcctttataaggcgtcgtcaaaatttaaatattcaaccttaattttagagttaattttaaattttctttcagcatgattccgtttttaatattgatttttttaagacgttaagtacatacatataaagttttatctataaattatatttaatttattaataagccgacataaagaccgaaacaagattttttttcccttctagatgatcgatcgccagcccaaggtaaagaagcagtgtttacgggacaaaggtgaattggagaagcgtcgccatcgagcgatccatctttgctgggcgatcgagaaataatgaagctctcgcagggggaggggggggggggggggggcactgttcgctgggaatcaaaatcaacgcacagcacagagtaagtctagctagatccatcctttcctttgcaattttaatttgcaagcatgcatgcattgctctgatcgatcgagtgtctctggacgtcaaactcagctgcagtgaaacgagtgtgcaacactactgctgcacacatgtgtatactgtatggtaagcgatcgatcgagtagtcgtcgtcgtcgttgctctctgcagctgcagatgcatatgggagatgtatacagtagtaagaggagctagctagccctgcattggcatggccagccaccgccctgtctggctgtctctggccggcggttagcgatgcaccccattattctctaattaattgagatatactgtatattctacctcagtttttatcggcatatttttaaattattaaatggtacatttcttatgaaaactttatatacagagaagtttctctaaaatgtcagatacatttgttttttaagttcatcttcatcttcatctaaaacttcatcttcatattaaagtatgaacaaacaccactttagtaagtcccggaataagttgatttttatgctatctttagaaaaaataggagggaaatgtgtttgtacactattggagaaaccatctttggtcagttgaccaaattccataataatctcgattgcaaaaaaatcagaactaatatattctttagtcccggtttaaaaggttagagctattttttttatctttagttccggttggtgttatcaatcaggactaaagatcatttttagtcctggactaaaaatttagatgccctgagtaacttgcttttaggccgagtttagttccaaactttttcttcgaacttccaactttttcatcacatcaaaactttcttacacacaaacttccaatttttctatcacatcattttaattttaaccaaacttttaattttagtatgaactaaacacacccttagatatggagggagcacgtagaccggccggtccgactgttgtcgattattacgtcttgtcacattaacatctcgaacaatcttctgacaaagccaattaatgcacaccgttattagctggttttgcaatttgtacttattgacctggcatgcatgaacatcgatctcttcttgcgtactatagagtagtaggtatgctccgttccgattaatcattatggattatgggtgtgtttagttcatgttaaaattgaaagtttcgttgaaattaaaacgatatgacgaaaaagttgaaagtttgtgtgtaggaaaagttttgatgtgatggaaaagttagaagtctgaagaaaaagttgggaactaaaccatgcctatattacatatgggtgaaaaaaagaattaaaaaactactccttgtgtcccggaatataaatatttttagatttagatacggttattaagaaagtaggtagaaatgaatggtggaaggatatgattggttgtgtagtggaggtaggtggaaaaaatgaatggtggagagttgtgattggttagaaagaaaatattagtggggaagttgtaataaacatctggtactatatttacttcggtaataaactcgatatatctaggatcctcactattttctacttcctccgttttacaatataagtcattctagcatttttcatattcataataatattaatgaatctagatagatatatatgtctagattcattaacatcaatatgaatgtggaaaatgctagaatgacttacattgtgaaacggagggagtagccaataacaaatcacgacattatatgttgattatatatatggatgcatgtatcaatattcatttactctcatgcataaataacgaatagccttagaaaataaatacaaatatgattgtcatttgagaataacctcaagatatatgtatgataattaattggaaatggatgaagtagtgtataatataataattttacacctacagttatatagacaaaatctctattatgatacgaagataatagcaacatatagcaagttttacagtattagagatgatagtcgtttataattttattcatatcatctactcctttgttcgctaatgatcgtatgatttataagtactctttctaaaatatgatcagtgcacttgtcccaacaccccgtaatagttttaatttatttgtttgattataatctattcatctatttctttcatctcttttaaattttctgtagatatctcattcgtttatctcctctattttcttcccacctcataaatgtaagcatacatatcatcaagagactagatacgtgcctacttcctccgtctaaaaaaaccaacctagaagaattgtttctttttttggacggagggagtagatgttattgcaattgcatctgctgatgtcatggacacgtcactactgatactcctaccccaaacaggcaacagtaacagatgaggctgctagctagaactgctcggaattattttcaagagaaaacttagaatcgggtgcccgatggtttggggaaaaaattgggcgttgatgtcagcatgacgtatgcgtgaaaaaacactttaaactatttttttctcttaacttatttatccaaatcatgatccgattccactattaaattcgttgcaattaaatcttcaaaacaaaaccacacatggatatattccaacgaaaaattcttttagcttattattgaattatttttaaggcaaaattggttatatagcattgatagttcacgttttttgttttatagcacccaaagttcaccatgttcaccatgttcctatttttaacgcttatgtcaattttcgatcgttttctgtctgtcttgatctagccacacacacgatatgacgtttctacccctcacaagtacaagtagaatgcatgtcaatgaggggtagaaacatcatattgtgtgcgtggctgggtcaatagcgatcaagacggatgaaaatattgacggatgtgttaaaaatgggaacggggtgaactttgggtgctattaaagtgaaccggtatctttcgatgctataaaaccaaaaacgtgaactttcaattctatataaccaattttgcctatttttaaatattgcacgatgttctactaggtatatcggaattgtttcactaagtagatcaaaaatgtttcaatcgtttaattcgggcgttgtttcacattatataaaatcaatgtttcagcaaattcagttcactgtaacatttgatacatatatactgaaacattgaaacatttttggtgaaacaaaaaatggaacgaattcccttaatagagggtttccaaaatatgtaggtgatttattgcaaaagaatatttcaattcactgcaacattagatctatacatagtgaaacattgtgagtacactaggtgaaatatttttggtggaacaaaaaatgaaacgaattcccttaatagagggtttctaaaatatgtgggtgatttgttgctaaagaatgtttcaattcactgcaacattatatctatacatagtgaaacattgtgactacactagatgaaacattttttgtatagacacatggcaagtgggggcagaggaccgtggtggggcccaagcatcacgtgtcacgcgcgtggggcggggggagcgcccgatttttgctcccccccgccggtcgaccgatcgctcgcattcttcttattttcctggccggccggacgggtgcattacaattatattattctctcgtgtttaaaagggaaaagggaatgaaaaggaccattgctccacaaccattcgatcgatctggagttaccgctgcaggacacaaaaagcacaatgaatcgccacagcggacaaatcactttcgtcactattgctactgctcgacacttttttcacgcagtgaatttcacaaaatcaaatatttaatggtctaagcttcacaaaaattagctattttaactgatgacatatatataactgtaccgtcccccagctattgtggttctagaattttgcaaaaccacaccctataacatagtgtttatgatttttttttattaaattcttgactaaggttgatatatagttcaactctttgctgttttcaaaagtattgtttcagatatgttgaaattaattgagatttgtatgaaggtaaggctttataacacatttaaatacaaaacctgtggtaataaaacataatgttttctacttctttcaaattatagtcattttcttctccaacactactacataggatggccatgcatcctacttaagtccttcatgacactactaaaagaacctaatgaacctaatataatgggtgccggttatgaatcacacataggtattggtttcctaatcgacaccctaatagcgattctcatatgtgatattgacaccaattttagattaagaaccggcacccatagtgttccacaagccaagaaaaaacaaacaaaaaagccaacttgagccaatactcagagcacccccaaccctgtccctaatctacccaactacaaagtttaattcacagataacacatgagcacaacaaagtttacttcaacactgatcccatattaacaaatcaacaaataaaaccaaataatagcctctagatgttcatattaacatatgaacaacacattccacatgaacataacaacaatcaataatcccctaagttgtacacgcatctggagcctccattgttagatccgtcggcctggtaccatggagaatgcgagggagatgaggaggccaatgatggtccatgacagactcttgataaaggcacgcgagctcgaggtaacatgcatcgtcttcgtagctgctactgctcgttctcgtcactatcaagttcgcggcggctgtatctggttgcccccgacctaattgctgctagatccgccggtggtcaccgacggacttgctggcgttgctcatgctcatggtcgcgaggatgcgcgatggaagagaggggaaggggcagcgaaggtgaggagatagcagaagagattgtagctactagaagctatctaaattgggtgttagcctctcaccgtctctcttactggccgtaaccaaataaatttaaattttaaaatttaattttagagttgattttgataatttttatgatagtctattttctatttctttgaaatcacaaataatacatacccatcaaaaccttagacaaaattcattctccaaaggaaaaagaaaagacagagaagacgacgttttctccatccaagtatgagttgcatgcatcacgacgtactcgcgatctttccctttcatccaagtgcaaatacaaataattttattactacgtattaatttatcctactgttcccgatgcggctgtagcttttatggttcgacggttaattttttacttgtattacaaaagttcctttttcgtagtacacaagggaaccattgtaattaacttccatattaaatgaatgaacaagttgcctaacttttgcaaattggcatatactcctatatgcaccgcactttgcaaaagtgctccatggatgttgatttaccacacgcgtaattaattaagttaattggtcattaatgtaagtgtcactccttacttttgctactccgtacatagtttaagtaaatgtgtgtcttgctgatgaggagggccggaggtcaagtggaacaggaggtcaatcaaatgatcattcggtcgcaatgcagtgtacctgattaaactaatggaggggcaataattccaggggcactgtgcggcaacaccgtctgcttttcttgtggattcatttaggagctgtttggtttacatggacttatttcaagtccatgtcacatcggatgtttggacactaatttagagtattaaacatatattaattataaaacccattccataagtttggactaattcgcgagacgaatcttttgagtctaattacgccatgattttgacaatatgatgctacagtaaacttttgataattatggattaactatgctttaaaaaaatcgtctcgcggattagctctcatttataaaattagtttttttattagtctatatttaatactctaaattagcgtccaaacatccgatgtgacatgggctaaaaagtattagccccatctaaacacccccttaattatagcatgtcgtacaagttgggtgataaacaaaacgatggatcccttggttcactgccactcctgctcgaacgttcaccggattaatgtgcacgcacttgttctcctgtgtgacgagtagaaaatgtagtacgtagtactatactgctcgaagtaacgacgaatagtacaggcagtcgggacttggacagttggcatttgaatgcactactacatgtttttttttttcatatgacaaaaatcgatattcgggggattggacgacccgcatgtatactggtgtctgcgtaaaaacatattttcctgtggtgcccagcgcagccgaatggaaaaatattttcgaccaaaaaaaaaattcaaaacaaaaaatgggccaaaaccctagcccgctgctggcccccagctccccgaggcgctgtcgtcgtcctcaccatagtgcactgccaccatcgtcacatttgtagctgtcaacgagggctgaggacggtggatctgtatctcccgagggcgggatccctcttgcccaagcccaccgccgttgctctcgtgccaacctcgcctgccgccaccgtcgccggagcttgccaccaccggagcccgagcccgctgcctttgccgccggagtccgtcgtcacgaggagaggggataggagtgggtgtgaggagtgggggaaactgaaggagtgggatggacgggaggggacttagtgggagagagagaggagaggataataaaaagagttggaagagagagggtatttttacatgcgcgccatcatatcaacccaattcaattgaaacgaaactcttcaaaattcaattgaaatcatatcaacccatatcttggcacgttcaagatgggcgatggtaccgaggccataaatttttcatcagttattctcttcttcgtctacgatcctactaaaacatgtttattctcttaattagcgcgctccaataatagtttgatgataatcatggccaccttaaagaatatgtatctaatgaagtgatcgcattttgaagaaaccaaatattctacttatccactttaatttgtaaagaaaaactaactagtatgtatacgtagttgcattttcgacacaactatatctccctagacgtacgtagttagagcatatccaccaacattgtcgactggtgagcatcctctcagccgctgttgatcatgtgcaattctttactcatttagtaccaatgcgtagctagataaattaatgagcgtgttaaattgatatctaattctcctgttgtgtatagagagctgctggccgtgatatgaataaaacaaggagactcctcccaacagattgcagagaatacctaatgttcaacaagcatgagacggatctggcatggagaaagaggagctcgagtctccacctttggtgtggggactacgagagccctctagccccgccccctaaatttctctatcatacattcggaagggttagagatctatctagtttgttcagctctctactatttttttgggatatgttcctttaaaaagtaaacatagttatgtagctttgtttaaacaaggcttcattttgtatttaattacaccgaatgatcaaatcttagatatggccctgaattatactattaaatatcttgttatcatcgcctataaattcagtaaagtctaaagcttcctttcatataaatcaaccttaattatcatgtctgtcactaacacacacccccacccatcctcttcataggtactcactccgtcccaaaataagcgtagttttacactattcatattcagcgtttgaccgttcgttttattagatttttttatgattagtatttttgttgttagtagatgataaaacatgagaagtactttatgctgactaattgtttttaattttttcataaaatttttaaataagatggacgattaaacgttgtacacggatacctatggttatactctctccgtttcaaaatgttcgacactgttgactttttagcacatgtttgaccattcatcttattcaaaaaattttgtgaaatatataaaactatatgtgtacatgaaagtatatttaacgatgaatcaaatgatatgaaaagaataaataattacttaaattttttgaataagacgaatggtcaaacatgtactaaaaagtcaacggtgtcaaacattttgaaatggagggagtacttattttgggacaggtgtagtagtggccattcgcatgacagatgacatgcacatatataatcaatccacagagattcatagtacatctgcccaagtacccagcaaatcaattaattaaactaatccactatcgtacctgttccacgtaagaaagtctcgatgaacagataaccttctacaagttcagcattgatatccatcgatccaaacagtgcatcgcattcgaagtttccaaccacagcattaatttatcatccaagattactaatgcgtagtagggttaacttgacccagcactgttggagaaaccatctttatttggtccggcaaaatccacaatagttccggatccaaaaagaaccgggactaaagattgtttttagtcctggttataaatattttgatctttagtcccggttggttcatcccctgtcaaatgtatgtcagggggccgaggatctttagtcgcggttggtgtcaataaccgggactaaagatcaccactttagtcccggttggtagtaaaattaaacacgtagtatataatctctatcccttatcctctcctccacagttacaacttaacggatcgaatctcaccccctctcctcatatctatcctctctaactctcttctccatctcctccccttcctcctctcctcccccttctctccccttcctcctccccttcccggccggcctccccttcccatccggcgggccggccggcggcgggcggcggggcggcgcccagcggggttgcacccggcggagggcggcgggcggcggggccgcgcccgtcgttcgtggcgaccggcggcggcattctctttttttttttaatttgtaatgattcactgagatgtatttatccgagaagttacaaatttgtgattcattgtttggatttgtgatgtatttgagtaatttcttaggatattgtgatgtatttgatttgtgtgtataagtaactttatgatttgtgatgtggatttggtgatgtgaatttgggatgttagttagatttggggatttgcctacttgattcgggagaaaataaaaaggaaaaaagaaaaagaaaaagggaccatctgcactgccgctattttctctttaagatcccctcatcacatctttagtcccggatccttactcccggttaaaaaaccaggattaaaggggattcctaactgggagtgatgatttctccaccatctgcattgtacgtgtgtacgattgtaccaaaagcacgagctcacaatgttgtgtaactgtgtgcaagagctggctaaacgtacgtgcatatgctctcggtgattgatcgatcgatcggctgtttaattggttggtttggtttaatcatggcgcctctgctgctgtttgcacgaggtgacagcttgatcagattgtacgacgttattacgttcaccactatataaaccttattaagcgctagttaattaaaagccccacaaaagatactgaatttttatccctaccatgaaagagaagctattggtatcggttcagaaaccggcatataaggttgtacgagtaaaaaaaaaaacgttggctttgatgcacgaatcgagatgatgcttcaaacggcttctcattaaatcctcatcctcaaaccaatcatcataatacacgaacaaatcattttatatacaaaattataaatggatcaagatttacatatacataattgacgttagaataaaacgcagggtgtggctaatgggcaggtgactgctccgggcgatcacccccatcacccctatacgctactctctcccttcctcctcactttcttctcttcctactgtaccatatttttttaaaaaaataaaaaaataaagttggaaaaaattatgtatagaaaatactatttataaaaaaatatttgaattcaaattcaaatttgaaacgggtatgtaaacttttgacttataaactttgggtctataaactaatatttgaattcaaattcaaatttgaatcggatatgtaaacttttgaattttaaactttggatttataaactttaggtgtataaactttagatgtatagaaatactatatataaaaaatatttgaattcaagttcaaacttgaatcggatataatttaaattcaaatttgaatcgggtatataaacttttgacttataaactttggctctataaactttaggtgtataaactttagatgtatagaaatactatatataaaaaaaatatttgaattcaaattcaaatttgaataggatatataaacttttgacttataaactttgggtctctaaattctaggtgtataaactttagatgtgtaaactagaggtgtataaactttaggtgcataaatttactaaaatatgaaagtaatgtggtgtcaaaaaggaaaccacgtggaggagaagggatcgcgccctgatcgccccgggcgatcgctcgcccagtaggactttcctaaaaaacatgccaatccacaaagtaaaaaacacataagatccatactcatataatcaacttaggccccgtttagtccccagacaaaaattttacaccctgtcacatcgaacgtttgaacacctgcataaagtattaaatataggctaaaaaaataactaattgcacagattgcgactaatttacgagacaaatcttttaagcctaattgctctataatttgataatgtggtgctacaataaacatttggtaataacagattaattaggcttaataaattcgtctcgctgtttactgacggattctgtaattagttttctattagtgtccgaacaccacgtacgacaccctatataatatccgatgtgacacgctaaaactttataaccctgtatcaaaacaccccttactactcatcaaggctagagtagtctagacacctacaaactaccgtcgagcaggcctgctgcacatggatctagccgtacccgacatctgagaggatagatttgactgcccctgacctcttggtgtttggatcgggccacctacgtaccgagatatgcattgagaaagtcattggtgtcaccattaccactgaacacctgggtcacacgctagctacaaatgcatggggaaatcgatgaagccattggtgtcgtcgacttgtcgcagctcgatttcaccacgtacgagcctgtgctcctcaagcttgtgaaacaaagtatccaaatgccacgagcttgagggccatcacatttggcggcccccgagttcaaggtgaccggatccagtcagcccccacattcttgacgtgctgatgcagatggtggtgagagagatggcacgcgggtaggaatgaaaattgctcgaaaacagatatggtacgtactataccacgctaatgtcatcatgacgtcagcatggtaccaatggctgtcgtgtatagtatcacggtatcagatctggtatctagctatcagatctgaacatacagtaccatactgatgtcaacacacataagctattccgtaggaagggtatagccactacaacagagcaccctataggtgtatgtaccattttactaaccgataccaatttaggagtacctctacccattggtataggtgccagttttaaaaccaacaccaatagagattataggtgcttgttctgaatatataaccgatatctttggttttctaggagaaaaaaaaaggaaaacctaactcttgactagctcaaatcgagccaattcatcaagccctagatcccagaatgaagctccaaatcccgtaaaatgaagatgaacacatgaacaacaatcaataatccctatattcttatttcaacaaacaaacaacacatctagatcttcaaaatcaacacaaagacatgaataaacgtgaacaaacacatccagctgctatcgccttcaccgacgacacctaaaccatcgccatggaggtcggaggtggccaaatccgacgacccccgacttccaggcagccagtccggcagccccctacctccatgccagcaaatccgctggccaggccaccaagaaaaagtagagaggagaggagaggagaggaaggagcggtagtcactgtgtcctccgttgttgtcatcgcccctccaatgggtggaaatatagaggggcttctgacaaaggagatggagacagagtgagagattgagaggggtgagggagaaagaggagagaggtcagccacctcctcctcccacttcaccacctcccaggtaactgtccctccttccgcgtggcggcgggagcgcgaggcgcggtggaggtgtcagcgataggggtgttgtggtgtacatcttgatccgatggtcacctttggccacaaagccgtctgtcttgggggcagaggaggagaagtagccattggcggtgggggaggaggaggggaggtagtagtcgttggagtacgagaaggcaaaagatggtggaagggggtggcttcggagagcaggagaaggggagagaggtgttggtgtggataaggatgggtgggtggataagaacggctcggctcggctcggtcggtttttttaaaacatgtggtatatgtttttaattaatcgatacctatacatgtcggttcttttaaaaaatcgggtacctatagtgaatttttttatataatttagacctttttaaaatatgattttattaacaaaccacctaggaaaatattttcaaaaatgaaccttttggccaatagcagtggtgtggccaaactgtgagctgcaacaccaatgttcgtggtgttgcaaaagctaccccgtggtagttgttgccattgaaaatgtcaactgagcgcggactcaaatgggtttcaaattgggggcaagaacattggattttgagtggatttggaaggaattgaggagggggcgtcagttgaaactcgcggacgagagagagaaaaaagagagggctggaagaggagaagagatgaaggaggaagaaagaggcaacggtggctggggatatttggcatggcagcgtcacgccactgagcctggcgtggcaagaccactccctcctcccccgcgccacgttggcgcccggttgacgttttcaatggcaacaactgccactgagcagcttttgccatgtggtagttcagtttgaccacgccaccactgtcaataaaattatatatttgaaaggtctaaattataagaaaatttcacctatagtactagtgcttgctttttctagagccggtacctacagtgataaaagatgctagttctacattttttttaaggacagagatgggaaaagatccaaaccgatatttatgaggagttttgtagtagtgagcgttcagtagtactccctccatccacaaaagttacgtctattttacatttgagtttttctaaataagttgtttctatttgtagtctttatgcattcaaagacttaaatgaagatataaattaaatattttattagaactaaggagacatctaaatactcattggttgtatgcttgcattcattttttgttttttaacatccaaggtgatttaatttctccttagtcttagtgtcaaaagtaatactccctctgtactcgtcaaggaagttatttaagatagcgacaaggtctccaaaacacaactttgatttcttatttctataaaaatatttattgaaaagtgatatatgtatacttttatgaaagtatttttcaagaaaaatctattcatataatttttacatattcaaactcaacaaattaaaagttattcatgatttatattcttaaagtttgacttaaacattgtcctaaacaacttactttacgagtacggagggataacttttatggatggagagagtagtcctctttttgttaggctcaaataattctgtgcttacgtggaggccatgcaaacggacggacggacaacaagtgggtacattattgcaaatcatatccgtcaagatacattgctgtcccggcccctgaacaagtacgtgaggcatgcagcaatggcatggaaaaagaaacatcctactatgaaataatccacgcgttactaatctgggatcgttaattggacattttcacaatcgaaattaaatcgtcgtgatctgatgtggtccagtgacgctcagattttgctgttgggttggacacacaaaagggcaccgcgtgtgaatacgcgtgtcagccgctagctcttgtcattgcatgttgtcgacaagaggacctaccagagctatctctcaagaaccatatatttccatgtgtgtacaaaatatactttatttatcatatatgtgcgcgcataccatattgagaaattgtaaatccaggatgagcattaaactatactcatcggtactcgaccgatataagataaaatatataatacgaatcatatatgtaatagaaacaactgttgaataaaaaaaaaatagatatctaagattcttccgtgtcaccataaataaaaaatttactccctgtaacttttttactcgttatgtgtaaacataccagtaaaatttttacttatgataacgtggacaaatctcaaacgttcaatttttaaaccaacgataagttttcaagttctatctgcatatctagttttcaccttgtatttttctacaatatcaagtgtaaattaattcgatcgagagctagtaccctatgattaatcgaaatctagcgaacatatatatgtccttgtatatataatctagcgaacatatttatttttttcctttcccttttctttttcctcctattcttttactatcttcttcctccactagagccatctcgagctcccctgcgtcgaagaggccgaagaagagataaatgaaagaggaagaacggagaaaaaataataataataataataataatgtgccatgtcgtcgtctacatgttataccacataggcaagaccacggtcaaatgagactttggaccgggatgatacaataaaccaagtttagaaatatcgatacacactttgcaggtacgtggacctagatgaaatctgcttacaagtttaaggaccgccagtgcaatttaattgctctataattaattcaagtttgcaacaacatcaacctaaaaatacaattgtctcttggaagaagtagatatattttaagaagcatgagtacacaacggattcgttgaaaacctggacaatgtgcatgtggccagaagacttgatgaagccattgtagcagaccgggatagcttgttttgcagcagattctgtaggaccgaatcacaataactaagccaaccagagaggggtgaatggttgatataccaaaaaaccgaaaacttttagcggaaatgaaagttaccctcgaaatcgacagaagtcggtctgaccgagattgatatgccggtctgaccgtgtggatgccgccggtctgaccggtatagatcaaccggtctgaccgccgaagccgcctgccacgcctaccgccgctgccggtctgaccgcctcgctcccgccggtctgaccgccgccttgccgtcggtctgaccgccggtgagtcgtcggttagaccgccgaaacccgatgaaacacaaatcgaagaactcttaaagtagatgacgactttattgattctctctgtatttacaaagtgcaccaacagcactccttacaaaaatttcgactaaactcgaaaccctaactcaaaaatcaactcaattgctctcaaaagcgataccgggaagcctcacactccccctctatttatacccgaggtaggcagcctaaagccacgaaccaaactcatactaagagtcctaaacaccttaggaaacccctttgccaataaattccaaataacaaaaccaataatctccgatgccaattgttcatcacagaataataatcaaaaacacctttgattttacaatctccctcttgatgaacacattggcaaacccatcaaaaatgttttggtgtttgaaaaaataaaaacaaaagcgataaaaagcacacttcgtacaaacgtacacatcgtgctcgaaaatcgaaaagaaaacttctctcacttttgaaaagaaagaaactcccaattgaaccaaaaacaacatgctcttctcaactcatttgcttctccaaaaattcaccttgcttctcccaaaactcatatcttctcccccttttgacaatgatttcattaagcataggaattatgttcattaatgttcaagagcttagcatacatatagcatatcatgtcatgtgttgcaataaagagaagatgaacccatctataacataacaagcatgtattaaagtataaccatgaaccaaagattttacaattaagcttgaatcaacaatcaaaattcatgatttcatacgatttataatgcaacatcttaacaagcacataggttgaagaataaacactaaacacatatacctattgcatttatcactctttctcaaataaactttagcacaaaataaccaagagaatttttttcaactttttcttttcttgagcctttttgctcatatttttctcttttattccgggtacgtccctgtcgttaagactgtttctagagattcggcacccattattttgctcacatcgaatacgtccttgtcgtcaagactgtttccaaggattcggtatttatttttttaatatttttattctcttttcacaatgagcaattaaagctatttgaggaataaaaattcaataaagcatatatatagagcatttatagatcaaaccatatgctagcatcaacattgcatattttcttaattcaagtataatttaagtgtcatgcatcatctcccttgaaagcaaaatctaaatctcatgaaaagactagaatacatacaagctatgctagagacaaataaaccttcaaagtattgctagcatgcacaagaaaataccatatgtatagaacaaagctctcttttatcaatttttctcattgtcatattttttgcttgataaaaccatgaggtacaaactccccctcaaaccatgccaaaaggatgaattatgcccaattcaccacgaagaaaagcaaagcgattagaatccaaaggtttagcgaaaatatcagcgagttgcgactttgtgtccaaaaactgtaattcaacatctcctttctcaacatgatctctcaaaaagtgaaaacgaatatcaatgtgctttgtgcgtgagtgttgaacaggattcttagcaatgttaatagcactagtattatcataaaagagaggtactttctcaaaagtaagaccataatctttcaaagtagataaaagccaaagaatctgtgaacaacaactagcagcagcaacatattcagattcagcagttgattaagcaacactagattgtttcctagaagaccatgcaatcaatgatgtaccaagaaaatgacatgttccactagtacttttcctatcaattctacaaccaccaaagttagcattaaacactcttccatatcgagaaatattcaacacagaatcaccacaagaatcaaaaactttacttccagttttcttaaagtgaacctcaaaatcctcatcaacaatttgtgaaacctaaagcaaattgtactttaaatcctcaaccaaagctacgttcttcaattcaaatttttcatttaccttaaccaaacctgtagcgagaacgacacttgtagaagcgtcaccaaatataatcgattcagtcttggatgcctttttgagagagaagaaccaatttttatcaccagtcatgtgccgcgaataaccagaatccacgatccacacgttctccttccgcggcaccaaagcctacatagaagcagaagtcgaagcctcagtactggggttagatgataataaaaatttagcaatctagtactgagacacacgaccataagatccaataggcatatatccacgtgcaaaaacagtttgagaattttcagaaaaattcctccgaggccggtctgatcgagggtgtgcagccggactgaccggaggccggtctgaccgcttctttaccgccggtctaaccggtgcccggtctgaccgacgctcagtagacggtctgactggtcgccggtctgaccgcgggacccactgcggtctgaccggtttcctcgagggaaaaccagattttttgccactttgattttgcaagagcaatctctctctcctttttctgtttatgagttaatctgaaataaaaaccaacaatatgtccatcttttccacaaaaagaacaagtatatttttcacgatgattagacacattggtagaattagaagacttagcaacacaagcaacaacaggaggttttgcatgcacaacattggattttgaagaagatgcattcaaggtagacatgataccagcagatttaaacacaattttggttagaatcaggtttaaccaaaatctcaccacttcaagcaccaacacctaacacaacaggaggatgtctagaattatgagcataaggattaaaacctaaaccacgattatttgtgctaaccttagattcatctaaaatcatgttgaggttctttttaccatcagaaaatcttagcaaataatttttcaaataagaaacctctttttccaaattagcacaatttttacaatctaccatgacacctttgcttttacgacacttggggcaagaaatcacttcattgtatttcacaacatcttccatgtactcaacacgacctaaagcatctttcaatttcatcttattcaaattatatgttgagcaatccaaaacatcatgaggttgttttaactttttagcacaaatcatgttaaacatcaaactagcatgaaaagcaatttgatatttttgcaacaactttttagttaaaaacaactcatccaaagtgcgtgtgtgcaaagcaaaactaagagcaagaaaagatctatttttcaaatcatgtgcagcattaatatctctaatttttgaaatctcattcattaaaacctcacaacttttgcaatcatcatcattaggaataagagattttaatctagcaatttcagaattaagagattcaatgataaattcctgttttctatatatcttttcacacttcttattttttgcacttaaaatattaatagcttcctcaaaagcacttatctcattgttttcacactctgaatccgattcaccacatgccatgaagcaaacaccggagatgttctttcccttagcttcatctccactatcaccatctacgtcgcttagtggctcaaatgcggcgtagacttgatcaaaagccttattgagattctccataatcctccttcctttgaacgtacccttctgcttgttgtcgttggtcttctcaccatctttgtcttctcttttgcctctcccaagcttaggacaatgcgaacgaagatgatcaattgaaccacattcaaagcaacgatttggaccacctcttttcctgttcctggcattattcatagctcgagcaattctgttagcaaccaaagccaaatcctcctcctcgatctgtttgagttggtcatcggatgtggcattaaaaacagcaaaaaaaaagaagacttagatgaagaagcatcaacatccaaagaagaagaagaagaaaccaaagcactcgacttagaatcaactttacgagaaagaacgttcatctcatgtgttttcaattttgtgtaaagcgaatccaaagtcaaagtagacatattaacagactcctgaatagatgtaacattcatctcccaaatagacatgtcaagagcattcaaaaagtgacgagaaatctcatattgtggataattagcatcataagaagaatcaacagatctaagatcactcaaaattttattaaacctagaaagatagtcatccaaagcttctccaggtttcatctcaaatttagtgtactcctttttgaaaatatcacgacgaagttctttaatgttatttgttccttgatgaaagttactcaaagcattccaaatttcatgagcagtttgaaaatgcgcaacacgatcatcatccgaacgagaaatcccactcaaaagaatattgcgagctttgcaattttgttcaaactcagtttttgcagtagcagtattaattacttcaggaatcacataaggatgagaaacttttctccaaatatcataatcttcagccataatgtaagattgcatcctactacaccaatgagaaaaatccgttcaatcgaaaacatgaggcttagttgaaaacctaacaggagtagccatggcaaaaactctagatcgataaaaatccaaagaagaaaacaaggctctgataccacttgttggatcgaatcacaataactaagccaaccagaggggggtgaatggttggtatacccaaaaaccgaaaacttttagcggaaataaaagttaccctcgaaatcgacgaaagtcggtctgaccgagattgatctaccggtctgaccgtgtggatgccgccggtctgatcggtatagatcaaccggtctgaccgccgaagccgcctgccgcgcctgctgccgccaccggtctgaccgcctcgctcccgccggtctgaccgccgccttgccgtcagtctgaccgccggtgaatcgtcggttagaccaccgaaacccggtgaaacacaaaccgaagaactcttaaagtagatgacgactttattgattctctctgtgtttacaaagtgcaccaacagcactccttacaaaaatttcgactaaactcgaaaccctaactcaaaactcaactcaattgctctcaaaagcgataccgggaagcctcacgctccccctctatttatacccgaggtaggcagcctaaagccacgaaccaaactcatactagtagtcctaaacaccttaggaaacccctttgccaataaattccaaataacaaaaccaataatcttcgatgccaattgttcatcacagaataataatcaaaaacacctttgattttacagattcatgggctcgtccaccaggatatgatgcgctcctcgccgatgagctgcgcgcagcgactcgaattgatcctagagacggctactgcaccacaccatgtccattgcaatgcaagcttctctgcggccaaggaggaggacgaagaggacgcagtcatgtattgttgtactttgaaaaattcataactatttttttcacgaacacgtaaaaagattgcacgtcgatatattagaaggaaaaaatagtttttttacacaacacaaccaaccaaactggtctatgccaggggaaggaagaaaaagcaaaaccaacaactgtagctaggaaaagagactactgcggcggctaaacgcaactccgatcagtgggaggggggcagggccacactacactcccaagaaacctccaaatatagcaatgccagcggaaaaccatagacagccatcttataggataaactccagaaccacagacagccctcccaagaaaagttcaaaactatgacatcccatatatccatccacacataccaaaagtgctacataacatacacatctaacttaaacttaacaattaacggtttttacacccgaggaggcagatgtcaagatgagtttattcagaattaacattacaatatatatgtatgcgcgcatgcacgcatttactttttggaaggtaccttcaaatattagactccctctccttattaatattttggtgcttatatataacatgcatgattcggtcaaacatttaaaatttatacgaaacttcgggcatcagttctatattatcatgagtttataagaatgtaataagtttatgatatataatgatattctgcttgcttttttatttaaaaaagttaacatctaatcaacaatcaaaattttaaaagcttaataattcctgtattaattctcaaatatatattatcagctggactgctggagtagtaattaacttgccatcatagagattttcattcaagcaaaaagtttgattaaacattatcgcacgatgcttttagtttattaaatactgtacgtgttgttcttttctgtgaacgacgacttctatatatatgttgatgtgaccacaattaattagctggcaaacttttcttttcaaaaaaaaatccgacctagtgcaggcctatatgagggcagaacaaaattggctgtgtttagttcagcgcaaagtttggattttagttaaaattgtgatgaaaaaggactgaactttggatacaaactttagatctaaatacagccattatcacaaaggagaagaagcatcgacgactttctccgttccaaaaataagtttatttttcacacacacacagatatatatatatatatatatatgtatatatatatatatatgtatatatatatatatatatgtatgtatatatatatatatcacatcgtaaaatctaaacagtgcgcgctctcgttttagtctaatcgcgcgacgcacctctgaccgtccgatctcgttatctatttattttcggcttacgttatcgctttctccactagtacttggctgcagacagtctgacatacccacgtagcaggaaggattgagatagacatgtatgccttttttctctttaaataaagttttctctcaaattacttatccgaactataatttaattacaccattgtgttcgttacaataaaatcttcacaacaagatcttacatgattatattacgatgaaaaaatatttatatttgtaaattacttttattatatacgtaagttacttttatcatatatataagttacttttagattttactaaattacttcttagacatataaaagtaaatttaataaagtctaaaagtaatttatatatatatattataaaagtaacttaaaacaaaacggaagtaactttgtcacgacattagaagtaaattcattgtagtgataaaatatgaatttatatagaaaactttatttaattagtacagatcaacacacataagtttaacaaattttaaaagtaagttcaatgttaacttcaacacacataagatacatactattgcatttttcaagttgaaaggagacactagatggagtataaactagctacgactagctgtgtagtcatgtccaatgaaaaatgcaagcattaaagttactttcttttgttctaagttacttctataatatttgtaaattacctttagtctttgctgaatttacttttatatgtctaagaagtaacttagtgaaatctaaaagtaatttagatatatcataaaagtaatttgtgatttttcattaaaatataatcatgtgagatcttgttataaagatttaattattacgaatagaacggtgtaatcggatcgtagatcggataagtagtttaagagaaaattttatttgaagtataggtggatagagtctctcataaatgacaaaccagctaccattagctgtgtagtcatgttcatatcacatatataaatataataaaaaatacaatacccttactttattaaatcctaatataattattcatctttttatctattcttaatttatttatttatcatttttatcaatttcgatgtaataattactaaaataattattttgagacaaacgaaaaaaagctaaaaataaacttaattactccgtaaccaagggtgtacgtgagtgtacggaccccacacgtaaaattctagtactgcttatgcttgcgatcgactaaaagctagggagagacagcaccattaataaaaaatttgtgccaagtcactgtcacgataactattttggacaataaaaggccagtccgtattgcagccaacatggtactactgctactattatacatatataaaactatatactattatacataaaaatgcggtaacatttgtgacacatgtgtgtatactgtgtgagtacatatatataaatgcttgtgacagcgatgcctgccggggaggggtaaacagttaggggatacgtagcaagttagtatcccatatactggcacatatattcactttcatattttaattaacaggtggtctggcgaccgaggcatatacatataagaaaaaatatatgcggcaagggacaggtcactccaataacagagcaaattaaacaagtgaaactaaataacattattgaatagttagaacgagattgtatggcatatattatactcattatttgcagcttatgttgttcctctattttaaataggccaggaaaggtccagctggttgtggctccagcagcttcaacaagtagagctgcactacgaacaaaagtttcatgcttacgtttaattatgatgtactccctccgtttctcattctagcatttttcacattcatattgatgttaatgaatctagacatatatatctacctagattcataaacatcaatataaatatagaaaatgctagaatgacttacattgtgaaacggaggaagtaattgataataagacattaatctttatgttttctaaaacaaattctcgcaaaacagatgagtggttagagtttgaaacaaacaatatctgatgataaatattttaaaaaagagaaaatgatgtagttagaaaatgtcatattgtacaagttcaatctctgcaaagcattactcggagatattagttattagttataatgggcgtttttacaatattagttattttgctccacggcctcatcttttcgtttatgtttatacttatcagctaaaatttaaattttcaatattaaatttgaagttgattttgttttttttcatcaaagtttatttttcatcatttgcttttacaccgctaagaacacgtatataaaaaatttattcacaaattattttttgtttgcaaatatgccgaataaacgaaaggatgggtccgtcagttcttggccgaacccctatcgatcgaggagataatgggagataccccccgtgtgaatgcgtgatccaagatcatcaaatgccaaggaaaatgcaggatcgcatctgagaataaacgaggcacctgatatacgtgatgaacagacagctagctagctagctcctctgtaaagacttttcaatctagaatgattgccaataattaaattaatttgctgcaaggctcggaatctcttttagaatggacctacacaaacacacatcgatctagcctattatacagtccgtaacaaaataaattcatttttagataaacaaagttcactttactatcctctaactaccctgctttgtaaatcgataaattttatctctttattacccttgcctactctctctcatcaacactaccactctctcatcaaaactagtatcatttttactgataagaggtattttagacatccgtaccaaagtgcataacaaactggctgactctcgcattgcccctcccccttgggcgacaccggaggcgacgcccctgccgacgcacgttcccccctcctcccttctccgcctcgccgccgcctgagcggccaccgacaaagccgcgcagcgcaaggatggcggcggcggggcttcgtcttcgtgccacgctcgggcaaaggggggattgctcggggccgcacaaatcgcctagatctgtgcctcctggccagatctagaggcgaggccgaatggtggggcggtgactggcggtgctggcggcggtggttagaggtgtggcggcggcggaggagaccaccaaatccgagcctggatctggcggggtgggggccggcgacggcgtccattgacggcggcggcggtgcctggtggtggtggcggcgggcggccggatccggctggacggtggatggcctgcggtggttgggttcggccgcggcgacgagttgcaggtgacggcgtcagcggcagaggcgcgagaggctgcgatcggcggcggcaagcgcactagcgcggacgcatagaggccgtgacggcagcggaggctcgggaggccacgatagcaggcgcgacagcagcacgtgcctagacggtggcaagtgcagtgactgtggctggcacgacgatggtagctagcacggcggagtggccagtagctgtgtggtgcgaggagggcgacgaggccggtcggcgcgcggtggctgcgcaacgggaggtaaggccggtggaggctagctaggccgaatggtggggcggcggtgactggcggtgctggtggcggcggttggaggtgtggcggcggaggaggagaccgccaaatccaagcctggatctggtggggtgggggccggcgacggcgtccattgacggcggcggcggcgcctggtggtggcggcggcgggcagccggatccggccggacggtggatggcctgtggtggttgggttcggccgcggcggcgagttgcgggcggcggcgtcagatgcagaggcacgataggctgcggtcggcggtggcaagcgcaacagcgcggacgcatagaggccgtgacggcggcggaggcttgggaggccacgacagcaggcgcgacggcggcgcgtgcctggccggtggcaagtgcggtgactgtggatggcacgacgatggcagctagcacggcagagtggccagcagctgtggggtgcgaggagggcgacgaggccggttggtgtgcggtggctgcgcagcgggaggtgaggccggtggaggctgagcccagtaaggtggcgcacgtgaagactggccggctgggggcaccggtgcggtggtgcccacacatcgacgtaggtttaaatggcggtggagcaacggtgcatttgtggtagatcggcaggtgaaaccccagcctggccttggccgggccagcaacgataacgttcaagcgtcattcccctcctgagggtgttgtcgtgctgtctcacccctcaagtgtggatgcagggcaaaagcccagtctcgattctctctctaagaccttgacggacggcggcggcggtgtttcgtcgcttctctccttagagacgtcgtctaggcacccccttgccgaaaccccccttgcaattggtgcaaacttgctctagattctcatcctcttgtattggcatcctagcttttacaagttggtcatgtcggagggcctaggggtagaggagttccatcttcactctcaccctctctccctaaatcctgaagacttggatagagtggggttttgttagttgtaagggtcgggttctgggcgatctcggcggtgttccgttgttggcctagcggcggccggtcctgtgctagccttctcctgggtttgtgtgttggcgttttcggtatgtgggtggtggtatacttttttcgttttcctggttacaaccttccagggttgtaatctcgtaactttttcctgctctatcaatagaacttcgcaccgtctagtgcgagttgtaaaaaaaaaggtattttagacattttcgttctatcttcattttttttctaagaattaaaagataaacttatttagaaacgagagagtaaattagctagagatcggtgagtgcagtaggcactatgcttgtgaaacaggtaacagggcacagagccgagatcggcaaattaactagctatacagcgtgggccggcccgcacgcacgcgtcgcgcgcgcggtgtcgatcgatcgatctccgtgtggccgggagcacgtacgcacgcaggcgcaggcgagcacagtggccgggacagcgacggccggcgccggagaagacgcagtgccacgacgttgacgcgcgagcagccgttggccacaaactcactcactgatcgatgcatgcacgcagccaatgggatcgaaatccaagctaattttagctcgatcgcgcgcgcgcgcgttgccgtccacgtaaaaaggtcgcgtcgcgtcgccggtgtggcgggccggggtggggcgcgtcagcttttggcgatggcgtgcgtgcgcgccagctgtgcggtggtacgatctagctgtggatggatccgccgacggcgacggcgcggggacgacgacgacgacgcgggccggccgctggtcgctgtctccatcgatctagcgagtagcgctcgcgcgtgagttggacgctgcatgcaaatgtgcaatgcattcacctggtcatcccatccatgcgtacgtgttcccccaccacatgacaacacttgctactaatttttccaacaacgactatttgcttgacattatacaccgcacacgctcaggggcggatcccattaggcagggtacgtggatcgaccgatccagctacgacccgtgtcactctatactcccaatacctcctaccatttatagtagtcatgggccatcaaaattaggtatagtaaggtgtgaacacccaacagattagtccgtatcttaacaacgcacgcacaccgcaaacaatgatcgaggcaattatgcgattgaactataaatacgatatgtattgtgttcgattgttcttatcgagtgatcatctctgttttccgccccatctatattttaaagttacgtcgtcactgacacgctggttagcgtgccatcttaatacacgcttaggtgtgtatgagagaagtcaaaagtagaaatataagaagatatgcaaaacgagatgagtcataaacacatttgagtattaatgatcccaaactattttttttttaacgcaccgcataattttttttaaaaaaaaatgcatcgtttagctgttcaaaaaatgtgcatgtgaagcacgagtaagttttcctcttaatctcactggtggagagatgatttttactcctgattggaaaccccctatagtcccggttttccaaccgggagtaagaatccgagactaaatatcgctatctttagtcccggtttaaatgcccgtgactaaagatttagtaaagttttttcccatttttttctatttttttctattttgtatatctcactcccattatcttaaatcattcacagcaatatagtcatcccaaatcattcacaataacagttcatcccaaatcattcacagcaatcatcccaaatcattcacagcaatatagtttattctcaaaatcattcacaacaataacacagatcgaatcatgcattaagaaaaaaagaaataaaaattccgcagcagcgccggcctccacccgctgctgctgcaccggcctccgtgccggccgccaccgggcgcggccctccacgcgaggccgccgcccccttcggatccggcgacggccggccgcctcctctcccagatccgccacgcgaggccgcctctgctgccacccggctgctaccgtgcgaggccgccgccgccaccgccacccggccttctgagaatgggaaggagagaggaggaggagatgaggaagaggaagagaatgaggagaggaggaggaagaggaagagttaggggtgaagaggaggaagagataatggtgagggaggaggagatagaacttattaactaatcctgctttctcctcctcgatcttgcgcacgcctcgtcctctccgccgcacatgctgattttttttcccggttggtgttaccaaccgggattagaaatagatatttagtatcgggactaaagataatagagggtctaacaccgcctgctgtttttttgaaccaggactaaaaatgatctttagtcctgataggtgttcccaaccgggactaaagataaaaaagtagctctaaccttttgaaccgggactaaagatatctttagtcccggtttttattgcaaccaggacaattatgtaatttggtcgaccgatcaaaagatggtttctccagtagtgtctgatgctaccaaacgtcaccaagaaaactttccctcatagttagcacccaacgaaactggatttccattgctctctagtcttggcggttattaattaacagttggtcgataaaatatattgtcttcccggtttagtttgatgttatccttgatggtttatggttgcgaagaaaattctggtttattgtagggacttcccggccctagcttattactactaaccaaatactcctccgtattttaatgtatgacaccgttgacttttcgaccaacgtttgatcattcgttttattcaaaatttttgtgtaaatatgaaagtatttatatcatgcttaaagaacatttgatgatgaatcgagtcacaataaaataaatgataatttataaattttttgaataagacaaatggtcaaacgttggataaaaagtcaatgacgtcatatattaaaatattaaaatatagagatagtatatagtacgtacttccagctcgatttggttcttttccaccacctgacaagcaagcaataggcatgcatgcataatttagatcatccaatctgtgacggtatttgtcagcttcctagctacatgtatggtccattataatgcatgtctactgtgtacgtggcaggcgccctgaactgaacccatataatttgagtgagctatatataggctatatctactgaagtttaagtcacatggaaccaaagacagctggtctagctagctgcaatatgcagctaggatatgttgtttgaagctaagtgctttcctttcaatatcctgcagtacttgcaaattactgtggtacggttttgtacttctcttgctgatctgaatgaatgaggagttgccatggctttacttacattattggtaatttactacagctggccgatctatcaatctaaagtcttcaaaccaactgggaagtgaagcgctcacagaattttgtgctgccgtggccatcgcggggtcacaacgcgtggacgcgcacttgagagcgggtggatttcgcggcctctcgtgagtccgcgtcggccctcctatactacgtacctccatattttaatatataaccaacgtcataaaaaaaatcggagaaagtactatatactctttttattcaaaataagttactaatacggatgtgacacgtctcgatacaacggctactattcaaatttgtaatattgtgatatgttacctctcataataaattaatttattttagaacagaaggagtataatggacaacctgctagctggctattgctgtatcagtggacatgctcgcagcacaatattctacctttaatcatgcatagacgaatgggataagattctcaacggttaaatcatccatatgtgctgatcattagttgtagctagctatgctgctatacagtcacagccattacatactactagtacagaaactatcataggttctggttgggaaccagttataggtgtcagttttctaactgacacctattggtcggcaccaatataagcaaccggcatctataggttcgtacgagcaagaaaacgagctagctcgaattgagccgatctcacaatcgccatcaccgtgccatgcccatatcgagttgctcccgacattcccaaatccccacatatcgcagatcacagatcgcattaacatactcaacaacaaaatcattcacaaattcacataaacattaaaattctacaaaatcatccacaaaaatccctcgggcgccgcctcctgctgcctctcctcgagcgcctcctgcccgccctggctgcccaacgcctccctttctcaccggatcaagcggaggggagggcgcggccacagccgctaccgtccccgaggtctgccgcctcctctctggccggatcttgcggagaggagggtgcggctgctgccgctgctgcctctgccgggccgctgaagcatctaggtccccgttgttaattttgataattaatgacaaacgctaattgtggactaaccgttgctattgagataatattttaagttaggtccacgtcagtgtgcgcatggatgactatcgatggattaaaattgacggcgcaaagcaaagagaaagaagacggtaaaactagtgctttaatttagaattgatcgaggtgtagggcgatcaaatttgctagtttactttttagtttcgccgtactattaagaggggtaataaccttgcaaagagatgattttaattgccgtattaggtcattatgcatttagacttgtgctcgtttttcatcacacacacacaatcacttaggatttcactggtttcggcctgaccagtggcggtctgaccggcaagacggcggtctgaccggcgcataaggccggtcagagcggcggcacatgagcgggcataccggccccttggaggccgcgatggtgctgctcgggatggccgatacagagccgacggagccgtatttggccagaccgaaccgatggcggtctaaccgagccgaggccggtctgaccgcccactcaacgccggtctgaccggccagtccgatggggccctctgacagcactacaacggctagttttctagccgttgcagagtagcacggtctgaccggccacatacctaggattgctaaacattaacataggagtgtgatttactttcctagagatataattgagccactatcaccctagatttgcaaaacataacttagttgcttagttagagttcaccctcaccaagcctagcaacttaggttagttttgattaggtgtcatttagttttaaatagcctattcacccccctctagtcgacatctcgatcctacaagtggtatcagagcttggtctctcttgattgggcttcaccgcctagagagaagatgtcgaacgaggtgaaccatgtagggaaggctcccatgtttaatggcacaaactactctacttggaaaattaaaatgtctactcacctcaaagctatgagcttccatatttggagtattgtggatgtagactttgctatcaccggcacgcccttgacggagattgatcaccgcaacctccaactcaatgcccaagccatgaatgctttgttcaactctttgagtcaagaggagttcgatagagtgagcaaccttgagaccgcatatgagatttggaacaagttggcggagatccatgagggcacaagcgagtacaaggatgccaagcttcatttcctcaagatccaatatgagacattctccatgttgcctcatgagagtgtgaatgacatgtatgggaggctcaatgtcattgtgaatgatctcaaggggcttggggcaaactacactgatcttgaggttgcccaaaagatgcttagggctctaccggagaagtatgagacccttgtcaccatgctcatcaactccgacatgtcaaggatgacacccgcaagcctcttggggaagatcaacaccaatgacatgtacaagttgaagaagaaggagatggaggaagcctcaccttccaagaagtgcattgctctccaagccgaagttgaagataagggcaagggcaaggtgaatgaagtcaatgaggacttggaggaagagatagcccttcttgatagaaggttcaatgatctcttgggaaggagaaaggagagaggaaggggctccaactcaaataggagaagaaataaaagacccaacaagactctctccaacttgaagtgctttgagtgtggtgagaagggacactttgcttccaagtgctcttccaaggatgatgatggagacaagtcatccaagaaaaagagtggaggctacaagctcatgaagaagctcaagaaggaaggcaagaagattgaggcattcatcggggaatgggactcaaatgaggagagctccgcttcatccgggtccgaggaagaaggtggtgatgatgcaagctccaagaagaagaagatggccgttgttgccatcaaggaggctccatcattgttcgctccaatttgtctcatggcaaagggctcctctaaggtaacatctcttagtgatagtgagagtgatgatgattgtgatgatgtttcctatgatgagcttgtgagtatgtttgaggagttccatgcttatagtgaaaaggagattgtcaacttcaaggccctaaagaaggatcatgcttctttagagatcttgtatgaggagctaaagacctctcatgagagactcaccatttctcatgagaagcttaagaaagctcatgaaaacctccttttcactactcaacatggagctctcattgatgttggcatatcttgtgatttgcttgatgatagtgctacttgccatattgctcatgttgcatcatctagcatttctacctcttgtgatgatcctgtggatatgcctagctctagctctagctcttgtatttctatttatgatgcctcacttgttgttgagaacaatgagcttaaggagcaagtggccaagctcaacaagagtttggagaggtgcttcaagggtaagaacactcttgacaagattttgagtgagcaacggtgcatccttaacaaggagtgacttggattcattccaaagaagggtaagaaaccttctcaccgtgccattcgttttgtcaagtgccgtaaggttgggcatttggtgaatgattgccccggtggtaagccttctaaaacatgcatgtttgattctcattatatgcttaggacggctcataatggtagcattgttgctagatatgtgggttcccctatactcagtggtaaaaagaatgtcatttgggtgcccaaagctttggtctctaacctccaaggacccaaacaagtttgggtacctaaaagagcttgatcttcttttgtaggtgaactaccgcactggtggaagccattgggtgcttgatagtggatgcactcaacacatgaccggtgatagagctatgttcaccacatttgaagaaggagggaaagaacaagaaaaagtgacatttggagacaatagtaaaggaaaggtaattgggttaggtaaaattgctatttccaatgatttgtcaattgataatgtctctcttgttaaatctctaaatttcaatttgctttcggttgctcaaatttgtgatcttggcttgtcatgtgctttcttcctgcaagaggttattgtttctagtcttcttgacaagtcttgtgtgttcaaaggttttagatatggaaatctttatttggttgatttcaattctagtgaagcaaatttgaaaacttgtttagttgcaaaaacttcattgggttggctttggcataggaggctagcccatgttggcatgaatcaattgagcaaactttcaaaacgtgatctagttgtgggcttgaaagatgtgaagtttgagaaagataagctttgtagtgcttgtcaagccggcaagcaagttgcatgttctcatcctactaaaagtatcatgtccacatctataccattggagctcttgcatatggatttgtttggcccaacaacctataagagcattggtggtaatagtcattgtcttgtgattgttgatgattattctcgctatacttgggtgttctttttgcatgataagtctattgttgctgagcttttcaaaaagtttgcaaaaagggcccaaaatgaatttagttgcactcttgtgaaaattagaagtgacaatggttccgagtttaagaataccaatatcgaggactattgtgatgatcttggtattaaacacgaactttccgctacctactcaactcaacaaaatggtgtagtgtagaggaaaaatcgtacattgattgatatggcaaggactttgcttgatgaatatggtgtttccgattccttttgggcggaagccataaacaccgcttgccatgcaaccaataggctttatttgcatcgtctcttgaaaaagacttcctatgagctaattgttgggaggaagccaaatgttgcctattttttgagtttttggttgcaagtgttatatttatcgaaagggtgttagattaaccaaatttgaaagtcggtgtgatgaagggtttcttataggttatgcttcaaatagcaaggcataccgggtctacaacaagaacaaaggtattgtggaagaaaccgccgatgttcaatttgatgagactaatggctcctaagaggggtacgagaatttggatgatgtaggtgatgaaggcttgatgagagctatgaagaacatgtcaattggagatgtcaagcctattgaagtggaagacaagccatccacctccactcaagatgagccatctacttccgctacgccaagtcaagctcaagttgaagtggaggaggagaaggcacaagatccacctatgccaccgaggatacacaccgctctttccaaggatcacccaattgaccaagtgttgggcgacattagtaagggtgttcaaactcgatctcgtgtcgcttcgatttgtgaacattactcgtttgtttcttgtcttgagccaaaacatatagatgaagctctttgtgatccggattggatgaatgctatgcatgaagagctcaacaattttgcaagaaacaaggtgtggactttggttgaaagacctagaaaccacaatgtcatagggacaaagtgggtctttaggaacaaacaagatgagaacgggttggtggtgagaaacaaggcaagattggtggcacaaggttttacacaagttgaaggtttggactttggtgaaacttttgcccccgtggcaagacttgaggttattcgcatccttcttgcatttgcatcatgctttgatataaaactatttcaaatggatgtgaaaagtgcttttctaaatggtaaaattgccgaacttgtctttgttgaacaacctcccggttttgaagatcctaaaaatcctaaccatgtttataaactctcaaaagctctttatggtttaaaacaagctccttgggcttggtatgaaagattgagagattttcttttgtcaaaggatttcaaaattggaaaagttgacaccacccttttcacaaaaatcattggtgatgatttctttgtgtgtcaaatttatgttgatgacatcatattcggttctactaatgaggtattttgcaaggaatttggtgatatgatatctagggaatttgagatgtccacgattggagagttgagcttcttccttggacttcaaatcaagcaactcaaggatgggacgttcgtgagccaaaccaagtacatcaaggatctactcaagaggtctggcttggaggatgcgaagcccatcaagacacctatggcaaccaacgggcatctcgaccttaatgagggaggtaaaccggtagatttaaagctttatcgttctatgattggtagcttgctttaccttaccgcatctaggccggatatcatgtttagtgtttgcatgtgtgcaaggtttcaaaccgctcctaaggagtgtcacttagtggccgtgaaaagaattctaagatatttaaagcattcctctactattggcttgtggtacccaaaaggtgctaagtttaagcttgttggctattccgattcgaattatgccattgcaaagtggatagaaagagcacatccggtagttgccaaatgcttggtagatcctttgtgtcatggtcatccaagaaacaaaactccgtagccctctctaccgccgaggcggaatatgtttcggcgggtagttgttgtgcccaattgctttggatgaaacaaatattgttggactatggcatatccttcaccaaaaccccactcctatgtgacaatgatagtgccataaagatagccaataacccggtccaacattctagaaccaagcatattgacatacgccatcacttcctaagagaccatgtagccaagtgtgacatagtcattagccacataagaaccgaggatcaactagccaacatctttaccaagcctcttgatgaaacccgcttttgcaaattgaggaatgagttaaatgtcatagatttctctaatgtggcttgagatggtgcaccatggttgtttctttttgcattatgtatatttgctctcatttgctcttatgctttggatttgttgccatttggttcttcattgcgaaaatggagcatgtcacattaagggggacttttgtactcttgcatgtgctctacttccctttatatgtgagcaaatcaactagtggtgctagtagtatttccaaaaatgcccaagtcaacataagtcaaaacttttgcaaaatcaatgtaatttgaaaactatctcttggaaaatgtttcaaaaggtttcctatatgttttccacacctcacattgcaagaaaaatgatttttgaatgaaaatcccattttggccctcttttgaagaaactagattcttagttttggccaaaatgagattgagaaggagtttgagaaaagtttcaaaacaaagttagtagagaagaagatttgaaatgtttttggtattcaaacctatttcaaaaaccaaatcattcaaaagttatttgaaaatcaaattcgcccaaaaacccctatagaccataaaaggtcacctcctagcactcaagtgagttttgttacaaatcttcataattttcaaatgttatgaatggttggcaatatttaaactcacacatttcaaaatatgctccaaaagtcaatttttttatcgaatttcattatgtgggggttgtcggcctgtgcaagggctgtgcacagccggcaggtggcctggcggtttgaccggcgctatatgcgcggtctgaccggccaggtttggcggtctaacaggccacatagggccggtctgaccagccgaggtgggcccagggaatttttattccccctcttcttctacccccacctacctctctcctcctcatcctctcacttccccaactcgattttttcttcctctctctcacctcccctcaaaccctaactccttcctccatcaaatccattcaatttgaccacggatttcattctggttacaccgtaagtgattctcctccgcttcctctctctattccatggattagtttgtgtttttgttgagtttttgatccatggcatggaaccctaggtgaagcacgaggtgttcttcaatttgcaccaatagagggtagtttcttggtgtgattcaactcctccaactggtaaatccctctccctcttgtgcattctctcaaatcgatctatttcaccctagggctatgggtagttgttccaatcttgatgaaataggtccaaccctttgatgttctagttccactcttgtgcaatattgttctagcaatttttagactcaaatgagtagatgtgaaaatttttggatgcttgaacttgtgggaggaggtctacctggagccacaggcggtctgaccgtgggtcagccgccggtctgaccggcgagtgcgcccggtctgaccggctggcaaccgtctgaccggcctgatgccgtcagacgccctgctggctgtggtctgaccacccctccataggatatagtcaaattttcacctctccaaattgtttctagaattattgctaatatctatcatcctttactctttgacagtgatgcctccccgcacttgccatggtcgtcgtgcacccactccggatgccgtgagtgagcctgaggaatcgagcggagatgattatgctcaaagtgatgaagaggttgaggcaaatgttgagggggctagtgaggaggctagtggagatgataacagtggaagtggagaggatgaggatgaaggaagtgataatatgcacattgatccctccatccagtttgttgtgaacatgaggaatccatcgcagtataccatcttgaggcaccatgatcagtttttgaggcctcgggacaccccggatccccgttttcacaccgctttccagaagtctgtgtatgagcaggtttatgcagggaaagcatttgcagagcataagtggatttcttggagagacataaatgagactccagagtttgagggattgtaggatctcttcaagactgttggcattgactggattgtgaccctcaagcaagactacaatgaagatttgatccggcagttttatgttacagtgtgggtggctggggactatagtgagatgaagtggatgtccgacaccctccactgttctatctctaggaggcaattccggcggctcctcaatattcgcttggactttggagatgacttgcatgagaagcacacccataatctgctctccatagactatctctctcagttttatgaagatggagtgcggtacacacatgggaaggttgccggcttgaggactatccccagtgtggttaacaggattgtgagagctaccatcctccctcgccttggcaacaatgatgacattaggggggtggcttggcacgtcatcgatgcaatcattcagggccgtcagttcgacattgtgtctctcatgatgcaagagattgccatctccaaggggaccttcactcagggaatctattatgccccttacatcatgaggttgattcaagacaagcttggggctgctgggcaaaatttgaagaagcacaagcagtacaagccccgccttcagcttggagctccctgtgctcctagggcggcgccctcctctcatcctggagctagctcaagctcagcacctcttcctcctcctcctcctgggtatgatccaaatactttcttccatccacagtatgcttattttggaatgcaacccaacgagtacttcaacccggtacttggagctattaataccctaagtgaaagcattcaacgcttgtctaccgggcatgaagctttgcatgaggatgttcgtggcttgcgcaccgatgttggagacttgaatgcttccgtggggagattgcacactagagtgggtacattagattctcgagtccaaatgttggagagctcccaagcatttgtgtatcatcgtagtcatgatgctccttatccttccactttggtgcgtcctccttctcctccacaagagtgaagacatttttggtgcttaatgccaaaagggggataaaagtgtgctttatgttttgtgggttgggactagtagtagtgaggatagtgccctcatatctaataggttaaggtggtttgggctatattttgtatgggtatgggctattactctatattgtgtgttctttgtcgttttgttaaactctatgtcatttggaccctttgtggtcttgtaatagcctatgtttatttgtgagcccttttaggatgatttgtgacttttgtgatttgattggttaagtgatgtgaacttgtgcgatgatggatggtgtatgcgatattgatatatatgtgaccatcttatgcttatggatgaatatttcttgaagtttacattgagatattgcttatgtgtttgtgcttattggaatgtgaaattgaaatgtgcattggctccatatttgttgtctatgattgatatgcacatgtttacggggagcttttgatttccattgcaatatatatatatatatatatatatatatatatatatatatatatttgtggtgtttgtcatcaattaccaaaaacggggagattgaagcatctaggtccccgttgttaattttggtaattaatgacaaacgctaattgtggactagtgctttaatttagaattgatcgaggtgtagggcgatcaaatttgctagtttactttttagtttcgccgtactattaagaggggtaatgacctagcaaagagatgattttaattgccacattaggtcattatgcatttagacttgtgctcacttttcatcacacacacacaatcacttgggatttcactggtttcggcctgaccagtggcggtctgaccagcaagacggcggtctgaccagcgcataaggccggtctgaccggcggcacatgagcggtcagaccggccccctggaggccgggatggtgctgctcgggatggccgatacagagccgacggagctgtattcggtcagaccgagccgatggggtctgaccgcccactcaacgccggtctgaccggccagtccgatggggccctctgacagcgctacaacggctagttttctagccattgcagagtagcacggtctgaccggccacatacctccggtcagaccagcagagcacaaagttgggggattttgcccccaacggctagttttggttggtgggagtataaatactccccctccagcagcaagggggctctcttggtacccaatttaattgcatacaccccttgcacctctatcacacccacttgaactttgtgttcatccatctagtgtgttagaaggttaattagccaagagtcaagtgctttgcttccatttgtagagctagtgtggcacttgattgatcatctccacgccgggtcattgcttgttactcttggaggttgccgcctcctagacgacttgtggaggagttgcccggtgacctctccgagaagattgtggaggaggcccggcgccagtttgtgagtggtttggagttcaccaccttcggagtgaaggaagaactaccctagtgatcgaggcttgggtagtcctctccataagccggctcccgccttgcccaccccttgacgaagggggcgtgcggtggcttcgtgattgagcggtggagttgggctcaccttaacgggaagtaggaaaccgacgagtttccgaacctcggtgaaaaatctcttgtctccttgtctcatttgattgtcgcatttacatttgtgcaatttacatttctagagacatacttgagatcatatcaccctaggattgctcaacattgacataggagtgtgatttactttcctagagatataattgagccactatcaccctaggtttgcaaaacataacttagttgcttagttagaattcaccctcaccaagcctagcaacttaagttagttttgattaggtgtcatttagttttaaatcgcctattcaccccccctagtcgacatctcgatcctacagccaccgccgagacaggcgagagagtgcgagggagagaggcaagagagaaagagagaaggagagagagagagatgtagagacggagagagcaagagggtttgagaagatatggacggaaagacaaagagagcgagatggtttgagaagataaggacagagacgatcggcttgccagctcggctcgcctcgatataggtgccggtttttttaaatgaccaacacctattgtataggtgccggtttttctttagaaccggcacctatagttgtttaaaggtgctggttttatgtgtgcttttagtctgcggagaaaggaacaatattataggtatcggttttaactgttgcatcacctatagtggcaatctgtatgagctttgtttaagtagtgtacggagaataaacagccatatatataaaatgactctttcaagtaaataaatgagcatcgccatcgtcctacaattgatgtttgcgtaaaatggcacacacgccgtccggtttcaacagcctaggatgcccctaataaacagaaaatgaattaagctactcggtacagagacttaattataattaattaggtgtatgtataattgttggaatgaagccatcatatatatcgatcctaagctatagctgcagattaattattgaatagctagctctacttgtttttgagaggcggcttgagcttagctagctttgctaaattgatcattaattgagaggcttgaacttagctagctttgctaaattgatcattaactcaaacttgaagaaaactagcttctctctatctcagaatataaaaatttctagcatttaaaatttgtcacaaaaatatatataggaactctgttacacacttctcatatcaagcaatcacaactatctgatatcatttcatttctcttcgtctttcttaacttaaccaatcataattgaacatcacctacttataatttcatctcttttattaatctctataaagaaaaccttaaaacctagataaaaagaactatatatatagatatgtttatattttgagatctatatgtctatattttgagactgaaggagtatacgatagctaatacaggtaatattgatatggggaattttgtcaaggcgggtcagggtcacagcccgtgcgtcgcgtcatcagaaaaggggcagggcccgggcattgccaggccaccacctgaaggccatcagccaacacccagtactatccagctatagcgttgtatagcctcttcttgcatgatcaatcaaaatctaatggatgcaagctagatgtcacagttagggcactgtcgccacaatgtcctctcttggagggcatatacatgcactaattattattaattcttggaataactagtctggatcaccatgattataactccctgttaaatcctgacgcgacagccagatgaacagtgtgactaattgtgtgcatatggattagtagttaatttgattaattctgcagccaaattgacctgtgtttatgttgatgatgatgatgattatgatgatgatagcaactgcagatgaattcgcactctcgttcgtacgtacgttcaaaaactacgtcccaactaatgctagctgatgatgaattagtctctccgggctccattgatctttcttgtgtgtttgattgatcatgttgactgcagaaaagtattggagctttgctgtatgttcgttgttgctgtacgtgtgctaatataattaggctattagcagtagtttttgtgtactgattctctagagctgtagcgatcactgatggtgaagtagtcggttgttgcgatattcttacctgtccttttttgacattttcttcccttccagtacatgtacatgtaacagtctctcgtattaattgtgcactacctccagtgaaaaatatttgacgccaaatatatgctccctccattttcaattataagggcccctttgaatcgcaggattaagaaaacgtaataatagaaaaatgtacaatattgatataaatgtaggtgtaaaatagaggattgcaaaacacaggaatgacggtttgattggaccgcaggaaaaacacaggaattagaggagagataaagactcaaagaaaagtttctattaggtagaacctcatgttagttttcctacaaaatttacatggcattaggtattccatagaagttttataggattcattcctttgattcaaaggaatatataagaaaattcttgtaggaataaaatcctctaaaatttctatgaatcaaagggggcctaaaacgcgtatgcatgtatgtatgtaattaattagcacatctcatatcttatatgtcaaaaaattagcgcatcccatatcctttagtttgtattttaaatcatatattctcaagatctctaattttattggattcgcgcatgcattatatttactagaattacataaacgaaaagatgatgataattattttttggttttttagttacaccgtattactccgtactacattttagaatagatggtatagtgattagtgatttgtcataatagtaataatatcatatgtgtatatgcgcaaattttagtgattggagtaatgatttgaattgtacgagtatatcagtgttataatttgatggtggtgaatagtataattagttttgttggtgaagtaattattacaagagaatgggcggctataattgttgggagggagacacgtgtataagttagaacaggcagcagacagcggtctctgtcgagcgtcgcgacaacggggcaataacttggaaagcgattgtcggcatcacctacgggcgccacgtggacagcatcactcgaatgtgggcccagcgccgtttcacaccacgaacatcagtatacgatctcaccggtttccaaacgtactccccctttttcttggtggagattaaagagatagctaaagttaaatagtgatggtttgtgtttggtttaaatgaaatactactagttgatagagaaattaaataaaaaatgattatcattggttgagttagaaaggaaaaatatgtagtacatatcccattgaatctaggaataaaatttttactcttagatttgaaaatgattacaaatggttgagataggaagaaaaatatgtagtgcaaaacacatgtacactaaaaatctagaaactaccatttaatctgggagtacaatttttactcttgttgatgtggaagcttccatttctagatccaacagtaatttctaggttttcacagatagaaaagtagatagagagattgctactctgcagtagagaagggtgtgataccattttttttattttttatgtacttttatccttatattaaaaaaacacgtacacataaaagtatgctctgcatgttagcaatgtttgtgtgcatatatatatatacaactgtacattttttatgaatcataaattaattgtctaaaatttatatcatcaaatctaaaatatggatatcaatagtgtgacgtatatacacatgcttctttatagaggtcatatttttatcggaagtcgaagacatatattagtattgcaaagaaagaactcatatgccattaattaagctatatctggtaattaaacccatgcaatgcatgctcagtaaacaagactcgagtggggactacggagtggctcgttttcagatctgacagaagagatgatgaaatgatcagaaaacgtcgagcattctaattaagagggctagccgtcaaacctagctacaacttaaaaatacgatatttgtgaaataaatcatcaagctaaaagtatggtcagcaaatattaatcggcactaattactccttttgacaaaaaaaaagaaaaaaaagaaaagaggaacatatcaaccaaaaggaaagtaactttgctgcatgatggctatatataattcgtgcagccataaagaggagcaaaagatctaggtctctgcaggcatgtcgtcgttcttagcttctttgtcttcttcctcgtgcggtgtagctctagatcaaactatgcaattaatcccagtcctgtaattaaaattcatgcaagatttggtgaaatttgtggagaacaaaatcgataatcctagctactagttgcgccgtcattatcgcattgcaacgtataactgtcttgtgatatgtccacgcaatgactagtacactgctccctcctgatctcctctgaattaaaaaaagagatgatgatatgatgatgatagaacagaaaaataaacagtgctagcgctgagctgctatatatctgacttttcttcgttctaatgatgatgagtcatcgtgacaacgcccctcttgtttaatcgaaaattaatcaatgactcgatatcgaatctgcgattaagaataatgtcaatgcgccgatcgaatcggatgctgtttcttgtgccctacttttgggcaaagcaattaaatatatatctgatattaaccggttaattaatttactcgattatactattagagaagccatgatcttatatttagccgtcgtacctaccaatactaaaagcagacaagaattcaagacgtcgtccaaccacagctctgcaacggctgcacagagacaagactcttgcatacattgctttctttgtttagggcaagagggcgccgccatttgcatggagtagttagggttaattagttccatatactccagtatcgcgaaagctacgtacgtacttcaagtactatatataataaattaattggtacgtatatacttgctaagtgagttttggaatcaaataaattaatgcaaaatttcattgtacatgcaaaatatctgcagaatttttatatgggattgatcttaaggtggattgggcatttaataaacaatatgcatattttgtagatacataattatgcaagggcacattcagtggctataatgaatttaatatccgttgtgctaaagagcgcacctcgcagtaacccactcgactcgctcccctccccttccctcttatgtataaaaggttaatcccacgtctcgcctttacattggttttgtcgctaggatgtccatcagtctcctcccgtcccctcccccctctctccacttgatgaaaaaaattatcctcatctctcaaagaattgaaaagatcttgcaagtaacttttttccaatgctagcttcctctcatcttgatccattttttctaccataagtgatgtgaatttctttttttacataaagacaagggggatgggggtacgtgtggacgggatatcaggagagtgaggaagggggtggatggtacaggtggagaacctaccaacaaaattaatgtttgggtaaatgtgagtaatattttttttttacataaggagagaggggaaccagtctctttaccaaaagcagtgtggtgtggctccttttagcacgcactcgctccccctctctctctctctctctttatctctctctaagatataatagagtgagcaacaaaattgtccacggcaataaggaaatttgccacgtacatgtcgcaaaggtaacctttagctatattagacgaaatttacgttgaattgtacttcttttttttaactgaagcaattcacttaagttgtcatcacaagcgcactaattctgtgatggaggtgacattaataataaaatccagcgagagatgtgggtgacaaagtgcagagtggagacatgtagagacatggttctctttcagtaaaaaggtatacgtgttcaagtgactgaaagagcatgtcaatgtacaccttataaagtattgagctacgacatattgctttagtttttagctcatctatcacccaattcagtcaagtgtgatcgagagatcaaatgtttttcaaagaatcaaaaggtgctcgacctaataatggccgatatatatcatgttaattaatcccaaagggatcaaccaggcagctagcagcaagcctccgcgagcaagaatcggctttatttggtcattttattaacttgttaattaattaaacatgtttaggtgagggattaattaattaactaacgggaggagtggtgcaactatgctgtcattaattaatcaatctagggtaaattaatagcacactgacccatctcgtttagcctctgcttatctcacagcccttggagcgatgcgtctcccggccaaaattctattgcccgatcgatcgattcggatttcgccgaatctaatgatgtcaatcacgcaatgatttaattagcctaatctcgaaagccacttctccaccactcattttgttaattaatctctgggattatattagtaactagctgtagtggaaggtggcatcatatgcagcatgcaaagatttttattaactatatgtggaaggggtagatgattaatttttgtataaatgtagtaaacactttggtagcacagttaacgccttgctataataggagatgtacacatatatatatacacacacacacacacgatcgtcgcaatcattaaccattctaatacgtatacgtatctgtagtgtgcaggtcggccggaggaaaccgttaaacaaacattaacttttgaaaaattatttaatctgcttttgttctctttttgtttggaccttctccgtgcatggaaagtttgtgttctaaatgtagaagcttgctttggaccaatttgggttgatacaaaagtttcatatagtagcttttttgtagtacgtaggccaattgatcatgtgaaatttatttgatcatatatatctcttcctattttaattcaatttaataagcctataaatcccacataaaagcttccttacatttctacagctaggttgcctttataaaagagtacttactttccatatatactccaccttttgtacatcttgtttatatggtcaaatggatataataaatacatgcaactttccctattcttttattgattgtgtttttttatatggagtgcttgaaatttatcatacagcctataatataattcttgggaccaccaaaatcgccacataggtatacgataagttgtcttggtacatgtaagggtaaaaaaaaattttcacatatgggctatggtaaaagggtagaaataggaaaataactttttttcccaatggtatatgtcaaatttagccttacattattaatttgttttctcctttttttttcttatactgatcatcgtataagtttttctaccaaaaccaagaaagtctgattttcctatattttatttaatgagaatgtgatggagaaaaatcaagaagcatgcacactttaactttccccacgcacaagaaacgagagctttactgccccaagtgcatgcatacacttctggttatatgatgataatatatatgtaatggagggaataatatataagcgaaagtcgccatcaatatggaatggcatgtatgaggtgattttagtggacccaccaccaaagaactatattaggccacataacaaatttcaagagcttatttatagaaaaaaaaagaaaggtcgagtagtaaattgaccccagagcaaaactttagatgccatagatgccataaattgttactctccctctgaaagctcttctttgataggaaaaaaatttcataggaactacacattataatttccgtctaaatatacaatcatacatatatatttcatccgtttcacaatgtaagactttctagcatcatccatattcatatggatattaatgaatctaaatttatatgtgtgtctaaatttattaacatctatataaatatagacaacgctagaaagtcttatattattaaacggatgaagtaccttgtttctacgtacgattcaaacatggtatataagataaacatgtcgtcgtctgaacaacaaataaatattttgtctcgatgtcctcttggtagttgcacgccgaacgttctgcccatttttcagcgtaatcggatagaattgaaatccatatcttcgtctgcttctagcagctagcatcagcttgtccgtatgcttcagagagaggaaatatcatcgccgtccacaatataatgccgatcgaacactgtactaagatatatataaaaaattttgttgctgaggcaagaactagaccggtgtcgttgctggtccaacttggccaatggccatatatatatatatatatatatatatatagttttgcatatatatatatatatatatatatatatatatatatatatatatatatatatatatatatatatatatatatatatatagacacacacacacacaccccctagtaatagctggtcccatgtacatatatatgcttaattgggttagctcgagctaactggggtgccaaaatgaatgctagctctagtttaagtgcatgcttggtcaagatggataggggatcagatctagtttccctgtatgcgccccaccaaatcatcacggccattgatatgtcccctgcctctaattaatctgatccactccgttaaatatataaatatataaatatatatatatatatatatatatatatatatatatatatatatatatatatatgacgtatatatgttgttgattttatttggtcttgacactttgacttaattctatcaattgaggaggttttatccagatggctagaatacatgcagttaattttagttctgcagacaaacataagtgaaactattataacaagaagttttatggtgtttgtataaaaaggaataagaattcgactctccataataaaatgtttttaagtattgacagaaatttttaggtaagaaactaggaaaaaaagtaattttgctagtagatggacaagagcaagccggattgtctttgatattatttgatagtattaattagttttcccatcttcagtacgtgatagttatttatgtatctatatattatataatctgtgtgtgtttttttaggttatattgtgtccccaagaacatattgggttaagatatcttcatttcttttgtgttgttcccatcaacttgaactgattaactgctgcgcctaacctctaaattaacctgtggcgctggagtgactgagggaggagagagagagaggcggaggagaagaaaaaagaaagactatgttcgttttctattttcccctactgatatgcccatattattaatgattaattactccgctgtcatcggctataatagtttttattctgtatcttactcctctcttaatcaatggtacatattggttcacctctcaataaacaccgtaataatttatcgtgcaaaaaaaaaggtaatcaaactcagaatggggtgtgtgtactgaagaaccatgtcaatgtcctaaacacacatacacataaaaaggaacaggtggaaagtatgtatagattgattggatatacttagttaaatactaaagtcaatgcatgaaccacatgttcatatatattgtattgtacttaaagtatcatcaccatgtacaataataataatacaacgtaggagtgttggtacgtactcaacgatcagtaacatgcaaacacatcgcacttttgttaggtgaagagacagcaacgtggcagtgtgtgtatatatatattattacatgcatggtattgaccattggtgaacgtgcatgaattaagactacacggtcagtacatgcaaattgtagtagtagaaatgtatcaaatcatcaaaaaagctgcatacattgcgtaattaactgggtttaatttgttgaattttccgatcgatcgatgtgtcttcaacacatcaaatcaatgcagaatttcaaaaggaggatgcatggccagaagaaagaacaagatgatgagctcatcatcgaagtagtatatatgctttgatagctccaggtaagacattgtacgtatggcgccgtcgctgtcacacaaacaaaaggagaagagaaaaataaaaatttataagaaagaacacaagtctctttcgcgccactaagaaggcaaccattttttagggtttttttttttctaaaagatcgatcgagatgtcgaacacgaaaataaaacacacgtatatatcaatcggcatcgagtaatgaatttgctggcatcgatggatcggtcgatgttaattcagatttcagagtgagagtagtaggcagcatgtcaccatgcacatgcatccatccatcgatatatctatctacctagccattgggcccggttaattgcaaattaaggtgcgacgacgagaacgagtttatactacaagcaggctcctggttcaaaatttcagttctatcggacctcccctccacccccaacccccatattatattattttggtcaaaattttcaattttttaatttattgaatttggtaacattttgtttaagtttgacttttttttgaaaattcaaaaaaaattggatcgacgtttcaaaaattttggtatatcggcgtcgctgatagaaatgccgaaaatgaaatattgaaccagagcatgctagagttcagaaacactggttatgtagatatttttcaatcatagatagagctttaattagctgtatgattttatcatgattgtaataaatgcatggttttaaatctctaactatagataccgctatcttcggttatagctatttgaatagagatatagttatttgttcttgcatacaatttaaccgctatagctgctgctataactgtttgagaagaccaactgttaaataccttagcccgtcttttaaaacactgaataaatgtaatatatgtctgtctatatggtggtatttctttttctatcttatcgatggtctgttatgagttggctgaagttatctggacacatattgaaacaagtggctatagtctttttaagcaaatcaaataatatatattgttattaattatgttaaataaatctagctaggccatatgtgcatgcatcatcagagattcagaaacaatatttccttcgcctaattaataattagtcgtactctatataacttataagctgtactttttaatgaaaagatatcttgaatccatgcatgcataatgaagcatgttcaatttactaatccttacgattttacaatccaatcatcatgctgtcgaattcccaagaatcagcgatatagcgtatctcgtgaaagtgatatcgggggctccatttcttcgccttgttttgtccatttcttcctcctctgctgctggcatgcacgcttctcctttattttttttccatgcatatgatctcatgaacagggccatcttgtttgattcttccctttaaaactacaaaatgctttctccttttcatctttttgagttgacatattgtctaacctatagctacttttaataaacaaacaaattaacaccttctagaatgatgagttttttaactttaaagacagaaattaatcatgttctacacatatatagtactatatatatcacctgcttaattagtaactgatttaatcctgagtatatatacatgtggcagctgaggaaaagaagtaattaaataaattagcaacgaacctagctagtcggctagctctaggtaggtatatagggcgtatttttggatattttcttggcatgagccggctaggtttgctgctgtgtttgaatgaagaaaataggtctcgtcgaaatcagagtagggcccacccgtcggtactgcctccaaaaggccaagcaaaacttcaaacacgtcgtcatgcatgcatggagattaattatttgcaaggattaattttattaactcgatcgactgcagtatattgcatcatttcaaatgcataactaaaataatactccctccattttttaaatattttattgagaaacacaggacaaacataaatacataatcactcataagtcataacgcgcgcatacttataccctcattctttttatatgatgttggtttgttcaatagtactctctccgtttcaggttaattataagacgttttaattttaattaaagtcaaactatttcaagtttgactaagtttataaataaatatagtaatatttataatattaaattagtttcatcaaatcaataattaaatatattttcataataaatttgtaatgggttaaaaatgttactatttttttttataaatttggtcaatcataaaacagtttaattttaaccaaagtcaaaacatcttataacatgaaacggatgtagtataaaaaaacagattatatgatcgattgttttagactatgtgattagctgcaaaataattaatccacatcgactcgcgcaaatcaaacgcatgcatgggtcgatgaatgcagcaatgcagcatagtgctaagtgctaactacagttcgatcgatccagtcacgatgctgtgatggatatatgattgaaattattagttttcgatcgatgatcgatgcagcgagagccgtacggcctaactgatcgtgctgctcatgaatgaaaatgcattatgcagatgggagtcatggagagaggtatgggctccaaggaggatctgtcgagaggtcgatcgatcgccggcatgcagcttgattgatctgcaaaacattttctatctacccttggattcatgcatgcgtgatactatgatttaattcattacctcagctcaatatgatgcataaatataaccgttgttatactatggttgagttaaatttcagcaaaatagagagaaaaattcgaccaacttgtaataagtcattaggtggaacaattgttatacattatttttttttcttgtttttaagtagttttcttgctttgtaattaatccatgattttataattcatagctatccgtcatacaaactctgcagtaattagatatagcttctttaaagtaaatatcgaaatgaattcgatgatcttaaaaaaataaacagagtggtgactaattaatgtattaggccggtaataataattcaaacaaattgtttatactagagatttaaaacaatctaacctttatatgtctaagcatgtagctggccaattttaaacaaattggtaaaactaaatttctgacatttagaaatcatcatatggttaaacaagggagcacacatatagatatatacagaacgcaaaccacatggacatgacaaagattttaattggatatattattcgttacttcgaatggaattttatctgaaagttcagcatcggatagaattaagcccaataacatttgggctcttaatgctggtgaatcctgcagcagatgtagaacagccagatgtgtgtcaagcctagttggtgggccagaattgcaatcaccgaggcccataaccacatacatataggccggtacttgtctcaggcccagcccaatctgtgaggctgcaatcattccattttggaaaaagtacaccggaggtccttcaacttgtcatcgagttacaaaatcgtcccccaaccgcaaaaccggatatatgaccacccttaactcacgaaaccgttcactttaggtccttgggtggttttgaccccgggtttgtccgacgtggcagctgaatcagcgtgggacccatgtgggtcccacatgtcaggaggccacatcatcagtcatcaccctctctcctctttctttcccctcatctcgcccttcatcggttcctcctctttctcactcttctcagcggcggcgccggctgcgaggtaggaggaaggaggacgtcgacgtcggcggcggcaagacgcgggagaaggggagggcgtcgacgccgcgcgagtgaggtcgaggatggagaccacggcggcgaggtgagcgacctcacggcatcgtgcaagcacggcagtggcccggtggagttccgcggctgccaaagatgggcccgacgggtgtgcag

SEQ ID NO: 80667 - DNA, 4066 bp, Oryza sativa
aagttacacgcatgggttcgaacccgagacctttgcttttgaaggaaaccacctcaaccaccgagctatcataaagggaggttaaaatttcaacctatacagaggtcaccaccgagctatcataaagggaggttaacatttcaacctatacagaggtcaacgccaatgagagtggcgctgacctttgatgatgtggctaacttatgacacctcggactgagtttagcgccaaaattggtggcgctgaaatgttagatctcagcgccagttcatttttgaaataaatttttgacacggtttattcttataataaatttttgtaaagagtcaaactgtcaaaatttgtgaatccaaggagtgtttcagacacgttcactgcaatcgcaccgcaccgcaccgcatcccgcatcccgcagcaggccagcagccgatcgcgagtgtctagtagtactactactcggcaccgagagctgcattcccgagctccaggttccagcaaagtagggtttagggtccttaggtttaggaggaggaggaggaggcggcggcggtgagaaggagagtgggatatggacggcgacggcgacgacggcggcgactggaccaaggtcacatataaaagtaccccaccgtcctctgcctcgagtagtgacagcgggggacgcggccgcgggcgcgggcgcggcggccgcggccgcgggcgccgtggcggcgggcccgggccccggtccggcaggaatggcggcggctgggacaagcgtggcaagaatagcagcggcagcgaccacgagagtgtcggaagtggaacccccccctgcaactccgtcgagagcttcgacacctgtaccctcccctgtgccttccccgtcatctacgttccctgatttcgcggaggaatacatccgtcactccttcctggttaggcttacccaatcttcggatgccagggtggccgagaggttcatgcagtttctggtcaagtatgttcttttctcatttaccttctttgcgaatctatccatatgatgtatatttgacttaatatttctatttctatagctacactgcccccggcgatcaactcccattttacccaacagaagctagagcccttctgcaaaggaaaaactctgattgtcatgagttgttggtgcacttcgaccacctgagagagatggacaaaatactcgccttccacatgtgcaacaaccagaacaggtaaatacatttatatctactatgcactgtgatagtgtggcctcttgagtttgccttgctgaatcgatttgtggatcacgcttaccttgttctattggaggtagcaagtcatcaaggccgaatcgtttaggtttttgttctttttttaaaaaaaaacatttgtatttgatgcttttggtgctctcatgattgggattaatttgggttgcgcgggatttatttatatggcttgtgcatgtcagatttaacagatgatttagctatagttgatgtgtatactggtctgatatggatggtttagagttagctttggtgtgctgataatgtacatttagcgtagcttcttcatatttagctctgattttatttggatctgatattagtatgagggctgccattaatattatgtgtagagtagcatgggtgattttgttttagtggtgctggagtagatttttatgaggccatgacgtgtggttagaagtttttggacactttttcttgtgacccatgatggctgaaggggtgaatgggttcatggaatttgtatgtgtgttatttgttcatggtattaaagagtcattatgtatttttttattttataactgtaaataggcatctaagcatgactctggtatctgaatatactagtgcaggtgttatctaatcatacactggtatctcaacagtgttctctaatcataaagtgctgtcatctaagatctgaattgtgttatttaaataggttagttatatcatgaaatagtgctattgaaatgtgacctgatattgccttgttggctgttgcttgttctactttcttcaaattctatcagtatgttttgcttttcatttcctgcattttcagggatgccttatattctgatagaacattaaagaatgagtaaattatttttactctaaaattagaaaaattaacaagattttgagctctgttatacttgcagaggtacatgctgagtagcattttgtgctaaacaaattggaatgaattgtatgcacaagattcaattccagatgcaatggagctgcaatttttcattttcttaaatcttttatttgacttgagtgtatgattctgtccggggactgtgttgttgtttctctccctttcttcgatgtgtctgttgtgaattttacttctctctgattgtttactgcttcttaggatattctgcacttatgagattatgtatcagtcacagattaaagttagtaggaaaaaaattagagcttggattattgtatgggaagtgtctgaactagtcagtgcaactatagtctttatattgtgagctaaatttctctaggttatgtagattttgggaaacataggcatataagatttcaagaggtatctatatcaacattgagcatataatatccgaacataactgcataagcatcatatattgatatttatgctttaaatttgttcttgtgagaagatttctggttgagttcacgtgatgtagtcttgatcacgggattgttttgcttttctgagaagctttcttgtctctctctgatgttgggcttttatttgcagtctattaggctcagcggtctgaaaagtgtttgggcttgtcaacatggttgagatgttttttgggctctgtatggacttcttttgggttttggttgtttgttgggcttgtttttaactagtctttcatgattgattgtctatatttgtgggctgtttaatgtgctgcagtacaattatatttgggcctgagattatatttgggtttttcaactagtcttttcttattgctcacatgatctctctctttcaggctagctcccatactatcgtgtgttgcatcacagttccttctgaacatctcccttcaagatgacgtctcagaagaaactcgcgaggagaaagtgataaagcacaagccaacgattgaatctaaagtgatactcagatttatcggcatgccaaattacaggtactccctccgtcgcaaaatataacaacttctagcactcagaatttgtcctaaaatataacaacttctccactaacattctcttcccaaccaatcacaactctccaccaatccattcacttttcccacctacctccatttctcgaccaatcacaacatcttcccatttaattctacctactttcttaataattgtgtccaaccctaaaacttcttatattttgggatagaggtagtaactgattaatatcatttagtgtccattaaaaggaatatatatttttcaaataaatgtatttatattgaattcacttgcaggattaccactctgaaagaattcctggtgaaaaatcaggatgcacttgttgaaaaagtgaggctcttttcaaaggataatgtgctggtaccagcaaaacttggaagctcattattccaatgttgcatcttgcacctcattgcaaaccataagatgggagttagctggaacggagaatttgagctaactgattgggaaatatctgatgatatggtatctctaaaaaaggttcaccatgggcctttacctgatgactcaaaagttgcagatcttgagaagctggtggatttattggctccgttctttttgaagaagggctctcccttattcttcaaacaattgaaggacgatgtgacccttacatctagaacattggtcagtgctagtgattgggaatggttctgggattatcttggctcacatgtgttctatatgcctccagtcgctcgactgcatcttatcaaagacctctttgtggctatcaaaacattcaaattgacttgggtgaaacctttctccactgtacttctagattttactgaatttggtgatt

SEQ ID NO: 80668 - DNA, 6926 bp, Oryza sativa
ttggaatgaactttgtattaccataggatgttgctgtgaagatacttatggagcaggattttcatccagatcgcttcagggagtttatgagagaggtttgtttaactttttctttgatgcggtaaaggcctttgagcttgctatttccagtattatgtttcttcattcctgaaaaatagtattatgcttcttgaatgaatggctactagccacaatgtgttgtgccctggccgtgtttatgcatttatagagcatccccatccttagtactcaccttatgagtttcttctcattgttataggttgcaataatgaaaagcctgagacatccaaatattgttcttttcatgggtgctgttactgagcctcccaacctatcaatagttacagaatacttgtcaaggtatggttgtgatgtgccttcaagctattccgttaattatctcaatcatttgatagcaagtttaatgtgtccagcaagtgatgccatttttcattgcagaggtagtttgtacaaattattgcacaggagtggtgcgaaggaagttcttgatgaaagacgtcgcttgaacatggcatttgatgtggtattgtattatctcatattctcttttttgtgactttgtctacctgctttcacatgaacttttaactcccaaaacaagaattcatactatttaagtaatctctggttgcttgacaggcaaagggaatgaactatctacataaacgtagccctcctattgttcatcgtgatttgaagtctccaaatcttctagttgacaagaagtataccgtgaaagtatgtttcataacttatacacctgattgcagctagacagggtatgatagtatgttttatgagtgcatgagtagatgattataaatcacgttgatcttgctgaaattgtggtgtcagtttttgtgatggatatttgtgtgaacttttgggtttttgctgtactactgtactgtacacaatttttaatgcgttttaaatcttgtctttttattattattattatgttttccttgttaccttctgagcagaaggattgagttcttctagtgagtatttgataggcagctaactgataacggacagcacttctattattgaggtggggggtatttggagcttgtagtcatttaatgcaggatgcttctgcaaactcaataatatggataaatatatatttataggtcatgattttctgtaaacatatttaaggaagtacttacaaggactgctaagtgtgctaaaaaatgctaacatagccgttgacttgacatagtatgtgatgttcaggcatgtttcttttttttctcctcctcagaggttgtatctgagatgattgtgttagtgcaactattttgtggatcgctaaggtgatcgttttaaagattattaatcattatatggatttgtttgtagcagatctaatccccatttcttattcttatccacactacatgttattgaataaatcccagtatttttcacttacctttcacccttttaacttttgtaggtatgtgactttggcctttcacgactaaaagccaacacctttttgtcctccaagtctttggcaggaactgtaagtaccatttccattcttcagaagttcacccttcaatccctttttcattgaaaatattattcatctttggcttatcttgttctttttccatttaaatattagcccgaatggatggcacctgaagtgctccgagatgaaccatccaatgagaaatctgatgtctacagttttggtgtaatcctatgggaacttatgacaatgcaacaaccatggtgtaatctgaatcctgcccaggtaattattcccttctatctaattttttgtgtccatgctgatgaagtgatgcaattagtccttggtatcattcaatgcatgcataacatatttttcttatctagaagcaagtatactcctgaagttatgcagatcattttttttaaaaaaaaacttttaccattttacatgatgctatgtttttctgcaggtagtcgctgctgtaggctttaaaggcaggagacttgatatcccaaaagatttaaatcctcaagtggctgcattaattgagtcgtgctgggcaaagtatgcattgacccatctatttttgtatatgaatcaattcgcaatgacatgcgagactaacggcaattttgtctgttacagtgagccatggcggagaccttcatttgctaatattatggatagtttgagatctttaattaaggttccactgccgcagttgattcgttcagactcatagccatttgtatattgaagagtcatatcatgatttgccttgataagatcaacatggagaagtttttcaatatctgacttgcttatacttggataattctgaccacattatttggtgctaagaaaatggagtcttgatttacatttttcaagcaaaacaaaacgtacctggcaactcctgtccatggtttcaaggtatgttgctacttgcagagtttaccttcaatgtaaatatataaccaagaccttggattggtaccacatcagcgaattgagcttaaataaggttttggtttcaattgaatgcagacttgctgattagtgataaattgtatcgttcgcaaccattgaactggacagtctttgttatctcgtcatatccttcagtctcaattttatcgtattccccaatctgtatagacacattgaaaacaaacggatgagttaatatgtatcaaacggtgtctgctgtctaattagctgatccatccaatattccaattataatgtgttctaactcttcagtgcacatataaaatttgttttgtccaagctgagtgctgttgctgttaatatatctgagtgagactacagtaccgttgactttgggtgtcattatttgaatttacacggcgttgctgttttctgattctaaactgatagcattagttatgttaagcatggcagttactagcttgttatggtctggagccggggacaggttacggggtagtaactggccagaatgatatggatttaaataaaaaatatattaatttttacatatgtaaatttagaattattctgtccggttaccggttgctggccaaactaagttctgttcagaatggcttgtttgtggtgactgtcagctcataatagaacataaggatttctatgtatagttcaatggagtgtgtgcttgcctactgggtcacctttatttaagagttcgtaattttgaccttgttgctaattgcagatctgttgatattccttgtatgaacatctggttggccaagttatccatgagatgcagcacttcacttgtctgcatcctttactgatagagatctccgactggctgcaacctttgataagaacgtcatccttccctgtgttggtagctgaatcacatattggaaatgcatgctgggaggttcatcaaacttgaggatcctgactgtaaattctagtctctcctagatgtctatgtataatgttgactgcagttagctatgatgaaagtaaagaggtttttttttggcttatgtacatgtaagtctgttacactatcctagagcaggtagtactgtacatatgctgtactagtgctcctacatgtgtattgcttgttgtaatgcactgtgttgtttcatttttactaacatgtttagtttaatgctccgtttgtactacctgtggctgtgaggcggtgcaatatttggcggataatcacaggcggaacttgtgggttcgtcggaggccaaatatttggactgtctcgttgggcggataattgtgttccttgtcggccgccactgtccctcctcaatccggcgactccgctttccaaatcccccgcctctccaaatccgatcccgaatgattccccaaggtgaaggtgagtgctactcctagataataaccccggagtcgtcggcgattgatctaataacaattactactaagattgattgatcatgggaggagatgagagtgagagcgaggagtgggaggcgttggagctcttgggtcctcctcgactacgtcgccttcatctccaactccaaccaccacggcaacgccaccaccgccaggtccaagactaggaccggccagcccatcgaggtatccttctggacggcgcctccgccgcgcgtctcctacatgtgcgtccactgtcctagattggatccctacaagttcgccacagagcccaccatcatggccacggaggccgacctcgtcctcatccgcgtcaccattggccctcgcggcaactgctttaataccaaatgcagcgacttgttcatgtactaggccaccacccacacctcgtcgttgcgcttgatcccgcaccctgctgctgtctgcagcttcttcgaccgcgaggttggcctcctccgctgtggctcggtcaggcgtcgccatgatcccacaagattgggcctgcacgcccataccggccctgacgacggtacctacatcgtcgccgtgctctgtaacacctttcaatcagggaacctggagtatgccctctacctttaccgcgccggcgcagatgcttggacctgccatccactctcccttcatggtttggtcgatccaacatcatttatccatgtcaataccaacaccatcacggttggaggggaagctggcaccatggcctgggtcgacctcaaccgtggtattctcttctgcgaccttcttccctgcccatacacccctctgctcctccgctacttcccgctaccgccaccactcagactcagtgcacacaccaagctgacaggatgtccaaggtttagccacgacattgctcttgtccaaggtcgattcaacttcacccagatgcgaattcatgtcaagccaggctccatcaccaacggcacatacatctctcagggttggactcttgccacttggagtgcaccagccaccaatccttggaagcaagggtggcgccaggattgcaacctctctgcttccgatctctctgttgatgccaacaccatgaattttcagttactgcctaagctctcggatcaccaacagggcacacctcagcaaaccttggagagacttcacgtgggccatccaacgctcagcttgcaatccaatgacattgtttgcctcatggccaaggtcgaccaatgggacgaccatgcttgggtgcttgctgtcgacatgaagaacaggaggctaaaagatgtggctcagtttggcgctgaaagaactcttggcattagcttggtctacatcagcagtatgatatcagaatatcttcgtacggctccaggtaattgtttttcgtttttgttctacttgttccttcctatttccgtggtccgtccactgctaaccatcataatcttgcctgttttcacaaatagcaaacctgcaataagttataattgacaataataccaaacctattaaattgatgcacatgcatatatatatgtgggttaatcaattggaaacatctgtttttgtctttgctcacaagaacaagggacattgctgtagggcatgatgcccctgtttctatggcattgggtgtacatgatactccagttcaggatgctaatatttctctggtgttaacaatttacttgacacacctgacttgggaacaccttttctcagctgataaaacatattacatacatacaacctgagatacatgcaaataaatcattgaagggaatgggatttatgagcaatgcccagtaaaatggcagtacatatacgactgtaaaatggatgccttcttcaataatcacaaaatgttacatgacaaatagatggtggaaacggaaactgcatcatgaccatgtgctttcacagaaagggcatgtcacctaggttgattgttttgctttggaattttagagggaaagggtagatatgagagctactatttagttgtaattgagccggttttcactaaatattttgctggctgcaggtataaagggtaacctaaaacgacaaggggttgtgttcaccgtaccctctcacaagaagcagacccgtatggttcatctgtctactccctcttggaaaggtggagatcaacagaattctggaacaagtatggatgatggagaggataacatggacttggacttggacatgttttttggatgaggggcatggttaagttaagtgtggtgcatcttcagttaacttatgactagattatctactgttttatcaggtctatttatgaggggtactgctggtattttgtagagcagatgaatagtcttgtttatgcccctgttcgtttcttatcaatgtagcgaggttgtaaaccgtatagtccttggtggtgtcaaattgctcacaatttatgcatgtgtgccccctagtagcgttgggcgtcttaagtccgattatttttctgctgcaatttggttttctgtcaatgtgaaatgaagaatctaaaatcggcagactgcaatcatcatttgttatgtgttgggcaatcaatgattctgtttagattcatagaactccctccgtttctaaatatttgacaccgttgactttttagcacatgtttgaccgttcgtcttatttaattttttttgtgaaatatgtaaaactacatgtatacgtataagtatatttaacaataaatcaaatgataggaaaagaattactccctccgtattttaatgtatgacgccgttgactttttgaccaacgtttgactattcgttttattcaaaatttttgtgcaaatatgaaaatatttatgtcatgcttaaagaacatttgatgacgaatcaactcataataaaataaataataattacataaattttttttaataagacgaatggtcaaacgttagacaaaaagtcaacggcgtcatacattaaaatatggaggg

SEQ ID NO: 80669 - DNA, 18390 bp, Oryza sativa
ggcgtagaagacgctctggccgttgagcgccgggaactcgcccttggtggctttggtcaccgtgaagttggcgttgggcatcggcatgctcatgttcatgctcagcgggttgcggaagccggtgaacgtaaaaaagtcgccggtgatgttctcggcgttgctgccggccgggatgacgtagtccgtcagaatgtttgggtcgccggccatgaccagcgccactggagctgacactactgcaagcaccaccaggagcaagatggaggatgccattattgtatcaggtcagatggcctgaatcttgattaagctttggaggctaaatgatcttgctaataagcagcttgggttgtgcacttgtgcttgtgccatggagatgatgagcaacccaatttataagaagcttttctcttggccaggaggaattggaggaaccaatgctgccgtctgtcttttgtgcgatcgaaatggcaacactcaaggcttttgacagcttgctccttggatgcatctagcatcaaaattgcatatcctgcattcaattattttcagaatggagctggcataatacaatctgacttggaagttaaggatcatgcatgtgccaggcatcgcaaagccttcacttgagtaaatactggatgtttaataaaaatatctcacaagtagagtttagcgtcgaactagtctaatctatttgtaccacagtttacaaaatggcaacatcaagtctaaaaatggagacaaagaatgcaatatcgaatcgacttcacatctaccttgtcagcccccttgaaaccaggttcctgatgctttgcaagacgattttcgtgtgcaacatctcgcgataaacagcacacaacaagctaaaagctattaatagcttcatcgccaaacaaatggcttctaaactgataacagtactagcgaaaactagtaatacgctatcatgctccaccaaatcaagacgtaaaatgacatgtttactagcttctgatgatccagggcaggcacaactcagctgactttggaagaggcttaacacggccgagcccactgagatcacaatgcgtctgagttgacgcagaaataattcttggcataatggaaccgaaaacaccagacaaactgacacagcagtagcaccgtataaggtgcaatttaattgggcaataatcaagatagataccgagataacatcaccttaacaatgtgccaaaaatctcaaaacattcaacattactggggcaaatgaacacccacatatgtatcactgaataaacttaacagaacggcaacatcaggtctataagactagaaaatggataagacaacatcatgtgttcgttgccctggtgtaaatctgttggctgcaatgaaccgacaccatcctgataagccccctatccatcagatccttcatagccctcctagccagggacccattaatctgcaggtaaatatataaaatcttgttacccatactgagcaagatgattaaaattacctagctgtacaacatctaggtataaattacacagaaggctaaaacaacaatgatgacgttaagagttacattgccaaaagagaatatgctatatgttgcacatgcaaggggaaaagagcaagatcaaacttgccatactaataacagtagtttcaggtactaataaaaattcacaaatcaactatatagtttggcgcatggaaaccaaacaaacatgcacagaggcctaacaaatcattactcctttgctcattggcatcactcaaccacacaaaaatgccaaccatgacaccgaataccccaaacagtggtgattctgcatttaactcatggatggaatatcaatatcataacccacaaatttagcacaggagcctaaaattaaccacaaggtccttatcttcctgaattctatcaagtgggctaggctacatgactgtgaaaatatagtgaaaatctgaattggcgcgcataaacaaagaagaaattgagaatgtgagctaggcaaccagcatggcacagtattgttggtggtaatctaaatttatcaatgaattaccctgaggcgctcggagaggacggagggggtgatctgcttgtacttgggcacctcggagagcagcttgtcgtaggtggcctggtcgaacagcaccgagttgttcaccttctccttttgctttcccttgctccacttctgcaaaccaaacggaggcaaatccatgaccatgagaaaaccgaacaagccagatccgaataaaaccgaacaggaggaggaatggagatgaccttcttcttctgcttgccaccgccggacttggcgggcttggacgacggcggcggggccttgtccttcttcggggcctgagacagcaagcaagcgagagggtcagcacgcagccggcgatcgagcaaaaatggtgggagagacaaacgaggcgtaccatttcgacgacgcgatgcggcggcggaagaaggcgcaggcgaaggcaaggatggcggcgacgaggaggagcaggctgaggctgcaggtatatgacttgggaggtggggaggctagggtttcagcgctccgatgcgtttctggccgtcggatttgatctgatccggagtattattcatccaagtcccacacaaacctctaatactcgttaaccatccctgaggggaggactacgtagaatgttttcaaataagcatatttgaaagggccaaattacaaagtagcacagggagtcatagcagcggtggaatagaatcgagtcatcatcatcatcagtgggggagttgggagagagagacagtttcacggagccaacgaagcgaagatcctctcgtctcgtgttctagggtttctcgcggcgatggaggcggcggctagggctccatccagggcggcggcgaggttcgtgcagcgcaggctcttttcctccggcggcaaggtgctcggcgaggaggagaaggccgccgagaacgtctacatcaaggtatcttccttccatctctctccctctcgggtgcgggcgcgcgattcctgtctgagatgcgtatgcgctgtgatctgtgggctcgggttgagcggtgtgtggatttcacctagttccgcaaatctgggacttgagagagagagagtcgcgacgcggtctctctttctttcctgtacgagtccccctgcccgcaccgcactcagctctgggatccccaaatattttcggcctgcattgttgcagtgcacgcctaggaatatattatacgtctgcctgtttactgatctggaatacagttgagttggctgtcgtcctgcctgcgtccctcatccattagcacagcaatttatgactgatatatgttcaccctgtgccttgcttcacatatgctattgcggttgcaatgttgcatcaaaattctttcctgttagattattcttgcattttttttggcctaattgagacagattcttgcttgctacttgaacataccctgtttgatttacattattgagtagattgttgccaccgattatctacttgattatagggacaaattaaatattttgagaaatgaacttaacaaatagcttaaaacaattggtttaaggtcagttttatgtgggttttttttttcttcatgagaagcagagcagggttgttctcctggttttataaaaaagatcgttcaaatattactcattcaacattttgtacaatagtcaagctgttcttgttttaattatctatatctgtgatcttctatgccggttgctcaattatactcttttgaagcactgcagtagctggcctgatgttattctagtgatcctcacaaacgtactgctggcactgatttgttttctccattatgtatttgtactactgctgtttcaattggatcgttgctggcatcccatattttgcttggctttctgtggaagtgtgaatacagtcttatctcaggactgactgttgatgcttatgctttgtgatattagtttcttctttttaaggcatggcctttttttagttccttttgttctttgattgcctttaaggaccgcaaatgtatatctaaaagtacatttgatgctcggaattttgtaactctgcagacagatgtagatgttcttttagaatcaatcattgtttctttcaaatagaaaccttttccgaaattacccgctttcttaatcgttgcgaacttctgttttagaatgtatcttgacgctatgctaacaacatgcatggtgacttactgcagaaaatggaacacgagaagctggagaagttggcccacaaggtatgcaaacatattgcctctcttaaaacttgattgggcagtgcctttaatggctcactctcataagtcctctcagctttttttttttgtcatgcacaagagattatgcattcttttatatgttgtcatacatttataaaatttgttttcgttggatattcatgttttgaacttaatacaagctagtatctgctttgagtgggcgagggaaatgaaactgttctagttcttgcgcttacaatagatgtgagctactttcagggccccaacccaggagagcaagcttcaaccgcaggtgctgcggctaacgctgtgaagactggaagcggctcaacggagtcaagatctgctggtgtgtcaactgacaaaaacaggaactatgctgtcctggcaggcactgttgctgctttgagtggcctggggtggtatctcttgtcaaagcctaagaagtctgaagatatagtggactgaaggtggttaatgagatcctagacggtctgtcattgagtttcaccctgttttacttgtttagaaataaatgctgaacacactgcactgagtttcctatagcatcactaaaactttcaagtatgcacccgagatatgttctcagttcttcatgccctgttttgactgttggcactgttctctgatgctgcatccttttgattgaagaggaattcggatacaagatagtacatgaaatcccgttgtttctagtccttgtttgaaccaagtgttgttttaaatttcagcaagtgatggttttatttctttttcttgttttactgaatgatcattgagtcgtttgcgcctcaaaattactcgtgtttatcggattgacagtgatatggtgcgtggaccaggtttttgtaccaaattagatggctgtgactactcgtgcagacagcgactcggtagtcgtttcagatatgctgcctagtaggactttacaaagctatggttcgtgttactagtaaatggaaggcatgaagagcatgtttatggccatcatcaggcgttgaaggagctagtattgtgtcaaacaaatcatcgtttagatcatctacgagcggtggatgcaatatgcaagtatattttggccacgcatctctatattgcacaaatcccacagcagcagaagtagctctgtggtattgtttcataagggccacaattaaaaccgctaccatatgaaaattatcaaaccgctatcgatgagataataataaccgcaaatagtgagcttaactgcagttcaaactaattactccatctagataagctaggatcgatggccgcatgagcgccgtggagccggtgctccaggcagggaaaagacttgagttttagcgggcggttgaggtgatcgatcacgaggagtcaaggccagcgatcgatcccgatcacctccggctggtgacattgcctgcctgcctcgtgggctcgtgggcgcatggccccggcccaaacgaaacaaattaaagcggcccagcccttttttacagcaggtacaatagcagattataagccagctgcaaatatattttaacgagataaataaggaaagagaacagtagcgggctacagatttataggcagctatagcacgaactccaagacacagtgtgtgtatgataggtgggaccatgtattaatagtgtagtatgaaacttctgtatgaatgagctattagattggctaaaaatgaattggagctagtagttggctatactattaaacttgctcttactaatactaattattttattatttgatcgatcgagtacgcttttaaaaaacaaaacttactccaatctagtcattgctaggacgtgattcctgcatatgctgccttcatcccacacagttgaattctttagaggtgaccggcaaccatgtactatacccctataggtagataatcaaattattagtaaatatagttcgtccttaattacatgcatgtggtcgtctgaatctgccagtaccgacgaatcgacgacactgacggcctttcctgcctttgtttctgcagtttccactctctgactttaatatttaccacacgtttgcaactagtagcaacgcgaggcggcttccttaattttcatttctttttcttaaccacttaattactgatttctctctctctcttcttttgcagggaacttaattactgacttcatgcatatgctctcgaactaacagggaaaaaaaagcaataagtgttgctcaacacaaaacatataaactaccaaaatatgctcaatgttagatgtaattaaactaaataagtgctataagtgttgctatattattctataaaattggtcaaactttaatacgaaacggatggaacaatgctctttttaaacggaggggtagaagttaaataacaattaatattattatttttatgtaatatcaatggactaagtaataagtgtagtgtatgtgtagcagataaacaatgaaggaacacacagaagaaaaggaaaaaagaaaagcacaggcagataagatggaggaggcgaggagagttgcgtaggatggagtgattccaatgcaacctccgcctcacgttccgcggaatccccatcggacgcctcaggttgcgccacgcgtcacgcagcggggccagattcgtttcgccttccacgacggctcgtctccaacgatcgagcgagcggtcgctgataaaaataatagcacaaaatttttatttcatttatttatttctacaaaaacaaaggaaagaaattaggaagggcggagcgagaagaagctagacacgagaggcggggcacggtaggcggcttcccgaagaaatctcctcctcctcctccggtcgccgttcgactccgatcccgaccagtcgccgccgcctccctcctcaggtaccttatcctctccttctctccccctccaatcggacctctactgttccagacgcccgtcgaatcaaattcgattcaacctttccgatttctttccgtgattaggacgatccctagggccttttgattctttgcgttatcgtgcaatcttctcaacgtgcgatttaatttcttgcagcttggatcaaggaaaccaccccttcgattcattgattgatcgattgattgattggctaggcctctccaacaattttggttcccggaccgagtttaattcttgagcgctaggtggggcgaaggcgtcggatccacccatgatggtggttgatacggtcagcgccagcacttccctcgttgcccaccacctgttcgaccaaaggtccaaggcaaaccaccacctccgcgggactctccatgtggtctcctcccgccccctgcccactcatttcgccgttcgccgccttgtggcaggggcgcacaggcagcatcaacctcgcctccgggagtggcccgtcaaggcgctcgccatgggggtcaccaagaaggccagccctcacagggagtccggggggtccccgggggaaggcgtttccatggccaatattgggatcaccaatcccaaaacaacgtggccctccccggaccaggccgattgatcccaagctgcacaacccgctgctccggcttaagcgcatgggctgtggttggctcgaagtgatctttgagtggcaaggcgtgattgttgaggatgacgctgaattggaaaggcaggcatggtttaccctcgcgcaagaagagggcaagtctccacccctggcgtttgtattgaagaggattgaaggaatgaaaagcgagcaagcgatatctgagggtctctgctggtctcgggacccatctgagttaaggagattgtcctcacggaaagaggagatacgctgcaccctacgtggaactgccttttatcaaatgaggaatggttcgagggagtttatgagcacgcttgccaactataagatccctcttgccgtggccaccacgcggccaaggaaggttatcgaagaagcaattgacgctgttggcgtgcgaagcttctttgatgcagttgtggcagcagaggatgtgtaccgggggaagcctgaccctgaaatgtttctctatgcagcgcagctcctgagtttcatccctgagaggtgcatcgtttttggtaactccaattcagcagtggaggctgcacatgatgccagaatgaagtgtgtggctgttgcaagcaagcacccgatctacgagcttaatgccgcggaccttgtggtgaagcagcttgatgagctctctgtggttgacctgaagaaccttgctgacattgagtctccagagtttggcatggagcctgagccagagatggaggaggaggaggacgaagattcgtccccgtcaacttcagttggtgtagatgatttgttctggtaaggaagccagattgtaaatttgattgattccgctcctgcacatgtgtacgattgtcagtcaatagcaatgatcaggaagggccatatattccttctaatcaatccgtccgtagactgtgatatgtaaatgtttctttagaacttacactgtatatacactgtacctcacagataagggggaactgtctgaatacttgatggaatataaaccaaactgcagttcctaacaaatgtataactgggatgttagtcagttgcaaacttagaggattccatataatatactatgctactaccatgctcttttcttgaggcagtattgttttaccttttgatgaaagggaagttttttgtttggattttgggcaccaattcgattgcaaaattcgaggattccataataacatactatgctacttacatgctcttttcctgaagcagtcttgttttacacttgatgaaagggaaattttttgtttggattttgggcaacaatttggttgcaaaattagaggattccataataatatactatgctacatacatgctcttttcctgaagcagtcttgttttacacttgatggaaaggaaagttttttgtttgattttgggcaacaattagtttatcgtcaagaattatcactccttaacacgagcccaaagcgaagaattattacatgtgttttgactgaatgattaaaatccatgtattagaaggctaatatctttgtgttttggcgcccaaagttaatacccatgaaacttttgaccatatgcgaatattcaagcatttttaacccaaggttaatcacgtaattgggttcaatgttgtactaatgaaagtttgacttttgagacaggttaatatttaggaatattgttctgaacaggttcaaagctaattacagtcataaagttttgggctggacataaacattcatgcattcttttccaaaatgtcaggcccaaggctaaaaatcacaaaagttttcgtcctatgattactatttaataattttcttccgaacggacccaaggctaatagttatgaaattttgggggaaaaatcatgagtttcttgtcctatggttaatattcacgacttttctgcctaataatcccaaggctaatacccatgaaaatttggaccacaaaaaatattcatgcttttttttcaagaggttaatattcatgaatttcggcacaagggtataacacataattataggccaaaggctaaaacacaacaaaaaaatgtttccaaggttaatattcacgaattttgtgcacaacaatcccaatacaaaatactaatgaaattttaggccatagaaaatattcatgtattttattccaaagttcatactaatgaattttggctagaggctataactcaagaaattatcggtcgaagccaaaaatcacaaaaaaaggtactacagataatattcatgaattttcttgaaacaaacccaatgcgattagtcacaaaattttgggtcgaagaaaaataatcatgtgtttccaaaggtaattttggacgaaagctataacttatgtaagtataggcgaaggtaaaaaaaaaacctaaggttaatatccatgaatttgttccaaatgatccccgggcaaatacttgtgaaattttggactgaaaaatattcatactttttttttcaaaggctagtactcatgaatttcgaccaaaaggctacaaatgagaaaattataggccgaaggcaaaaaatcatttctttcccaaaacttactattcacgaattttagaatggcccaaggctaataattgtgaagtatagggtaaagctaaatatccaaaatgttaatactcattcattttcaccgaaaactataactcacgtaatccgaaggctaaaagtcatgatttttttttgtccttcgagtataatacttttattaaaaaaggctttgactaaaaattttaaacagaggactaatagtcaaattagtcaatttgttaggcttgagtttcctactcgtgaaatttggtgttgtgtgtgttcttttctcgaagggcaatttaagcatttttgtgttattttatacttataaggttaatataaggcttacaattgtgccattttttgcctaataagattataatatggtagtaggaaatttcgtgcacaaggcaataatgatgcatttttaggcatgtttgtcgagaaatttgccatcgaactgtgtttagtttctgaaattgaggagaagtttagggaaagtttgtagtttaaaaaaaaagttgggagtttatatgagtaggaaagttttaaatgttatggaaagttgggagtttgggggaagtttggtataaactaaacagggcttagagctatatacgtaatgagtcagtttgggatggcatgtacctattggatcgtgttgtatttacggccagcttgatgtgcctactctttgattgagcaaaacaatactgaattctccgtatacgattaggaattacaacatgtacaatgattattattgagtaatgaagcggtttgtgtattggttagtctggccgcccgtgtgcgtgcgtgcgaataatgaaggaatggtggtgtgaggatggatgcaggaggaaaaggctcctcctcatcgtatcctggccgtctatccatttcggcatttcctcccacggggaggggaggggaggcacgtgtggctcccacgcgcgagcgtgccagccatatgacggtcgcacgcgcgagtcgacccctagctagctaggcatttggatccacacacacacccacacgcgcgagcgagatcccgatgcagcagcagcagcaggcgatggaggaggatggggtgaaggaggaagaagaggagtactacttggaggaggaggacgagggggaggaggagactcggcccccgcttaatcatcagcaccaggtggggttggggctgcgggggctggcacaggaggagaacgagcggactaagctgcgggagcggcaacggcgggcgatcactgagcggatcctggcggagctccggcggtacagcaactacaacctgcttgtgttcggatgccttaaaccagataagctagtccttaaacctcaggtcaagtgtggcaagataaaacacaggaccaaaatgagctcatattgcttatacggtttccaacagggaaaacatcctctgcactttatggatgaacccaacaaatcatcatcaaatgggtactgtctggtaccctaccttccacttttaatttatcttaggcggtctgctctgctatgtttaaagctggctggcaggcagctgagcctgagctcagtgagctggaagccaagtaccggagagttatttaccctgttcctttcattattttatttatttttgacgtcataaataggtcgcatccggtactgtaggagatatgttttcaagtgatgatgacaaaagcacccctcataactcatttatgagcccttttcgcctcacggagagtagatatatattcattattattttaaatcaggcttccgtatccaacttacggagaagcatatgtttgtctggaaggacatataacgctgaaattatagagacggggtatttcatattatggtaattttgaattaaataggtacataaaaaaagacggagcattacagcttgcaagtaaaaagacaggccgaaattaaagggctaccaccgtccaaattaagcacacaatatataaagatcgtttattagaaatgatttatttagaaattaaaattgaaagtttggtgaccgtcggtttgcacatgagaccgaaaagagaaaagtggcaaattcattgacgcacggccaagggcaagggcgcgaggcaaaggggaaaggtggttgggaaacgtccagtccttctctcgtggcctccgtaggcttcccttccctggaaacgcgcgcgcacactcccaactctctctctctctgtctaatcgttatatttacgagttccaacgatcgagcgcctcccctcgcttgggctaatcataataatcatgatttcttctcctgcgctcttcttcctcctccagccaggccgcccctccatcgccgcgccgccgctcccctcctcgccggcgcctcccctccgcggcatctccatctcccccgtcgccgcccgccccatctcctccctccgctcctcctcctccatcaggatcatcttgccgccgcacgccctccccgacccgctcctctccctcccgtccatggacccccaagaggtacctcttcttcttcttcttcttcttctatcagctactactagtacgttacgtacgggcattcaacctagctggcttcactgcaggtgcccgatctgctgcccccgcgcccaccggagcgcgacttcgccggaacgccatacgtccccgtctatgtcatgctcccggtaggtacatctctccttccattcttttcctcgcaccacgccgctcgctcttatgtatgtatgttgctgtctgtagcttggagtggtcaatggtaatggcgaggtggtcgacgccgacgtcttggtgggccagcttcgggtactcaaggctgccggcgtcgatggggtcatggtcgattgctggtgggggaatgtcgaggcccacaggccgcaggagtacaattggaccggttacaagcgactcttccatatgatcagggagctcaagctcaagctgcaggttattcctccactccacattatattgtcatgcatgtcaccctttgttgttaatcatgttttggtgtttatgcgcatttcagatttcagtaccgtgctaatacaggatctattcatttatcctctccaattttaccctttctttcatggtgtttcttttaatttcttgtcaaaatacttacttaggtggtcatgtcattccatgagtgtggaggcaatgttggagatgatgtgtctattcctctcccacattgggtaacagagatcggaagaagcaatccagatatctacttcaccgacagggctggcaggcgtaacacggagtgcctttcatggggcattgataaagaaagggttcttcaaggacggacaggggtcgaggtattctacccacttctctaattacgcaatccactaattcttaatgggaagatcacaatccgttgtgtttatgtgtttatctgtttcatcccttattgatttaggtatactttgactacatgagaagcttccgagtagaatttgatgaatattttgaggatggtatcatttcagaaattgagattgggctaggggcttgtggagagttgaggtatccatcttatccagcaaaacatgggtggaaataccctggcattggagaatttcaggtaaaacttcacccttcacactctgttcttctcctgcgttcttttttgggttcaatatcctatcttaatgaaatttggtcggcctaatccttccgtcgacccagcaatttttgggttcaatatctactcattgatgaattgacaaccgtcacttaatgatctgggcaagagcaccagattcaggctatttacccttgtaaagttttctatttacccttgtaaagttttcttatacaacaagagggttcacttgagaatgtattttgctgcagtgctacgacagatacttacagaaaagtttaagaagagctgcagaagcacgaggacataccatatgggcaagagcgccagacagtgcaggccattataattctgagccaaatctgactggatttttctctgacggaggagattatgatagctactatggtcgttttttcctcaattggtattcccaggtgttggtggatcatgctgaccgtgtattgatgttagccaggttggcttttgaaggttcagatattgctgttaaggtcagttaacttcttgttgttaatgaatgaagtgcacaactgttttcagtatttgaccattcttctgggggcacgtatccctgtttccagcatcctaatcctataggtttgacatcaagcttggtttacactttgtggtatgacaggtttcaggtgtacactggtggtacaaaactgccagtcatgctgctgaattgactgctgggttttataacccatgcaaccgtgatggttatgcctcaattgctgctgtcctgaaaaaacatggtgcagctttgaactttacatgtgttgaactgcgcactatggatcagcatgaggtatttcctgaggcctttgcagatccagagggccttgtatggcaggtagggaactttccatcatcctagccatggttgctgttttgctttctcatctacctggtagcagcttagtaggctaatgtattttttttctgtttagctgagaccagctatcttgttgttatgtcaatgccttatcaattggacgtatcgattttcaggtgctaaatgctgcatgggatgctggcataccagtagctagtgagaatgctctgccttgctacgatagagatggctttaacaaaattttggagaatgcaaagccactgaatgatccagatgggaggcatttactaggattcacgtacctgaggctcaccaaagtcctcttcgagagagctaattttttggaatttgagcgtttcgttaagagaatgcatggtaaggcttagcagaccatgtttactgacagtggttccacctgacgtaaacctcagacttatgaatcttgtcatgtttgtttgcaggtgaagcagttctcgatctacaggtataagttgtgttcagggttcttacatacatacatatatatacatgccattgtaattggcataggccttatggcttatgatgggggaacagagatgccatttttgtttcgtaggttgttgtagtataccatcagcagatttttgaactatagagggtttggctccatggtgtaaagcatacccttggcaaagagttgtcatgcagaaaattgatggtttcattcggaatgaggttggaagcaggtgtatttctttcgatgcggcagacatatttgatttgtcatgagatgaggattgggtgagcaggtggtatccttctgaaagatttgaggctgtattgaagagaatgtgctgatgcatgtttatcatggagcaagcgacattaatggagttagcaaaggttctcgcggtgtatgtgtttgtatttgttggtggaatgtcactcgaggatcttggctgtatacaatacatacatgtgcttttttttgggtcttttctacagtgtatgagaaatgcatgtttcttactgtcaaaacattgcattgctcatcagtaccgagaatttctctgagttttccccatattttacatgaatattttataacaacggcttacaattcctctagaaaacaatgttttcttctttctagtgtgagcatacaagttgggcacaaaaagatgtaaaacaaaaggaaaagcgtacccaccactaggcagatatacatacaagagaaatatggacagcaaaaaatgcgtcggtagataccatgaatgaataataaggaagaaaaaataacagcagaagttgaagttgcatatacataaaaaaataaaaagagatgatgaaaaggtgcataccagggtaaggaaaggaagaagaaagaggatggaatggaatgtacaggcacagctagggagaaggtgagctgcgcagcacaatgtggcctgactcgtccctgtcgaagacccgctcgatgaggtcgttccagctcatacgctgcctggccatcgctgacaccggcgggaagctctcgcttctctccggctgctcgccgaaggtgccgtaagccgacggcgaccgagcgtccggcaccgagagcgtcacagccctgcgcagagctgccttgtgctcctctacgtgctccctctgcaggctctcgttcctctccatcctctgctccgatggcacctccattgtcttctccttctcaagcatcaactgttcatatgcacagccatggtcaccatcagacatttaacaagcaacttgcaagatgaatctaacgacgccgtctcaaccacaatgggatgtaaaaacgcctgtgctacatgcttgtaagttgtaatccacagaaacaaaggttggcaatatacggtttcttacatccaacgccttttgtgcttccctctcgatccaaataatggcatggtccattgtggcattgcaggaaagaactatatgctcaaatctaccatccacaggcacagctgttttcaccactggggggtatcttccacacctggaattcaggaacaagttcgtttatgatcatgcttggaaatctctattgtaacaaaagagtagtaatctgaacaagacaaaacattaataaattatcaagaaaaaccagatcaaattaattggtatacttgatatcatgggacatcagtgtattctagtattgactgcatggctagcggtgttagtttgaaatagctgaattagtaatttaatacggacagcataaatggaatgatatgttatttgcacgtcctcttggcacaataaagttcaacaatcaaagctactagcatagcatctcttctatgtctaatagacctgactactatcaaaatcctaccaaacaagccattaaccttttaatatcagtacagtcagcaaattatatatttcaagaggggcctcaagatatttttgagttgtaaaacaccaaacaaacaagaaaaaagggagtacctgaacatttttctctctacaatgtgatatatccgacctggtgcataaagcctccttggatcttttaacatagcatcttcaggtatgcaagtgtccctcaaacatctgatacacagcaggcagggcaagctgcccaaaaagaggagatgatccaagtttaaacttgtttgaacccaataagctggaaggagaaatgaagctacatccaacttactgcatagcattgctacaagcagagaaacagaaaaaatcggatcaaccaccccatcccaaactaaatgtcattttctatctccacttttctaactcactggtgcatttgcactgtccatcagatcctctatttccttcctcaagtcatactatacatatcagctattagctgctaattgcttgggtcaagtcagatactagctgtgattactgaagtataaacagagaaactttctataactttgaaaatcacaagtaaacggcatcaacttctttaggtccctacaaagctcttacatagacatccaacaagaaatattgtgcaatcgcataagtttcaggcaattattagccacacaagccagcttaagtaataactacatcagttagcaaatgaaacaatggatgagcacatatgttaccgatctgcctatggaagccatctcgacaattggaattaacaagcagaaaggtagtgatggtatttactgtaaaaggaaaattaaatgtgactggaatcatatatgtgatagtgctgccttgtatgaccagtgtagaattgtgtaacgctacttttgtaaaagattggtgggcatgggcatatatgtaccataggattgacttgaaaatgtcttctaaaggagtggctgtccgaggcaagaaatcatcctgtcaataaggagctataattattttgttgagacagaagatgaagaatgcagatcaagtgtgatgtggtaggaatggtgaggaggaataagcaagtatagcaggaattgaaaaggg

SEQ ID NO: 80670 - DNA, 10795 bp, Oryza sativa
ggggggggggggggtctagctgctagctatccctggcagtgacgctgcagtactgggtgccccggccggagtgatctgtcgtccagtgcaggtacacgacgagttccaactaagacgcaggtggctcgagatgtacacagtaacacactggtacgtcgtaccacctatccatcggtagcgagcacgtctccgcgccgcgcggtgctgcatgcatgtgtctccatctgcagccttgcaggtttttcgttcagatcaatcagggggggctgctctcccgttttccttcagggtgattgatcacactggccgtcgatttccaaaggttttcacaaagcgcgtattactattaccacgtgccgattggatcgagtgaacactagaagtaaaaactgctgtccaagtagggagttaagtaacacatcgcgagatccaatgacccaacaaaaccttgcagaggtttttgcagttgcatgcatgagtggcaattggctcttcggtttggtttgcatttactactatattcgcatcatcaaggattgacttcagactttctgatgagttgcaggtgcgtgcgtgttcatatacgtttattactgtcagttgattttctttgagatgtactggtctggttggttggaggaatatcgagtgcacttgatcgatagataagatagattggaggaatatcaagtgcactagacggatagataagatagattactggttacatcttcacagcttgtgcaagcctctgaacagagaagacgatatatggagttagaattatggaaaccagtcttaccggaaccatatgcgctttatgcagtgcacttaagttttaggatggaaaaatgggggagggaactggccgtagtaatgcatggtccctagttactgacaggatggtcataggatgcatatactactgtaaccgtttggtgcttggattgatccatgatacatcagtgagggcaggtagcagatcgatcagtgcatgccggactgaacaatgactgcaagtctctgcaactagcaagcagtacagtcgtacttcagtttcttttgtaattgaattaaccatcacataatatagcaagccccatttgcaattaaacactgaaatagtaaaacacgtgattttaatagaaatgtatatgcaaaacagaaaattataaaacacaacaagataacataggaataagaaataaccgtttaaatagaatatagaaaaaaaatataggaaccggaagagaataacagactagaatgaaagtttctaataggttgaacctctactgagatatttctgaggaatttcataggatttaggaagcttcaaccctatgtttcaaatgactaggtagaaaatttttctataggattaaaactctacaaagttagtacacattgtttccaaaatagaccgatagtgtattctgtagggtaggatctgattgacagattagataatgcatgcggtacagcacttacattgcaaatttgcaattagggccctatttagattccaatttttttcttcaaacttctaacttttccgtcgcattgaactttcctacacacataaactttcaacttttctattacatcgttccaatttcttcaaacctctaattttggtgtggaactaaacacagcctagctctaactctctgtgcgctcttcttaatcttaattaagtagccatagcagcgtggttgctagaatcgccaacaacatttatagaaaacatagaaacatgaaaaatacggaattttaatatgaatatataagtggaaaacataggaaaatctatgagcgactttttgaatagtccgcataaaaaacaaaaagaaaaaaaatcagataacatagatagactaaatttttttttcaaaaaatgaagctcttgctaactttcttcaaaatttataggcattaagtcatttcttaggaattttgtaggatatacatgaaaaatacggaattttaatatgaatatataagtggaaaacatcggaaaatctatgaacgaccatttgaatagtccgcataaaaaacaaaaagaaaaaaaaatcagataacatagatggactcaaatattttttttcaaaaaataaagctcttgctaactttcttcaaaatttataggcattaagtcatttcttaggaattttataggatataaaagcccaaatcctttgtttcaaagagctaaatagagaaaaaaaaccattaaaatttgaatcctataaaatttatatgtaaatccattgtttagagggggtcttaatcgatatatactaaggctgtattcggcacccctttttcccaacaactctccctcgttttctacgcgcacgcttttcaaattgctaaacggtgtgtttttttgcaaaaaatttctatacgaaagttactttaaaaaaatcaaattaaccctttctaaaaatagctaatacttaattaatcacgtgctaatggaccgtgccgttttctatgattactgttccggatgggagcaagaatgcccgaacacagcctaattgctctagtctagtgagatacagtatatatataactagataagcttggaacagatcttgtttgcaatttggagcaagtgagatatgcaactattcactaactgaattgtggtcctagcgagctcgggggtaaaccacaaagaaatcagaaaccacgcgaagttctatccaggcagcaaatggcgtgcatgtaatggcgatctggccagtggacagtggtcctctccaagatttctctattatatactgcacatcgatacaaatatttccttactcattgaattatttctgtaacaccggactgcgcacgatcacatgagtgacaattttgtaggctccctcgtagtgggatggcaagatcggatcagtaagacagtaatgattccaaacatagcaagtaaggcatggcattttcttgtagagaagtggtagtagggattttattagatttttttttgaaattattatttattttatttgtgacttactttattatatatataactttaagcacaacttttcgttttttatatttgcaaaaaaaaattgaataagacgagtggtcaaacattgcaatcaaaaacttaaaatcccttatattatgggacggaaggagtagtttttttaaaaggtacgaattaccctcttgaactatagtagtcgaccgaattaccctaaactcgtaaactcgaataccagccatttacaccctcgactattaataccggatgaataactccatgaacactgttttggacagttttgacttgagtttgcgtacataggcgttaacatggcaatccaatcaacaatgaaattattaaaaaaaacaatgtcatctctcccatagcctaatccctcccccctactctccctctccctctcctccctccgacccggtggccggcacgccatcccagcccctaacctcccattttagatagttatgccttgagtttgcgtacatgggcaccaacatggcaatccaatcagcaataaaattattaaaaaaacaatgtcatctctcccacagcctaatccttcccccctactatccctctccctctcctccctccgctcggtggccggcacgccatcccagcccctaacctccaccttgctgccccctcccccaacctccgccacactgcaccgtgctgcccccatccccaacctctgcctcgctgctctctcttcccttcacccgatggtcggtgccatccccgtcctcaacctccgcctcaccgcgttgccccaccccgtcccccaacatccgctgtgccatcccttcctccaatctctaccgcaccatccccacccccaatatctagtgcgccgtccccatccccaacctccgcctcaccgtgtggccctgcccttgcccccaacctctgtcgtgtcgcccttgcccccaatctccaccgtgccatccctgcccccaatctccagtgcgccattcctgtcccccaacctctgccccacccatgtgcccaatcttcaccacgctatccccccccccaatctccactacgccatccccacctctgatctccagtgtgccatcctcgtccccaacctttgcctcgttgttgccatcccaaccaccgtgaccgcgacacgtgagggtgtagcggatggtggccgtttcgagctcaacctccgcatagctctagcttcgctttggcccaccacctccgagagccagcttcgcgtgcccaggcgagcttgcgttgatccgcctcctttcgagcaaggtccctctctgtcctacttctctagccaaaggtgcacagagagagagagcccattgatttgcacctgaaatggggagtggggaggattggcttgaggaaagatatacaagtgggcccattgattttttttaaaaataattttattgctgacttgattgccacgttaccggctatttatgcaaactcaagtcaaaactactcaatacagtgctcagggggttatttgtccggtatcaatagttaagggtgtaaaatgtctggtattcaagtttaggaggtaatttgatcgaccgctatagtttaggaggataattcatattttttttcttttttttccattacacaaaagacgtgtatgcaccagcacaattataactatacatggtagtaaatgtttccactaacaaacgtttaaaaaaaaaggtgaaggccaaactacatgtccttgttctaactaaactttattaataatacaccgcatgtattccaatgactctacacactaccggtgctttccccttgacaagctaatttctgaaacaatgagataagggtttcgggatctcgtgaaatttggtcatatgattcaggaaaaaaaaagttgtttcccacaagaaactttaacatgaattttgatttttgagttctacagtccaaaagctattcgcatgtaaattttctataggaacttgttggagaatatgtgacacaacccagccttagcaaaagttggtacgtgattccattttaatcacgcctaaagtacttgtacataaagtttgataataagaataatcactaccttggaacccttatatcctcttaatgagatttttaaaaatcacacctacgtcgaaattatttgattaataccaatataatggttcattgcaaattaaacaatcgatttacctattaactattaaggtttaaatcgatggacaagattcacgcatttattcttagtctttgtctctttgtcatataaacgtgtattaaagagtgtgtatttgtggacatgtggccaccatgatatgcacatatatgtgttttgtccgattgaccaaataggtaaaaaacttttatgtatgtagtttgcatgaccttggtcatgtatatatcacacgttggtagtatggctatatctacgaattagaggcccggccggtgccttaaatattgtaaaaataaaattaaaagtacagttcaccgctgtacgttgctctttatactcgatgcctattatgggtggtgtgccatgtatccgcatcagaaaagtagctagcgattaatctaatgttcttctctttagctataccttgttattagacgaacatatttcaggcttttagcataatcgccgaaggagaaaggacagcttaaaagaaattgagtgaggaagttctaaaacttgaacaaattggtttggtgtggacctaaacaaaaattttagaagccctcactcattctgcacaccatactgtacaggcttgtttggtagcaacagacgcgcgtcgtggattacttgactagcgaagctagcagcatcagggacaaggttacaatacaagcgtcaaggttaagcaaacccgagaattttttttaataaaccttatgactaagctactcgacataatagaagataacatcataattcaaagtatatgtatcaattttaaacttctaaacttctcacatatgacggttgatctcagagtagagtggaactatggaccgaaacacagaagacacgtgcatacgtacaaagtaagacgagaggagagaagagcgagacctagcttgtcacacagcacgagcactaccaccagtagtatgctattacgcacgggagcatgcaactaggccagcggagcagcgcagagacgctactcgtgtgttactaaaataccttagagtatatttattaattttggacatctaaacttgtcacacggcggttgatcttatagtagtgtggagcatggagtaaaacacatataaaatgtgtacaaacgtatgaagtatgtgcggtaagacgagacgagaggagagcagatcctgcaagtcacacgacacgagcgttaccaccagtagtacattgctacacacgcgagcagacggctaggccaacgcagaggagaggcgccactcgcgtgtcgttccctataggaaaaccctctttatcaattttggacctctaaactttcacatatatcagtttatcttacagtagaaatagaccgtgaagcgaaacacacaagatgcatgcatacgtacagagtactcccctgtcccaagctataagggattttaagtttttcctacaacgtttgatcattcgtcttattcaattttttttaaattattatttattttatttatgacttattttattatctataactttaaacacaacttttcgttttttatatttgtaaaaaaaatttgaataagacgagtggtcaaaagttaccagaaaaatttaaaatttcttatactgtgggaacggagggagtacatgtggtgagacgagacgagagaagagccgagtcctagcagccatcacacgagacgagctttaccacgagtagtatgctactactactacgcacgcgagcacgcacgcagccagccaggcaggccagccgagcaccgcagagagcaggcaggcgccaactcgcgcgcgcgcgtcgccttctccatccaccaccatccaacccccccacgcggccactcctccacgcacacacctctctctctctctctctctctctctctctctattccaatccagtcctgaatcagtccacccctttccttcgctctctctctctaactgcagatttccctcccctttcaacgcgcgcgcgggtggtggggggaggcacggcacgaggcggaggcggcggaggaggtggtgggaatcgatccctttctgttccggccgcctcgatcgcccgctacccgcacgccgccttttcgtcccggtggatttctgcctcccttttctcgattctttcctttttcttcttcttctgcatgcgcggcgggctgtgacgccgaccatgggggacgcctcggcatccacctccgcgcccgcgacgcccacgtccacgctcatctgccgggaggatggcaacgacctcttctccgccgaccccgccgacgacgatggcggcggcggcagcggcggcgactgggagttatccattgctgacgacgaccatgtgttgctcatggaccgggacgatgagtacctcgcgctgatgctgtccaaggagaggtgtgccggcggcggcggcggcggcgagcgtggggatgaggaggaggaggagatggtggaggagtggatgaagaacgcgcgcgcctggtgtgtcggctggattgttaaggtcgtttcgcgtctcctcctctctttgtcgcccccttgacctgagattactctccacacggtttcgcggagatcggatctttgtattgactcttgttttcggagggggggggggggggcttcctcctcgctttgctggttgcagacgaacgcgggattccggttcagcttgaagacggcgtatgtcgcggtgacgtatctcgatcggttcttggcgcgccggtgtgtcgatgtaatgacgatcctccctgcttgccttgatgcgccgcctcactcttgttgtcgtgatgccgagtgcgtgttcgacgtaatgcctgactccgtattgccattttttttgtgtttgtgtgtgggggtgttttagagggacaaggagtgggcgctgcagctcctctcggtggcgtgcctgtcgctggcggcgaaggtggaggagcgccggccgccgcggctgccggagttcaagctggacatgtacgactgcgcgtccttgatgcggatggagctcctcgtcctcaccacgctcaagtggcagatgatcaccgagacacccttctcctacctgaactgcttcaccgcgaaattccggcacgacgagcggaaggcgatcgtcctgcgcgccatcgaatgcatcttcgcctcgatcaaaggtcgatcattccccccctctgctttcatttcaccgaatcggatcgcaagaatctcatttcatttccgcaatctcgtagtcattagctcggtggggtaccagccatcaacgatcgctctagcagcaatcctcatcgctcggaacaaggagacggcgcctaatctagacgagctcaagtcggtcgtgggctcgttatggcagcaactagacaccgtaagcactcccaactttctcttttgcgagatctcatcccattaggtttaagttcttggtagaaatgacaatgtcgagagtaaattctgcaacgctgttgttctcttgcaggggcatgtgtattcctgctacaacaagatgatgattcaagaggacaggtcgatgcaatcgacgacggaggtagcttcctcgggtgtctctgttgcccacattgggggatcggaggacagcgccatgggaggggccaataatgccaccaccttggaggcaaccccggacaagaagaggaaaaggttgcactcgcctcagcgccagtagagggaggagctggaggctggagctggacagcatgttggttggagtccagctctgcaatttttagttgatcattttcaccctttttcttttgtttcagctgagccctagtcagtgctcttgcaagttcagggggggttggccaaatggaggggccaacatttgattcttcttctgattatgcaattgttacagttgattgattagttagcaatggaaagattctggttttgtggagatctttccctggcccagaaaggtactagtgtaaagagcagaggaaaaggcctgaaaactgataaagagctcttgctcaaagtagggaggaagtcctcactgagatgtggagacagagagagggaatcccaattcccaagtattgagtagaagtcattttttgtggatactgtatggttatctgttactctctgttgagtcatgccattttggttcattagcaatttcctgatgctaaagccaaacagtggtagtacatttttgttgcaagaactgattgatagtagttggatagccagggggcaggggccatctctctcactgtacttcactctactctctcgtgtctcgtgtgcaattgctgaccatgagtggttgggaattgtttattgatatctgtgggacgaaaggaagaaatgcgtttgctcggtgcctttctgatgttgcctttgtgccgtgtcatcaaatcaccctgccttgctatttctcagcaatggctttgctgttctttgccttcttggaggtgactgccactgttggtttgtctctctcgcatgaaagcagctgtaacgctgccttctttagctctctctgaattgtgcatcatgcaatgcaaatcactactccagtagtagtacactccactaggacacgtggaacaggccaaaagaaagactcttcttcactcttcagcttcctctcaccagctgccgaggttctgatgaattgctcatcttggggagcatgtgagtggatctgcttctttcccctttccctccaattttttaactgcctccaagaagacagtgcgtgtagtgtagcactgtgaaaacctctgatgaaagtggagtacaagagctgctgtgttttgtgtggtctggatctttgaagtttttgaccaagggggtgtttgggaactagggactaaatttagtccctctcaaaaaaacataagtccctcaaacataagtccctaccacagggagggacttatgtttttttagagggactaaagtttagccccaatttagtccctccaactaaacaccacgcaaagaaacaactccccatgaatgatctgaatctgattcagatggctgtggatgaccaacccttgcactggattcctctagcccctggtgactcgtcgtgggcggtagcaactggcattgcggtcaaaacccaaaagcgctgcacaagcatgacatgagaaagagagagacatggtaaaattttttttttcatgtactgatctgttgtgttgggctgtcttgtgcctggcagcaaggtaaaaaaatgggttcaccgcggttcacaggggcatggctactggtggccgacgctgttggaattttatagtgggcagtaacatgcccagtcactggcttgactggtcagcagcattttgtattggcactggtgaagtggtgcagtagtgatggaagcacaagctgcctgttgattgtgtgtgtcaattgcatgcgatgtgtgaagagagaaaagcctgggatgccaaaaggaaggtaactgacagcctgccaggcccatgcaaccagtacatattatctgctgatgctggcatttggattgcaactgagattcgtggtcaaagttaaatgtgacgttatatcttggatcttggaaggtagcggaggcatttcacaaatcctactacagctaaccatgctgaaaattg

SEQ ID NO: 80671 - DNA, 16689 bp, Oryza sativa
aattactgccttgtcacttactgatgttctaggactttgtaaagttgaattggcttcatctgcaattaccttaactggttaatttcttctgtatttttttccttattctgcttgcaatcttatactctcgacttggtaatacattagcggatgcatcatactgttgtatcttcatgattgactacctttctaactacaagttgtaagttgagaaatgcttcgtggcttgtaccttacagcagtcttatctcattgtagtgctaaggatggagcaagacattttgaagttcattcatgaccctacgcagacagagtttgacttccatggtcttcctacttcttacctgcgtcttgctgcacatcgtctggcacagcattatttcctccagtcaattgctctacaagataacggccttcctgatggatctggttctcgtatcatccttcgcaaaacatcagctgagtgccggttgcctgctgtgcgcctatcagatattcaagttaatctgcctcaagatgagagcaactctatagccaaagttgctatcaagcaaagacctcagaagcactaccataacaattccagttcaggtgctcactcttctagagccaaccttcagaaaagtgttgaagaaagaaaggaggaatacaataaggcacgtgcacggatatttaataacaacagtagcagcggcaatgctgctgatggaagaccaggtgatgaagtaactttgccaaatactctccataggtccagttccttggagctaagctcaggtaacaggctaggtgaagggcctgaaattacccttgaaaggagtttgactactgcctcgtctagcagcagggtaaatagaaacaagactgagaaggatcctgcatttaatagaaacaggcaaaacaacagggtggcgatatttcgagaccgtgagtcagatcgcaaggatcctgattatgacagaagctatgacaggtccgtttaacgtaataaactttatttttgtaactctttagctatagaatgttttgccattccaccgtacagttcctatttattattggtgaaccatttagtactctcaatatttcacgtgcatcctaaactatcaaagtagctcatgggtgatctatgcaatcatccatataagcatttcattcatataactattagattgcaaatttaaactctaattctaagagaagcttgtgtaaaacacatcaacaggaggtaatcatgtgataatatgttaaagatacaaagaacaatggggactgactttcaaaccaaaatgtaactctattaaaactacctgttgacttttttgttatgtcagtgaagacaaggactgcccttttgtatcaagccaactcatcatgaatggctttacaggtacatgcaaagatttgatcctggatttggatttaatggaggttcatacactattcaacctttgtatgcccctgctgttaactacaacactgagttccctcagcttgggtctcatgggtctccagttcctgttgaacagcagcctcagtcaatagcacagcatattcctgggccctggtcaccggctcaatcgcctaatgcgattgggtacagacctccggatggttccatgccaccaccttacagtcctggtcatgctggtgctcccattaggtcatctgtttttatgcatactccccaacaatttgctatgccttcacggccaggagtcacatatgtacatccacaggaacccatgcgtccatttgcacaggtttgtatccgtactttagatccttgtcgcttttctcattgttcaagttgaattgatgtactacaagaaatatcattgtagaggtgcgtgaagttattgatagttcaattgttcatttgacataggatttactacctctgtcccaataagacttcacttttatacacgaacctagacaagtttgcctgtcctgagttgtgtctaaaagtgaactcttttttggagggaaggtagtagttttttcaaggtacatttttgtgacatgagacttttattatgtttatacacatgtattattgcacatacaacatctattctgatatttcttcgatgcaatttatagattatgcattaacactcagctgatgtgttcctttttcacttgtgcagactcaccaacaacaacctgaagctagtttgcgcttagcccggccccgatgaggggcctgggcatgcctgcaccctgccagcgtgccctgaatgtgtaaatcggatgtcatacccgattcatttcttgctggtagatggtagcaggcataaaagaaccgagaactacatatctgagctaaacaatccacttgatcttgttagcttgtggttcttggtgttgttgcaccctgcacattcaggtgcaggagaggcaccttcttcgtcctggaagtaaattgcagactgttgcatacgggacctcaagtccaatgcatagaagctgagaaatgaaggggagagcagtcatggctggcatgatcggtgctgttctgctgctgttccttgcagttcagttttgagattcaggaggggcacattgcccccttgaagtcaagcactcagcgcgggtgatgagaagagaatcggcacaacatctaatatgtggatatttattcaggacgtggttagttcaattcttgctgctatttgttttgcttattagcatctttctcgctgaaagtttttctcgactatttgcagctgcttggtccttgtcgcttgctgaagcttcgccttcgccttccacctgaagtggcgtcagattgactggaccgaagatgcagcgctgtagtccccacagtgaacctaagcccctcgctgaggcttaatcagtgtctgttatagatcattgtagttgtagttgagtaaccccaactttgtaactccactctagtaagttaaaacaatgtactaagctcgattgccaattgtactagtagcactatatgtattgtcgtatggactgggatgtcgcagttactgcttgtacagtggagctgcgtaactttaacccattactacagctttatgccgccgattttattaggtccctttgtgttctgtattgaaatgatgccatccttcctgcctgctactcacaccctctccatgtttgttctggtcatagggaggcagccagcagagacgaacaagcagaagagtcaaagccaaagcaacaaaaggaagggaaagggaaggagatggaagggatgcgatgccgtcatgatagctagcgaatctcgtggtggccgggcctaaccttttgccatcattttccttccacggcctacagaatccagcatatctgctgctctcatgatgctcttgcactgcctctgccttgcattaataggctcgctccgagggctggatcaagtgaaatgatgaccattcgagctgctcacgttacctatgtcaattctgcactgctgctccttccttttgcttctataaataccttaccttgtgctgttgctgcttcaatcttcagttcttcactagcaggagctggagctagagctgcatccattccgctcacatcgcagcctcgcaaggaggaaggaggtggtttcttgacttgatgtaagatgccctctgctttcctttgttttctctatctcaatatatatatatgctctttgttacataattctccctatcttatgaactgcttgtatatatgttgcgatggatttagtaagatcgagtgaggagggaggagatggagaaggtgaactcggagcttgtgctgcagaactgctacatcatggagcagaaccagaggctgaagaaagcggcagagctgctacacaaggagaggcagaggcttctctccgagctcaaggcccagctcctctccaaccagcaccgccaacctcccgctaatggacatggacatggagacgacgacaagcccgccgccggtggctgtggctcttccaactagtgtcattagcctttataataaaacatatattccgcatgtgttttcctttgcgaggtactccagtacatgtcctgttaactgggtaggagtaatatggttagtgcatcatcacaagcaaatgaaccaagagctctcctaacgcttactactcttgagacggctctatgtgttagcagtacaatgttttggcattttggcgcctgtttatctaacgggtaacgaccagtctgtgtgctgcactgtttgttgcctatgtggaggtgtgaaactgccctcagtttattcatgttctgctggaaattcccaattctttgtatgcaatttgtttgtgttccatttttctttcttttagaaaaaaaccgagcattgtgggcctgatctgtaggtggagagcccatccaggcccagcccagtagactggattggcctgaagaagccatgggcgtaagctaagcttgcccaagccactcgccgatgtcgctcgcccctcctccgcaactccgcgctttccgccgcgatggcgacgcccccctcttcttcgccgccggcgagtcctctcgcgctacatctcgatctcgatgcgggaggaatctagtctccgtctcctacggtggcttcgcccgcgcgtgctgcctcttctccgccgccggcagccgcagccgcagcaagcaggttcgtgcacaacatctccaatcccccccccccccctctgattgattgactgattaccttgccagttgaacctattagctactatcttgcttgcgccgaaatcatacgatggtgttgaagaaggagaatcatagaactgactagccatccctgcctggattggatttgggcgagggattaacttggccaaaccccttatctagcttggaaaattaactagtgggcttatgtgatactccgcatgtgttgattttttttcatggggagcattacatccaggatggtgattgttgatgtgataatctattaatcttattatatgaacatttaccccgcaaaaacaaaaaaaatctcatgtgaacatttacaattagaatggtgattgttgatgtagtaatcttatatggtatgatgacgataatatcgtgctaaaccaccaatccgattgctgtcgaactgtatagagtcataggattcagtggttctcttaatttggcatgtgatgataggcatgcattactgcaataatgccattccacataggattatctgctgttggtttgtgtgagaatccaaaattactcttgattcttcaaagttgataggccaacagaatatcacaataacaaaccacaacattttttcctctcaggatgaagctaggaaagcagtggaaaatgccctggggtggaagaagacggggcttccaaaattgggtatgcgaattgaaagaaggcagcaaagactgcctccttcagccggtggtggaggatggtctggaggaggtggttggttcaggtggttcagcagtggaggtttctgggatgctgcaaaacaaactcttcttacgatcgtcggtattatcgccgcggtaaagacaattaatatcctgcactttttgtatgaatgagttgtcaacctagatgtatttctaactgctgtgcaatttctttgcagtttttcctgattgcaaacttcaatgtgctggtagcagctattgtaaattcactgctggctgtgctgcggcaaattcggcgtgcactgtcattcgtagctcagtgtattcttcagggcgtacaatcctcggctccgaggcgatcatccccttctctagacactggcaatcaggccgctgtggttgtgaaagatagagttggaaagtcagcgaaagagagagttgtaaggaaatgggggaatggcgtataacacagatctaccctgtcttatgagccgcataatttttgttcttgctgtgttgagcgctttgcgaccaccataacttgttctatgatcttgtttgagaagaaaaaacgataaaaagaaagttatgatgtgcctctgcccaaatttcattgtagtttctccgctgttgtctaggagagaatgtcttgggggttacaagtacgtacgcagcgaacaactcttcatccgcaattccattccgatccgatttcaagccatagttaccaatgaggtgaggtgaggccctcaaaatagttttcgacccagcaacttgttcatggttggtattttcttaatttccttttgatggggccagtgtaagtatatgttgttaactttatttgatttttctttaccagatccggtatgagaagcttaggattgaacacagtagagcatcagaggggtggtcggagtttaaatctccgacctccttggctgctctaagaaaaccattccaatttccaagcgctatgctgttgttggacaagccatatattaactctcgtctccatccatggctttgtccagccatcgtttctccatgttaacaccaccatggcgataatgctggctgctgggatggaagctggcaccatcaccagatgcaggccaggtctgatacaggcaaccaaacaagccctttgtgtatcaaagccaaagtggtgcattttcaggcttatattgtcctgaaaacaccgcttcaacggtgtctgccccttttgaatggtttaaacaggaatttgtcaactgatgaagccgccaagtgccttaactatgatcgacagaaggagctaacacagatgaattatgcagcatctgatcaagtctacaaatatttttcactgcaaactgacatatggaaacaagcaccacacagcgtttacaccgcaaaggggcgtaatgctagcgtatttcagattcagcatagaactgcccggtttccagaaatgttaatcctcatcagtcttgccatgatcagctgcatcgttttgttcttgtggcagtgactccttatctattttccttctcttttcagctttcttttgggttgtttctgatctccgggcggcatttttgttcctaaattctgaaagaggcatggcacaaatgggggaaaaaagcttgtgtaaggtggatagatagacacaattaaaggttctgatagacgaacaaatcatctctaaatcagaaaggatcaaacagaatgctgtgagaccccaagaaaattgaagtgattgcagttacgtacatatagtaactaatggaattgctcagttgtacgaatattaaagttcagtaacctatattattgtaaacactcagatctttaaggcaaaggactaaaataactaagtatttcactgagtagaaacatgtggcacttcatcctacatttgacatttgtaataccaaacactgaatggaagtagacaatattgaccttgcaaagaagtattaaggggctctacaaactcagggaactccatttcatcgagtgccttgaggacatcatcagcgttgatcgtctgcctctttgattctttgcacatgtcattggcactgcaaacaatttctataagtaaaggcgctgcaaataaaatcatcacgaatacttacaaagaggtatggtactgcagtttgattctaatagatctacacaaaaagtcttcttttttaaaaaaagaaaatgttcacgaagggaagaaaaatgattcttatgagtttgcctgtaccctcaagtacattactagagttaagaaagtttatgaacaaatgcagatcgtggatcacctgcaccatcaaatgtcaataatttttttcccaaagtaatgtcaagcaattctggccatgagcataaattcacttagctttacccagcgaaataaataaattcactaatagctttctcccccaaacccctagagattaaacagaaacatgaaatccatgaccaaaaacgtgaaagttatactatatcagtatgagtatctatattcatagtccatatccatagatagaaggaagaataaggcgaaggggggatggggtacggacgtggcggagaggtagtggatgaagatgcgggcgctctcggcgaaggcggacatggcgtccttgttgacgatgacctcggcccctccggcggcgacctgggcgagcttctccttcactaggcgccgcacgatggccttgggcagctcctccacctccgcctccgccatggacgccgccgccgccgcttggcccggctgcttctcaggttgggaatgggatcccccaccttcccccgtctccccagccatctccctctctctctctttctcaggttgggaacggtggtgcagcggcgattcgacaaggcaaaccctagcctagtgaaaaattgacgagtcgcgcgcgctttgtctcttcttcccccctcccttcccgcgctttgcttctgcttgagttcgcactaccaaaacaagcaactgtccattccattttcatttcgagcactaaagaatttcagttccatttttcactctaaaaacacactccaacaaatctaaatctaaaccacaattgtgaaagcaagatggtgtctacttccggttccgggtcgagattatgcacacatcactttgaccagtcaccaggactacatgtacagttgagtcggggacacagaaaaagggagaggaatcagatgggccaggaaagaggagagggccatgaacacaaagcccatgtcagaccaattcctattttttaaaaaaaattagacaaaacatggggtgttgcgagaatcgaactcgcgacctctcgcacccgaagcgagaatcataccactagaccaaacacccgattcgaacttttgtctctggaacatttaactgacccaagcattttacaaacagtaagaacagctactacgaagaacaaaatgtgtttccccttccacaggtagtaagaggtaactagtcaacttggaagtaactcagatggattcgcggtcaaaaagtgggtgagtgttactgatgccagcaacgggccggtttcagcccacgcaaatgtttaaagcaaaagcaaagcccggcccaccataaaccctagctctctttctagcatggacaggaggacaggacccgattcctcctccctcgccggcatataagtagccgcagccgccgcctccatttcccgaccttgctccacacccgcagcagcagcagcagcaaggagaagaagaagagccaagatgcagatcttcgtgaagaccctaacggggaagaccatcacgctcgaggtcgagagcagcgacaccatcgacaatgtcaaggccaagatccaggacaaggaaggtacgcttgcttagcatttagcaatgcttcttcttcttcttcttgctcggtctcttttgcctgcttgattgcgaatcgatctgctccgcggggcctcaggcatccctccggaccagcagcgcctcatcttcgccggcaagcagctggaggatggccgcaccctggccgactacaacatccagaaggagtccacgctccacctcgtcctccgcctccgcggtggcatcatcgagccctccctccaggccctcgcccgcaagtacaatcaggacaagatgatctgccgcaagtacgctccttctaatttccttctccttgaatgctcgacttttgattatgcatactcctttatatgttcctatagtttattatgcttatgatatgatgcttgccttgtgagggttggatctgtggtttgtaactctatgacgcgtggcattgggttccccatgggtccagagattgacaacccacctatactttgtctgctgcctagcctatttcggtagttgattttcactggtgggacatgttaaatcattcgttgtcataccacatggaactgcgtagaagattggcaggaatgatgaatcaattagatgtgcgaagtctccttgtgagcttaacttttgaggcatacattctgtctgacctgccaatcagctcatctatgtttcaaagcaagttgcttttttttgtcatttgtttgtgagctttaccatatgttttgggaagataaaaacactacttttcgacttgaaatttcaagtgagctaacctatcgaggcacatttttcattttaaccatcttctaggatgtattattttattcaattaatataccctgtgttatcttattgctaggtatgagtgactcactgactcttagtttgtgaagttctatcatcaagtattttgttgctgtgtccagcagtgccatgtagtatgtatgtggaaattagcagattggctgggatgatgaatcaattagatgtgtgaactcaccttatgatctaaaacttttgaggcataattactttctgacctgccaatctagtaacattcaaaacattttttcactgtgtttggctctgatgcttggactggcatgccttgccagaaagttagtgtcatttgctaatgttatgccagtagtaccatcatgtattataggcacagtagtgctgcatctgttttcctgatattgctcccttttagggtagactgagttcagcatgtgaatacatttcgactgttttcttgcaggtgctatgctcggctgcaccccagggctgtcaactgccgcaagaagaagtgcggccacagcaaccaggtgattatcattgttctatacaagcaagtgatttagatttgctgtttacttggcaccaatgttctttagtaataggagcaacagctaagggcaccattagattttagaatttgtattgacccttgcaatttagagcggtgcaagtctgctgctctaattatgtttgaagtagtgtagtgtgttgagcatattaggtttacatcagccttagatttgtgattttttttaatactgttgtgagaaattgcacttgaaatgtcaaccaagtttagtatagcttgttgacaagtattctatatcctcgccgaaatgcgtcttatctactgtagcatctaacgtgctttcaaattcctaccctttcagctgaggcccaagaagaagatcaagaactagagtttgagatatcatttccgcggatcattgaaatcaacaggaagatcagagtttaagtttttttgtagtgtaatgcctcatgttgtatgccgaactttctgtttatcctgttgtatgttaaccttggttacgctggagagtactccagcttattttgatgacataattgactacaaagtcaaggttatatggcccggccttaatttttgtccccttcgaagtttgcccctcattgttgtttgtggttgctaccatgctgtgatctgaattcaaattgtaagtttataaccgggccatctcagttactacgtgtgattcgtgtgttgtcaagtggtgattggctacacagctcttgtggtacaggctgcagattggaacgcctctgtcgttttgtttgatgaatttcaaggcagacaaattccttcgttatgtgagtgtctactactcatgtcctggaaagttgaaatagacttttgatgatatgacttgaagagcgaagaatctgcactgatcagaaggaaattaagcagtactcgatcgtttattttggagagcacttacattacaatattgcataaacattacagcaggaattaaggcatgattcggatttcagaaaacatgccaaaattaaacattcatttcattttatttgcaaccaacagatcgaaggtgacgatggtttgatgaaaacacacaacagccatgagctccaggttcaggttcgctcacaactcactagaagtaaaagtagtaggaggctgcgaagcaaagcagcagggtgatggcccagcgcgacggcagcaaagccgcggcggcggaggaggaggaccccggcgagggcctcggcgaaggcggcgcctggtcttgcttgagctggtcgacggtggcctggtcggtgtgcatggacttgtcgaggatggtgtcgtcgatgccgctgccgaagagcgcggcggggagggagatggtgccgggggtggcgctgccgaaggcggagaaggcgcgggcgacgacgtcggtgccattgttgaactggaagtgcaccatgcccttggggaacacgaacatgtcgccggtctgcagcgtctgcgtgtacacggtgccgttgcgggcggcgtcgacgagccccaccagcagcgggccctgcacgaccaccagcagctccgacgccctggggtggatgtgcggcgggttgacggtgccggcgccgaagacgagggcggcgtaggacacggactggccaagcagcgccgggaactcggcgtgagtggccttggtgacggtgagcttggccgggtcgccggagttgccggtgacgaggttcttgtaggtgaagaaggcgccgtcgatcccggatgggtcggtgtcgctgggcacgacgaagtcggtgaggatgtccgggtcggcggcgccggcggagaggatcacggccagcaggagcagcacgccgaggctgacgctgctgcggctactcatcatcatcgtcgtatcttagctctgttagttagtgtgcgatggatcgatcgaggtggaggcagccgcaaattgatgaacgagcgagacgtacggtggtatttatgtgcgtagaatcgccggctcggcttaggaaaagctgtcaccatgctgcatggcttgtcatgtatgtaaacagcttcatcgttgctcttcatcagcttattaattagccacaatcaacaaagttaaattttaatttttaattttgaagataatttcaatattttttatactttattttttcaacattaacttttaaatcactaggaacacacatgcataaagtttttattttttttatcacaaataaacgttaaggtttacgcgaaaagatcagactgtaaagttgattccttcgtttcctaggtcgtttcacaaataaattaattactacattcatatatgagagcatatgcatacgtgcgtgcgtacgtcgtcattcggaacagagctaacagtccagacccccagtgtacaaacattgttgaaatactaattactggaccagtttgatcaagctgccatgtgtagtatattagccggcgccttgtgccgccatatatttgctcgctttggaaacaactacaacatttggtcttaattgctgtctgattagctttcctgctgtatagaatatgcatttgcatttgtgtactatacataaaacaatcgatcgagtttccaaggcatttgggtttagtggtcttattaattctcttgtgtgcactacaccttagccttttccattagcatattgcaccatgcaagaagaatgatcatccatcggtttccaaacgcaaataattaaattattagaggtaattaagcagctaccaagtgcatggctgtgtatatccattgagatatagacgccggattttaatctattttcaaaaaaaaaaagtgcatgtgcgcaacaactactaggtagtcattcttttcttaaaaaaaatcacaaaacaacaaatactatcacacaactatatatatatatttatttaacatcaaattaatttatcatgaaactatagatttaagatagagaatcacaaaaatatattatatgatgaagttatcgtagaactagcgccaacttaatcacatcactacaacgttaagaactccaacaggacatcgttgttagggatttaaactatacaatctgtagtttgagatgaatgtatttaaatgaaagttcgtggcgacagttgaaagttttgtatgatttatatatgttgaaagtcacatggttttaagtggaaagtttcgtaggaaagtgatactaaaagaaaaaagtgtgcgctagctggtcatgcctacttgaaacaagaatagaacaatcgccgactcaaaaaagaaagggaaaaacagaaattcaattttgacatatctcaatcgaattaagttttcaatgatcacaactcaagtcaaaacatacataaatatatactagcacactcgactcgaggtcgaggattattcccacgtacggccacactacagcttgcagcattttcatctgtcacgcttttgcgttgcactgcatgtctgcattgcttggtgttattcaactagtaacagccaacaggacgacatacgacaatggcgagagaaggaagagtagctaattaggacttgttgggcggagtcaggttcgccttgagcttcaggatcgtgggcacgtcggtcttgaacgatttggcgagcacggcgtcgtcgatgccggtgccgaacactgtgaccggcaccggcacgacccccggggcggcgctgccgaacgccgagagcgccatggccggctggttcccggagttgaattggaagtgcaccatccccttggggaagacgaacatgtcgccggcggccaggtcctgggtgtagagcttgttggtcgtgtcgatgaagccgacggagagcgcgccgtcgacgacgagcaggagctcggcggagcgcgggtgggtgtgcggcgggttgacggtgctcggggggaagacgagcgtggcgtaggagacgctctggccgttgagcgccgggaactcggccatggtggccttggtcacggtgaagctgttcggttccggcgcgctgctcgtgttgaacaccttgcggaagccggtgaacgtgaagaagtcgccggtgatgttcatggggttgccgttcgccgggatgacatagtcggtgaggatgtcggggtcgccggccatgactagggtcagtgctggggcccaaactgcaagcagcaatagtagcaaagagtagtagctcaacgccattgaatctattttaatcgttcgatcagctgctaaactgtcagtaagtaatgagttaagacgaagtttaatttgactgatgtggtctagtcttcaatctacttgtgttatggagacagtgagcagtaggatttggctatttatgcagaagaagcgtctgacgataagccggagaaatcgaggttgaaattgacatatactatgcgtaaattaatcattcatcttccgttgttggacgaccgaaagatcggtgcatcaagataaagaaactagccagctagaggttcctgttaaaacttatgcccgtccagaacagaacagaacagattagatttctggcctccgagaatgaatacgtatctgatgccatgctacttagcttgttaaattaggaagtcagattgttaactccatcagttatcttggacgtattctgcattcccctggttgtttactatgaataatagcaaggaagatgcatgatgagaaaccaagggagaaagcaaatgtcatcccaaggcatcaaagtcctacccacctacagctgcactgcaagaatatctcattgccaattcactactgcttcgtcaggaatgacatatcttccattgataactcagctcagctgtgcggtccagttgcctttctagttcaactgaattatcaaacaatgcaggtctattaactcttacacaccaagacttgttgttttttgcgtgcttgtcctcagtgttttgatttgaagttgtttgtgtctgtactgccttctggtaggcttctgtgctcctccttaatatatccagtagtgctcctcccgtcggtttcaaaagaagatttgaagttgtttgtcataatggtaaatacatggaccaattggcagtgaggatggtggaagtttccctttttagctactgtttggcagtgaggatggtggaagtttccctttttagctactgtagtagagtggaaattcaaagcatgtgagatgaacaggtaaaatgcaatcagtgaactgtagaaaccacaaacgggaaaaggcatgctacaactgagacaaacaatggataagctttgataatggaaatggacgtcgttggtaggtacactcggtgttgagcattgttcagacagatgtaacaatgcaatgatgtatattactagtataaattaactttgtttgatactataagagaattcaacttgagagcccactgtaatttaacagaactgctctgaatatgggttgctagaatggtgctcttgactcttgagggcttatatgttaggattcaggagaaacataacagatgttaaattcttagttttagttggtgatgcatattgcagttgtttatattgagatccatgttatccatctgaccatcatcaatatttctgtcttgtggatatatgcagactggcatataagagggtgactgtctgactgagtatatatgtggatatatgcagatttagcatataagaaggtgagtaagattgcaacacaaatttactattgccagtaacaggtagtaagtggaaacacacagtattaagagatgtatcattattgtggaaagccgttacagcagagaaactctcaacacttacaactgaactggtctatatatattcccacaacgccttaattaatactgatagatacatggttcaaagctcttcagacaagacaatacaaccacaattcagaattattcaccacacaaatcataatttaccttcttcagtagttggtagcctggaaggtctcttatttcaagcagcagcagcagcaggatgaaaaacaagaataattaacaccaacggggagggcttaggctttcttgggaggagttaggcctgccttgagcttctggatcgtaggcacgtcggtcttgaacgacttggcgagcacggcgtcgtcgatgtttgtgccgaa

SEQ ID NO: 80672 - DNA, 7441 bp, Oryza sativa
aagcacctgttccgtgtagtaattgtgttctacttgcccaagtgctacaatcaatatcatattttggttgctggctttgatcatttgatccatcgtattagaggaatcccaagaactattaggattatattctatcctttccacaatacttgaaatttgattgattaatctggaaagttatttggcaaaaatatcaagcaggctataactagcactcttcgaggattgatggtgtcacatttttgttaactaccctgtgttatcttccaaaccttttcctaatggaacaaaaaactacaataattattttctgttcgtgaagtaggattctgaacaacatggttatctgtgtgcaactgcaataacactttgataaatccaatacacctttgtgatggtttctgatgccatgtcaggttgctgttgcgttggagaaggcagcattgtcagatgattattttgtcaagaggaagctgtatccaaatgtggatttttactctggcttaatatataggtacatcagtgggaaagctgtttttctcttttctctccttttgtcattgagtagctaattgtgattgtgttgattcagggcaatgggattccctacagagttcttccctgttctgtttgcaattcctcgcatggctggttggttagcacattggaaagagtcacttgatgatccagacactaagattatgaggcctcagcaggtcagtgataggcaaacaaatttgccatgtactattatgttcccttagtatgaactccaggtcaatcatgaattatgattactcctttttgagcaacttaacatttagattttcttgtcaatcaatattgagccagattggagccattgttattctgcacagtgactgcggtgatgggaaataaatagttatatgctcttttccttttgaatatcatttggtttggctagctcttctctgggctgcaaacaaggagcgtaggattttcttatgaccacggcatagttatatctttcactaacaaagtccagcagtattcttgatatattgactccttttatacattcatcacttgatactgtgctctctatctagacctttttgggtgtattctgaatgctggccaattaattcctatgtattatatatttgattcatgcgatacataattacagatatggtgttaatcagttagttgactagatatcttgatgatggcttcttctttcttcaggtatacactggtgtttggctgaggcattacacacctgtcagagaacgagtcccagcaagccagggcgaacagcttggtcagattgctacctctaacgcaacaaggcgtcggcgtgcaggttctgccctgtaagatagcttcaaggtacagcatccagcgtacaaaataaaagcaaagcttcatccctgtgctaacaagtctacatatctgcatgaatctgggagctgtaagtcttaagttgtcaagttcacgtatatatgggtaataaactaataatgccacaccagagagcactgaggcgtgcgttgtaatcgtgctcacccaatgtacattttctctttaacttgaattctcccaagcatggagaatgaaaggatatctctgggcagaaactatgaaaatgcaaaatttgaagaagattttccagttcagtcgatcatatcaatatgccatcaagtttattggttgcattacaggaggcaaacttgcatggtcaatttcttgctcgttcttgagaaatcagaaactgccggttgtttcagtggatggtgaatcttaactgttactgtctactataattgccgtttttgtcatgactcattaaccacatggttttaaattcttatctaatcacctcttttctctttcctttgttttaattcttgatttttgtgtagagatatttcttgtatgagaaatagtttcatctttttacctcttttctcattaactttcttgctatattagatttttgcttatgtgatagtggatttaatgttatgaacactagctgagattgagggttggggccttaagcccaagcacaaaatgcattgcatcattttcagttcaccattcgtcactaaactaatccttgtcaggttgtggcatgtcactgtctgcattggcctagatatttcacacgtaggaactatacacatgcgttgttctattgctagtcatgatggcattttttggtcagattattacttgtcttcattcatgtggaccttatcatcaagcttaggtagggcccttcactgcactgcctacctaagtgtctccatccttccattccttgctgcatgttgatcagaacggtttaaactgcaatcatgtgctcatgtgctggtgggtcatctcatttacatctccttttggagttcttcctctttgttaattgtggttggttcttgcatttacggctggtaagtttccatgttcatagcggtggaacatgacctggaattttccaaggaagcatcttaaaaaaaagcattgccactaatgccctatcgcctaatctcatgcctatgcacgttttataggacttatttagtggtcagctaattacttaacattatctgaaaaataaacttgtcaagttggactactcctaagcaaaatcgaccaaaacaacttccatttgcggatttacatattactcaaaattagactttagtagactactagaagatcgatcttagcatgcgtcagaaagtccttgataattatgaatcggcctgctacctgctaacaaccaagatcatttaccatcaacatcaaccattcatagttgcttcctcagtggtgtgcgatgacttaatagcttgcatcctgtactataccactgctaatccatgcagatgaccaggtcagcagcaaacagaccagccaaagaaagtcagagtcagagagcacaacttgtcattgacaaaccatccatgccatgccagagtggactgttgtgttcttgacaacagcctctaatttatgtccaacaacagatttgaagttgatctttgttgaccagttgcaagatgtatagataatctactagtaatggtggatttgacacatcataagttgatccaaatcacctgctttcactggctagtactagtagagagtttgcaactattggttggtcatcatgcatggcatgagctcacatcattcctaagcaaagtggttttcagtccaatttcaccatcagggaagaagaaattaagatcaccttccaaccatatgcatgctaccagtagcatcaattgctgatctttaggaaaggtttggatcctcttttttcatcttttggaactaggaaagagaagtggcacttggctagcagtggcgtttggttctttgcacaaagagagttcctgtggactgaaatgtcaaacatcaaactaggtatccactttaattagtccaagtagatgaaggggaatggcatgtttttagccaagccagtagtagaatcacatgcttgggttgactggtgccacagctgatcaatacagtttttggctccattacatgcactgtatgtctgtatctggcagaatgaagtggatggtaatctaccacaggttgagagaggttacacggaagatgcacaagcatgcatactactaggtgagatcggacggtggacagtagcgatgactgataggtaattaactggaagcatagggatttttttgcaaaaattacactcctaatctccaatgtgcgggggctaatttgcaaaaggaaccgctgaagtggcatcctaattcttcaaggatcccacgcggtttaaagaagctaatgaaaaatgttttgagccgaagctctattttctatggaccaagcaatgcagtcagatacgtacatgtgctcaaaaccgttggaaggcgtgcaaggttaactagcaggggttggctatcggggtcacgtgggataggttaaactctgtttttaagatgtgacggcctcgtacattcgtttggcacgaggaatgaaatgatcctaatgatcctacttttaaaaagatatcttatatatcagccagataaaaaaatggtttggaatagtccatcaatttaatccgaatcttgagggaatattctcctgagatcatccttcagagatgatagagagaatagtgggttagatttatccgtcagttctaataatattttctatgagataccatcccatcccacttatccttaagccaaatactcgaaaaaatagattctaacctaacccaacctatctcatcccttaaaccaatactttagatctatcaaaatgtgtgactcctactacctccatcccttagtataagggatattcactattttcttgtaacgtttgactactcatcttattcgaaaaaatttgtgcaaatataaaaactaaaaagttgtgctcaaaatactttggataataaagtaagtcacaaataaaataaataataattctaattttctttaaataagacgaatgatcaaacagtgcaaataaaatattaaaatcctttatattagaaaacggatggagtatattttatcaagcctaaaaaaatcaaaggttgtactctaagattggatcgtcgacaaaaggaagatggagtctagcctcgatgtggtttgggaaaccttcggagatatcatctctttggtttttttgtcttttctaaattatttattctatgttttcaaaacatgtgctatcataacactttttactgtaatacgtacgaccatttgtttggattatttattaaaattttaaaaatatttaatttatctctccagtctgtctaataatcaaaatcaaaccagaccagaccgtacttaacggtatcaatatgtaaactagtactatatccgtcctaaaatacttgtcgttttgagtttttctttctaatatttgatcatttgtcttattcaaaaaattatagaattattatttattttgtttgtgatttgctttattattaaaatattttaagtatgacttattttttttataattatactaattttttaaataagatgaatgattaaatattaaaataaaaaaaatcaaaatgtctaataatttgggacggagacactagtattctcgttgttaataaataaaaagaaagacaagttgaccggacgtagaaactgtacagtagaaagaaattccgtactactcctacttcttatccgcgaacaaaaaaaaaaaaacacacgatcagcagcagtgtcagcgcgcattaagcgttaatcccccagctggtcaaaaacccgagcctgctgcgatatggcctaccgccgctgcgccgcacaaccacaacccatacgcaactccacccaaaaaccagcgtcgcatcgcacgcgcaagcgcagcacgagcacagtgaggaggagcttagcttagcctagctagcttagctctaccaaaagctctctgtagcttgcttgctgcccagtattgggaggggccgaagggcaatggtgggaggcagccgtctgttcctcctcctcctcctacctttgctgctgctgctgctgggcgccggctgcagagatggccgccggtgcgccgccgcggccgcgcagactcagaggctgccgcagcaagaaggtgagttgcgtacggcggcggcggcagctagctagctttcctctcagattttgctcttcttcttgttttgttttttggttgttgttgctaatttctttgttaattagaattaattactgtagtaagcatgcgcctaagtgtgttttcgcttagctaagcttgagctttgtcttgagattcttgtggatttttttgctgctcccaatctgtcattgcaaccgcaactacaaatcgatcgatggcctccacacgctggtagttgatttttattttactacttcgtatttacaactagcagcctctaccaatccccggaaacaagaataataaaaaaatgtttgtttattttgatctggagataaactgccaaagatttcccttttctttaccgctgattttggcgtctcaagatcatctgcaaaattcacccagatcgcccggaagggcactcaggcatttcttctgctctgccgcatcagatccatcagtgctgctcacttggggggcaatgcctcaagaactcgtacagtcgtacaccgtgcaaaatggcgaaatgccatttttcttcttttcttattgcgcctgtgatcctcgggtgaactgtgttcaggacgcatggagttcgtgccgaattgttgcttctctcaggacgtttctaaaaaattctctcatccagcttaagtgcaaatatatagcattccctgaatcattcagggttgaaatgcaaattggtattcctttaggggcataagagcaaatagcatcgccatttttcgccttttcggttattcccccaccaaaattgtttcctccaagggcccccaagataagggcaagctgtgcgatcttgtcgatggcgaatctgagcaggaagttgttttggcttttgagttttgacttggccgctctcttcgtcttgaagatcccatcttgcgccagagctgcgggttaggcatatgcagtggtgaacagattgatctagtccaatgggtgctgcacgccaactgtttgatgaaattgctgagtacccagggtgcacgccgggcaacttcctaggagtgccaaagttggctcggtgcgctggcaggagacgttggctgctttggcttggctttatgtgcaatacaaaccatggtgacaatgtgttgtatgcatctcatgacattacgacaatatgttgcctggtgattgtattgagttggtaacagcgatggtttcgcaaagccttcctcttgcaaggaatgatgaaccggagaatggcagtgcacaatgctccgcgcttgcaatttttcggaggtttagttgctagagcgcaatgagtcatgggcttgagctgatgggtgagttgtgcaaagccatggcctactgtgcatatatgcgctacaagaaattgggcacttgagggaaagaaatggcatgtttgatagctcaatgactcaaagttaatgtcatggccatggcctatgctggtagctatgtgtggagagaaataatttatgaatgtctcacttcacttgctaacgaggataaatatggagttctgggaggctgctaccatcaaacatgaggcttttgtgccaacattttagtttttttactctctaagcaaatgagaattgcaataccaaacttccttttatccactgcttgataggttctctagctcactcattatgcattgttccgtggctttgtactgtttaagtcacaaattttgacaatttgaccctttctgaaaactaattttacaaatgaaccgcggccaaaacttatttcagaaatgacccttttgttcggcgccaaa

SEQ ID NO: 80673 - DNA, 12961 bp, Oryza sativa
agccccccaccgccgccgttgccgagcccaccgccgccgtcgccgagcccgccgccgtctcccgaggaagagcgcgcgagcaaagcggcggtttcacgccgtcgctcgtcccaggtgggacgagttcgtccgccagttttggccggaccgattggtcccggatctgagaggaatattcctctgtagggaccaacccatcccactcacccctgaaccaaacacccctaaaaatgggttcatcccatcccatcccatcccatcccagcaaccaaacactaccctagggaagcgaggatggaggggatcggggaagccatgtgggacggagcgatgcgcgtgcgaggtgtggatggttggatcaaaccaacgcgcggacatcggacggtgcatgcatggcaagggactgtagtactgtagcacattttcctagactgtggttcatcgaatcactgctggtagtggggtcaaaaaaactaaggatttaatatgatagggggaaacatttttaaactcttaaatgagatatcctcttgttcgctcaaataccatctaaatagttatatcaataattttgacaacattcttacttcaaactactctaaacttaactcacacatcaagaaataaaaaagacaaacccaatgtacgagaaacacccaaggatcttctggctagctccaaagttgatggactagacgacttagattcgaagcctcaccatttctaattatttggtattagattattccctaatattcacgtctatttttttcaaagtcaatgtataaatagatattgcattactatttgtatctgattttttttcttctcaaagtgtagatcgagagggattagaatccattcctaataatatgtataaatcgtgacatccattttaagagatattttgcagacagagaactccaaactctggaaaactagaacttccgaacatcagaacctcaaattacaacttcaaactgcaagaacttttgagtgagttttttaaatctaacagagagctaaatatttttgaaaaatcggacattccgatgctcttagaacttccgatctaagttggttagtttatggtagatttgaaagtgaattttgagtgaattgtaaataccggttaatatttagcagagtgaattgcagtttgagccaccttttctactctataattcaccaactcactgttacacctacattacccattcatcaaatccaacgctctgtatttatcgaatccaacggctccgatcgccccacgcacactcacgcagacgccggcgatgccccagtggccccaccctgcgcagatcgttgccgcgccgccctccgccgtcatcgcctccctcacgcaccgcaccttcgtcgtcgtcgcatcgctcccgcgccgcccctctgtgattcctcccctccgcgcggccctctcccgctctccgcgtcacccctctccgctcgagcccatcccgccgccagttcatcgtcgcacgccgcatcactcggatcaatgtcgccgtcgcacgccttcatctgcacatcgcccagatcggcactcgccctcaccgcatacgctcgtcctcggacagatgggcaccaccgccgtcgccgtcgcgctcattcctccccgtccaacccgcgggcctcgccacagccaaccctgcccacgaggtaaaacagcaatgcttacccttggtactttctttgatcagttttgcattccatcaatattcctgtatcatatagtctttattgtacctagaatcagcaatgcttacccttgccactttctttgtccaatgtaatctcctttggcaagtttttgatgtaaggtattgtcctgcattttgtttcattttttcagttctctgacaggctatgttgggtttggttttgaaactctatacagtcactcgctttaactaaatagagaaattactgatgcctaaatcaattgagagtttctggagttgttaaggagtacatccaggagaagaaattggagatcagtgattcttaattatgcaattcaattccattgattaatgaaaagactaaagtgaaacactccatctaagcacaggttgatgggtgcaaatgcacttaactgttagtaattgtaggacattatctcattccttttttgagacattgcacaaatctgaaaaactgtaactatgggcctgtttggtacagctcaaactcctaaatataactccaggagctgagtctggagtggagttgtggagctgcctaaacctagctccacaactctagtacattttgtgagagagctccacctaactccactcctagttctggtggagctgaaactgtttggctgagctccagctccaggaggggtggagctggagctggagctgtgccaaacaggccctatatcttggtgttaaacttgttaatatcatctgggactttgaaatgtgtgggatatgctagagcatcatactttgtttctaagggaacaataatgagtgaactgaaacaatgagtgaaggatgcctcaagcattcaaagtcccagacggtgcaaagaaagtgctggtatactctctaatcttctcttgtaaatttcactcttgctttctctgtgcactgagcatccctcttgaatttcatttttttctgaggttcccaataattttgttgatttgcctgtttcattatcagattgaaaactaacaaaccgatactagattgtgatgattgttggacggtagactgttatgagcactacaaactgatatgattgttgcaactgccgttgagaggggctgattcaagagataatttgagctctgatgaaacagcttggaagctggaatatgcacatgaatattggatcatgttaaccaggaggtatatagtgacgttataattttcatcattgtaggtgacatatctatgtttagctataagatttcttagttaaaggtcatcaaaataaatggtgcagatcctgccactaaacaatggttagaggttgctggtgaacttgcatgccattcttcagtgatgcggttgaagttacttggtgagttaaattctgaaccattcttatggttgacaaccatgcacatttaagaattcactaggtgcatgtgataatcctttgtgtcatctaggggggggggggggtactatttccctgtattaaatatgtaacataaggacttaatattcatctctttgtttgccttgtgccttaatccgattcatcataattgtattttgttttgataggggaaagtatttcttccactgttttgcacatatataccacatattgcaggtccttctgttttggaatcagggaagtaggagggtggagcaaatcttttttgaagcaatgttgtatcaacacctcgttattttgtttgctttatgctcatatgagatttcttaagccaatcggcatgctccttccgaacatactttgaatatgacattgttcaactgtttcacaaattgatggaaatgaactaaattgttttctaattcttaaattttacagtaagctgttacctattgacaatattcccctatgcttttaggaatatgagcaattggttagcggttaagaactacttattcatagtcagaagataatgtcctacataagatgatcagaagatgtgccttttttgaagtgtaagagaatgttctgctctgcattccctttcactctttatagcttctgttttgttaaatactaacattcaattttactttaaatttgagtccctggtttagctacaaccatatattgtaagaccatactgccaaggttagcaattgcttgtatttttcttctgcaaataacttgaaatatcagcaagtaattgacccattacatacccaaacctgatgatagttccagatgaagtagtaatagctataccaaataaattattattgtttattctatttatgtcatggcttctgtattctgtccatgtacttttgtattttgtaaaacatgcagccaatcactcatgataatttgatgtaggcaataatttcatcttgccattcatataattctgcccgacgagagtgtctgtagctccccccctccctttctttttgcttcttttgcagaggctattgtggtagtaattatgttaattgcttgattgagtaaagatgacacttttcatggtttcttattcagcacagttagtcgtacactcttattggcttaagagggaatggcaatggacagaaatttcaggaaggagtccagctagagtataggaaagatgtggaggaagcaacaaaacaaattgtctagctgaaagaatcaacattaagtatgcctgtgtagattacaagcctgtggtccttattgaccattgcatacagttgaattaacggactgcattatatgctgcgtctggtaactatattgatgacagacaattattgcgattatatcgacatatataattctgtctttatctgtcattccttttttacgtgaattttaaatctaccttattctatatttgattgccaaaacgtacattatattttgcattggttgtttaatttgcattgcaaaaatattgccataacattagcacatgtatatttgccattgaaagaagatgtccgcatgcatcgagagtatggagagtatgagtaatggataggatttgaagcaaaactgactggtgcttggatctcccaaatctgaaaacttaattatccacttttgcttgtaaatatatatcctatcttatattgattggattgtccagatatctagcccaatctgctaggttgatacctatccacaatattagattatgaaaaatatatgtcacaatgttgttttaaagttgtatttgaatttattataagtaaattattggagtctttggaacgaaggtcaacaaattgggtgtaaggccaacatataaatatccctgataaatctgtgcctgaataaagttgagtgagttatgaataaggtcttcgagttgtttgactccaaactttatacaatttaataaatttatgagtatatgaaattatttttaagccaaatatacacaaatcatttatcgtgctcacaaatacatgcatatctttgtttggatattcggtttttaaaatattttaaatttatattgtaaaaatatatatcttgttttggttgtttgatttgcattaataacgaaatttagccgttgcgttagcacggacatattactagtattgataaagttttacttgaactattatttgcccaacctttacacttttcattagctaattttgtctttattataatttggatcaccccataccacttcttcagcacatcaattatctcgagcacaacaactccggtgcgcccgcgaactccacctatgtgtaggcagcatgctatacctttgcctgaagagagactagacatggttagaggagaaagttaggttggtttaaagtgtaataaacgtgaagttaactagtccaaagtaaaatatatatatatatatatatatatatatatatatatatatatatatatatatatatatatatatatatatatatatatataaagtgtaatctaaaatgaaactttaacaataaaagatgatgagaaactgcaattcactctgtcaggcgctcttattacgccctatcttaactgcaaaccatgcatgcatgtgcgaattgcaatcgatttgccggcttaatttgagatccccaagatcatccttcttctcggcaggtggtgtataagctgtgtgtttgtcacggccacatgggaactcacaatatagtatccatggcggctcttgccattggcctcctaagcagtttgttctgctcgagtaacttgcccacaggatagtttaatcagcttgccatgtactatctgaattcctgctagtacagtagcttgggcctaaagttcatcttttttggggcctctttttcgaatttctttccccttttttttcctccgtagggcagccggcaacatggatgcaggatgcagaattaaaacatttaaactgtactcctcacttgaaggaccacaaattgcttttgctaattgcaatgtatcactcttcactttgtgagtgggaatggcactttcagaaagacagagaaaaagattggtttgcagaaacataaatcagagtttcagacttcagcaggttaattcagaaaataaaaaggattagtcttgactgctggataattttcagtttaacattttagcatcagaagtcgaaaattcgtgtgagctacttactataatgcagggacttcgttgaaagctgaagctagcaatggtagctagcttctaagctagttaattagccaaaactagtttaattagcagagtgaaatctgacgggtaggtttgtttagtgttttgccgggtagaaaggcttcaggttgggttaaattaggctgtttgttgggggattaacacttaacagccgcaactttagaccttagacacgccacccggcgaattatcagcgctaatgacatgccattagcgtttgcagagcgtggttaagtgcatgcatggacacaattatccagcgaaagcaactgatgccaaatctttgtcgacgcacgcctagccctagttcatgccactgataatcaaccttctgtcaattaagttacacaatattgtataagaaccagacaagcagaggaagcaggcagtactgattactgaatcctgaactgatgacagagtgacttgtctgattcagagagattctgctgttaattaggatctctgacactgttgccatctgctgaaacattcccaaaaattttagctacctcgtactgaatgaactggagtatgtgtttctgtaattctgtctttacatgcaggttataagtacagtttcaggttaacttcgagcatcagtaacgggaagagaagagagaagcaaatttgttcaggctgctgaacatatataaaaggacactctagctctgcactttcatgaaaagaagttaagaacatcatatatataatcctttgcctaattgactaattatatatcagcataacacctgtcccactacttgtacaaaaccctactcttctcttctacctcttgcacaagcacaagaacacaagaactcggaaatggagctgaacaccagaagcttgcagcaatctggtagcagcaagagcaagggcaagatcatggcgaagatcgtcgaggaggatgaagagggggaggaggaggaggaagaagaagaagatagccttagctcaggttgtcactgcttcttgtgcgccatcaaggagcctgatgctcgcctccgccgcgccagcctcgccgcgttcttccgggagttgccgtactgtgaggatgacgatgccggcgccggcgccggcgccggcgttgatggcggacggtcatgtggtgaggtggtcggcgcggtgtggagggcggccatggcggcgcccgacgacccggagctcccgtcgctcggcgcgatccggtgcatgtcgctgctcctcgctcgcgcgctcgccgacgtggagtggcgccgccgtggccggaacgtgtacgtgccgtactacgccgcacacgtcattggctcgtacaccatccgctcctccgcgcacgccgagctggccgtcgcggccggcgccgtgcggccgctgcttgccttcctcggcggcgccatgacgtgggtcgagcagcgcgcggcggcgcgtgccctgggccacctcgccagctacgacgccacgttcccggccgtggcacggcacgccgccgaggcggtgccgctcgccgtgcgcgccgcgtccacctgcgtcggcaacgtctacgcgagcttcgtcgcgctggcgccgagcaagcggccgaagtaccagcgcgatctcttgacgcgcgggctcgacggcggcggcggcggcgtggtcgccgacggcgaggaacggaaggcggaggagtgggcgagccagctccagtgctggtcactctacttcctgagctgcctcgcctccagggacgtgtcatctcatgccacgatatgccatgaccccgtcttcttgcgcgagctctgccagatgtggggtggcctcgccaacggcgactcgccggccggcgtcgggctgctccgccttctctgcaggagcacagccggacgcgccgccatcgccgcatgccgcgacgcgctctccggcctctgcgacctcgcgcggtcgtccgacgactggcagtacatggccatcgactgcttgctcctcctcctcgacgaccgtgagacatggcacgcagtcgccgacgccacggcggcgcgcctcgtcgacctggccgagctccggcacctcggcccaaggcgacggctcggcaatgcaataacagctgcactgcttcttgacgacggcgacgacgacggcgacattgtccatggccgtgagctcggcatggaagcaaaggaggcgatcgccagattgagagaagtgcaggtagagaggaaagggagagaagacgccatgtctagggatgagctgctcaagagaaggatcatggcgaaggagaagaagaggcaaggcaacgacatgttctggcacggcgaggtggagaaggcgatcgagctgtacaccgaggcgctggagctgtgcccgctgagcaggcggcgtgagcggctggtgctgcacagcaaccgcgcccagtgccggctcgcgcggcgcgacgccgacgcggcggtgggcgacgcgacgcgcgcgctgtcgctcgcgcggcccgcggcgaacgcgcacgccaggagcctgtggcgccgcgcgcaggcgtacgacatgaagggcatggccagggagagcctcctggactgcctggccttcgccggcgcgtggctcaaccggaaggacgggacggcggcggccgcggcggcggcgtcgcgcggcgggaacccgaagctgccgtactgcgtcgcgcggatgatcagtaagcagatgggcttgacaggtctcttctccgccgtggcgacgaacagtagcaccaccaaggtagatagagatgatcgcatgccgcattacagcgacggcgacggcgacggcggcgacagcgacgacgaggaagacgacgacgacgacgatcgtgatgaaagcgaggaggaggaatttgctgagaaaggaatgaagctttgtaggccaggtagtagtaattaattaacctctcgagcttaatttacctatgcaactactgcatatacatgtgttatgcatggttaatcttgattctgatccaaattggttaattatcaccgatgatcaaagtggctaatcttgtttgaccaggtaagggtttaccaatcatcacggacgaggcttggaggagattagctcggaggaagaaggcaacgagccgagtgttgtctcatgatcatcgattctagcttgatccattgaagaaagacaagtagacagagacagatagctacagttcattgatcattggtcgggatgaatgatcatgattcagcaattcgatcagggcttaatcgcagacttgttgtcattagctagagctgatgtgatgggggtagtggtttaatttgatgttgacgctggcttagctatactttctagctagccttgcatttgtagtttcactcacgtgatcaaatgatgttcccattgataatacttccgtatctgtgctagatctctgttatttcttgcaagttagaagttgtcaatgtgagaatggccgatcgccctatcgaattggtgaaagcagctaagctacttgattcatagaaatatcctattattaggtttttcataacttgaggaaatgtttcagttgagaatttctgaagaaattattagcttcctgccaaattaattaatctgatccatgtcagcattaataaaacaataattaattataggaaaaacatcggtagcgtggttatatgatttcactcatcaaatttaagcatagtgttaatgaatattacgcacacgttaatgcgctagctctcaatagaacttttgtgagcctaaggatttaccaatgatcttttttttagtgtgtgttagtggctaaggatttgccaattatctttgcatttttagcgtgtttggagggtgtactcgtagacagcattgtatgtacgcatccgtcttttatgtaatcggaaaaaaaaacaacaactcattgaaatactagggtatcatttttgtcctcttcacccgtttgaacttttacttaaacacctaaaagagaccaaacacacctaaaagagaccaaaccttaattccaataaattatatcttctagcaagacattcaccgaggattaatcttaaccagagaacctgcttaaaattggcaaatgaaacaaccactaacacattgaactgttgaactctaacaaagttcaacagtttgttaaaagcacatctacatatgtgtaatatttatgagtaagatttaaatcttagtggctggagccatattccatccttagatgcctcctccatcatactacctccgtcccaaaataattgtatttctaggattcaaaattcgtcccaaaataattgtaattctagagtactaattgccccatcaatcatctctcatttaaatttctccctattttaccctcaaccatcttcctactctcacataaacaccatttaatgaggggcacaatagtctttcttctcaaatcttaatatatgctaaacaacatagaattacaattattttgggacggaggtagtaaaacatttcttttgcgatcacatggcagatgtgcacgtatacgtactactatacatgcaacaccacactcacacacccacgaatatgcaccctaacaaatactcaaagagacgaaaatcaacggacattcctaatctcaataaattcctgttgaaagcacaattacacatgcgcaatatttgtgggcacttcattagtaaagtacttcactcatgagtcatggctccaccaccacatcactggtgctactccattataataataatagttgccctataataacttaaaatatatatctgcactagtaattactcactccctcccggtattcaaaatttatccaaaaagcttgttagtttagagtatattttgtcacatcaatcaccaccaatttataattttctctattctactctcaactatcaactatatacacaccatttgatggaggatattatagtctttttttctaaactttaatttttgctaaataacctagaacgataactatattggaacggagggagtaagcattaaggtctattctgactctgatttatttttcacattcctacgaaatttgaactcctatctgaaaatccagtgaagttccagacgtgggcatgaacagaaggatcggatgggatgagatgaacagtacatcatgattagaggattgagggagtggcgcgacgtacagaaggcgacaaggacgcatgattagccaagtgccgagcatgtcctgacccaataatcgactgaagaatgtggcggccgtacaggcaaattgagcgtatcgccaaatataaatcccgtgcaaaagctgagccgtgatgatttgattcgatcggcaggtggttactgggtactaagccaggactaaaagcggttagtgcatactaagacggtactactaaaagtaattatttttgtactaaaaagtgctttaagcgcgcacatgacgagcaaatgctagtggcccgtggccgctttccggatatagcaacctgggagcccaacttttcagtacagaatttacatttcttagcttagcctcctgtagaacagtagaagcatgcgaatagattatagtgaaaaattctggaaataattgggcggtatcacctttttatcattggttcttttgtaaaattgtatttgcagctttgatactaataattcatcaatacatcaacgtaagtcattgatcctccaataacataagcgccggcacctggcaacagtgatgacagcaacaggcataggaaaaaataaaatatctgtaaagtcatgtacataaccacaagacgcatgtgcgcagtgatcttgaaacttcactgtaacaacgatctactgttatctgaaaccttatcgatcagaacaatctaaaggatgaaaggaaagtgaagaaataaacaggcctaaatattaaatgcaacacagatgattaatctcaacatagatccacccacttccatttaacgatttcattttgcctcagcgcaccacatagttcctcaatcgtttctaatgcatactacacagagatattccctctgttctcaacaggggctccacgaactaaagtagttaaagttatcaatgatggacaggtcagatctcatcgtcttcggtggcttcatcatcaacagcagagctgttcccgttagcaggctccaattgcttgccattggaccctggggacttgccgttggacttattctttgttgttggttttttgcccttctcggcttgctgcagctcgaggcccttagccgacagcctccgcctcctctttgagttcacggcttcagctggttcttcagcagtagaattatccactgccagagaaataaaactaagaatgatgcccatgtttcagagaaaatagcagtataattgacggtggaattatcttgaatgaatacttgaaacaagatcctctttctgcctagaaatacattgtcatttattgccaatactttcaagttattctagtttgcaactttgcatatgatgacctgtagttttctttgaataacatggtttcccaactgtgcatttatattatacatatatatgaaatgagtaaactgctacaattttgttcaattaaactaaggaccaggttcaatttatatctcaccataatgactgcactacagtgttcccttgtgtgaagaaa

SEQ ID NO: 80674 - DNA, 14775 bp, Oryza sativa
ggtctgagtgcattgcagaattacgtcaacagaacactccaactcggcgaaatcaaatgaatatttcagatccctgtcaaccagtttatccagtttattttcttccttgacttctctaacctgcagagaattaagattaggtggtaagaaagtatacaaggatatgggcatcaaatgacagtagttaggtaattagataaagattgaactaaaaggagatacccaatctagaatcattcccttctgagattgcgcgtgcccattgctcaaggttttaggcccagtgatcagttccaacaagagaataccaaacccataaacatcggtcttttctgaagactgtcctgttgataaatactctggagcaatatgtccaatagtgcccctaactgcagtagtaacatgtgattcttgtcggtcaagaagttttgccaatccaaaatccccaacaattgcttcaaaactttcatcaagcaaaatgttagctgctttaacatccctgtgaatgattttaggattgcattgttcgtgaagatacagcagtcccctggctgccccaacagcaatccgcatacgcttgctccaatcaagagatggttttccatgatggtaatctacaaattaactttgtgttagtaagagagtgaaatggaaaagaaatgataggagaatgatgcaaaatcaaccaacacaggatcacaacacacatctttgtaaggaagctatcatagttttacataatcatcattttagcttttggatcaacaacagtctaccttcaataagaactacaactggaaactggcccagctatattaaaacataaaatcaaaatttgttttggacgattgtaattacctctcaagcgatcagcaacactgccatttggcatatatggatatacaagcaacctttcttttgaggtcatgcagaatccatataaccgcaaaaggttcctgtgcacagctagaccaatcaactccacttctgtctgaaattgaacttcaccagtaatatcaggatcttttagtctctttacagccaccaaagctccatttctcagacagcctttataaacaacaccaaagccaccttgacctaatatgttctttgagttgaaattgtcagttgcactctgaagctcgtgaaatgagaagtgctttagatggcccaattcaatttcaagatcttggtctagaagtaacaaaagaaaagaatgtttatcagatgctatatattctgaactctgcaataagagagtagatgcttaaccctttgaaaattaccagcagaagcaaaaggcaagcgccatctgcaatattttagccaacaaatgacaaacagaacaaatactgtggcacagatgatgcttaatgaaattgccagagctagttgatgatggctgtttgtttttttcgacgggctagaaattgttgattctgcaaaggaaggcaaattaggtccaacagataaatatgcaagtatatgacatcaggtaaacaattaccattagttaatactgtgagatctttgcaaccatgcataattgatgaattgcaaaggaacctgtttcctgcaatactggaaatcagaggaaagtgatcatcaggagggtattaaaactgatgagaaggaattatgtgcatatgctttgggaaggaattatgtgcctacgcttagtttagcataagaacacagaaaatatgcaggtgccaaacactttggttaagcaaatggaaggaaataagcagagcttatcgtacgcactctcaccaacttacctgtagtcatgtgcatagatttttggaaccgggccgctcaaattattggatgataaatcactgaaacaattttcccatgttgggtaaaaatcaataattacgtttatacacaacatttataacagaagagagaatataaagtggtgaaaagagacatacaggaatgtgagacctggaagctttgcgacatcttcagggatctgtccagacaagttgttcttatctaggcgcctgaaggattcacaaacagaagtcatattttgggacaagcaaaatatgtggcacaaaatttgaagcaatattttggcatctgctcacagatagtttaattcagtcagccgccctagagaacttgggatttcaccaacaaactggttaccagaaagatcaagagctttcagattggtcaacttcccaatctctggaggaatgccacctgatatcatgttattctgtagtaacctgaatgaagacaataaaaatgttgagtaatcaagtaatggtattttgtttcattttatgaggacagacagatgtcaagcaaacaagttcatgggaatcagtatgaatacacgatcaacttaagtatatgacactgcaagatgtaatatgctcatgtccttacaaataggatgaagacaatcaaatgttggacaaaccatactcataaacatttcaatgttatattcaaatatgaatcaaatgaatattctatagtggtcacatagtaatagccttcaatccacatatgcagcacagttgatcattctgatttgtagggttagccaaaagaaacatgaatctctctacagattaagatacatttctactaaagcagtcagttaaggtgacaatatacttccagactatttatatactaaaaataataattgctatagaatctgcatataattttcacgtttgggtctgtagacaaactttggttatgaattctagtgctgcaaggttcagaaaaatgtttatagaacagaaaatgcactaattagtgagtcatgattatctcaactctttatatggatctatttcaatgatacttagaccaaacaaggtgagccgcacattcattattaccaggccttgaatcctgagaatgtcatttattataactaataggaagtgtgacttgctcacatgaaaatggtgttccaatgctagcattggaaatgcttcagttgtacgaaaagtgtcatttgcccacatgaaggtctataaaaaatattaaaaatggagatgccatggcatggcatctgtcccccactcttttcagatgaagaaaatgaaattttattcagaggtgccatgctatgtcagctgtcatctctcaagtgatgtattttacacatctgtcttggcctggctctggagagtaaatgttcagtgttcacggaccctacatggagttctcctaagttcaactacaagagacatagcccatagggtaatgccctcactttccagctctttaactatggagatatcaatcgatcaatcaccaatcggatggtaccaaatccaaaacaacagttggggaaaactgatcctaccaacccagctcaactaattttgcagtgctacgactatgagacaatccgtgctcactaataaatgcattaatggaacaagaacaaaacctttgcatttgataaggttcgaatgaattcgttcaagaaccccttacattgtctgcaggtggctgaggttcccgatgctcggcgacagcgtcccggccaatccgttgttcgccatctgcctgcagcagcacagcaatccaaccaaaaccgccataatcaacaccaccaccacgagcagtagcagcagcaataacaaaatcccacgaacgaatcaggagaggggaatcctcacagcgagacgacgaatccgtcgggggagcaggcgaccatggaccaggtgcacgggtcgacggagttgatgtcccaccctcccatcacccccttctcgtcccgcatcctgctcttcaccgccatcagcgccgccactgcaaaaaccccccacatcatatcaaaaccctaacccacctagggttcccgttccccaaccaaaacccacgctacccaacccacgcaccttcgtagttgagccccttgggcgacagcggcgggtccccggcggcggcgacggcccacgcggcgaccaccaccgccgccgccacggcgagggcgcggggccccgccatgagaggagtccgacggcgacgccggggagggcgaggaggaggccgcgcgggcgcagcgcagcagcggcggcggaggcggaggcggtggcttgaggtgggctacgctgcagcaggagctcgggcttggcggccatgggcgcctgcgcgagtataatactgccactgtatcgagctaagcgacgggggtgcttagcttaggcggggggtgtgattagattagagttaagattaaattagcgcaatttggttgggaattgggcatcttaattacgaaagagatcgctaattgggccttaattacgtttatcgcgagtggaggcgggtggctctctccctgcctcgggaatcgcgctcccaaaaaaggctcccgatttttatttattttcattttcgttttttttgggattcttttttgttatttgggtcggtgagaaatgtgaaattgtaaataggtcctcgaaattataagtagctagggaattggcgcttccggtctgccttgagccctcctgttgttttgctgcttgtttttttactgctcctgattgagctagctctgacacaacacaattgtttgttctctttgggaacactaaacatttgtttccttgtgacagtttctagacaatttaacattactgtatgtgtggacaagagggccattaaaacacagtttttttttttttgtagggaaggagggaagaaacaaacaaatgatggcactggtcctagacaacagtattggtagttgagaaaattgagcatgcagagaaatgccagattggtatcgagtcccatagtgcaatttggtttggatattgaagctacagagggtgataaggttaattgtgttttcattttctcgatattttatagctcaatgttctagtacattttttcattaaatctatgacttgccccgagcttaatgtatatccatatattatactcgttacgaggctggcctatattattataggtgggcgaggcatcaatagatgtaagcagcatatcgcgcatatcaaataaatttaataccataattagtcaatttttaattgtatctagattcgtgaaaaatcttagctattattctgtacacaacggacttagatatcttatatattgggcgataaacaatctgggtagcaacagctaaccactcctacggtcctatcatagcttcgatgtcaacaaagatggagccatagaggaccatctcatgtgattgcaactagatttaggtgctatccacaaggagactaacaacacctgtatttagatccaaatacatttcgtcatcactcatcagtacgatggagttaatcacaaaatcttttcctctgcatttcattgtcccctgaaattttctgtaaggcactttatcttgaaaaaacacgaacatgtaaatggagaaaatgtgtccttggaatcaaaagtttataaggaaaaagcatattttacatctttaaaaagttcactttcatccttcacctgttataaacagatgtgatttgtgccatgtcagccaccacacatcaccacaagcaccttgccatccttattgcttactttaccgtttgttctccgcagttagaacaagtgcaataagatttggctgcttcttctaaaagtaccgattaggttgtggtggagaagggaactgataaggcagagaggataagctgtttcttatgcaaatacaacatctattaatctttaaaaaagtgaaaaacaaagtgctaaagagatttatcattttccgtgtgcatgtttcccaaaatgctaaatgttactttttttgcaaacaacattctatacgaaagttgtttgaaaaaaataatattaattcattttttaagttgaaaataattaatacttaattaatcatgtgttaatggctcatctcgttttgtgtgtatcttctcactcttctcttttcccctcctctcaaatacagccagtgtgagagcaaacaaaataaataaaattataccataatattatggtttatgaattagagatgatatgttaaacgtgttgtgacatcccggcccagggcttaataggattaatagaatactcatatcaacaagttgcaacttcttttccggaagccgatctccaaagaactcctgggtgtgcacgagtgaggacaaagtgtgccaacttgtgttagtctgtgaggacagtttatgacctataaaagctatcatatgtaagcgggccgacctgggagaggataaaaaatgtgagtttttcaactttaactaatatttagattataatttatagaactacatattatcagaatctaggtgagaatatagattgcttaggggagttaaagactggattataatttatagaactacatattatcagaatctaggtgagaatatagattgcttaggagagttaaagacttgagaggctcctctcaaacatggtcatttcttctagaatctagagctcttcaaacagtctagacttttgttcagattgtgaaaatatgtagttgtagaatatagtaaatgaattagaaggaaaaaaattagcattttcagattctcaccagttagcttctcaaaacactcaagctcttcaaacagagctaaatatgggagtgggagtaatgtcttggttagtgggattaatgtatggtatgttaatagattaatttagatgcaatgtagcctgggatgcgcattagtccaagcatactaatctccggtaaatgttgcccaagacgaagacgagagcacaagcacaaactgcttttgcatgtgtatggtctatcctgcctgatggtagtacctactgccaagccaaaccagggaaaccatgaaccatcgtcagtactttcatttcggcttgtatatgtccacaattgtagtgcaaaaaccatattgatgcattgttaagaagccgattcctgcgactgtgagaccagctcaatcaacggccttcagaaaattcagattaggccctacaaaatctgactccacctgctcaccttagaaatttgcagcactgttttgttctaattccaacttgtcagttgtcagaatcgtgattattgaccaaagaactttgaaatcatgcaggtagacaatgaaatctggggacggtgtgaaatgaagaagtcatcaaagcagcaaaaataaaacaacactgtatgtatatgctttgtttacagacttctataagtttgtagccttcccatagtcaacagcaactggaaaaaaaatagctataaaagattaatagagcaggtgtgtcagcatgatgataataaagcaaataaatagtgttctgctcaaccacactaaacagacagcatctctattgatgaaaggaccagccgacacaaccaattggttctcaactgttgcttttattctctcaatataggattggtgcagacacctgccttaaatccttacacaactcacaaatgcagacctcaaatatattactcatttatcaacaattttatcctagtattccagtgacaatgataatcacaacattcatctttgcagccaacagatgaggaaagttctctgaaccatatggtagaggaaaccagtagggggggggggggtaaacaagtttgggcatggggtatcataacaagagatttttccattaggaacatttacacaattacatcgacaatagggcatgagaaacacttacaggggcactacaacattaatcgtgggagaaagtagtacagtacttgggatctgatccctttcaatagcttaacaatacaccatccccattccctccagctatccccacagtacttggctaatcctgaccaccatggcctcctaataatggaggagaagcattaaattaacatgggttggctgtgcctagcacacccacctcatataacacattggcgccagctcatgttcagcttcccaataatggtcagattctacaccttaaatgtgagaacatgcaagttgccctttggcacaaacaagcatcggcttcgcaaagtaaaaataccatccagctgtcctatggtccggcagcaggcaagaaattgaacccacaatgtcaccgagcatgctctggtatcaacctgttgatgagctctggcgataaattcgctagctgcaaatgaacaagcaggcacataagtcggtcttttcatcttaacttagtatttttgttcatgaaaggtatatctgcctagaaattacttacttcttgcttaaagttgaacagtggggggaatggacgtccatttggcaaccttgcgtggggttctcgcaattcatcaaagaatgaatgtgcacatgcttcgagctgtaaattgtaatggtgattaatcagcatattgcatgaagttacactggtatgaattcgaaaacactgatcatataaattcaagggcagagaatggcagcattataggaatgaaaagtaagatagattgttgtggactccatattcacaagaacatagtgaacatgagaaatccataaacctcttgttcaaaaaactgaaatcaataaactggtagaaactagaaagataaacgaatatattgattattttttttctgttcctcctcgaaaacatccacgcacatccaaaataaagggttaaacataatctttccttttgcaagaatatccgattaaatgctgtacacctttaggagagaattaacaatgacatactggtgttatccaacccaaatccaatgattgacactagttttatacccacaaaataaaggatgcgtgaacaaataaaatatattgattattgatagaagatgttaacagacgaaaactgaaagtgatgggcggaacatgaccaatcaagttgaacgaaacaactaatgccataataatttggagcaatcattaataggtagatggcttcaacagttgacttgaatcagtcaaacaaaatgagatggaaaactcacggcagtgcatcgtagatttggtgcatactggagaagacgtgatgcaaggtcaattgcttctggaggcatccgcttgtggaaaatctgcagcataggatttgcaggttgtaatatgcactagtatcataacatcaattaaaaaaatggaatgctaaagtaaacaaaacaattctaataccttgtgccatgggtgagctttaatctgaggaaatctgaattctgtgtagttgggattcatgcagcggatttcctcacgtgttggagtaccaagaacctaccaacaaagaaaattcattcagtttatgaaaatagaaaaacattaagaaattttctttagaccgcatgtactgtagagcagtgcctaacatactacctttataatctcgacaagctgatccactgcactttcaccaggaaagagaggctggaaaaatggacaaaaaagatgtttagttcaaagtttgctatagtcaacctgataaaaaaaaacagtcaaagaagccacaaacaggaaataacctggccaaggagcaactcagcaagaacacacccagctgaccatatatcaattgatgtcgtgtattcggttgccccaaatatcagttctggagcacggtaataacgtgaacatatatacgatatgtttgcttcacctttaacctgcccagcgattgaatggaaaagcagatcaaaatgaggacagtagagttgcattacagcaatataaaagaaaaaagaaatacagcaatgtgaggttgatccagaaatgcactgtttttccccagtttctaatttgtccacatgaaaacagcaagaagatattcttgcaacaaaacgaacaaaagatctaatccagtaatttaaattatgtaaatcaaactgctaaatataccctcttgaaaaccagaaagaattgtgctatacaaaaataaaataaaataaaataaaataaaatgagctacttcagtatttaaatcatgcgaattaaactgctaaactaaaccctctccaaatcataaagaaccactccaatataaatatctgtaatcaacactaaaatgtgcattaactcaccaacatttttgcgctcccaaaatcacatattttgacttggtgagtaagaggatcgacctattaaaaccaatataaagtaagaatcagcttatattcagatactgttaaccacaggttattaaaatatcaagcgtgaaatgaacataccaaaagattctgaggcttcacatccctgtggcaaactccaggtacagtatgaatgtaagccaaaccacggaatatctatacagaacagacaagcaatatcaatatcatgaatacaactatggaaactaacaaaaagtagtaagcaactgtattgtcaataacatcttacctggtaaacatacaatttgacatatataagtggcatcctttggttcatgttgctataatgcttcaacacacgatacagtgactcaggaacaaattccatgaccaggttaaggaaaagttcatctctgcttgttgtagagaagaagcaatgcttcaaagaaacaacattgcaatgatccattgatcgcataatctgcaactccctgttcttgtaacgcttgtcctgtaaaaccttcttaatggcgacagtctcaccagtctccaaacattttgcctgaatgataaaagaaataccaaataagagacaaataaactttaaaggaggacaatgttacactgcagaagtttacctgaaagacgattccaaatgatccagttcccacaactcgttctgccatgtagctaatcgtctacagagcacaaaaatcaacccaagttagataaccttacacataagattgaataacatattgtggcttccatttatgttataatttacccttttaggttctccattcttccctccaatcgttgtggagattatgtggccggtgacaggatcactcccttccataagagaagcaccgtgctgtcatgtagcaacaaccagtgaggcaaggcagaacatcaacaatcaacaaagaaagaaaaaccactaaaacaaacaggttcatgacatctactgcctcaattatctaaagcggcagcacatcactaatgattccatcccatagcactagaactataaatccaagcgatacatactatcgacaatctcctggattgcttcatttcaaggagcttggaccaaacaggtgacacaaatgtgctgacttggcacggctgattactgcaagactaactgcataccggcatttaccctacgaattcataacaataagctagcaagagtcccaacaagactaatcagatgacttacaaaccttgctaatcgccccaacaccaaacatcgcatcgcgcgctcattcaagggctcaactcaactgaatgctcaccaccaaggcgctaaccaactaattgccccctcactagaacaaattaaaccataaacaaccataaataagtactaggaaactagtatcatcaagccgtccaagtttggacgcagctggtgatgggatggagaagcgcttgcatggcgcacacgcaaaggacaaccccggaggagggcagcgcatcccctcccctcccctcccctccccgccaagcaaacgcgccatgctgcgtcaacccccaccgcccaattcagctcgcctccgacctccgagcacgagccggcgcgcaaaccagggaagcggaacacccacagatctacgacgcggaccaaaccaaccgcggagaccaaaaccacctaacgcgccgcggaagacgaagacgaagacgaagagacggcagcagcaagcaaaaccgcagatctggaacccccccccccccagagcaaaccaaccgcaagtttctccgctcaccttttcaccggcgggggcgaccgctgcggcggccgcggcggagcgcggctggtcgacctgcatcgggtccgccgcggcgccgcctccggtggggtggggcccgcccggcagcgtggccatgggggggggggcaaatggagcggcctcctctctctctctctcctcctcctcggcttctctctcctctcgtctcctctcctctcttctctctcctcggcgaggaggttggcttggcttggcttggctaggcgaccatgagatgagaccttccttttttttcctctttgtttttttattcccttcttccaccacccactacaggaagacggcgttttttcatacaagggcttggagtttcgggaaatagcaggcggggtcggcttgtccgaagcgaggtcttacatttcagcccctatagggagctatttgtgaattttgaatgttttaagggttttgtgtaagtttgtgagggggggacaaggtcaatctgtcagtctggcgcttggaatctcccatgcggggattgagaattccgtcatcttttcctttttttctggtttacccctttaggaatttggaaattggatattatgccctgaagattatttgtagctttccgttactctaggcataggtttagttcgaacgtactttgttcgtactaactcatttcctcccgtgcgaaaaacgagttatcgcacaattaagtacgtaatccctcaatccaaaaaaaggtaacctacgaaaggatgtacccgtctagtatgtgcagattcattatattagaagttttttttccggagggagtacttgttaaaatgcttgataaatataaagtaaattgcatcatcagtacacgaatttgtcagtaggtgcaatctagtgcacgaacttgtaaaatgcttgttttggtgcataaacttgtctggtgcgtgcggaggaaggcgaaaaggacgctacatgactaatcttattgatttagaggttgattaaacatatatctgagaaggttgcaattagacatgcacatcttcaataaaaaaaatagaatatgatatagtgatagtagaaaaagatgaagaaaaaccaagcaatgccaacgatattttggtcctcgtttgcacgaactagacaagttcatgtactgaaacggatatttcacaagtttatatactaaattacacacatctaacaagtttgcgtaccaccaatgcaattgactctaatattattattatgatttttgaaacaatattttatagaattttttttaaaaaaataatattgcttggtattttgggaagtagtgcgcgaaaaatgagagagtaaaagataagaaagaggagtagcgaatacatcttagaagtttcgaaagccgtgttaaaaaggatcctccttgtctgaaaggcgaaaacagtgtaggaaggtgtcatggttacggataaggtaccttatattaattctacgatttatgaaatatacagatacgtcacaccttcatatgcgtgatagatttccgtatacgataagaaaatcgacaagagattatagaaataatcctcacggatagaaaagggttaggattatactatatcatgtaaggtctgaggtttccgagttctacttggagactaaggggattcacggtataaatacatacccgctaagggtccagggtatcaaataatagcaccagccaacccgccaccatagaagcaatccagagtacttgaagcctactcgccagtagatcacgtcgagactctcttgataaggatctcgctggtagcctcagaatcagttgttttctattgtactatgtggatttttatatcaatctcatataaactagattagggctattatcttacgaggggcctgaaccagtataattcttgtctttttgtttgctcgatgtagaatcgtatagatcatcgtagcaacgtaccccaatacccatactattcggtctacgggtatccccgccgacaggaagaaaaaatgaacatgaatatggacaactatgtgaataaaagtaaggaccctttcctctggaggaaaaaacatagaaattttcaaggattttaattttcaaggattttttttatgaaagcctttgaaatagagggttgaatcctaccctatcctttgaaatacgtatggaatggacaatcttataaagatcttacagaaaacttagcaagagctccaaccttttagaaaattttctttgagtctatctctcttatctgattcttgtgttcttcttacggtccaatcaaacgggttttctacatttttcctgtagtttgcaatcatttgttttgcacttgcattttctgtcagaatcctatattttttttattcttatgttttttcattcttataattcaaaaaggtccttttgcaggtattttatcgggctaaattttactactattctaattagaatctccctaccattttacattagccggatatttctatctgcttaatgaaatattcgtggtctttaagaaaattcttcccactgttatctactccgtactcctgtattttttttcgaatataaagaagtcgcgcacgttttgcgtggtctaaggatcggtcgatttcaatacaagtacagtgaattgcgtggtcctgtttgggaagaaaacagctgcatggtctacgatttgcatttgaattattttaaaagagataaattcatgtgagaacaatatcctacgaaatctactttactactcttaaatatctacaattactttactaattcatgtgagtaggagtagtctagtactcggtgtattgcatgtcaacgtctcataggtaacgtagacaagtttttacacaaatactactgtacttcaaagtcagcaattgattggacagctgatattattgattgattcccaccagactttgttttcagtatgt

SEQ ID NO: 80675 - DNA, 15813 bp, Oryza sativa
ccatgagacgcgtgcgagagggaaagatctggggagcggaggcggagaggcgaggcgagctatggtttggattggatttgcggttgcggtggtcggggtagatagggaaggtggatattgaggtcggaatcggaagggaggaaaaagtaatttgggtcggaaaagggaaggaatctgaagacgaggcggagaaggggagtggtcgcgtcgcgtgctccccttctccgcacgcgaacttactttattaccctcacacgttttcaatgtctccgcgctccgtccaggggcaattcagtcttagtactgcatctcggattgtgaaggtcaagcccagcccagtaatggccttgggctgtggccgtgctgatggagcaaacggacgggatattttgggcctgcatgcgaaggaaggaatgattcagccttacttaacttcctgctcaggatttggttttgccctcccctcaactaagtagtagattctctacaccatacatgctctaactagtgtagtgattattttctttttctaggcaaggcagattatattaaataaaaaataaattataatcttcttcttgttatgtataacactaaacaactccgacgcacgccaaaaaaaatactaggaacgagtatcggccaccatcttcatcaccctaaatatcaacaaaccggtatcaccaaacaaactagtgccccaaaccatagaattggcacggctaattggatcatcagcaacccagtagacaagcttatcctaaatcttgttgaagaccttgtgaaaactatataaactctaaataaaaaaacctagggcctgtttggatgccagggctgcggctacgccgtagccggcacgaacagtgccgcactcactgtgcgcagctgcagctctcgcagtcagcctgtcgaacagcccctatataatctaaaagatcaaaccaaccaaaaattattcacaacccccccccctctgaaagttggggttttttttaaactatttgccatcctctttaagtgtgcattcccaaatgtcattctcttcatcatatttgattatttgccatccagacccactaggttgttttcggttttgccattcttaggctcttcgctgtcagcaagacaggtaggaaatgaccttgatgccctctaatctccttttctctatcaccttttccccgagctcaactatagccatctcatgctcgcctgcccaagtcaccgtcgagattggtgcatcttggcatcctcaaggccttctaggtcaattcatggttgtcgagctcacccttggagccaaccccgggctccatggttgtggaagaaaacggtagcaaaaatcactaaaacttactcaggtatatatagtaggaataagtattaaaaagacaagtgaaagttcgtcaatgacacggcacatgtttacacctatagaatgttaatcttggggtttcctattagctatgccagggatgcaactgacgtgtctcagcgctagctgcggcaagcccccttatgtttaattttctatgataaaaatcataaaataggtgagtggtaaaaaaataaataaaactattaattttgagctgatttttaaaattttgaattgaaagttaaaatttaagttgaaagtttttaaatctgagttaaatgtttcaaaatgtgagttgaatgttttcataccttgagttggaagtttttaattctaagttggaagtttcaaatctaaacttaaaaagttttcaaatcttccaaatcctcagttaaaagttttaaatgggaaaagagaaagaagattagctgaactggttagttctttgtggtggaactagtccacccgagttcgaatttgggtgctcacatttatggctaattattttttcagtggtaggcaacgtatccatcgacagtgaggcgtttatgatgactttgtcaatctcaagatatgccggtacaaatttttggaggtgctcatatgtgtggggtgcgtgtgcgtgcgcgtggtgtggacacctgggtatgtattattttctcaaaagaaaaaaaaagaaagaaggttggataaggtgtgcattacttccgattgtagctggtatgggctaatataggattgctattaatcttaccttaatccccgtgtgatgtgtggcatggcagattaataagattaataagacggagcgtgcagtatattctgtgatgagatccatccatgtgaatgtgcaccatccagacccgagacgtaacgtacgtatacgcacctacgttaggtagggaaagacgacagcttagctatctatcccgtcttccttgctgttccagttacagatcggacggcacagtcagcgccaccctttcctccctgcgcgccgcccccctactctactagtattataccatctgtcaaatcatcgtcatcgtcgtcgtctcccccagttgttgtgatcgccaattcatccccgccctgctgcctccatccaactcatcaggaaccaacccatcgatcgaccatggatctgcaggaggcggcgatggaagccaggaacggccatcggatcccgccgacggaggagaaggtcatcatcgacacggatccagggatcggtacactaattctgatttctccacttctcctacctgcatctgtgactgtgatccatccatccatcttgacaattactaattcatatcaattcccagatgacagcgtggcgatcatgatggcgttcgaagctcccggcgtgaaggtcgtcggactcaccaccatcttcggcaactgcactacctcccacgccacccgcaatgccctcatcctggcaagcttattttcttttctttctttcaccatgccccctttgcctcgccttacctgctttatcaaattaatgagattactcaactgaaaattgttcatgtacagtgcgacagagcaggccgtcctgaggtgccggtagcagagggcagcgctgagcctctcaaggtaaggtatttacatgttgtactccatttcacttactactactccactctaattgctaattatttcttcattctatcatttcgcacatatgtatatgcatcagtggttaattaattgccatattatatcatcaacgcttttactgactgaatcattctagtcaagctcgaacctttcctgcacttttacatctcctgcagcttctatatttgtgcctgttttacatgcaaaagtgcacttctcttttttttcttttgacaaattaagttagttagtgctgtgcaaatcttcagagcatttgctgaaaaagctctggtataccacttcgcgaatattcacaatccatcgccttttcctcaagttgccttgtttattcagctatgcagtggatttctgtataaataaagccaacctttgtgtgttgcagggagggaaacctcacgttgctgattttgttcatggatcggatggacttggtaacacgtcctttcctgatcctaccaccaccaacaaagttgagcagtcagctgcagagtttctggttgataaggtatcagaatctccaggagagatctctgtactcgccttgggccctctcactaatatcgcattggtatgtaatatgtgctttctctaacgcctcttaattaatactctacttactaggaccaaaaccttatttctggcagtaacacttttgctttatttctttctcaggccatgaagaaagactcctcctttgcaagcaaggttaagaggatagttgtgctgggtggagctttctttgcagctgggaatgccaccccttcagctgaagcaaatgtaattttgttactactacacttgtctgcttctgcaaatcaacttcggttttgtctataatgttgctctgtttctgcattttttccccctcttgcattgcctaaagtttatccattagcttcaaatagtttcttatagccaacagcacaattacaaaaagatttccttgcaattaagatggttgcctttacatctgttcttatactcgagaatctgtactaaaagtctgaaaggacactatcgtttaattttactattaattaccaaactctgaatttcggtgagaagaaagccgtcataaaactgacgaaatatttacttcctctgttatccacagatccatagcgacccagaagcagctgacatagttttcacttctggggcagatatctacgtagttggccttaacataacaacccaagtctacttcacaggttcatgatcagcctatcatttcaactttgcaccttcagtgtgaactttgacagtagtgctggataaccaactcaccaggtgacatgcattaaacatgtacaaaaaattgcagacaaggatatgttggagctaaggaactcgaaagggaagcacgcacaattcctttgtgacatctgcaagttctacagagactggcatgtccactcctacggcgtcgatggtccgcacatgaaacatctctcctttccttcttacaagttcaggctttgggaaattaacgttccagctcacatttgtgtgatttcttcagctctttttctccatgatcctgtgagtttcaccgcgctagttcaccccgagtacttcacgttcaagaagggcgtggtgagggttgagacccagggcatctgcaaggggcatacttccatggacatgggactgaagaagtaagaagatgcagagattgttactgtctatttattcagagaggctggatatatatgcatttgcaattgatcatctgcttaactgttgcattggtgtatgcaggtggaattcagacaacccgtggactggttactctccgatctcggttgcttggactgttgatgttcctaaggttctggcatatgccaaggagctactcttcaacgcacaatgaaaatgtaaccggatcagtgtcatctctctctctctctctctctgaactctgatgtgattgtgtcagaattggcatgcaaatatatctttttttttgggcacaagcagagatatcttggcattgttgtgtactgcagaaattgtatcatatcatttattctgatgaattgcaaattattgataaatgttcagcagcatctgctagtagtacttgctggtgacatgatgatatccttgctgaatcaccatgctgattaattgtgttcctcgtgggtcgagctgtgcctgtcttggtagataaataacttcggtggtgccaaaactttggtattgccgttacctatttcagtcttgtcgattaagtacagtaagcacttccatctcattagtatgcgtttggatggttggcacatggtttggggcgtgtgctctggtgcacatccttactactcgacagccagctatcgatgtaaaacttttcttgtaacattttcttcctatcttaattacattgaatgaccttcttcggcattccggcaaaaagaacagtaagcactaggcagcctttactgaattatttgcgcaccaaacagacttggagtgtaccaatatgcctagcgcatgaatattgcaaaacaaacaaatactcataactcacagattctgaacatacatgcaccagctttacagcaggaattggcagtgtaattttacaagtttctgcattgggccgactactagtactaatatccttttggttttaccctgggaaggcgcagcaaagtggccatgcaggcagagtaatttgccattcattcgttggatattagaaacatcctagaagcgtccggctcgaaatatagctttcaaattaagttccgaattatatataaatatgtagcatcacacactgatcgatttagctagacatcatttatttgctggagatgctatctacaagtagctcaagaatgaagcatgggcgcctgataacaacactagctagaagcagcaaggttagtaggagcaaagatggggaattaagccgctttattatgagtggaacgcatgagcaaatgcatatggcgagcatgcattcctgaaaggcaagattctgcgaccaaagtgtacattctgaattttgtttaggtggatgaaacacatagtatatttcatgggaaggagggaaactggaaaacggtgtgctgctgctaggcctgactctttgggcttggacgcttcttctctctcgcttctgcaaccagagcatataccccaatctgccacgcgtgccggccgttactaatccctcatcactaattgtatgcatgatctactgatgcattgcatctctgttctgttcttgaccagaccgtactctcgttttggagaatgagaggtcaggaattgaagcagctagctagagaaagaggctgcaggggagagtccaaattaaaccaaccaccacgttgttatgtgttgcttgcttggtgctagagtgctagtaatgcactagtccaaattaaattcttcatgtattttaggatgtagtatatgatattattaagtttattgatggtgattttctggatggttgaatgcatctgcaaactgaaagagtggccggtgtgaatgcagtgcttaattggaatccgacagtgggtaatggaggagatgggccagtagggttggtgactgttagacgctagcacatccaggcgattaatacgactactgtcatacgtactgtacatgtcatgctacattatatcgatctgtacattctcttggtcatgcatattacagcgccatatcctatatatcgtacctacgaccaaaattaaactaaacgctctctgaaaaaccaatcaacaaaatacatacaacctcatgttcatgtaggggtataaactataattaatgttcatacaaggagtatcactatcatgttatcgatcaagctgctgctatgctaggtggaggatggcaatattgcattgatgtcgcccgggttcgttgggccagtggctgctaaccgaatttaattccatcctccgctgctgctgcgccagcccggtcagcctcccaagaccaaagtgaacatatggccctgtctagttccttaaaaaacttttcgcaaaaacatcatatcaaatctttggacataggtatagaatattaaatatagataaaaagaaaaactaagaacccattcccagcaagacggggaaatgggggcagcgatcgattttgttttctttgcgctttgggtgcagagtgacagtgacattgacatcccgagctggcggctgggctgcctatatttacacctccacaccaacgcaaatcgatcgcgccaccaccccctctcctctcacactatcaattgctcttgtcatctctgatctgcctgccgctgcgccagctgcctcctccgatctctctctcactctcacacacacgtactagctagcaagtgcacacagacaatgtgactctgtgagagatctatcgggcatggaggaggagagcagcacgctcatacggcgccggactagtttgccggcgaccacggtgatgatggtggtcctcctcctcctcctctgctgtaactgtaagctgcatgctctgccctccatatctgctcccccacttttactagtattaaattctagctatctactactcaaattcatttactgctgaaacctcaactcccataatgtgacgtataggtggtgtcgaggtggtggtggctacggctgatgagtcgtctccggcgccggtcggcaaaggaggaagtgatcatggcagttgccccggcggcgacggcgacggcgaagggtacaggaagcagctgtgggtgtttggcgactcgtacgcggacacgggaaacctgggtaaccttgggagggagctgacccacgcctggtactacccctacggcatcaccttcccgcgacaccccaccggccgcttctccgacggccgcgtcctcaccgacttcgttggtacgcccacgcctccgccatctctctctatatatcttcatgctatgctaattaattactcctactgtcatacgtactgtacatgtcatgctacattatatcgatctgtacattctcttggtcatgcatattacagcgccatatcccatatatcgtacctacgaccaaaattaaactaaacgctctctgaaaaaccaatcaacaaaatacatacaacctcatgttcatgtaggggtataaactataattaatgttcatacaaggagtatcactatcgatcaagctgctgctatgctaggtggaggatggcaatattgcattgatgtcgcccgggttcgttgggccagtggctgctaaccgaatttaattccatcctccgctgctgctgcgccagcccggccagcctcccaagaccaaagtgaacatatggccctgtctagttccttaaaaaacttttcgcaaaaacattatatcaaatctctgtacataggtatagaatattaaatatagataaaaagaaaaactaattgcacagtttatatgtaaatcacgaaatgaatcttttaaacctaattaatccatgattagtcataagtgctacaacaacccacatgtgctaataacggcttaattaggctcaaaagattcttctcgcggtttccatacgagttatgaaattagtttttttcattcgtgtccgaaaaccctttccgacatatgatcaaacatccgatgtgacatctaaaattttcatttcatcaactaaacaggcccatatatgtactggagtacgtgccttttatacagacagactactactagtcactcattttacaacctgcacaatggaaatttaccactcaaaatttttcataggcagactgtacatcattttcgtttctaaccaaaatatatataggtgatcacaaaaatcacaatgataggcaaataggagtaactaactaaaagaagaatctttgcattatattggctctttttcgcggatggaaattgactcagttcatcgcatctggataattcattcatcattcattcattctttgtttgttttttcatgccgacttaactgaccgcacatgcataaaagcctcaggctgcagctagtccatgcctgcactgcatagtgacgacgtctgtattattctctttctttttacctaccctataataggtctccaaattagcacgccctgtcctattgttactgttattgctctcactcctcgcttaattaggcttgacatgtacatgtccaaaacataaaacacatttatcaatcgaaccgacattttggttgcaaatctagtgaacaactaagcaagttatggtgaggcgtcacaatcaactgtaccctgcccttcaaaacaataactaaggctgtgtttttcagcgcaaagtttggattttggttgaaattgaagatgatgtgattgaaaagttgtgtgtgtatgacaggttgatgtgatggaaaaggactgaagtttggatccaaactttagatctaaacacagcctaactgtatatcagtaacagtcctgtcgcgcgccgtttctgaagagatgatatatagatcctctgtgtttaatttgcattcagcatttatcagttttatctaattaattgttgtcttaaaagatgtactaaaattaaactggctagtatttgatgaactctctctttttctatacaagtagcacttgtttttagaggtaagttccttcctagtgttcttcagactagtttaagaggttgagcagcattcatgtttagttgcagcctagctattggaggcaaactaaactaaaagctgaattcgctctcacctgctctactgacgtgcgtatgttccataccgcatctcatgtgccggcagtattttatttatttttaatcactctctcaacaactagtaaaagctaatgtatcctgcacatttgtagagagtaattaaacagcacgcgcgcgtgcgtgcatctatcatgtcagataatgtgccatacaattatctggctgaaagctaaccttaaccattaaagtattttgcagtgtttatttgtttgtttttataacagagataatagtaataaggttttaactggtacgtagtatggttgaatttaaaatattggcgggtgcagcttcggccgttggcatcgcgacgccggtggcgtacaagctgcggcggcgcggcgggcacggcggcgaggtggcgtcgcgcgggatgaacttcgcggtgggcgggtcgggcgtgctggacacgggctacttccagcgcaacatcagctcgcagatcgacctgttccagaagcagctgcgcggctgcggccccaccggcgtcgcgctcgtcgtcgtctccggcaacgactactccgccgtcgtagacaagaacaacggcacaagcgtaagctgcaattgcaatacaaccacaccggccatctcgatctatatatcatatctcctctctgaacatgcatgtatgaacaggaggcggcgatcgcgtacatcccgacggtggtgagggggctgcgggagcaactccggcggctgcgcgacgaggtagggatgaagaaggtggtggtgaccaacctccaccccatgggctgcaccccgtacttcacgcggctgctcaactactccggctgcgacacgctggccaacgccgggtccgaccagcacaacgccgccctccgctccgtcctccacgacctcgaccccgccaacaccaccttcctcctcctcgacctccacacccccttcctcaacctcatcaccgccgccgccgacgacaagttcccggtgcggctgcggccgtgctgcgagacgttcacggcggacggccactgcgggcaggaggacgaagccggcaacaagcagtacacggtgtgcgacgacccggagcggcacttctactgggacgacgtgcaccccacgcaggccgcctgggccgccgtcgcccaagccttcacccccgccatccaccgcttcctctccacctgaacgaacgaatgaatactcaccaaccagctttctcatttccgacgaaattccgcgaaatttcgacgtttctatatggctcggaattaagtttcgattcgaatttcgaaggttaaacagtagatttgatcgaaattcagtagatttgctccttgcacttcttcttcttcttcttcttcgtcttcttgaacaactttttttggggcctatctaatttattattacctttggatgatgatttgttgcaactggatagcagtattactgatttttttttttgagcaaagggcgagagccctccatttccattaatagaaatgaaaaagtatctaccagtctacagaaagcagtaatactgatgccggaatacttcaaccaattaaagaaccctataaaaaaaccccaaaaacattgccttttggaacccataagcaaaaaggacattaagttaatcgtctgaccttctacagatttactgttacacaatcgatcaccaggaggcctccctcgctcgctttctttctactgttacactctgctcgcgttacaactaacgggttgtttggctgaggtctcaccctttgctattaagaagaagatgaacacaaaggctctagcagctacataaatttaatcaaccatgggcaattctcaaaacacatgatagttctatgttgtatgcacttgattgtcctatgcttacccaagggggtgtcagtaataattctccagcaatcccaactgctatgaggcaccattattgttgccttctgttgctgctgctggtggtggtggtggtggtgttggtgtcacgtccatttgctcgacgtttgtctcagcagcctcgtactccgaaaggaggtccatgaattcgtttaacagccgttggaccttgcggttcgtagccatggaaggtagtatatcttcccttaggagtttgtgtttcttcattccctgcagatttaccatacttgagttcacaggctcaaagtggtaaataaacatcacgtccaagaaaacatagaattatcaggccatctatcagacagagagccttacaagaacatcaggatcccatgatggatttttcaaatcagcagatgatgcagcgtcaaccatgcccatcggaggaccaagaaagctctcacaaacttcacgtagacgagattcatctgcctctctgaacgaaacaaagaacaagcaatataatcatttccgcacagcatcatagactgttctcatcagatataaaagaatcacaaactttctcagccaattaaacatatagagctgaggttgcaaaaaagaaatgttgctaagcctcagaaaaggagactctgtagccattgtattgaattgataaacaaactaaccttgccagaaatcttatgtaggataagaggcattggcgatattcctgtggagacttcaaagccaatgaagctgccagctgggtctctaaatgggagcgtgtctgcaccccatcatcggtaaccctgtagtgccaacagtcaaacaagtatacatttagagcaaattctgctatgttagtacactagcatgtcatgattctagtttcaaacgctcataagacaagagcaacaatggaagtgtgcaaacctgctccaaataggctttctagccatgaattttcctatatcgatctgcaacttgcctagctctccaccttgagtagaactaaatgagctagcaaaatttgatgctggaaagcaatcatcagctatccttagccagcatttcaggctggtgtcataaagaaaagcatggcgactggcaagcacaactaagggcgagccacatcttgaaaatttagcagatataacctttactgtacctgtcatataacaaagcaagatcaacttgcaagaacaagccattttggtcaacatcaatttagatgcacaaaagttcagattaacactacatatgaaatatttaccggtatcttttccagctgcctcatctggagatgttaccaaagaagccaaagaatcatgcaaaacgcaagtcctggtatagaggtcccatatgtacatcaaacccctccttgttacaagaagcaatttccaacactcatcacagtctataaaaacagctgctgatcccatcatcatcgctggcattgctcgccttccacattttgtgtaaacctgaacaattagaccagttgattcgagtgtttaggctaccagattgtcagaaaaatgaatgcacatgaaggaataaataaaatcatattccagcaattattgatagattttgtaactattccaaactaaaacatgaaataaatctacaaggaattccactaaagggatattagatacctgcaggcaaccatcttcacagccaactgcccagaaattcgcattaccagccaagacagtcaccttggcagagatgcgatctgaccaaagagtttctgttcctcttgtacatgtaatctcagtttcttttgttgaaaaagcaccaccaagcccaatcatgtctcctgcagaacgttctacaggctttgcttcaaggcggaccggtaaagaatcctcattgtctttcttattgaatacatggatagaaagtgaagagcaagaggccaatgagcctggaactacagatccagactgttctatgctcaaccttccatcactgccagcaccagctgaagctttttggattacaagactctcactaatgttagttcttgcagtaatgccagagcgtcccctaactccacaattattacagttaccgctagcactataagatggtcttgttccattctctccaaggatcattcgctgatccagggatgaaaaatccacaccttgattctgagaacggttggacatgtcctggttggaaggaaatccaactgcctctggaataatccttttccggccatcaggacgccggtattctctttgtttcactggactagataaacgaggtgctttatttatgtcatcagcagtggaacctgcagttttcttctcatcttcaggtaaagcttcaggagctttctgatttggaacgcttgtagacgggttaggtgcatctgtaaaaactttgggggtgattgaaattgctggacactggaaaaccttttgcttgcagattgtttggccgatgcttcttctagcagtaactgagcagggctttcagctatatttgattgcctccctctaacatcgccatatctattcttcttcaattcatccagttcagcatcccttaacctgtatccaagctcctttgcttcaaagtgaaaggtagcaactgaaccatccaaagagcaggcaaaaagtgaatagccatcaggactcctgtcagggaaaaagagcagttgctattgagcttgcacatacacgggatactaattatagaatatgttatatggtcaaattcacataccaagataaatcaaccacactttgagtgaagaaatgcttggcaacaaacaatggccgggcactcgctgtcgtccagacagtaatagttcggtcctgactcccaatagcaataacattatatggttgatgttctttagatgatgcttttgatgctccattggcccatccagctggtgcagcctttgcgtcttggccagaagataaatgcttacggaacattgagtggttaaacttaaccactacaacaggtgcgttatgccccagaaaatcaaaggttgctgaccattcaccccgttcaagcacaggggctgagtgcctaggtttctgaaaaccatgagttgtggttatgaagtggccacagggagaccaagcaagtcgcctaaaaaatgtcgaaccaagctgcaaacacacacacacacatagaaaatatttttcagtaaggaggctttctgcaaacaagatatgtgaaccacagaaatgtaatgaccaagtccaaattcacaacaatataacaaaaacataccgattttgaccaatggccttctgtcctgtgagcaagactccagtcactcgtacgccatatgataacagtcttgtcatctgattggcttgcgatgaaagaaccgataggatcccatgtaacgcctttaactaaactggaatgccctcgcaagacagcagtgcatatgccattggccatgctccatatgtgaacagtattatccaaactgccgctagccaatgtcgagtcatcaggggaccaattaaggtcaacctactttacacataagaaatataactgtgttcaacaatgaatcgataaggatcatgacagttttagtaagagatctaagtaacaggtgacagattaaaatctaattatgttaagcatgacatgactgagattttggcagataattaccacatcggcagtatgccctcttaaggtcataacaaccttccagttttctacatctggaggttctccacttccaaattcagatgttccagtgccagcttttctttcatgaatttggataacttgatcgtccgatcctgaagcaagatagcggccatgatgggcccatctcacacagtttactgttccaaaatggtctcgaattgtagccagcaacctttggctggaatcatcactgtcattgtctttggccactgatttcatgctccatatgcgaatctattgtgagaacaaaaatgggatattagcaaagagcaggctgcgggttcctcaatgatggcttgataacaaattaccagcttccacactgacgagcccagacactaaaaccactaaagcactgatgcaaagaattccctctaacataattatgaatatagtgaactatccttgatacatcgaaatgtaacggtgctgcctaaattccctaccttgtacaggtcaactctgagaaggtcaatttatcacggggaa

SEQ ID NO: 80676 - DNA, 36045 bp, Oryza sativa
ttaactttatagataggtgattatatagatgaagtaaatattacatattataaactaacaatttaatagtaagatatatcaaatatttaagcaatgattcatgaatgcccacgcgaatgtgcgggctcccttcctaattggatcctaacaggaggacgaggggctcacaagagacacattgggcctgtttggtagagctccaactcctaaatgtagctccagagttgggtttggagtagagttgtggagtagccctgtcggaggatgaactcctcgagcgggggaccgtgaggcacctcctttgttggttcggccgggggctactgtcgatgatatgggcccggggatatcgtgcttaaaggggagaggtcgccctcgacgtccacgtggcacttcccccgaggggttgggcccatggatgagcggtagccgcccctctccgcccctaccccttgggacggtcaccacgcggccatcatgcaagggtagtgcagacggagcggacgtgccacgcctcatttaatgtggcgtgctgcacgcttgaccgaatcgtgaccggtgcatgaccggttgagtgacagacgagatggcggcaagccacgcgcgccctggccgtgtgtcagacagcgtgcggtgcggtaggtatgccttatcccgtcaaaatgatgaggggcacagtgacttgcaaccattcagagccggcttgaccgacctggacacacccgggacggcgttcctggcacattcgcacccaaaatcctccccgtgtcagcctgcatcgaccggcatgatttgatgggccccgcacgacagccgatactcagaggacttccacgttgtggcgcaagacacacatttaatatagggaatatttactcccttcactgggcggcacacccggtgcatgtgagttcccctgggagtataaaaggaggttcatatccaatgaagagggggatcgaagaacaaagagttggatcgtttagccctagtttgtacaccagagattcagagacttggaaagctcagaaaaaccatcatacacatgagtagggtattacgcttgttagtggcccgaacctgtataattatctttgtctcatcctctttgagggacccgacccccttgatagcttccaatcttcctagctgcttagctttcactcgctgcccccagccgaaacaacaaaggaggggcctcacggtcccctactcgaggagttcatcctccaacagctggcgcgctaggtagggggcgcgttcgtgttcacctgaggagcactcatcttcgtgcgccccaagttttgtccggtacatccatggcgggagtcatggacggcaagctggtggtgtgtggctgatgaggaggatcttgaccctcgtcaccaagcacgacctacttcgactccccctcgccgcaatcctaggcgaggggagggccgggataagtctggggactcggccatctcactgctggcaggcaagggaggacgctgagaaagagtgcgctgccgcctcacgacgacggtggcacgcctcagggcgcacttctgcgccaccccttgtcgatccagagccagagacctcggtccggtgctggctggacgatgtggccaacctggtcaccaccgcacagcggcagcttgccgctggcggccggacaacggcggctggtatatcacgtagtacgattgccctctctttgtcgtcaagatggagagcacaccgggtggcggcagcttcccgccactcgtcctcacacccctcgtcgatgcccgcagggagctgtgggcgccatgagtgtatctacggagaaccggacgctcggcttgacatcgagcgctggctggatgtgcattgagccgcccgtgcgccgagagtaaagagggtggcaatgcgccgagagtagttgtattgatcgatagattgatagattacaatgacccagggtgtatatatttatacccatagggagatactagtccttgtcggacaggaaagaaactaaagataaaaggaaaagataaagtccttatcagacactaaacacccttttctaaagataaaaggaaactaacaaactattcctaattagtagataaactgtcatgccgcatccttcttgaactcggactcttctggataaattccctttagttgatccgactccatcgagaacacggttggtggtgatttgacgactcccatcggctgattccataactctgaagccgatactgactctaagccgatgatgactttgggcttaccaaattttgtcgttaacacatgccccccagttttggagtgtgaggacccatgctccaaaattctcttctgtctgatcttgttaactccaaaattgatcttcccttgcttcttgcaatcggctttcataagccgatactgtctgcattaaatgagctagactgtcaaactcgtggcagaagaatctctctctgataggtgctgacaatccttggaatgcaagatctgcgagctgctcatcacttagattcaaactataacatcgaccgcggacattacaaaatctctgaatatattccatagccgattctccttcttgctgctcaaccgatattaaatctgaaagcttcaactctttgattccaacaaagaaatagtcatgaaattgcttctcaagatcggcccatccttggataaaatctgatggtagcgatgaaaaccatgtgaaagctgatccagtcaaagacaatggaaaaaaatctaactttcagagcttcttcagccgatgcctccccacattgtgctaagaattgactgatgtgttccattgtagatgtatcatcttgccctaaaaactgggagaaatctggaactttgtatcggtgtggcaatggcaccctattaaaccactcaggatatggcagccgatacacagaagtatgttccttaggtttgattccaaacttctcctctattatctttgcaattctatcgggcaaatcattgtcatattgatattcttcatcatgcccatattgacgaagttcttctggccgatattgatatgcttgcccctcgagctgattcttttgaacaattatttcaggaactatcttcttgaccacatcttgtagtctactcatcaaaactccaaactgatcaaacaatgtgcgatgaactgcttcatcaactatatcttgaagtatttcaactatcggcttggggaatcgagtcttctgagttggctcttctggtgtcatgatgaaacattgaagacaacgcgtttgaaaatcagctacaaactgctccatctgttgcctttgttcctccgttaaatcctccactatgaccatgatcttggcattgacttcttcttcaaacatgtggatataaaatcatggtcccaccgggcgtgccaaaagcgtgttgatgcgaaaaacacgaggcctgggagatctgcttaactccagtgcaggtccaaaaatcttgatgagatgcgggtgtgccagtcagtttgaccctgcaactgacaagatatataaacagtagatcaaacggctgatcggctgacaagccgatggagtagttccagccgatgccgataccagccgatagccgatgccagccgataacgatagggttctaagctatcggctttatgtccaatgtagagtctgacacttgacttaaataatgatataaaggcaatcgactgatgataatatagtataacaataatataatacagtataaaccaatcggctagcaatgagatgatagaataaacactgatccgaaggttaaagcatacatcggctggaggtccaatgttataaaatccacaatattagataaacagtaaaacctttgttgtgatcggctaagtccaacttatatgtatatgcagtccttgtaagcccatgcaacgtccagataactcatcggctgaaaccccgatgaaacccttattggcaatcaagaagcaggctagagattatggttctaaacatgacttagtagatcaaactcaactgatgcagtactaagtatgaaaagaaacataatatctagacaatcaagccgttgactgatttttagggtggtaaatgtctaagctaatctaatctagcaacacgatttagccgataccggcagaaaccctaaagcgagaagcggccgatagaggtaaactgatatgctaagactagattaacagagacatatgataaataggtagacaaatatatcatccaaaccggagcaatccaagaggtcgaatgtactgatgcagccttgaacaacgctgatgtagatgagacaattgcctgggccgacggaacgtaggacttaccccttcgctgaagatcgaaagccgatgcagccccgcgtcaggtgccaagttccatcgaatgataagtaaaaacctcggtaaagagggtggcgatgcgccgagagtagttgtattgatcgatagattgatagattacaatgacccagggtgtacatatttatacccatagggagatactagtccttgtcggacaggaaagaaactaaagataaaaggaaaagataaaatccttatcggacactaaacacactttctaaagataaaaggaaactaacaaactattcataattaatagataaactgccatgccgcatccttcttgaactcggactcttctggataaattccctttagttgatccaactccatcgagaacacggttgctggtgatttgacgactcccatcggctgattccataactctgaagccgatactgactctaagccgatgatgactttgggcttaccaaatttcgtcgttaacagcgtgcggtacaacggaaggacgatgagtccctccactcatacatctagcagttctgtcaggtccgcaacaccatcgatcccatgcatccctcctcacgcggtcatctacgcatttaggggggcgtgtggcataaccgcgtgctgaagaaggtcgcctccaaggagcacaaaacatacgcggagctttttcagctcgcggatcacgtggcccgcaaagaggaggcgtgggcttggaactcctccagctctggcgcggcggctgcggctgcccctgagtcctcctcctgctccaagcggcgagagaagaggaagaagaagagatcggtccgatccggcgacaaggaccacgtcctcaccgccgaaggcaccttgcggcccccgcacaaagaaaaggccgcgagcatcaaacagaaggacaccgccgccccttgtgagagccgctcactagataagtggtgcatcatccacaatacctccacccacagccttgctgactgtcgcacgatcaagtccttggccaagcgcgtcaagaagtcgcatcaggagaagcggcagggtcaccgggagggtaaagccccggagacctcggccgacaagcggcgagaggaggccaagaagaaggcccccgtcgacaatggtgatgaggacctggagttctaggagcttgacaccactatcgccaccgtcgactgtggagcatgcgcccacgcatccgaccgtagctttaaggccatgaagcgcgagcttctggccgctgtccctacccatgaggcgacacggcgagcacgctggtcggaggtgaagctcaccttcgaccaaaccgaccacccgccagtggtttcccggggagggcagttggcgctggtggtatcgcaaaccatctgcaacgttaagatgaagcgcgtcctaatcaacggcggggtcgcactaaacatcatctcccccgcggccttcgacgccatcaaggccccagggatgaagcttaagacgtcgctacccatcataggagtgaccccgggacacacgtggccgtccggtcatattgtgctcctggtcacctttggtgatcctaccaacttccgcaccgaacggctcgactttgatgtggcggatctcaatctgccctacaacgcggtccttggcaggcccgcattggtgaagttcatggcggtcacccattacgcctacctccagatgaagatgctgagccccggcggccccatcaccattagtggcgatgtcaagatcgccctgacttgcacgaagcaacgtgcaatcaacctcgcagccggagaacggcggcggggggcctgagacttccacctctcgtctcttgaagaagcggatgacttctggtgacgaggtgtccgtcaagaagattatccttggcaatgatccgtccaagaccgaagattggtggtaacttggacgacaaataggaagacgcgctcgtctccttcctgcgggcaaacgccgacgtctttgcctgaaagccgttggacatgcctggggtccacagggaggtgattgttgacgaaaaaatcgaacacaccggcctgggagatctgcttaactccagtgcaggtccaaagattggtgagatgcgagcgtgccagtcagtttgatcctgcaactgacaagatatacaaatagtagatcaaaacagccgatcggctgacaagccgatggagtagttccagccgatagcgataatagccgatgccgataccagccgatagcgatagggtttaagcaatcggttatatgtccaatgtaaataataatataaatgcaatcggctgatgatgatgtaataaaataacaatataatccagtataaaccaatcggctagcaatgatatgataaataagcatggatccgaaggttaaagcacacatcggctggaggtccgatgtcatgaaatccacaagattagattaaacagtgaaacctttgttgtcatcggctaaatccaacttatatgtatgtgcaatccttatgaaccgatgcaacgtccagataactcatcggctgaaaccccgatgaaacccttattgacaatcaagaagcaggctagagattatggttctaagcatgacttagtagatcaaacttaactgatgcagcactaagtatgaaaagaaacataatatctagacaatcaagccattgactgagtttttagggtggtagatgtctaagctaatctaatctaacaacacgatttagccgataccggcagaaaccctaaagcgagaagccgatagaggtaaattgatatgctaagactagattaacagagacatatgataaataggtaggcaaatatatcatccaaaccagagcaatccaagaggtcgaatgtgctgatgcagccttgaacgacgccgatgtagatgagacaattgcctgggccgacggaacattggacttaccccttagctgatgatcgaacaccgatgcagccccgcgtcaagcgccatgtcccgccggacaataaaataaagtagaaaaggtaaaagatggcgatgcgccgaattgtattgatcgtagagatagattacatagaccccgggtgtacatatttatacccatgggttgatacaagtccttgtcggacaagaaagaaactttcctaaagataaaagtaaaagataaagtccttataggacactaaacacactttcctatagataaaaggaaactaacaaactattcctaattaatagataacttgtcatgccgcattctctttgaactcggtctcttctggataagcttcctttagtagatcaatttccttaaccgaatatagcaagaatccgacaactgacgacttgacaactctcatcggctaatctcaggacttcgaagccgatgactactccgggcttaccaaatttcactgttaacagtgatcgagcaccatctagccgtgcggccggacgcgagacccgtccgacagaaggtgcggcggtaggccccggagcgacaagcttttatccgcgaggaggtggcgcatctcctagaggccgagttcatccgagaggtcatccatttggagtggttggcaaacctggtgttcatccccaaggcgaacggcaagctctggatgtgcatcgactacaccgaccttaacaaggcatgccctaaggatcccttccctttgccacgcatagatcagatagttgactccaccgtggggtgcgactttttgtgtttcctagatgcttattcaggttaccattaaatctgcatggctaggaaggatgaggaaaaaactgctttcattactcctgtaggcacattttgttatacaactatgccttttggtttaaagaatgtgttggtatttcttaacgacattactagaaatataattcccagcaatgatttacaaagtctgtcagggttatggataccacatacctaatagtagttgactaaatctcggcaggacccaccacataccatgtcttatacggaaataaccttcggatatggatagagttccggataaggaaagacaaccagagttacacaccagggatggtgttcctggtgcattcgcacacccaaaatccacttccattaaatggtgaatgagggggatccttcccgtgtcggcctgcgtcagccgacatgatttgatgggccccgcacaacagccgatactaagaggacttccacgttgtggtgcaagacacatatttaatatagggaatatttactcccttcactgggcggcacacccccgcgcatgtgagagaaccccttggagtataaaaggaggttcatgtccagtgaagagggggggtcgaagaacaaagagttggatcgcttagccctagtttgtacaccagaggttcagagatttggaaagctcagaaaaatcatcatacacaggagtagggtattacactttttagcggcctgaaccggtataattccctttgtctcatcctttttgaggggcccgatccccttgacagcttccaatcttcccagctccttagctttcactcgctgccctcggccgaaccaacaaaggaggggcctcacggtcccccgctcgaggagttcgtcctccgacaagcccaaacccagctccacatctctagtttattttatgatagtgctctagtcagctctgtacccattttaagtggagctgaaattatttggctgagctctggagctgtgtcaaacggacctatcatcttcgtacgtggagaagaatctccatcgtgacgtacctaacaccacctcactgtaccgtgaatagcctaaggctgggttcggaggaggggttggacccggcacgcaaaacgatgttcgcattaacgtgtgattaattaagtattagttaattttttttcaaaaatcgatcaatatgatttttttcaagcaactttcgtatagaaactttttgcaaaaaaaaaaacacatcgtttagtagtttgaaaagcgtgcgcatggaaaacgaatgtgggggagttgggaactcccggcaaagaacgcagcctacatgaggttacaagtctccatttttcaaaaacatgtgctataggacacaccctcgttggtgttggcgcacgtgatcttggtgtgcacgcttgagtgcatctgtgcatccaaattgtactcgggataaaaaaaaagatttgtctattcgatgaactaggagtatttgattttctagcacacattattggagaaatatatgctgaagaaaaggcacagattcttactatacatcaagctgcagactgaaccatcatcagctatctgaaaccaatccagcatcccttgtgctcacaaccagaggagggatgctctgctcactccagaacagctgatcaggatccacctcacccttcaccattgccagcctcctgaagtttcccctgaagtacttctccccccacaccctggcctcctcatagcttgtgtttccctccacattctgccccaaatccaggtccctgtagttgatgtatgcagccctggggttcttgctcacatagggtgtcatcagctcatgcaaccccctcacccagctcagatgatcatcctcataggacacattcttgtcacctccccacttgacaaagtattgcaggttgtagaggtatccgctccggtgagcgtacggcgtgccggattccggtatccggctcatctcgccgccttgtgggtcaatgtcgatggagccgtcttcgtcttcgacgatcttggtgagcaattcgatcaggccgggtgtcggaattggtgaggttaggtagtcgagcttgatcttgtagtagtccttgggttgcagtgtcctgtcaagaagcacctctgctggttggccattggtgtagccgtaggagtacagcatggattgcagccagttcatctccctgcaatcggttggtttgatgccgagttcgggcaaatggtggtcgatttgggtgatcatgtcgctgcaatttccaagaaacaatgatttgaacgtcaccaatggatgacgagttgagtcgtcgccgtcgttgatggtcttggcctccatggacattttgacgaacaggttgtcggggagagcgtgcgccacggcttgccatttggtgaggaggcggaggagagattgctcgtcgtggccacctcgccggagtaggaggcggtggacggtgaaggcggagacgacggccgggacggggacgaggttgacggtccaggagacgacgatgccgacgctgccgccgccgccgcccctgatcgcccagaagaggccctcccccatggccgccctgtccaggagcctcccctcggcgtccaccacctccgcgtccaccacgttgtcggcggcgaggccgtacttgcgcatcatcgggccgaacccgccgccgctgaggtgcccgccgacgcagaccgtcgggcagattccggcggggaacccgagccgcccgccgctcccctcgccaccgcgtagtagagctccccgagcgtggcccccgcctcggcgcgcgccacgcccctcgccgcgtccacccgcaccgcccggagcgccgcgacgtcgacgacggcgaacctcggggaccggccgagcgagcggtacgagaggccctcgtagtcgtgcccgccgctgcgcgcgcggacggtgaggccgtgggcgcggcagcagacgacgcaggcgcgcacctcgtcggcggtcacgggcgtgagcaccagcgccgggcggggcgtccgcggcgaggcgaagcggaggttctggatggtggagtcgagcagcgacgggtaggaggcgtcgcccggcgcgtgcacgagccgcgacgggtcggcggcggtcgccggcgaccgccgcgcgacgcaccggaggaagctctcgcgcagatcgccaacgccgcagccgtctcgccaccgcgcggaacacggcgaggcgagcagcgagaagtggaggaggaggaggaggaggagagggaggcgcgggcggcttggctccatcgtcgtcttgctcgaggtcgcggccggagctttgctcagctccgctcccactgcgtcgaacgggtcacctacctgctcgatctttgggtttggtggctacacgtaatgaggcatccataaccagaaagaacctcaattattgtgatttatttttaaggaacctccgattttaagataaaatatttcaaaaagccttatacttttcaaaaaaaacctcatattttactattatactcccttcatttcttaacaaattacgccgttgatttttagcataacgtttgactaattgtcttactgaaaaattatataaatgtcattttttttgttgcaacatattttataattaaaaaactttaagtatgacttataatttatcatatttacattatttttttaatctaataagatgatgggttaattggatcgatgccactgcaactttaccaaattaaaaaaagccactactattcatcatatcggctgggtgccactgtaattttagaaaattggatccatgccactcccgtcactttttccatctcatctctcacaccgtctcatcctcatcccctccacaccgcgcgacggccggcacgagcggaagacaagctggcgcggtcacggccggccctggtggggtctctccggcgcggtctccggtgccgagctccctcgccaccgccaccgagctccttcgccaccgccgagctccttcgccgccacccaggtcggccttgccgttgacgacgctgacaacgaaagccacctcacgggtcgactcggcgaccatcgtgctgtcggggcatgtggtgaggaagccgaggcatccaaggagaaggcggcagagtgggccgcggctgcgccaccgtctccggccagcagcgtcagcgtccctggccaaggacgcgcacgacgaggtccttttcgcagcgaacgaccggcgaggcgacgaggagcagccgcatcgctccctgcggtgtcctcaaccgccgtcatggcatgggggctgctccgcacgggattccggccttcactcgcgcctgcgccaccacgagaaccctaagccgccgccgccgccgccgccgcttgcgcctgcgtcggtgtcgtcgccgaagccggagtcagtggtggtgtcctctggctcagtcctcggacggggaaagacggcgtcaacgggagtggatggaaaacgcgacggagtggtatggatccaatttcccaaaattgcagtggcgcccagccgatacgatgaatagtagtagtatttttttaatttggcaaagttgcggtggcatggatcgaattagcccgatgatgaatggtcaaacattattctaaagttaaccgtgtcatctattaaaaaatagaggtactatatgattattttttacataaattcatactagttgactcaaaatatgcatccctctcgtgtattttatcttcttttcctcaattctgcactgtggtattaaaaaacttaacgtaattcatgacatgagaataagctaaatatacacataaattatcaaaccatcgatgatcaacgctagttgcaaagcaactgacatttatattatatactccctccgtttcacaatgtaagactttctagcattgctcatattcattaatatctatatgtatatgggcaatgctagaaagtcttacattatgaaacggaggaagacaaaatatctcatacaattgtttacagttttaaaagaaaaatattagccaaagtggatgatttaggcttggacctaaaggttataagaaatattttgccctaaaacgtaagattgcatgaagcaaattataaaacttgggattttgagttaagaatgcccccaaaaccagaacatgatgtggtattttttttaaaaaaaaatactcctaattattcagctagtaggtgatggtaattgatgaaagataactagccaaattttcctgttaagcccacagctaaatttcaaggctttttttaaaaaaaacattatagagtttttttttttagtctcagggcagacccaaccaaacgttttcagtcccagtggaaagaaagtggagctggttgtgatgatcaaaaaatgaataaagaggtgaagtggggtttgggccaatccataacttgaaattagatttatgagtttgagagccctactaaataggtccttggtctctcaaagtttaaattttgtgaacataattagatttaattttagggttttttttaagtctgtttttttatcgttggcttttaaaccgtaataacacaaatatttatgttttatttgtgaattattactttttttgctttgttcatttttcttaaatgatcagagcatatgttttaaaactagtgaggatcaccttaaaatcatttttcatcgcttggaccacgagcatttattttataaaccgcatgggaagaagaggaaaaggggcccgattcattcttgagacacagctcgatgtctctgtcggatgcatcaagcatttcgactgaccaactggaagcaggagacaaaagcggtatatcagaaaacgccaatctcttgcagccggtgaccggccagaaaacaactccgtctcgccaccgcgcagaacacaagcttttgagctgtgctactccgcttgaaattaaaacataaaattaacagagagcgatgtaaaaccattggattatcataaaaaaaaagaaaaaaagaggcagctcgacgtctctgtcggacggcatcaagctttcaacgataactcaggtcacgaatgatttcgacaggccagctagagcagtagggaaaaagaatggtagtatttgaaaaaaaaaacgccaatctcttgaaaatatctaatctagaagggactaccttcctgaacttgcaattgtaagtaggtgatcagattcagaggtagctacatgtttccatgcaaaagcacaagtgtgacattggacaagatgatgtaagatcagatcatgctcttagctttcaggtaattgacaaaaacatctggccggaaaattcatcaagtaacataaaacttggaaggtgaacttctgcccaacaagggaaaagcttttctaacagctgagcctacaggtgaaaatgttttaagaggtattcgcctgggccttgttgaggatgactccttcatacttgacctggaaccacttcatggcatcctccttggtcacccggtgctggatcccaacgcgagacttgcacctccgacgacgggcaacacggtagccagcacgctcaagcacaacatagaagtccattccatagatacctgttgaggggtcgtacctgcagcacacaagagacggtttagccgtattttttcgaaggatagtaaaaccatgtgatgtgtgcagaaaattataaattaaaaacaaaaacacacttatttcaatgtgcttttggcgaataccaaacatcgtattggtgcattctctccatcatcagctatgcacagctcaagagcaatgcaaactacacatacgaaactattatggtgcatatgtggacaaacttcgtggacggtcaagatcaaagatggtgagcgtgtagatcatttctaaattggattgtgaagaagttccaaagggttgctcagatcatttgttagtatgaaacttgctaatttggtaggcatttctatgattcaaataaccaagcatttccagtcactaaacagttgttaatacgtccatgatggatagaggtaattgggtccgtaaaaagacagtactaacaagtatccaaaggtgaaacaagggataaattgacaattcaattagatagtttttttctgcaagtataaaaaacaatcatcatgagtaaacatgctctgatgctgaatgccaagtgaactgctcaattagtaaacaaaatagacaaatgacaaaattgcactgatggtgagaagagcttcccagaggttctagagttctaactcacagtacatttactaatagggtgatgtttctaccatagaaatacgaagtttgtactgtttcgtggttccagaccttctagatttttgacaatgtggctcttttacaaaacttattttataaatagacccccaactgtgaaacaaagtgtggttttgattcattgtgatgggaaaatggagagtgtcaaaagtgaagaaaatgtgtgtgttgactaacataggtcaggatgtgatatttgtgcccgaaaaacggtagttttgttacgtgtgtgcatgtgatcgaattcaatcttggtcaatggcaaggaccagaactatgctcagggaggagcagtccggtgaggtcaagaggccatgtgataaggtgggattgacgtcaggatccttagaggtcaaccggggtcaacgacggatcgagactaaactcagggaggagttgaggtcagaacgatcagggatgccggttgacaagcttgaatacaatgcggtgcacgatgaacggacacaatgttgggaggacttcgcaacgggcttcacaaggtcaagtgtgcaggtgtcgggattcgcgaagagtaatgtatgatgcaaatgcaagaatgctccccctatgtgcctaactccccttttcaccaagatctaaagcaaaattttaaattctcaatgagtgcattttgctgaatatttctccccctttggcaatgatgacatgcaaaaatgcaaaaaatgagacattgcaaactttaatttgagtgaactttggaggttaccagctagacatatacaaaagaagtatgaaacatgacaagagcaacaaggttatatcactagcaagctttcatgctatttctagaagaagcttaagagtaagcaatccaacgcataaatatgcaagattaacattatcaaaaacaaaaatgaacccatgataccatgctaatgcccagttcaagagagtatcaagatggtaataaaacatagaacatgggcttttagctctatcacatttgcattttattccttttcggatttttgaagaaaactatagcacaatcgcgatggtacgcctaatcttatcagtcagcgagtgatgagggcgccaaacagtgtcatcaaatctcaaacaagttttccagttagagctcctgttacaggtagtctcagtgctatcttcagcactacttatgcgtaaacacactcagtagcctgggacaaaagcagtggtaaaacacataaagcatagaaagaacataattgatgcacccatgaacaatcaagcgtgagcattcaaaaggatgtgccgaaagctattgctaagatgataaaaacatggcatatctatgagaaggatattgcatcaaaagcaaacttctagagcaagttgtgcacattaattaagttcaagtgtagattcaatttaagcaagtatcaatgcgcatgaagagcatagcatgaacatacaagctacttaagcacgtgtaacctagacaaaagatctagcttgcataaaagtaagagatgagtatcaaaaagatgtccagtaaattgttaacaaagctctttaatgaaaagatgtataatacaatgcaagaaagtaaacatgatgcaaatgttacaaatgcatgcaaaagaaaagaactccctctcaacgcaatccacaggggtggatcacccctaactcactttgcaagaactcacatcatgctcaatagagaggttttgtaaaaatatcagcatgtcgtttctcggatttaacaaactctagcacaatgtgttgacgaaaaatccacgcccagctaatggtgccaaatctgtgttgatgcgaactatgtcgacaaacacaatgccgggagatctgcttagctgccgggagatctgcttagcttcagtgcaggtccaaaaatttggattcgaatgcgggcgtgccagtcagtttgatattgcgactgacaggatagataaattgatgatcacatagtcgatcgaccaataaggcgatatggcgataccagacgatgttgataggattttgaacacatcggctatatgtccgatatagattctgacacttagataaataatgatataaagacaatcgactgatgataatataatgaaataaatatccaataaaccaattagccaacaatgatatgatagaataaatattaatctgatggttaaagcatacatcggctgggaatctgatgtcattagaatttaaatccaaaagattaggcaatcaataaaaccttgctgcaattggctaaaaccaacttgtatataatccttataagccgatgcaacatttaaataacttatcgactgaaaccccaatgaaacattgattcatgtttactaacttaaataaatctaacttacaaccacaaccctacagggcgaacacaactggatgtagcataaggttgataattacctgatagatttaagcaagccaatatgacaccaatcaaagtgatcatgtattaaatttgactaagacagtaaaatcatcaaagagaaatttaacacatcaaataaaccccccgatgaaacattagcacgaacctatcggcttaacaagactttgattattaataacaattgaggtcggacctaaccgatgcagcacgagattgcgtttaataatctgatctcaatgagtcgataaaactttctaatgcgatggatataacaaatctatttaaaatagcattgtgattgtagagatatgtcggctaagacaagatcagacctaaccaagatagtcctaactaaattgatgcgtctctaaacacaatgcaattaaaaatacaattcaaatatcaggtaggtaaaatataccaaccgaaccagagcaatccaagaggtcaaagcgatggagccttgaacaacaccaatataaccaatacaactaccagggccggcagaacttaggggttaccccttcaccgaagatcaaagacatgcagccccgcgttaggtgccaagttctgcaggtaacaaaaacctcggaaaagagggtgttatgcgccaatattgatccagagataaatggcaatgaccccaagtgtacatatttataccctcgggctgatacgagtcctaatcggacacgttacaagtttcctaaagataaaaagaaagatagaagtcttgatcagacactagacaaaacttaaggaaaattactaaaaactacctaattattagatagaattaaactgttatgccatggtcttcacgattccttcctaaactcgatctcttctagataaaattacatcggctgcttgacttctttccttaaccaaatccactaaagaatcttaccaaattttggtaaattttggcgttaacacaatggtacatttctaaacatattttcggagaaagtggtaccgtatctcaatgtgcttggtccttgaatgttgaaccggattcttaacaatgttaattgcactgttgtcacaaaaaaaacactcaaagacaagcaaccatacaccttcacttgtggttttgaatttaaacttcaaaagcccaaaaggacatctctcataaagaggtacacacccatgggcaaatgggccggcaaagtgactctaagggactactccaaagggctccaaagggagcctactcaccctaacatccacctctctatttatagcccaagatggatgaaatccccctaagataatgtcaaaattgcccttggggcaaaacccatagctcagatgaaatctaggccatccgttgttccttctcctcaaaggaaatatctcagatgtccaaacgagccgaagcttctcatgcgcacgcactccagggtgaacccgtgattcgcgcgaacgcctcctcggccaatcaccgcacgcacttgcttgcatttgcatccttatctgtcacttggtcttgatttttcaatctcttcaaataaccaagtttgacttgcaatattatttgctttgtggagcaaaatcaaattttcaaaattttgcttgaagttgccaatgtttccatcaagggggagattgtgaaacaaattgtggttttgatttattgtgatggaaaattggcgagtgtcggaagtgcaagaaatgtgtgctgactaacacgagtaaggttgtgatatctatgcccgaacaacgggcgttttgtttacgtgtgtgtgcaggtgatcgaagtcaaccttggtcaatggcgaggaccgggactatgctcagggaggaacggaggtccgacgcagtcaagaggccatgtgacaaggtgggactgacgtcaggatccttggaggtctctctaggtcaacggcagatcgggactaaactcatggaagagttgaggtccagaagagtaaaggatgccagttgacacggttgagtacaaggcggtgcccgatgaacgaacaccgtgtcagtagtacttcgcaacgagattcacaaggtcaagtgtgcaagtgtctgagattcgcgaagagtaatgtacaatgctagacgatacatgcacttggacagcgtatgtgtactgtactcatgcaagcaagtgattgggttgcgcatatgtgcacgtggcccaatgccatgcacttgtgcatgagtctgatcgacttggcttggaggaggtcaagccaattaggctcttgcttgttgacccaagacggaggcggtaaggcgtccggctagcagccttgttggcagggaggccgaaccatgctggtccaggtgatggtccaagacgatagttgcagatgaggcctggctagatgcaagacgcagcgagggcatggaggcgaaagccgtacggaacatgcggttgtctcatactcgccgcacaagcgcataaggtcgcataggtggagcgcgcctcccagagacgcgtggtgaacgggtattcggcgagcggcaaagacgtggatcaacgacgaccaagtacgtgtggtgattggccaaggagcatacgcgcggatagcaggccccaccgtagattgctcgtgccggagaagcttcagccttcagctcatctcactggtaggtgggcctagctagcaaggtgcgcgggaggagtggttcgatgcatattttatgtggaaaatgggatctggagcgggcaacaacatggaggacatccgagttatttcctttgagaaggaacaacggatggcctagatttcatctgagctagggtttcacccagagggcaatttgaacattttcgtagtgggatttccgtcatcttcgactataaatagaggggtggatgttagggaaagtagtgtccctttagagccccttggagtagtcccttaaaatctctttagtgtcccttctgcccatggatgtgtacttctttatgagagatagccttcagggcttttaagagtttaaattcaaaacaagtgaaggtgtatgattgcttgtctctttagtgttttctttttaacacctttcgtatcaaagatattctggagttggatttaatttcagtttttgcgctacggtctaagggaattcttcgctaaagattttttatgggtattcaatgaaaatttcaatacactatatacgacgactttgtccaaaaatgccatcgccgttatcgtcgttagggttccgtccattccgcgacattaagtgctataagatgaacaatgtacttaactccgcgacattaagtgctataggatgaacagtgtacttaacagtgcaaaatagacagaaccctaacggcgatggcattttgggacaaaatcgtttgtacgatggtatttcttggaactcacacttgctaatggcattttttggatttggacgcttgtcaatagcatttcttggattatctcaaagatgatggcgccaagaccttgtcacacgttgtaagcaatccacgtcactagatggtcagctccaggaaccatccacgtcactagatggtcagctccaggaaccttggcattgatggaataagccttgtgctcttagtagccttgttggtttttggtctttgtcgttctgttttgcttttagcatcttaggacagcatcctttcagttttacttttagcatcttaggacaacatcctttcggttttgctctttagcatcttaggacagcatcccttttatgctttatgttttcctttcacctttagactagcccgcagctagcaagctatggctataaatatgtatccaacctcccccggatagtatgacttggtactagagccactctatcctgtagtctagacatctcttgctcatccccttcacgagctcccctctgtcctcaaccggcagctggaacatcggctattcctgctcatccctcttcccctgcactgacgagcagcagctcgtcagaggcaaactcttcccccacactgcaggcccccaatagcatgccatgcccgcaggacagtcttagcgctcggtcgcctcgagcgcgcggctccggcaggaggccgagctcgccgcggccgaggaacgccagcaagcggcagcagagactgctgcgatggcagcgagggcgtcaaggctgcctgcggcggaattggtggcggcaagggtggaagtggaagcagcggcggatgcagcgcaagcggcggcggcagagctcaaggctctgcgcgacaatagctccagcagctctgtctccgcctacgacatccctgctgatgagctgacgagggaggcagctcgtgagcgggtggagcaacgggcagccgcgcaaccccacacgcgccgtagcagcagcccagccgggcgtggatgcgtcggcggcgttcctggcaggagcgcgcgcggcagcggtagcccagacgggcttggacgcattggcggaccccttggcaggggtgcgcatgacggcggtgctcccggcggcaacggcttggtcgacggagatcgcggccgttgcaggcggctcgtctctccctccccggaccggtaccgtggacaccacgggattcaggccgtcatcagggaagtcagccccggcggtggttggcctgccttcaccaagaccaactacatcgagtgagctgcggtcatgagggtgaggctccaggtgcggcacatgtgggaggcagttcggtacggcgacgtcgactacgacgaggatcgacgggcactgaaaggatgatgtcctaagatgctaaaagcaaaactgaaagaatgttgtcctaggatcgctaggatgctgtcctaagatgctaaaagcaaaactgaaaggatgttgtcctaagatgctaaaaacaaaacagaacaacaaaaggcttattccatcaggcattgggcttatatacttcttaaaatattaacacaccattagaacaattatacatgtgtggtgtggtgatgagatgcctgctcttgcctcctagcaagcttagttcgaacattgggtgggaatcttttttgttttcctttttttaagtggcatgcacaccttgaatggaccagcaaaagaagactagacaggaaaaaacacccatcatgaagatttgatcacatgatttccaggaacgtaagagttcatttaaccactttaagcactcgtcaacttattatagatgatagcccattaaattcttaatctcatatgagctcatcgccaacaaaatattttagatacaatttttgtgcatcaatattgtgccatgttgtgttacgcattcctggtaatgcatatgtgagctcatatgacagttgataatgagctatattctataataagttgattaatataccaattgtttaatgacatcactaaaaaaattgcactggccaaggatcgaactcaactaggtggcaagtttagacatcttaccactacaccattcatgtaccattatgtggatgggtgtgttaatatgttagaaacatatgagcccagaaccaaagttattggcgcggaccatctagtaatgtggattttgtgccacttgtgccatggtatcaatgctaggatctttggtgacaagatattgaggatgtttgaatcccaagcaaggaaaagcatagcctagcctagcaaggagagttgcttagtattagcaaaagaaaaaaaaagtattgcttagtaaggccaactaactaccgagaaaagctcacccaagacaaaaagccaaatcggttagcatccgatggcaatttgtcgggctaaacatccaagcattgtacttttgcttttttatgccatagctttcatgggctagcttgagcttgctaggccaagcaaaggtaattgcacaatctaaatagaccatgaatattggtgctaatgatcttggagccgagattcaggtccaattattttataagttttgtcaaggtctatttataaagtaagttttcaaatggaccagattataaaagatctagtccatggtctgcttcaaaatcgagctcaatgctctttagaaatcacaacaccacttaaacaaaagcatcaatgtttatgcctcaatcaaataaacatctatagcattagcagtatgctaacaattcctaggtaccaaatgaattgtcaatgacccgagaacacttaaaaaaaccatcttcaggtttagcaacttacaactaataaaattctatcacttgtaaacatcaatccaaaacaaatctattgaatgaggcaatttcaagcaaatattggaagcgctatcctaggtcacaaaagggaatggagacaatgaatgctttaaaatcttctaggcacaggactaacataaacaggcagatacgaaaagcgaaatgtttcatccgagaaagagtaacggggcctttacttgatgccaagatcaatgtgctcctggataccgaagccgaagcatccggtgtcactgaagttcctcctgagcagctcgtactccttgaccttgagcccgctctccagcagctgcatcgccttctcccctctcaccgtcacgtagcacgcgatcttctcgttacgcctgattccgaacgaccgcacggtgtacctcgctgcaaagaaagcgccccccgcaaactctcgtcatcaccacaacgaagctaagagtaaactagagtagagagacggcaatggcggagagcttaacctacccttggagaacaccggggtctgcccgctgagctgctccagcacctgcaagaaaccggagagagaggggggttgaaatggaggttggcgaaaggagggttgggagaattttggggggaggggggttggtgaccttggaggcgcgggttaggcggtcgccgctctcgccgacggagatgttgaggacgagcttctgcaccttgatctcccgcatcgggttcgactgctttttttccgacgcctgcaccacaactcaccacacgcacgcggaagaggggtgttaggttgaggagatgaacagcgatgagtcgggaaggagggagggaggaggcgaccatggcggagatggccgggagttcgtcggcggcgaggagggaggagggaaggtggcgtggcggcgctgggataaaagagagagcgcaaccctaggcggtggctgcgaccaagaggtttctggatgggcccaattgtggtaagtggccttttgaacgacagcgaaaagaatggcccaatgcttcgatgcaaccacaaaatgggccaaaagcccaaattctaccacgtacaaatgtgcccgcttgatgagttttggattatttttgggattttaaatgttctaatggtaagaacattttattcggtatttttgagtaaatttcaaaaaactacatatactttgacaaactattataaaactatagatttaaaaaggtgtatcacaaaactacagatttaggaccgaattcatcaaagaactacatatttaaggtggaagatcaccaaactataaatttagtaataaaattatcacaacagttcatgttttgcatcatgttaagtacaaaactacacatttatcactctaacatagcagtagtggtaggaatttaagctgtaaaatatgtagttttgtgatactctagtattaaatctatagttttgtgataaattttgtgttaaatatgtagttttataatacgacgccttaaatctgtacttttataatacttcgatcaaagtactgtagttttataaaatttactcgtaattttatttgtatgagcaatcataaaaagagatatgaccaacaaagaataatctcaaaatcaaaatcaaattatattattatagattttgattgcaatccaaatatttgagggacctaagagttgtatctcaaaatacaactcaactttttgaaatcttgctctacgaaaaaattacacgaaaatatccgctagttgtaattattgtagctcgagtacatttcaatcatattagcttaactagtcgcaagataaattttagattttctcgcattgccgccgctagttataacggcatttcattctagaaaccagactagaaaatcattacaatggagaaaaaccttagatgtggtgcatgacttcactcacaaggtctaaattctgatgttcataattatgcatgtgtggatacttaactgagattgtggatgtatcaacaggctttcatctctccagttgtatgttaaaaggatgtactcgtaggtatgtgcatgtgcagtgatgcatgtacgtgcatatatattccatataattgagatcacctcgatgctttcatgtgcatatgcatacttttggacaggggcagacccaggccacgggtcaatgcctaggatttggattgaaatctcactacgtagtacaaaattccatcatgtaagttcaatcttaacccaaagtgcaatgggctagcctaggccttgaccaaggctgggtcagcccctgcctttaaatcataatgtagagcctaaatattctttctcttacacggttcccacatagaaaaaaaaaacatgagcaagtaggagtgaatcgctgggcaaatctcctttggcagatagggatgggatcaaatggaagcatcagccatatccatatccaatccatccctctgccaatggagtagttgccctgcaatgcacatccacaggctcgatctcaaccattttcctcatcagaatgcctcagatagtagtagcaagtagtattacatattgtacatattgtgattgctcgagatcgtgttggtgtgatgatgagcgaaggggcgacggcggtggcagcatttatttgctgccggaaacggcatatccggcagcacaatgctttgctgcttctccagctgaattcgagagccctttcccctttcgtcgtattgatatttgacggccgatgcggcgatgccatattgccatggaagaaaaaaaagggaaaagaaaagagagggtgaaatgccaagaatccgagttagctttattccgattttggagatagatctcgcgtctttcctggacagcctacgtggaccctgtgttacgcgacgagaggccgctgctgcatgcgatgcccagcgtttgttctcttcttgtctgattttttctttgtaaaaatattttgcagtccagacagcacatagatagagagagaaaggcaggctgccatttgtgctgtgaacagttttgcagaatgcgatgccattgttctttcgcaccaaagaggaattgccacttgcgatctcaggatgcgatgctgcctatatatctgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtatgtattgatctgacgatcaggttgtctcatcatgcccctagaggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatagatataagttatcccctatagccagtcggataactatgccatgtaggtatggggtacccataatctccacagtagcccctgagaccttcacagtcgaaaagataatcttctctcgaactagattactccaaagctgagtgcttcaatcatcttcgccatggtctccgaagtacttttaccaaatacgaagactgtggagggctgaaaaataaagtcaggtgtatcgactagatgcacctaataggtgtagcccccgactatgtggttaattgaacaaaccaagcatatagtcaaggaataaataatccaaccaaccgagtggttttaataattatagtcaaccaagcgacctgatattaatatgtagcatatgcggtgtgaatccctgaataacatgatccgagtgatataccgactgctttgtaaaatatgatgagtgtaacctaaagttggttacatcattgaaaattcacatagcaaaacagctataaagaagcttatatattgtgaataaagaaatttccaaagtattgggcatacgccatgcgcacactgctttaacagatgtgcttaagtccctaaaagacacatggtttcaccacacccggaaatatatgacatatgtggtataaaatccaagtaaataaactcataaaggatttaccaaccgcctgaaaaatgaccacaatatataatcagcctaagccataatattggtcaataaaaatgcacacttacgtggcgaaaagcaatgatattgtatctaatcaattgcttaaaaacccaaacaacaccttgacttatatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccaagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaataactgacgcagtcggcatggagatgaaatgaccaacatgaagacgaaattgctcatcagaagtaacggaagatgtcagtggtagtaaagatgccaccaatcaaatgtaatgaagttgcataaccatggaggtgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattggcggcaacagagatagccgactatgatgacgaagtttcccatcaacggcagcagagttggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgagaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccggtgccgaagataataaagatgaagtcgctccaccatgatgacaaagttgtattgccgtaatgaagtgaacacaagtcggcggcaacagaagcaaaccggtagtgaagacgcgtagttgtgaagataaaagcaccaatcggcggcagcataatcagtcggcgacggaagatgaagatgtagaggtaagggcactagtcagcagcagacgagacgaccggcgatgaagatgtagatgcccaacaacagcggcataataggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgctagcggtgacatcagtcagtggcggatgcggcggccggccggtgaagacgtagacgcccaacaacggcagcataataggccagccgtgcaggcggaaacaccagtcggcggcggtcgaggtggccggtcggtgacgacgtagacgcccaacaacggcggcataaaggccagccgtgcaggcggaaacaccagtcggcggcggagaaggcaagccggtcggtgaagacgtagacgcccaacaatggcggcataaaggccagccgtgcaggcggaaacaccagtcggcagcggcaaaggcaagccagtcggtgaagacgtagacgcccaacaacggcggcataaaggccagccgtgcaggcggaaacaccagtcggcggtggcgaaggcaagccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgatgttctgactgatccattcctggagcgtaagagataagcttaaagccatgaatcccttttatgcatatctggatctggatcttgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatgaccatcaagcaccgggagtcggcctaggcacttcccaaacatgcatatgagtgacatgagttcgtcattaatggaacaaagtttcacggatcagaatttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgatggcaacgaaggtgagccaacggtgaggacgtagacatccaacaacggcggcataataggccagccgtgtaggcggaggcaccagtccgcggcgacggaggcaggccggcgatgaagtcgtagacgcccatgaacggtggtgtgaccaaccaaccgtataggcgaggacaccagtcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcagtggcataataggccagccgtgtaggcagaagcatcagtcggcggcgacggaggcaggccggcggtgaagtcgtagacgcccatgaacggtggtgtgaccaaccaaccgtataggcggggacaccagtcggcggcgacggaggcaggccggtggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattagaaatcaatctaatatatattgataacaaattgaaacgaaaaactcaagtcgagcagtgaggctggatcatgagtgatagccggcgacgtgccatgcaacatgtataagccccggcaactaacagctaactcgatgttctttcggcatgatgccatcatcggaggtagccggcggagcccatcaaccatcatacatgcaaacaggaatcgaatcctggcggcctgtgccactcctgcaacacgtccatctgcaaggaaaggaagagaggagcactcggacacggcaagggcacccaagtaggcgacgatgatggtcgtgtttcgatctcatccagtatatgaaattcgtcaaaatatcaggaaatcaaacaatgattaaaaattaatctaatagagattaaattggaacggtagacccgattgaagatttgagccatcgaaattgatgagattgatctcggggtttcttctgaagttgattccatcgcacttttcgacaggtaattcgacgcaccccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtatgtattgatctgacgatcaggttgtctcatcatgcccctagaggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatagatataagttatcccctatagccagtcggataactatgccatgtaggtatggggtacccataatctccacaatatctttgttatatttaactagaaaggtagcccgcgcattcgcgcgggcatgtatcgtaagctgcatttgagatactcgtaagtaataggctgattgtgttaaaatgtcgtatttgttgtatagtaaactataggcatatggatcttatatcgttggtttgattataaacagagcaatagttagattagaaatcagacgtgaaacttataattatagattatttatattttagttaaataggaacgtaagaggaatgaaaagtttagagcttgagccagagaggggaaggagcggctgtgtagtgatgggcgcgtgtggaggggattttttttttaatttttctaagtgattaagtgaaagccaattattagatgtaattttcctaagatttgcaagatttttttaaaatatgtgacatgccacttattaagatatatttttctaaaagtagattagatagttgaaaataatgttaataggtcatcgatctaggtgaaaaccgttagctagatgttttattttttttcttttaatatataagattttactaatttttaaaatgtgacacttggtaatttagcatgtatctaaaaggtcatacatggtgactttgtatttttctattttttattatgtagaatgattaagatgacataatacatattgtcaaattttcaatgtttcagtgttgtttgcttgttggtgtatgttcaaattacgtattttaaattttacatagtaaaatatgagtaacataaataaacagttcaaataaattaaaaataggatgttatttgggttgtcaggtaaagaataggtggcagttcaaataacatattttattttttatagtgaaatattggtaatattgattttaaattatttagctgtctagttatgaaacaaccgttcaaacaaactaaataaaaacagatatactacatccgttttatattataagtcattttgacttttttaagtcaatttttaagtttgaccaagtttatagaaaatatagtaaaattttcaaaaaaaacatattatggatatatatggaacgttatatctaacaaaacaattttgtgtgatagatgttgttaattttttttatatatttggtcaaatctaaagaaatttaattaagaaaaaagttaaaatggcttataatatgatatagagggagtaactttttaaaattatgattattttgctatgtaactattatcttttttctaaattgttagttaaaaatagatttgttatttataaaagcatgcatcaaatcattaatcatttatatatttaggcatgggacatgcaatcaagagtccacatccattctcgttagatagaagtgaagaaattaattattaagtaataaaacaaaaatcttaactaccatacagaaaaaaggaaagagatgaggagaagggattgaggggaaggagatgagaacgtactgtagtagttgaggaagaattttttttatgagataaatccaattggcccaccagttcaagttatatatttttttctaatttattagagtgccacgtgatggcttatgagtgtttataggagtctcacgtggcaacttaagagggtttataggaagtttaatggacttttagtatataataatagatagatagatagatatataatatatgttgttaataagtatttaatttatttagatggcatgcaaacttgcaaaatgcacagtctataccacaataacatattgcttatatatagcaaaacattggatgtaaaattgtcaatttaattataaatagagcaacgttttaatagaatataaattagctatgtacatttaaattattttaaatggtcaacttaactcgtttttaatttgataacataaaagaattaggaagagaaagagatggagatataaaagaataggaagaggaagagacagggagagcgtactaagttcttatgttttttctttttccggcccacggttatacgaagccacacgtacgtacgtatgtttttttttctttttctggcccacagcagaggaagggattactttattgggtccaccaatttaactaaaaatcgacggtgagattatacagtggtatgtggcggtttaggagtgtttgtaggagtgacacgtggcagattgaaagcgtatgtaggaagtttaagccacacgtacgtacgtacgttttttttccttttttttggcccacagcagaggaagggattactttcttaaataatagatctaatccaatggtctaaaatatcgggtccaccaatttaagtgaaaatcgacggtgagattatatagtgccatgtggcggtctagaagtgtttgtaggagtgacacgtgccgaattgagagcgtttgtagaaagtttaatggacttttagtatataatagaagatagatagatagatagatagatagatgtgttgctgttcgttagcaacaaactaactttgatttgtcatcgtgttctttttattaaaataaacggttgtgcaattatctctaaataatatatgttgtactgagaagataaatatatattgtattgatgatcatgagtgctagtgagttgatgtgtgtatcttaaatttttgggacaaattgcttaaaattgtgttcattgattgtatttcttggaataggatgtttgtcaatggttatattttctctttcaattactgaaatcaattgtttaagtataggtgcatagccagaaagagttgcttatcaatgcccatgatagctgttagctagagagagacatggctgtgtaaaaacagttgaaagggccaactaa

SEQ ID NO: 80677 - DNA, 22937 bp, Oryza sativa
acggcgccatctattaaaaaacggaggtagtagtatttatagcaaatccaaagaaaaagggcaaagacgaactcacctacagaacagtgtatgcaactaagcatggcgtgtgagttgtgacagtgactgacaggaacagcttaatggtaatgtgcctttgactaatcaggtacgacctgaataaacaaagtcaaccatattcactgtgtgacgcgccgatttataggtgcattatgaaagctgaccatatgttatatatagtaggaaaaagatgaataccatatcttcactaaaatatgctatgtagcttccagcttcttttagcaaggaagatggggtgttggggatttgattggttagtcaaagtcattttcatagccttaagtcgtatgcttattcacaattttttttctggatttatatataaagtttggacttcaaattttatccgatactttatgcatactgtatcaatgttgtcaaatgttggacaacattgctgacatactgtttgataagtggagatgtccatagtataatgtcgtgaaacatgtaacttctcctttaccttgatgacggcaaaaaaaaaaaagtggagatgtccaactgagcaagggcctaagtgccgaactgacacaaatcagaggatgtgttcaacagtgatcagaactttagaagagggttgtatgatgtcaaaatgacaaacttaccgtctaaacaatcaaaagatgggacaaagcttggctgttggctctaccctggacagttggctgaactgtttactgttctccattgtatgttaatggtctggctatgaattctaaactaattcatcagaagacatgaaacattttcaggccattttctattctttttgcgattgagttagcttcagtagtccacattttttactcagtaaaatcagcagtcaatactaagggtggtagtgcactacagcactagaactacagaaagtaaaatgaagtagatacggctgtgtactgagaacagaagggaaatacataccggccagtttcttctaaagacagtgccagaacacatttttctgaagacagcaccagaacatattccggatccctaaggaacaacaaccttgtcaactgcttttgcccacttcggtacacaaagcacaacctaacactgagtcttagacttgttcttgttgattacatcgcttctgctatggaaaaggacaaaaaaaacagtagggagagataaaaataagacatgaagaaaatggccctgtgctgcttgtttgttggatggtttggaaggaaagaaatgtgcttgtgtttcagaaccagcggcgctcagccggtttcctgtttggttcaatcaaagaggaagtggcgatttggaaggaagccggggttttcagaaatataggagagtagtctctcagtgtaatcttttcttttgggaggttgctcctgtgacaacttccattacttcgacaacttcttgttgaagttaaaactttgtatatttgtacatattcttcaatcttaagtaaatttagttggcctatcttggtcggcccggcaaaaaatagggcatgaagatcaatatgttgagcatatggtactgaacaaaaaagtcctaagcccctacctcaaggaatcttctgaaacactgaaatcgaacttctcttgaacttggctgccggatgcttctgttcactcttcaagtccagtcattctggaaaaaaaataaaaggattgatcaatgaattattcaaagtgtgctatattacatatgggtgtgaacatgggatctatctattacttgactctaaagaagatatatgagcaaactgggttcccattatgactgctgacttaacctggacttttcaagtgaagcttctccatcttttactagatttaatctatcaagaataaataaaataggtcctagaatcaatttaacataagaatacatgaattagaacttctcaaagtgcgagaaacggatccttggagtttctttactatccttaggagttaggaggcattcaaaggtaatgtgtattttagtgttaatcatgaggtataaaaaattaactctagggtgaatctctacctcttgataactcccaaggaccattgaagaaatcattatgcgaacgttaaggttagatcagaaaatgatcctaactgttgtgaaactagagagccctactgctttatgaacaactttttgaatccttgcataatgataaagctacctttgttcatacatgtgatcttcatagcgttaagcaattatcatggatgatgaagcaaaaatatgtactacatgaaactacattttggactcgcaaacattgtattatagcattattagttaaaaagcaccggtgctcactgctgattttgattttgagacatgttgttgccagtactcgcacaaagaagctggttaattatgcaaggcaagcagtactccatgtccatggcatgttaagtacgatttggcactagataattgagaaaatctaaggaaagataccagcataggcactagctcttgctgataatctcttgtcaccaagttaatcagctaagcaccaacaaaaaccaaaagaaaatgtctcatctataattactgcagtatgaactctctaaacatggaattcttaagatacagtgtgtgaactgagaagcacagatatctccaagcaacaaagcaacatgttcaaatccaagctcatgttctggcactatagtagaatggaaagtacttgcaaattactgaggtcaaagagcccattttgggtgcaactttgaattgaccacctccaactataataactctatgtgaataatgtgactagttttttttccgtcctcatctccaccggaacagctaaaatccgttttaaaggtacagaaaacatagaacgtgatacctaaaaaatactgtagatgacgagcggcatcaccatgactacccctgcaacgaaatgcagccatctaagaaggggaagagggaggatttaccgtcggtgacgcctgcgccccgggaggtagataagatgccgaagccctagcggctgcagacgcggatcgtacggcagcggaggtcggtgccttcgcccatggagtgcaggagacggggggttagggttcggaggggatttgagttgaaggagaagttcgtctggagccattggaggaaggatccgagctcgccggcgccggagatgacggcggcagccacggtgttcgacgaaatgcgcggctgatgttgagggagcttgagatttttgcaataagacccctgatcgtcgatcaggaccgctaccaatggtaataacggtcgttgcttttcagatcgacgttttaagaactatttttttccaaaaaaactttagggattagggttagtaaaaactgttgaattttgagtttctgacagaagacgaaatgggattggatctataaactagaataatcatcgtaatattctttgtgcaatttataaaattcggttcaaaataaaaatgacgataattatatatggcattaagtgaaaagatgagtctagctctagtttaatatgaaactttgataaatacagacggtccaaagtgaagtttctcatgattttattacttgtagcattagaggaagtttaatagtatagccaactactagctccaaatcatctatagccaatgtaattatacaatagttgcttactatactattaatacctgatcccatctgtcatacacacattacgttttggagtccgtactgcaactggctacagatttatagcccgctgcttctctctctatttatctctttaaaatatgtttatagctggcttatattgtacatgctcttacttgctcccttggtgctgtatatgtggatacttttgtcatgaaactgcatcagctcacactatatgagcttctctttatcaacttctgtattatgattgggtacaaaataatttgcctgtctccatacttgttgaattgcacaaaatatgaatagctaaaacattttcaatgtgaatgatctatcaggctctacattttgtgagccaacaggtgactgaaatgctacaattcattaccatgattgccaataaatgcttgatttttttttaatttgatagcctttactctccttatgatcaattttttacatttcgggttactctaactgttaacccataccttaatttgcctaataaattaagtattgtacatggcttcgttttccttctcaagttgttgttttgctacaatttggattgtaaattaagctgaaattatgagaacctaatctacaaagtttgcaagtacccaggtaattaaacgaacagttcaccaagctgtagttcagataatatgcagttcgaataatatgcattgaaataaagtatcagtttcttgttaaaggtataaaatgttgagaatataggcatataatgatttaatatattccataaataaatcatgacattacagatgtatactagcattaacgcatcattatatctacacatgtaaactaagcagtaaaacatgaacatatcaaatatgcgcaacatgtcgaacacgtaccgaggtggcggaaagaccggttgctcggcaggaactactcgcggttgcgagcgtcgacgaatgcgcgcagcatgcgagcggagaggaaggcgagccgtcgcggacgaacagggagcagtcgcgcgaagcgcttcccaaaaaccttattgccgccttctctcggtgcaggatgtcgaaggcagaggttccggagacctgctctcccgatcgctggtgcacgctggcgagcgggatggagtagtctacgagcgacggcgcaacacagaggaggaggcaaaccctagattgatttcgcgtgtgttgcgtgaaggcggcggcacggtttaaatagagataggtcgcttgatcagggcgcccgcatgatctccactctgcgtaaccgagccggataagtcgcgcgtaacttatccggactccacgggcgcccgcacgatctccactctgcgtaaccgagccggataagtcgcgcgtaacttatccggactccacgggcgcccgcacgatctccactctgcgtaaccgagccagataagtcgcgcgtaacttatccggactccacgccgttttcacgcaccggatttttcgaaatgtttccaacaacaaaacaaatccgaattttcctgcagcaaaacaaaactgcaaaaggagactgcatatgcgcaagggtgaggagccaattttgcgggcggaccattcaacgcgtacgtcgtgcacgcgcgccgcctgccctgccagaccaggccagtgagcgcgcgcgtgtggtccccctcttctctccaccacacatgcttcaagtggctaggagggcatccttccttttaaggaggtcccctctcctagaataagcaaggtgctactaaactccatatgcatgccatctcatgaggtgggcttttgtgattttccaaagaattaatcttcgaatgggccttagcccatctattaattccaacataaaatatacggaagaatctcctctgacataaagttagatggacatgtaaagttaaaaagatttgggtccggggcccaaacatttgttaagaaaaaattgtgagtgttagggattgaatattggaccatcaagtgcactttgaaaccatacaccatttgccactgcactatcaagtgcatctccacatatcattatattacaaagcaaaccatttatcttttgtagttccattttttttgtgaagtatattattgtcgatggaattttaggtgcataactcatgtttccctgtgtgcatgcataggtgatttacagtttttgcttacattcttacgtaactatttacatggaattgcctgttcgggcccatggtagaaaaaacacagtaatgcatgtaatgcatatgctaagcttaggattgcgaaatgcatgagcaacacaagaatttggccttggattggatgaaaacccagaaatgttttaaatgttatatttgtatgacacagaaagattgacattaccctgaatcctggatctttggaacgaaatttcctacaaaaatatataaattcatagcaatttttcaaaggaatgggtaaggtgaatccaacagtccagttcctctgcaattccccggttcttcttttggttcattagaaaaatgttggaatttcacatgagtaataaaatcctccaatacagtacagataggaacttttttttaaaaaaagaaggaaattccaaggtaagaacaggcctgacttgagtactcagttttccacgctagtaaacagtaaactgtaaactatagttttccacccagatagtagctactaagagaaggaaaaccaaaaccaaccaccgcatgcactataatatgatgttgacccactgatggtgatgctcgtttacctgctaatttgtttcttttaagttagtgattgtcattctataacactcatctctattatactatctgctaatctgctatatccaaagtctccgttgtcctcaagtccacctcggcgggcttcatgcaagctgcaagcattggcatctaaatttcacccaaaaaaagaaaaaaaaggaaaaaaagcagagaagttagcctggcaagtgacaagctggaaaaagagcaatcaatttcagttgaattccgttaccgaagtgtttaaacttgctgaaagtttagcttgcatggtcagtagttggtcgctggactggagcaactagaccaaaataagctaagccatggcggagctggtgccgcaggtcgtcggcgccgtgagccgcagcatcgccggccgcctgctcgccgacatcgacctcgccagcagcgtcggcacgaacgtcgaggacgtcaccgacgcgctcacacggctgacgtcgatacgggccgacctcgaggcctccatggggaggctgccgcagcggcggcggccggaggaggtcacggactggctgtcgcgggtggacggcgccgagaagcgggtggccaagctccggcgagagtaccagcgccggtgttgctcctgcggcggcggcggcgccttctcgctcaacctgttcgcgagctacgccattagccggcgcgcgtgccacgagcgccaccgtctcgccgcgctgctcggggagtgcgacagggtgaggagcctcgccgccggggcgccccggccgtcgtccggcgccatggtcgtgccgtccacggtggtcggcatggagggctacctcgaggaggccctggcgtgcctcgacgaccgcgacgccggtgtcgtggccatctgcggcatggccggcgtcggcaagagcacgctgctgcgacgcatcaacaacgtgttcgtccaggaccccgacaggaggcacgagttcgactacgtcatatggctcgacgcgccgggcgactgcgccgccgtgggcaagatgcaggacgccatggctcaccggctcggcctgtgcgcgctcccggacggcggcgcgccggaccaccgtgcgcgtccgatctttgaagtcctcagggactcgagcttcttgctgctgctcgacggcgtaaccaagcctgtcgacttggtggacatcggcgtcccgcacctcgtgcacgacgatcgccggaggcagaaggtcgccatgaccacccgaacaaggggagtctgcggcaggatgagctcgtcgcgaaggattgacatgcaatgcttggacagtgaccattcatggcgtctgttcagagagatcgcccgcgacgagacgatcaacgctgacccgaggataccggacttggcgaaggaggtcgccgggaggtgcggcggcttgccgcttgtgctcaccgccatcggcggcgccatgaggtgcaggaggcagccagaggagtgggtgagcacggtgaccgcgctcaggaacttggagctcgccaagatccccgggatggacgccggcgagaagccaggcgccatgctgcgatcgctgcaagagagctacggcgacctgcgccatcccgtgctccagaagtgcttcctcgccacgtccctgtggcccgagggccacgccattgacaagggcgagctcgtcgagtgctggatcggcctcgggctggtgggcgagtcgctgccgatggacgaggccgtgcgcacggggctcgccgtcctcaacgagctcgaggaggccaacctgctgctgcccggcgacgccacgggcgaggtgaagctgcacggcgtcgtgaggggcgcggcgctgtggatcgcccgtgacctcggcaaggcgccgaacaggtgggtggtgtgcaccggcggcgtctccctccggtcgaggcagaagctagtggagttcttcgagcgcgcgcgcgacgcggagcgggtgtccgccatgcgcagctcggtcgagcggctgcgggcaatgccgccgccgtcgtccccgtgccggagcctctccgtcctcatgctgcagcacaacgcggcgctgcgtgacatccccggcggcttcctgctcggcgtgccggcgctcgcgtacctggacgcctccttcaccggcgtccgcgaggtcgccccggagatcggcacgctcgcgtcgctgcgttacctgaacctgtcgtcgacgccgctggagtccgtgccgccggagctggggaggctgcggcagctcaggcacctgctgctgcggcacacggcgcgcctctcggcgttccccgccggcgtgctgcgtgggctgccgagcctggacgtcctcgacgtgtgcccgagcaggtacaccgagtggtgcggcgcgggaggaggaggaggaggagcgagcctggacgagctgaggtcgagctcggcgttcgtccggtccctcgggatctccgtcgcgacgctcgccggcctacgcgcgctgcgcggcctcgacaacgtgcgcacacggcggctgaccgtgacgcgggtggcggcgaccgcgccgtctgtcgcgctgcgcccctccatgctgggcctgctcgaggccctgcacgagctcaccgtcgccaagtgctccggcctgcaggagctggaggttgtcgccggcgaggaggacaacgcatggtggcgccttccggagctcaggaagctcgagatcgatgagctgcacgagctggcggccgtgcggtggacgcggacggacgtcggggcgttcttgccggcgctccggtgggtgaagatctcacactgcaacaggctaaggaacgtgagctgggcggtgcagctgccatgcctggagcagctggagcttcgccattgctcggagatggttcacgtcgtagacattgacggcgacgacgaggagcagcgacgagagcacccggagacgcgcacgttccgctgcctcaggaggctgctgctggtggagcttccgtcgatgggcagcattggtggtggtgcagcgttgagcttcccttggttggagaccctggagatcgccggctgcgacagcctcggagagctacctgttgagctgcaaaaaaagttgaaggagatttgagattatgttagccaagctgtgaatctgaacattgttcctagcatcttaaagcttaagaaagaaagattcactcaagaagattagtctttcatataacacgcgaacagtgcagaagtttcaaacatcgcaatacatttagctaccccttatagctcctttaattaatagcctaacaaacgtaatgccagaggcatcaaaattctaattctagagccggatagcccgggctagcttctgattgtgtggcaattgttctagcatcttacacatttcacttcagaacctattctcatggaaccagctatgaatgaggggttcagaagatatatttcacaaaggaaattccaccactcttccaactttccaaagcgggccctacacggtgttgcatatgtcaacaggccatggtgaggatcaagatcttgaggtgcatcatgcaggcagcacactgcatttccgatgacatcctgatgcagcacacttctgtacagtcaatgcgataagctgctccagtctgatcattcttcatgcctcagatgcctgttcaacaccagttatatgagctatgcaggcaaaaatggtagaacctcgcaagctgctgtggtgaggcttctatggaaatcatgagcccatcaaaaggtcaccaaattttcttgaatacacacatgactgcaaggtagagtaaaccgtaaggtataatagcaaatgaaaaactgtagaaggctgtaacagaaaactgagaaaatcggctagtcgagagactccaggattgttagtgccaataaaaagttacaacggtgtgtacactaaaaaaacaaaatgttagacctaacatgccagtataggacagttgcaccaaccggcgaatgcatgagcaacagaaaaatataaaaagaaaacaatatggcagcattgtatcataatttattcaggcaacattttggatgagtgcaataagactatcacaacattaaatatatttagtaaaccatgctttaaatattgaataataaaccaatccatagtacctcagtggttcagtaactagaacaagatgtcaattgacaggctaactggtcattcaaagaccacaactgacaatactaggctttgttttctgtttgctcgtccaatgaaaatgaaataacaaacatgtaacaattaacaaacttacatattaagagggcagcaactgctaacacaattaattgaacaggacgcccataccgaattcgatatcgcgacctctgcagtcgtctatgcagggctccaagacaaccataaagtttcttattgtatgtactctcatcacaagtacttacacaactcttgcttctttcaaagcatctatccgatccctacagaaggaaaggccctacagcattagagaactagaatgtattcaaatgaaagcattgttggacaatgaatatttgcactcctcaaggatgccatctgtacctgacccatctgagaactgagagggattgtctcttccacatcttgttgatcaacagcggcccatttcacagatccaccttttttcttcgttctaggcttagattgcaaggcactcgtcagtgcacatgttttcactatcttcagcaaaggttcttggtgcttgtcatcatatggtaggtcagcagaactctcgctctcatttggacataacatagtccatgacccgatatcagcatgggcactagcagcccttctgtgcccacgatgcgtttcttcctttactcttgctgaactcaactcagcggagccagaatccttggagctgtcagcatacatatcctttttaaccattgctgcattgttgcccacatcaatatcaccaacagatggaattgtaactactttgtctcgctgttgaaaagagcttgcagataggaaggtagcaagatcattccgttcatcctcatccaaatcaatccagcttagggcaccccttccctctgcaacattggattctttcaaattgttctcaacctcaagtatgcgacaaccgattgccgcaacaaagtcatcatgccgtgcttttgtgtcctttccagctgagaaaaccttgtcgtttgatctaattgcccgctccaattcatctagctagaaacaaaacacaactattagactcttttgccatcaattttcaatataaaatccctgaaattgaaattaacacatatgggacaaattggcttctcatattcacatagatcagataggaggggaactacattccacttagggctcaaagcaccttaaatgacatgatctacataaatgcaggttttgtataataaaaaaaaaagttctcatttaccacaattcgtaattggtaaaaaccatgattttcaagaagcaaacatcagtggctcataacaacaaacaaatcataccacgttacgtgtcttcctgctctaagcaatgaactatgtttctaggtatcctaataatttagaaaattaggggcaaaaggcattcgtcaaccacagatcaccacgacacagaagagcaattaccgccgatcgtgccatggctagacgctagtatacagcagagaaatggatgtcgagagagcaaccaattcacctgccacttggcggtgccgagcgcagtgtgcagctcgcggcggagctcgccggcagggagccctcctccacccacggcagcagcagccgccgccgccgccgcctccgaatcgcccccactcctgtcctgcacccatatcctgtacaccgactccatgctacagagacacaccgagaatcaccatcagatccatacgaacgcgacgaacccccaaccgaaaaaaaaaacaaaacgggggaggagacggcaacgcaccggtcggcggatccctgcacctcctcggcggcggggaagaaggggtccttctcccagcggtcgaacgacgtcgccattgcgagcgagaagggggagacgagggcaacggaaagtcggaaatggccgagacgagacgagacgagactccctcgcgttttttctcgtggtggccagggcgcgggacgctgcctattattaactggcgaactggcaaagaagaggggatttcactgccggtttctctgaaaacggcaaaacgcttacgctttttcctctgaaaaacggcgaagcagcaaatcccaccaggaattgatctgcgcgttactacacgggaaagctcctcgtttcgttgaattttattggcaacatttaggcaaaggtgcgtggttggagactgctgttgccttgttggcttattgcttagtgctcgccgtgtcgttttatctcgtgctgtagcatttatccgttatttattaagcaagggctgtgttttttttttgcttagcttgtcatacagcaggtcagcaattgctgatccatggatatcttccaagttcgacatttgcatcacgatgagcatatgctgtctctgtattgtgtagatttgtagctgatgacagcttagggctatctatggttttccctggtaaaccaacagattgaagataatttgattgttacaatgcagtgccttctatatcaaacgaattgctggttcggatgagtgaaggcattagatggaagacagattccctgactaggatttgacaggcggacgacaacaaggaacacccaagtttgcatgttattatcagataccggacgaaacaaaaagacaaagttgaactgtaatcactaaaaaaaggtgagtcgaatagctgcactgactaattcttgacacgcatatgaaaacagttctgcaatcacgacatcaaagaacatcagcagcttgtctgagaacccaactggtcaactcacatgatcacatcttcagttctgtcgtccatgttccctgaacactggggcgctttgttacgtgtctggttctcagcttcaccactttcctgcccagagaattccttagcctggtagcttgcaatagtatgtcctcgggcgctaaatttcggacacaaacaactcgctcattatgattttctgcacaagaagaatgttgattagaaaactgaatgtcataagcttcgtttttctcaaaaacgaatttgttgtagccatgtaaacacaaccatgaagaaacattaataatggaacaagaaaaacagtatggctgtttggttcaaagaataccctcattcctagagtcttatcagatcctacatgatcctgtttggttattagaacgggaacatgtgaccaataaaaatttgtttggttattgcaatgggattaacctcattctttggattgaaacaatccaaaggtggatgagattatgaaaactcatggaatgcagttatccacaagggcacccattcatccaagatgggtgtactaattgtggtcaaaatgcattcctcaaattacaggcctcttaacaaggttccttcggagaaaaatcacatagtacaaccataatgatgtgtttaaaccaatgacccaatgtccggtcatcaattcacagataagacagcggcctactgatgttttgcatcttgtcaaacaggcgagactttgggtagacaactactcctatagtatggcattttactcagaatggactcaaagatgtaattcagtaccagaaagtgatatccttatcagtaacagcaataaggctcctatagagttcctggtaattttacaatggttggaaaacaagggagaagatcttactgtaaatgcccttcaggttaggatgctgtccacggactaactctgtcaccacctctaagtgggggttcttttccttaaaagctggaagatgcgcctccataaaagccctgcaattccaaaaatcattttcatgaaggagcaaccaaattaaaatatctaattgttcagacatcaacttccaacaacacaagtattggcaaaatgacaacttccaaatgtgtaagctgggaaatcatacaagtaatacttgaattatagcatattgatatacacaaagagaggatataatgtgaaaattactgtccagaaaaaaacaagttctcgaatgtcggccatgatcctaacgtggcaacgagcagcttataattggctctaattgtgaccaaactgcctaatgtctagctctgatttctctcatgtctcggtatgataaatgcacatcaatttaacttgcaacaattgaacattttcccaccagggcaatatgtatgtatagcccttcgttatgctttatccacaaagaattgaacgaaagtgcaaacctatctccgacgcacagcaaagactactcggggtaatcgaagacaaaaagaacagttcccggatctaaatcaattcccggcaacaaaggaaatccggaccagatcatctaggaggcccgtagtatcatcacggatgagagctatacctgatccccctgctgctccctccccaatcgcagtagttcaccacgagcttctgcagctgccaaacgcccctcagcgccatccctgccgccgccgccggggtcgatccaaaccgggagctacacggggactccgcttcgctgcacgcggaaattcggagaccccggatgaggaagacgaggatgcaagcggacgaagccaatcgatcagtccttaccttgctcgccgccggcgcgcgagttgggggaggagacggcgaacggaggaggagacgacggtaggaggggatacgcttcgttgctagggtttagcccagcgggagatgcaaagagtggagctgggcctcggtaggccgggctaagaccaggcccattttatccactagcctagggctttgggctttgggccatgggctgtacagatataatgtatcctaacgattctgtacaattatttagagaaaatccaaaaaaatcattgacaagcacttgttccaaggaattgttaccaacgagtacgagttctatgaaatagtagtagcatcattttagaagtgactttgtccaaaaaaaaatatcatcatcaatagggttccgttagtagttctcccttaggtgctatagattatagaataaatagtgtatttaacgatgcgggatggtaagaaccctaacggtgatatcatttctaagacaaaattgcttatacgatggcatattatgaaacttgcatttgtcaatgaaatttcttagattttggtgtttattatcaatagtatttcttggattttctctgtttttaagtggacgattccgtgctgtcgcttgaagttttcccgaaatgaactggctggtactgtgcataccagtcatgagcgcatggaatgatgcaaataaacattatctctgaatcttttttgaaaagagattatctctgataatctgatttatagactcggcactttatgatgtgtttcaaaatttaaggatgttaggcaccgctcagcagcaagcggacctaaggcgcaacatgctacaacttttgcgttgcctcagtagaatagaataaaacaaaggagcaaatctgcaacagatttccagtgcaatccaacagcagcagatggcgttccgttcatgttacgttctcattctgcagtcttctgctgccctcacttgttcaaagtagggatgcgcctgcaggggagacaaaaagcagcatatgttacagacttgcgatccagggtccaggccaacaaactgtttgcaatacatatgctcgaccaacagcaagttaagcctgtgaatgaatagcttgacaggaaccaaccatagcttcacgagcggtcagcctgtcatggtggtcgaagcgaataagtttatcaagaaaatcaatagcctgcacaaagattggtgcgacgtttagtcctgtactcctgatagagggaaatgggatatggaaaagaaaaatcataggacgagaaggaaatgcatataacctctggagagacaagatgcctattttctggatttataaacttagaccaaggtttcctggtatgcctgtgtgtagagcaacaacaaatgtatcaagtaattttttttttactaatccaaaatgtgatatgaagtgaaagcatcagaacaaatattctacgaggtaatacctcccaatcagagcctcaagctggggatcaagtgcaatcctgtatttattcaggtaagcattaagctggtctgtacctagaacctgctcaggtatagttcatcaatatgctaatgcctgcaatattttcaggcagaaagcagagcagacatatacagatacaagtgcaaatgctcagcataaacacatgcgcatgcgtctatgtgaactgtagcaaaccttggctattttgacaagctggtcatggttatcgtggccatagaagaatggttccttgcgaaatatctgcatcaaaaacagtaaataaagcataacagttgctatctttctatacgcaagtaatttacagaagtaaggccatggcaattttgataggttattttataatcataggagggcaaacacaccattccagcaaacatacagccaaggctccacatgtctaaagagtagtcataactttggaagtcaaccagcaattcaggccctttgaagtatctggataaagaaaataagtttgcagataaaactatccacattttcaaatataagaaaacttatatagtcttctaaaaccaataaatttgctataacactggtaacagaggatggattctgcttatccataaaattagcaaattcaaaataattattttgctaacaaatattatgcagaataaaggtaacaagcgatggcataaggctatgtcacttcagatattttttattgaaataacaaacgataatccataaatatgaatatgaaactaataggaagctaaactagtcccaagcactctataaataatgttctataatggaaatttagatatcttcttggggttaataggatggggtaaacatttaaataaacaggacaccatcaattgacggagctacagaatcatgaaggcatattttatgaacttgccttgaggcaacccgaacattgtactctttctctggaaaataaaactcagcaagtccccaatcaattaagcgaagcttgcggagttcatggtcaatcataacattgtgaggcttgacatcgcggtgcataattccttgagaatgacagtaatccaatgcctggaaggtaagcaggacggaatttagaaaaaagataacaggagattagaaataagtcctggctactaaatcgacgaacaccgaacaagcccaactgaataacggaagccatagaagggagattattgaaactagtaactaaataagaatataatagaatgttctgtaattaccacatatcctttttgttatcagtacattcacataaacaattaggtagactttctatgttaccgtctgacatgaaagaaacaaactttataagtggaccatatatgcaagactaatcaagcagaacataaagttgcaacatttgtttcagcctctaattcaaactactgtaggccatagcattaatactaagtatgctagagagtcaagttaatcaatttatagattaatgcatacagttctataagacattcaacattgcaataaacaacaattgcatcatagtcactatctaccaggcatagcctttccataatgccatcgtgaaatatgttaagctaatgccacttggaacaaccacaacccacaactccacaagcacaattcaagagcttgttattaagtccatacatagccaatggtcaccatctgaaggggtatgtacatacagatatttcaaactatcattgttagactaaagcacaaaaactgatttgtaagcgtgaacttattgtagcacaatggatttgggcaaagtttagcttaatatggtgtgataggaacaatcagacccaagtattgacaactatattcatcacaagagctgaaattttcaacacttctactaatgactaaattaaaacagaagcgctaccttaagaagttcataaatgtagaatcgaatatcatagtctgtcaatgttggatacagaactttgaaatctgtgctgtttacatattcaaatatcaaacttggagtttttgattgttgatctctgacaatattgtgaagtttgacaatatttggaccaccacagaggttctgaagaatttttatttccctctttatctgcaaaagaattaaactgctcatatataatagcacagagaattctaataagcacatgagcaaacagagaacagttcggaagaaaagatatgaggttaaatatccaacaaatgagcaaaagtgagatcgctcattgtagtggaaaggagcacaaaaactaaataataaaaactgtagttaataataatctaacttcttaagtaccaccatccatacaatctagtaactggattcaatgaagtaactgaattcaaaagtaccaacagccataaaatctgaaaatggcacaaatggacttgaacagaattaggatgttaaaatttagctgatttaaccaaggaacaagtcagcgtttagagaagtaggcaatgcaggtttgatccatcaaactgttccaagtattgagtgtgtcgcgaggaataatttaagcagaacatccatatatgttaattttcaaagaaaacaaggataccttctttttcttaacaggcttgagaattttaatgatgcagcgctcatcatttgtcacattaattccttcgaagacttcactgtatttccctctgcctacctttcgcacaacctcgtaatcatcctgctcactgaatggagaagaacaatccattggtaacagagcataactaaaagaaaataaatagtttgatttttttttacttcacattcccccaagttgtcaattaaaacagtcaaatagatattagcaaggtagaagaacattttttaatcatgataacaatatatggtcatgtaaatgctgtctattatccagttaggcatattggttggtgcaaatctagtttatttcaccaaaacctcctctggccatacattgagataaaatggtttccctcaatgaatatatttgtgagtgattttagtagtgtagaatgtagttccctcaatgcacacacagctcacatgataaatctagtcagatgacccaccaaaaaaaaaggccatcaatagtattgaagaacagtgcccatttgttcaactaatatatatatacctccccaactacaattaggaaaactttagcaactaatccttcctgtcaaacttcaaactatcaccgagatgaaaggaattgtatgatcatagcttggtaacaaaggtttcgaaatatacagtatcaaaaacagaaggtccaactctaaattggcaacacgatgatgaccagacccaatagccacatcgagcgataccactgccgaacaacacaccgatcgacaacagctagttcgcagctcgcacaatctccgcagttcaatcgtacgatctatccccaaccctccagcaacacacacacagtcacagatgcaatcatctcgcatcgctacgttattctaggcgacgacgacacgagtgggggggggggggggggggacaatcacacggtagcacggcgaggcgtaggtgggaaggaatcagttcttacccccattcgacggcgagggcctcgtagtcccagtactccctggggcggtgcacgttcacgtcggcgtagacgcgggccgtcgacatggccgccgccgccgctaccgacgccaccgagcgggcgcgggggagggaccccgcgtgcgcccccgccgccgcgagcgccgcgacggcgcctgtggcgagggagccgacggtggcgaggagggaggggagtatggcgctcgtggtagcggtggcggtggcggtggccggcgcgcgcggcgaggcccgatcggattttttttttccttcttctgggtggggtcgggtgctctggtcgggtcggaacgcgacggggtcgctatatcatatcaggtcacggcgaggggagcgggttgttttggcggtttcccgctgaaaaagggggtgtgcgccatcgcgcagcacgccggtttctgaacaagagatgcgtgcacagctcctgcagcaacgagttgtctgtttttttttcccgaacacgtaaaaggattgtaggattgtaggttatttctgattgcagtaattggaaccaggttttagctaaccggttgaaaactacgaaacttcaaggtttcgagattggatgaaagtagattccgggtagactttgaatggtgttgaagaatttaaatttaaattttaacgaaagatgtcgtatagctaagatcggaatccagcacttatgatgcttctctctcgtggcccgatattctagaaatgggataactctcgctttgatcaagtgcaacgtttgcgacgtggctaccaaccagaacaagtccagaacgccgtgcaatcgctagaccacaaatgatgtcgtaccaaccgtaacgtgcggttgatgatccctacaatgcaaacgagagaacactgcaagaacaaaataaaatgcaatctaaatattgcgaataggggataactctcgctttaatcgagtgcaacgtttgcgacgtggctaccaaccagaacaagtccagaacgctgtgaaatcgctacaccataaatgatgtcgtaacaaccgtaacatgcggttgatgatccctacaatgcaaacgagaaaacactgcaagaacaaaataagatgcaatctaaatattgcgaataggggattaaacacaaaggaatagttacgattgaagtggtagatctaatcgacccggcaaatcaacacaccaattattaggggctctaaatttatagtcgccgactaatcaagcgaggacaagagacaagtgaatgacacttggcaaaattcaattaaacaaaactcaattgttctagagggtgtacatagacatttatagaagaaaatagatcaaaggtttagtgctaattcgtggaggtgggcctagtgtattacaaggtccaagtaccaagttcggtttcagcaacaacattgtcttgttttgacaatttccgtttactcggaatgaatttgtatatgaaaccggatgcgtttgaaaggtgacgagataagctttccatcaagtctaacatcacccgaatcggagttggcatgaagacactaggtccatttgaagtcaatgctgtctccggaggtcgaactggattccaaaactcattggagatgtatattgtagatcctccattcatccgatgtattcttgggcaatgttttatatttctcatgtttggttgtatacatatacttgatctcaacctattggcaaaatcctttaggtatgtttggataatgggaaatgaatggtgggattgggattgagaaattgatgaagggttttgattaaatagaagaaggagaatgaatggttaggatttaaagatgtatttttgtgggtaggaaattactttattatcccattagccaaacactgccttatactttagaccggaggtagtattcaaaagttgtttatggtaattggctgcaactcttttatatactctttataaaacaaaaacatctttgaatttgccgttaccaaaatcttcatcattttttttgaacggaaaaatcttcatcattgaatcctcaatgtactgctactgaacaatgtaacgcattttcattttgccaacaaaatggaaagataatgagtctgtgtaccgtcacgtcatcactttgttaattgtgggcctccatcagtttttgggcttaaggccttaacacctggaccactcgacgcaacctagctggaggcccagtacagtgccagcgccgaaaaggaaaaagtatacttcgattccctcgactatcacccgagtacgattcatatccactaactataaaaccagctatatcgactccttcaactattaaaaccggtacaaacaatatctctcaatgattttggagattgttttggctgacgtggcgcctacgtggtagtcttgaccaagtctttgtcgtacgtgacgcttacgtggcattagaataaaataaaaataaaaataaaacaaatatatgggacccatatgtcattcgcaaggaaaaaaaggcattgtgggacccacatgtcatcctccctctccttctcttcttcctccccctctctctctccctccggcctctctcttctcgggacgacgacggtagggagcagcggcggtggtggtgtcagtggggacggtggcggcggcggcggtggggagcggcaacggtggcagtggggagcggccgcggggcggtcgggagtagcagcgatggtggtggggacgaggcagtcgggagcggcggcggcggtcgggagcggccgaagcaccagcagaccagctcct

SEQ ID NO: 80678 - DNA, 2545 bp, Oryza sativa
cccattaatgggaactaggcgagcaccatataaaatttctacaaagatagttcaaaggttcttagtcaaaaaaaaaaaagttcagaggttcatcctacagatatttttcagagatcgtttaaatcttcaatatatactgtggtgcaaacttgataagtcactaagtcactttggaccaatttctctttttcaagaataaaagtttgcacaatttgaagggaaaataaaagaggcattgtacaactgccacaagaaatctgcgtgtgcactgtttgatttgttagtaatttacactttttcacatgtacaatcatagttagttgttacaatttgagatggtctcagagcaagtttatcttctcgtgagcaccgttgcttccccaccctaagtttcaatgaccagtaataagatattaatcagagacagaaacacggtcgtcgtcttgagtactatgatcttccgtccaagctgttcttgcatgatgtgttgtgctcaagctccccatggcatcagtcttctccatccttgaccgcatcttggagttcagagaagtccactacaatgttgttctccatggcgatctctttggtcaccttcttcttcagctccatgctgttcaattgccagaaaacctccacaccaactgcaagacccaactttgttagctctccattcttccatctttacaaatacaaatcattgactcgtgaaatgaatggataatatatgctatctagtaccatgggatcaacaatgccggtgccgtcctttgccgcctcggtgaagtcgctgccaaacttgtccgcaaggatggtgcgcgcgaacggcaactccggcaattcgccgcaccaaccggcggcgagcatgaccgacgcggccgcctcacgtatctcatcggtgcactcactggacacaccaaatacaattgtcatgtgaccggaaaagagatagaggacgcgatcaagtctagtgtgaggaaatgaaatgtatgtacccaggcttgtccagctttgcagcatgctcgatgagtcgcttgcaatacatctctatcatttcgaacgcctctaacatgttgtcctcccctatgacttgctctgcctgtgaggagagagcaagacattgctggcattagcacgcctcgccttggagcaatgtggatccctctcttcatcagagaaggtcgtagacacttacccggtggatggcgcgatcgaggtggtcgagggtgagaagctggcgaacatcatcggtggcaatggatttgcgagcgaggtggggccggcgagcggtggcgatgcgcaagacggcgagccccaggagggtcttgagcttgctcgtctgcttggaggtcttccgatggaggaaccccattgttaagttatcggttctcggcggcgttcctgtcctaggctgttggttatatgaactccgaccttatcagttgtatggtcagttcctttgcgtgggggaaaggaaggaggaggagaatgcgagttgcttgtgtgagctgatggaggaagtctgcatgaaggggcaagggttttgtagggccatgttgcttctgttctgggtagtttaacttttgtgtttgttgcttcactttggtgtacatgaactgtcgtactcctttcttgcatatggaaaatattgggtgggggagcaattgagcatctcctagagaatgtcaatgagcaaagcatgcagaatgcaatgagaagacagcgagccaaacgtgcttacgtgcaaagaaatttaccgtatgtaaaacgcaaacaacatgcagaaacaccaaagccagggtaatgtgctgctctgcttcaagcagttacgaaaggaagcacaatttgtgcgtggtgaattttattttaagatggtacagtgaagacgagcaccgcatgcacggctgagatagcaactagttcagtagttttactcgcagataacaaagccattacacatctaggcacttatgcagagtgccatttttcaggtgtagcgcagcagcagcagcagccgtgcatcgatccaaactttgtgcaaatagcgtgcagagttgtgcaattcatcgatcaccccgtaaagactcagttaacccgtctcctttcgcaaaacggtgattacaactcctttgtacaggacaacaaaaaaaaaagggaatatatcacctctgtaatttgtacattctctttcgtttctagcgcaatccattttaattatacacatttgatttcccagaggcagaatatcatatctgtatctcgaaagcagatcctctaatttaactgcacatgcagttgagtcactgacatgactcaactgcacagctgttaagccaggggatccctttccctgtatctccagggatcccgcgcgacgaacctccggtttgccagcaaaaaagcaacggcccccagttctcctgcaccggaattcaacagctgagctgactgaccaatgcgctgcgccgcgccaaaaccaacgaccggaagacaccacctcatcttcgggtgcgcaccgagttgagcctcccctgctcctggttca

SEQ ID NO: 80679 - DNA, 1107 bp, Oryza sativa
  unsure (1)..(1107): unsure at all n locations
tttttcctttttaatttgctaagaacatatatacaaagttttgtttttttacaccttatcagccataaagcaaacgacttaactgtggatcatcatggaacatgctttatataattgattattttatgcactcgataatacatgatctttaattcgatcaacgatttggaatagtaacatacatgatggagttcaaaaaaagtcaatacacatcgaatgaatgtgctaatattttaacttttttacatctttatctaaatcttagaagcaaccatactgcgatattttggccggccctgttttgtaactctccgcttttcgtgagacgttaaaaactaattcggcaaaatcctaattgcgaaaattttcgttctttgtgtgagagtctaagtcgtgccaggatctcaattcaatcccgttgttccctctcatcgaaatcaaaatcctccacctcgtaattcctccttcgactcaaatctccaaatcaaattccgaaattcaatcgcgtcctttgaatcctcggcagatactcgctcccaattccgaaaaatatcaaaccctaccttgagtcttccttgattcctccctgaaacctcgagttcgaatatcgaatttgaatccaaatacaaactccaattctctccaaatcagctttccctgcaaaagtctattttacctccctcgggtgttgtgggccgttttccccccttagctgtcacacccnnnnnnnnnnnnaagagagggcngaattgnnaannncagangaccccnnnaaaatgcagaggaaatcaggagaaaaccctaagaaggtaatgcaaataataatcggaattgacatgtggaatttttcttgagttctacatgtcgaaattcattaacaggatttttagtggaattttcagagccctagaaataattttaaccaattaaaaatcactaaagtgcaattgttaattccagggaaaattcttttcctttttctttttcttttccctccctttttccctcctttttccttttcggatgggccgccggcccattcccctccttcctccccctcctccttgctgggccggccgcaggccgaggcccagcctggcagccgcc

SEQ ID NO: 80680 - DNA, 7939 bp, Oryza sativa
agcccgtggagaagcgcgtgcgcgggggcgtgcggcgggagcgcgcggggggcggggcgggtggcgcggcgatggcagcgaccggggggaagaagtcgctggtcatgctggggaggctgcggcgtgaggccgtggtggtggtgggcgggctggacgcgctcgccgagctccaggcctcggcggcgccgcccccaccggagcccccggagagctgccgcggcgtgtagtacccgtcctcgtcggaggagcccagcgttgcggcgcgccgcagcggcgggagcgggcggagctccgggctcgggtggtcggcgtcctcgtcgcggctcaccccgcgccgcgcccgctcgctgcgcagcttgcggtacggggaccccacgagatcggcggtggtgggcccgtggtggcgcgcgggggtggtgggctccaccgtgccgacgtagaggaagtcggcggcggaggtggcggcgctgcgatgcgcgccggcacggtcggggccgagcagcttctgcgagtcgccgcggcggcgggcgcggccggtgatcaggaacgcgcaggcgaagccgagcagcgcgacggcggcagccgcgcccgccccggcagcgactatggtcgccttcgtagggccgcctccgtggtgtcccgagccggaccccgacggagttttcgagacgtcggcggcgacggtggtcggggagggagtcgttccggggctcgtcggcgtcgtcgtggtcggtggcgccggagggaagaagtcgccggaaggcgcgtcaggcgccggcggagtgctggggtcggaggtaaaatccggtgcaggcggcggcggcggcgatggtggaggagtccactcaatggggaagaggggctgatgcagcaccctcctcgcactgccgccgccgacaccgccggactcagcggccaccgcgacatggccacacagcaacaccgccgcgatcgcgacgaatcgcgcgatggcggggggcattgacagcagaagaaaagaaaaacaaaaaattaaaatcgagccaaccaaggcagctgcagcagctgctgctgctttctagagtgagagagagtgagcgaaggggagggaggggagagagaggaagaaagccgccatttttcggtttcggagttgtaccatatgcaatccatcggtggagatcaacggtctccctcacacgtggcatcagaatctgctttccgttttgcttcttttccctcttttcccctctctttcgcagcatttcctcctctttttatttgtaggtacccactcagtcactcactcaccaagaaaccatactttagattagatggacctttatttttcttctttaaaaaaaactcaacattatgtagctggtagtgtaaaaaacttagatggtataaagatatcatgtagtcctgttgcctctggagaaattaatgagttaaacaattaggttgtggtaggttggtgctcagcgaaggaaagaaaatattccacacaagacacattctgaactggaatcctatactttgcgtaccaaccatccagttgatgtgaacatcagtgtcgccgaacagcattccggtggcttaaactaatcaggttgcgttcactgacatgtggggcttcccggttaaagcctgggcctttcctaccgtgtttgggtcgcgcgcgcaatgtactgatttattactagtacatttttatttaaagaggatgtactgattgacaatgcacaaagcaatccgtcgttggatgctgccctggggttgcttagtgcctgcttcttttctctctttacagaaccattaacaatctgtatctttctcttgctgggattggatcttcaaataccaatctttattttttttcctcctttgttagtgctcgattagctttagtcgaaagcgttttactgtgggggctgcatgtctcctgcgtatcgtatgtactgaatcatcacgcagtactacattaggaagaggagaatataatttcatagaggagtattttgttttcccatgttgggtcccacgtgtagcatggtctgctggtcgcttggccttcggcttctcttttgtccgctttccagtcctcttgcgggtagatggatggaatggatggatggttttgtatactctaatccgcacgtcaagcatctgctttgccttggctcgcgccgtcacgtgcaaagcggccccgatcccggagcggcgctcggtcgtcccgcgcgcaccgcggctacgccacggcacgaccggtttggttgccggcgcagcgcgcgcaggttgtgtaggagtacttccttccacttgcgtggtggtggtggtggtgagaatgtgagtgagatcgtgcagggggatttaccggtagaattagaaaacggagggggatttttcaggcgtggaaacgtgggcaatgacacgctgcgcggcaggtcccgcgtggtggtggtctcgtgctctctctcctctccgcggtccgcgggccatcgatcgggcgcaattggtcgcgcgtgtctggctaggcgaataggtgtgcgtgctgaggaggagacacgggtaggtccggttaatcccgcttctgtactagtctagctagtgataaacttgggaaatgcgtttagcaagcaccggctggctgctaccctggaccctgaacaatgtcctcaattggaaagttggcatgagttaattggtagcccgaacttatggacatgtatataaatatcaacgtgtacaccgtttctcacgatggtaccgcagaacaaaagggggtggagttcacataaacaaaccattcacaaaacttggtccagtgtgttttaaaaattttggctacaggtgaaacacaaccatctttttgtcaaaaattaaaattaatttgattattttataaaaaaaacttctgctaaaccgagtagtttgtgtcctcgagctggaccaagaaatctagttctcatgaaaaccaacaggttctcgttagttttgtaaatccttgtagggagatatgtgatcggagatcttaggactcatttggattgaagtgatttcaacacaagtttggtggatctcaattgtttgggaaaaaaatcctatcattttatttgaaatgaaggaatatgattaagccattccctaatatccacgtcttttttttctttgaaacgaaggaatatgattgacaaaaaaaactaacaatttgcttctcataccaaactaaacgaattcatacttcatgcttttatttttatatgagaagccccatgcattctctctcgcgcacacactcataaaaaaacaatttcttctaaatttctatatttcatttcctacatatcttccaaacacaaactctttaattcatgtgttttataaaccacacttcaagggagatctaattaattaatgtctttatagtccattggttctcaacccttccaaattccagtatattggcagtaaaattttgcactaccaaatcgttgataggggtaaagttttgttgtcaatgtttggtttgttaacaatattgagccaaatcttataatagagtgaataaagttctaagaccctgtttagatgggactaaaacttttaagaccctatcacatcagatgtttggacactaattaaaaatattaaacgtagattattaataaaacccatccataatcttggactaatttgcgagacgaatctattgagcctaattaatccatgattagcctatgtgatgctacagtaaacattatctaattatgaattaattaggcttaaaaaatttgtctcgcgaattagctttcatttatgtaattagttttgtaagtagtctatatttaatactctaaattagtatctaaatatagagactaaagttaagtccctagattcaaacaccacctaaaaattgtgtcaaataaagcataggcattaccaaataggagtagttgacatcaaaccaaactatcacatttatgatctgagctaccgataaatttatagggtatgttttggcatcaatctaaaacggtcatctgactgactgaacccattttgaaatgtgattttctttccaagtctttcttttttacaaaattcgtgtgattcaaaagaatcctagttttgttggttcatccgatgtactccggagtactaaagaggtggttaggagcaatatgcattatttctgcctacacgaaataccagctagtagatgccaattccacaattcccatttgcattagtcccagaaagggacagtgcagaaatgtcggtggccaggagtactactacttgtactatcaacagtgcagcatgactgacgataccgtggcactgtggcagcctatgcctgcagctcgatcctgtggatcggccgtgctactagtatgactactgtatatacgtcgcaatctcgctaattccacgcgtttattatgccatccaagaaccgacctgacgctctgacacatttatgcgtatgtggacagtagatcggtgagcctcaacggagtaatcgctgcttgatgccatgtcgtattgtctttctggtccttgcatttaagccacgtgtttcgatgcgttgcttggtgttcatgcagtagtatgagtatgtgggatggatgatgcctcaggttatcttcaggtacgatgctttgaggcaatcttttcatttctgaactttctatcagtatgcctttgcttcgaaattctgctcctattaaccagtttatgcgcccaaacatactccaaagcgtgccccccaatgagaatgacgtcctgaagctccagctccttgtcctcgttgtcgtttagtactattttttagatcagtccagcaaattcaacagacgagaagtttgggccatctgattgtgtagaataactttgtcttggttggcccttggcccttcggcaggttgttaccaaattgtaaaggaataagttcgttttgggtctctctatttgtcgcccagtccgatattcgtcccttagaccgcaaaaccgggtatgacccatccccaacttacgaaaaccgggtagacgaggtccctcggcggttttggctgacgtggcgcctacgtgacttgtttgactagttctccgtctcacgtggcattaacgtggcgcttacgtagcaattatatcttaaaaaaaccgtggacccacctgtcagctacacacaaaagaataatttaaaaatagcaaggcccacgtgggcccacatgtcagtctaactcaccctcctcttctgcttcctctctccccttctcccctcttcatctttcttgcgctggaggatgcggccaacgatgacgacggcggtggagatggagaagagtggtcgccggtaggccagggagctcgcctagccatcagccgcccttctccccgatggccgtcggcgggagaagagggagcggtgcgcgacggcgtcggcggcgggagaggagggagcagcacaagctctccgccgcaacccgcctccaccaccgtcgtcgtgtgcgctcgtggcggaggacggcgagagcggtggccgtggcactcacggcggaggccggcaaggacgtagaagctggagcccttgtgcgcgacggcagcggcgaggtcggtcccctcctcgagggggacacgacgaagacgacgggcagcacggcgggtgcctgctctagctccccgtggctcctctacggcgggtgcctgctcaccgtgatgctggccggtcctggcagcggccgcgtgctggtgctggagcggggcggcgcgcccacggagttcccgccggcgccgctctgggagagctagtaggaaagggaatgatatgtgggcccacgtgggtctcactatttttaattttttttgtgtgtagctgataggtgggcccatggtttttattttttttttaagatataattgccacgtaagcgccacgtcaatgccacgtgggacggagacctagtcaaataaaccacgtaggcgacacgtcagccaaaactaccttcaaaatcactgaaggatctcgtgtgcccggttttcgtaagttgggggacgggtcgtacccggttttgcggtctagcgacgaaaaatcgaactgggcgataaatagagggatctcatgtgaacttattccaaatgtaaatgcaaagcccaacccattcgtttcacaaaattagaagaaactgggccgaggcggactcgccaagcaatgatgggctgggcctttctcctggtagtgcacgatactgcacatgattgcatcgatatggactaatcggcgcaatcagaacgcgtgaacgctgaacacccaatcgcgagaatcactacttcactagtacagtacccatttaagcctggcagtgacatgttttctactacctccgtcccattataagtgcagccatagttttccgcgtccaactttgaccgtccatcttatttgaaaaatttttgaaaaaatttaaaaacataagtcacgagtataagtcacgagtaaagtactatttatgttttatcatctcataacaataaaaatactaattataaaaaaatttcaaataaaacgaacgattaaaattggacgcagaaacttatggttgcacttataatgggacggagggagtactttctacgacatgtacatagcattgccttctggccattgtcgtatccgttaatgtaatgggcagctcgtgtggctcaagtaagcgcgtacgcgcactgcatattctctcctcttctgtactctcgccatcctcatgcacctcatcttcaaactgtactgaaaccttcattcaactcacgcacatgtactggctggctggtaaaacgtggtacaaaaaccagagaaaaacttgacattgtccgtgagaaaacaccgatctgtcgaacacgtacacgatccggccggcccgtctcgcggcggcgcgcgcacgacacgagatacgtatccgtcgctaacttccacacgcgcacgcagccgctccacgtacaggcgtacagtacgcacaaaaccaacaggtagatacccttgactatactaccttgggggtgcatgcaccggtgtagcgaccgtacgtacgtacatgcaggcgatcggagaagcaaccgcatgtgttgacgcctgcacggcacactcttcctcggctataattactcgtgttgtaccttggttgcctggccttaatcgggctttggccttaattggggttgctagtttcatcggatcctgctacagtatacgtaggcagtacacatctgacgtccctagctagaataaagaaacaatcttaattgacagcaagcgagaagccagcagcggcattgttcagatcgattaggtccaaatcgtgtagtacctgttgaaccaagcagcgacgagacgacattgatcgtccaaatccaactctgtccgcctgccaattgccacaaagtccccaatccgccaaagacccagatcatcacgaccctgttggcgcgtcgactagcacaagctcacacaactcatcacacagccaagttcgcgaatcaatcagcagccatctctggcctctggcggcatcgcacgagcctcctatcctaccacgtaccagaaaacgccgcgcgcatatgctaagctccgagcattattcttcggaatcgctccccgcgccgcgcgcgacaagagaaagctttggctttggctcgagcccgcgcgcgtcgcgtcgcgtcatgtcgcgcacgtacacgtacttcttccctcgcgaacaccgcggttggcggcgtggtgaccgactagctccggcgtgcgtgcgcggtgcgcctctcggctaggcgcgcgcgcgccacctgtgaccccgtgaatcatccggaccagtcgtcgcagctggtcacgctggtgccgtacgcgaagaaatgcgtagccagccacggccgctacgaggggggggcgggggccggggggggggggggg

SEQ ID NO: 80681 - DNA, 1316 bp, Oryza sativa
cgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcagacaaagcctttcccaagccgacccagggatacctcatgccacatagaaggatcaaatcctcacataaacataggccattttagttttcacaaatcaaactccaaccacctcgatcggtaattcaacaagcttcgcgttcttgcattaccaggaacccgggttggctccaaccgaccccgccccggcgttccccaactattggcatgcgaggtttccctgaaccgactagttacttagctagggtgtcccattccaccttgtggttgcactttgttatgattgatgagtttcccacaggaatcggtccttatatgcgaatacgggacagcgccacgcaggcaccacctccgcatcgtgagttttcacaattcattttatttttaaacacaccgacaccacatgtcgggttttcaaggcttctcaaacccatttcccaatttttcgacaatcacggtgtatgtgggatatttggtatacgcgctcagagagcacggataccgaggtaccacaagagtggagcgacaaggaatcagggtagtacaacctataggaattagtgcgactactgggtaggtccgtcggtttggcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagagaacccgcgatcaacgaaaaccgataaccgcaactatacgcaaacaatcgaaaacctaaacaaaagaccaaaagaaatatcctatttagacctattagtagtgccattaaatagatctcaattttacggaattactggaagtggaacggaggcgatcggagctacggatcgagggatatgaattttggaggtctaaatggatttcctggacaaggaaaaggaattattaattcccttggaaaagaaaaggaaggagggatcggatttagacttcctcgggcgacttaggcgcggcccgagggattctcaaggcttggccggccattgggccgagcgcg

SEQ ID NO: 80682 - DNA, 16141 bp, Oryza sativa
aaccaaagacaacccaaacttaaaaccaatccattttacccgcttcaacccaacctattaaaaaccaaaccaatccaatccatttccacatgtggaccaatccgctccaacccattaaccaatccattttacccacttcaacccaacctattaaaaaccaaaccaatccaatccatttccacatgtggaccaatccgctccaacccattagcctcctcagcccatttctatccaaccaaagacaacccaaacttaaaaacaatccattttactcactttatcccaacccattagcaggcttaaacgcatggctgcacccatgcatgcatccgaaatatctgttcatcaccgtcaacctcgacctgcctctgccgggccctgtcacgtagtatgcactgggcgccgtcacgaggccggcagctgctgcctcctgactggtactgaaatgaaatgcctcgctgatgttgaggccccaacagcaagtcacagccaccgtctctctcgtccattggcgcgttgcctgggcgtacggcttatgcatacgcacgcctgtgcctgcgctgctgtgcagccgtgcaggtgccactgctgctgggtatcggtgtctcgcggttcgcggtctcgcgcgcgtcggcgattcgacggatccgccgttggttggttggatggtggacggacggggccgcggcgtcgctttcggttttgcgcccctggttccggtcacgtaatggccgtcggacgggctatttttttgagggttttttttttctggtcctgcgtgaacgttaccgtcgggcctaattaattgtcaatattgtacccattcgtcatgcgtggcgtgttacagagaacatctcagaccatgtcccgctcgatcgatgcatcgtgctcctcacttagtcgtgaaaaagacatggaccgacggctatgggctgtacttttttctgaatgaagggcaaaagtttcgccactttggtcctgtttagtttgcgaaaaaaaaaattaagtgtcacatcgaatgtttgaccggatgtcggaaggggttctcggacatgaatgaaaaaactaatttcataactcgcctgtaaaccacgagacgaatcttttgagcctaattaagctatcattagcacatgtgggttactatagcattttatggctaatcatggattagttaggtttaaaagattcgtctcgcgattcccatgcaaactgtgcaattagtttttatttttatctatatttaatgctcaatgcatgtgtccaaatatttgatgtgacatttttgggaactaaaccaggcctttatagtgatagagcaggaataaaatggtaaagtatttacagagagtgggacaaaaacaaacgggcacgcaaaattaaacaataaggcgctactctcctgtagggattagctctgtgatttttatcgctcccactgtgatccaagtatgcgcctcctctttgattttggcaatgatggtggtgggagtggaggcaacatgcctaaaaatcttggcatttcgttcgcaccataattaccagcagctcatcgtgcgtgagattttgtactaccgttattcaactgtcgcacatccgtccgactcttgcaatcggagatctgctcctgtccaccgttatatttcagcctagattcttctggacagtatgcaattggaactttacacatgcaatctagggagggtgggccaatcaacatttcagtccagattcttttggacagatccggtactttgcgacaaagggggcaaatatgttgattggcccaccacctcttttagcctatccgccgtttagactctgttttaaataatgagccagaagaagaacttacatttaggtggagctcaacacttccaaatggtctggttgtaaatcgtcccgccgctccaaggagttgtagcctctacgccgtgctggaagagtagattccattgccgtcagcttccatacgacgaggtcctttaggtcggttagagggccaacgcattgtatcatggttcatagacaaacgtactagcatagatggtctgcatctatagtacgcagtaggtcaatatcccgaatccaggtgttaagggcaagagcctcgtgcacagtcctggttatttgtttggaggccgccaagatagctggagcgatatcctcgggtctcttattctcgagccagtgcgagtcctagaagctggttgttttcccgtcccccagaattattgtcgttgccccaacgaagaggttcttgtccagctgatcgcagggaagtgtagtaccagggctgtacttttgaccctacgagcacttaatgagcaaaaatgacggttatgtggaattaggctgtgtttgttagccgaggttgagaacttatttttcccgtgcaaaaaatagggtgactcgttaaagcatgattaattaagtattagctaagaaaacttgaaaattagattcatatgattttattaaagtaattttcatatagattttttttgcaaaaaaatatttcatccatactaaaatgtaagattctgagttgtctatgggtattgaaatatgtgtaaatgagaaaggttgtgattgattgagaagagaaaagtgaaaaaaaatcaattggagaatggttatgattgattgagaggagatgataggtgaagaaataacttcatcttgagactatgcacggtagacgtagctatattttgaaacggaggtagtatagatccgaaaacgtgtacgcaaaaaattagggagtaaaagttggaaagaggagaaactatgtcagctaatatctaccagaccacattttagcaaataatatttctgctctacaatactccctttgttccaaaataccttttgttccaaaatacaagaagttttgattgtatgagatatattttagcatatcagattcgtagtaggatatatttcatctaacaaaattagatgaaatatatcgtagttttgaagttttgtgccgaagtgtcgaaaccgggccgcaccgaaactttctatcggggccggaatcgccgccaaaccgcaccgcacgttttcgacgcaacacggcatgcacaaacgaggcccgcgggcggcccacggaccaacgtgaaacgggaacaccaccgtccaaatccatcaactggttcctcctggaaacgcaccggttttgccgttttcgccttcccctccctcctcccttcctagctgtctcccccctctcacgcggtcacgccctccgcaccgcacgccctcgagtttctcctcctcgtcgacgtcgacctcgcttacggcttcacccatccgcagccgccgccgtcgccgtcgtcgtacgatttccacgcgagccgcgatgccgcctccagcgtgggggtggggctccaacccgctggagcccgtcgtccacaccgtcgcggccttctcccgccgcctcctcattgcccccgacgccgcgcccgacgaagcacgcctccgccccctcctctccctctccctctcccctccgcccaccccgccgtcgccgccgccgccgccaccggaggtcctcaaggtaatccctccgtttttttttttttgccttcattgcgttatctctccgttgctgtattgtggcggagggggtttctgaacttgtgttgttgtgggggtgaaatgcgcggcagaaggattcgaaggcggcgcccctgaccaaggaggaggtcggcagggccacgtggatgctgctccacaccatcgcagcgcaggtgctcgatcttttgcctctgtgagtagcacaacagagcatatgaaagctttttatgtacttacctcgcactagtaagttctgtagcatcaggggtgaatttagagcacatcaacgaaccgtgactcatttgttagattgattgacatacttgtgaataggctgcaagttgttgaaagtacgcagtctggtattgactacggttaactcgtgtttgtatttgtgaattgtctttcagtttcctgacgaaccaaccaggcaacaaagacgcgatgcgagagagctggtaagcattaagcaggataaacagttagtgatatctctctagagtttgggtggaagtatggtaaagtcccttgttttgattttgggggaaacatgaggaccttgctgtcgctacccactcgtaatttgtcacggctaactacaggattgttgaatcttagaaaaggcactttcttgatgtttatcttgggggccttgtattctcctgcaatggatcctgtttaagatatagcttgtatttaatttattctttatgtgccttgaaatattcaagattactttaagactgcacagtaaagttccagcatggtaatctcgtgattttgttgctacaggatgcaggctttgttctaggtgttctcctggttcattccccgctaactttgagcttagacatttttagaaagtgttttgtgcttttggtctagcacagttatgaattaccactacattgcttgacaaataaatgttatactttgcatcgttgaaaatgggtggcagtatgttacgactactgctaaggtttcgtttggaatcgactatctcatttgattgaacctcatttagatatatgggtgtttggctagctgttatttttttttctcaatcatggtgcatacagatgcattatcatcatataaaacatctgagttgaaatttgatggatgagtctaccaaattggataactgagttttacaaattgttccatgaaaacttaaaaaataagcataggccagcacaacaactgcaaattgagcctcaatccatgatgaataatgggaagttcgttcactggttttttactcgctttaacgaagaggaattattttattatttcctgaagaattacatttttctgcatctcattattccttttgcttggttacttggttcatgcaaggtcacatttctgctgctttttatgttcagatggctataatatctagactctatccttgcaaagaatgtgcggaacacttcaaagaagttttaaagtaagaaatgctctccaaccactagcataaattatagtatccattttgatagtttgattcctcgagatgtgtttctgtgtgacaggactatgttttgttgaaatgttggtatgtaatacattatcaacctttatccattcattgttttagggcgagatataacatcatgtaggaactataaattctttgtacttttgcattatgaaactgtgcttctggatcttttatattctaaagctatgcatccacaaactcgtttaaaaactttttagttattttacaccatctgtaccttttgggaatatgatttacagaagctatggtgataatgggatgtgggaattggatgtaacaatccatttataagctcatttctcttatagctatttttcatttacttttatggttataatgtcgtttttgctgtcatagtttattatgttccagttatatccagctgccaatttctgttgttctgtttttttcttgtgctgcccttaaattttcatgtttgtgctcaatgtagcaacaataaactgtctcggcacaatattgaactgacttctttatgttctttttgcttagagcaaatcctgtgcaggcaggatctcaggctgaattctctcagtggttatgctacgtgcacaatgtggtcaatcgaaggtaagtccatattgtcaagtttgaactgttgacttgccattccgaaaggaactttcttaaggtattgcattgttaatttgttcgtatagagttgctgcaaaaataaggtctcaaagccaaaaagaggaaaattaaggcacccttttaccataaagggggtatgtgttttgaagtatagatgttttcattcacaacatcatgattttgctgaatctcatggcctcctgccctcccatgatgagattattcacaatatctgagcgttttgtggttgtcttttgcagccttggaaaacctatatttccttgccagagagtaaatgcacggtggggtaagctggattgtcctgaacgctcttgtgatctagaaggctccaacgacatcatcccgaatagatgacattagatagggatcgtttagaaattctggaacagtgacaaagtttaaaccatcactggatgggcagcatgaagagcatatgggaaaagaattataacgccgtgccggcattcttcctatacccttgtaatactagtgtatcaaatgtgatttcattttgttatttacaagcttcagctctgaagatttttgctgaggttgtcatttttgtggatttatatacttcgttctgatgctttgattcaactccctgtactgtcaatcttgcagtcagatttctgtgtcccctgtatctgaagtttatgagggcctgtttggtacagctccaactcctaaatttaactccaggagttgagtctggagtggagttgtggagttgcataaacctagctctacaactctagttcattttgtgagagagctctacccagctccacttccagttttggtggagctgaaactatttggctgagctccagctccaggaggggtggagctggagctctgcctaacaagccctgagcatcgaaaaacctggacatatgatactcctgcgctactgtacatgttgcacggttggcaattaatgcgaggtgctggcaacagaggaatgcatggtggccattttttctgctgctgctcctcggtgttggcgagaccataaattctgccgtcttatcacatcaatttttttaatcatgtactgacaccttacgatcaatgcaaatgaaatcacatcacgcatggacctttcgttatcttttgaaagaggaagcagcgagaggaggaaggtgcagaagcatctgaagttacggtgttgcaggggagatgaagatgaagcgtcttcctctgttggttttgctactctttgcatttcttggaggaggaaacatgttgctagggatcgctttggatgcaagaagaagcactacgacatcctcaggtacacaaagaaaacgatggctctctctgctctgtctcttgccctctttgtgtttttctcctgtcactcacttggttcgtgtggttcctgtcctcttttactttgtcttgattggttgagtgaaaagtgatagctactgtacctttagctttagcggttatatctgccattggttcttggttcatgtttgatgctggatctctgaaaagattgtgaatgagatgtgatgctattgacattccaacgttcttaggtaccgtaggcgtaggtaagattcattctgcacttcgaatgaatgtttggatttccatcagttgtacttgggtttttgctgtacccacttctgttcgttggctgcctctggttctggtttcttcagtcctttgtatgtaggctcatcgttttagcatttgtttgtttagattatgtggtggcaataaacaatgtactgacaatggatgacatttttgctacattcatagcagatcatcaaacctatggaagcattgagctaaacggcaggagattacaggtgtgcactttcagtttctggcagaaaatggaaaacatactagctgtatatatttcccttgatgttgattttattttcttattataagaaatactaaagttagttggaaagttttctccagttccataatggcaatccagtacttgtacttctacataactcgtgttccttcatctatctttctcaggaaagaagactttcttctactaaccgaaagacaagggccttggaaaatgtcaggatcgatgactaccgacctgttgatccaagtccaagctccaaggcgactatcggggcaggtccaattgagcatggcactcctctccttccttacgtgccgcgaccgaagccgcctcctgatcatcctgcccaatctcctgccacctaggtgaaaactgaaattctcacaatgcactggatagtatctctagaaccactatatatatggccagaatctgctgttttgttctgctattttgttcagatttgctaaagtgccatatgccttaaactttgtttccatgagcatttgagtactgcatgctttgtgctgtgtatcaatttcatgataagaagcaatgtttcactcttctattttactttgctagtgatggattaggtaactgctcatttgctcaaaccttgaggatatatgtttagtgaacttttaggtgtaactgacatcgtcatgttgttgtcactactcacaactgggactgaacttttgtgtcctagtgagcgcagatgtccatttttctgaactttgaacttgtgtttgtacgcctcaatttctgatgtgcgtcatcaccagaaagtagagaggtccttccttaggcgacgactattgtaggtggttgtgcaaacatgtgcatcattctgctctcctatccagtcactgaacagataatactgaaattttattggttaatggagaagttcctggatatttcaatacgtagcataatattaagttatttttcatggtaagattaggactttaggagagttaaaatttcggtcagtatgattagaagtatgactactgtagatttgtctgaacaaaagccactttacccttcagcttataagccgcatttaaatttaaattttattaattttagagttaattttaggaattgtttttcatcgtaatttttttcactgttttcttttaaattgttaacaacatgtatatataagtttcatgcacaaatcatatttttgttgctaataaaccgttattttttagataatggaagctttatttagactcagttagttatatcaagatgatacaaacaaactgagtcatccccggcctctgcataaaatgcacacagccagaaaagaagaaagaaacaactagaacatctcccaagcataaaagtttgacagaaacatatatcttagtggctatcaatccgtaggctaggtcgccacccatgctcctgggtaaaaaaactcctgtgccacctggtccaactgtcgagataccaccgtatatcttagtggctatcaatccgtagactagaccgctacccatgcttctgggtaaaaatctcctgtgccacctggtccaaacatcgagataccactataatagtatcccgcggtcccagttggtggaggatagcccaggtacgtagccaccgggtaactaaggtgataacctgcaaaggagaagacaccattttgttatcaaaaattactccattcctgcttagccaaatggaccaacacagagctgttgcacccatcaaaagcagattcctcatttctttggggacacatgatagccaactcccaaacatatgaccaacattgcgaggaggtttcagattagaagccaaatgaattacagaccacaccaagcgagataagcggcattgaaagaataaatgttggatagttttatccttgtgacagaaacaacatgtcttgctgcctttccaatttcttttagcaaggttgttcttggtgagaattacgccccgacgtaaacaaaccgttatggcttataatcaacataagtgaaacgatgtctgtctttgttccgctatacagacatgtgctgattaaattttgcacgacaacctaccaatctaccatacccttatacgtattttatgacatcgtatttagcacatgttggattcttatattctttgtttggcttagacactacgaatgatgatttaatcagaaaacaaagtgtacacctttctaccgtcttcaggtcttttcattgagaactacttggaaaattgttgcatgtgacaatacaatacctccaagctgcatttcaatatttgatgtaactgcaacaaaacttagtttgtcaagtcaagttttgatttgactccatatattctaattccattgacgaacttgagtagtattctgacgacattgaataaaggaagaaataaagcacggttagcttctttcttaaataatcgtgtcgaaataaagcaagtggttggtaaaaagggggaacaacaagacaggccgtggacaacagttccaatagatcagtcgaaagacttgcaagacctctacctcgcaggaacgagacaagtgttgggtgatgggaagaacaccaaattttggttggcggactggttgccggtggggagcataaagtcgagattccccttgaacttcagccatgtcgagcgctcgggcttgacggtggcacgagggcttctgaaccacaggtgggtacgagacatcaagggggcatcctccaatcgcgcaattggggaatactttcagatttgggacgcggtccagggggtgcaacttcaagatggggaggaagatgagacaatctggaagtgggcaccaaatggataatacactccctgctcggcctacagcatattcttcatgacaaacacggtggcgcgatgtggtactctgatttggcaaacaagagcgccgtcaaaggtgaaattctttatgtggttggcagaaaaagggcgatgcctcacggcggataatctaagtaagcgtggctggccgcaccagcaggtttgccaactttgcttggtgggtgatgaagattttgaacacctatttgtgtcttgcacctacacgaccagggtgtggagaatgatcaagggctggattggggttggctttctgctgccatctgagtcaggcttggacttgggcgaatggtggttagcgatgcggcaaaattttcggaacaactacagggacgccattgacagccttgtgctgcttgtttgttggatggtttagaaggaaagaaatgcgcgtgtgtttcaaaaccagcggcgctcagccggtttcctgtttggttcaatcaaataggaagtggcgatttggaaggaagctggggttttcaaaaatataggagagtagtctcttagtgtaatcttttgcttttgggaagttgctccggtgacaacttccattacttcgacagctttttgttgaagttataactttgtatatttgtatatattcttcaatcttaagtaaatttggttggcctttcttggccggcctggcaaaaaaaaaaaatcgtgtatccagattatcacttgaaatattgtttagaaacaagtgttagcttatacctacctgatgtaatgtttcaatttcttagagctgttagttaggattttcatattgcttttaacttaagctcggacaggcagaacaaactaatagtgatggtttcccttgttgacaatttcctttcaagcttttattcgcactgatataaacacgagacacacgacaaacaatattagttaggagatatatatgtcgctgtttcgtctcagtactgaaatttgtcaagagcaaattaattagaccacgacttgttttgaaacgaactttgcttgtccaaagcatgtctctgttaggctggggaacatcctaaactaaaagcaagcagaacgaaacattctgaacacctgctaggtaggccgctagggcaaatcctgatcttagaaaacaccccgttttgattcacattgcatacaaaagaataaaactattatcatcaacttggataagcttgattgacatgagacctaatcaccaagcatcactggcaacaactttgattaccagtatgatgagccatggcatgtatgttccttctgtctcaagccataataaggccatcagcattctactgagaaatccacaccacaacatgcacccacttctacacaaatctttgtaagcatcatgcttacaattatgcagagaaatctgccactaatttctaatcctttattcatctactaggcagtgaggtttaattacctctccactgacaacctccatctggattaattaaagaactgaaggtaagccttcagtggccatattatgctctgtaggtgacacttgctttcaggctttcagagatgggcctattactacaaactaacaagcatcattagtagacaattgagtcagtgatgatggactaatgccggtgtaattaagactcagcaatcagctgacaccttagctaatgctgaagcttcattagaaagactgaaaaccggtggtggtgtttctttcagcggtacacagattgttcagacttcagaagctgttggcatagtgttttgcccttatcttttggggaaaaaaaactgctgctcatatatgatctatcacctgctacccttcgacagaattcttgaataatctgcttatcagatctgaaaaagaccctcctttcattttttaaaattaattagaggaaggttttcttggttattgacttgctgtaaacatcagggtagcaccctctgaacattctgatacgggcttttgattaacgccgttctgtaactgaagtcaaaatcggcttctgtcaaagcagcccgttatgttttcactttctcatttctgtatcatattagtactgtagatttggatgacatccacacttccaatgtcgcgttcaaattaatttagtgaaaatttatggggctgttcagattgatgtcattttcataatatcattttttggcaaagttgcaaaaaaaatgtttacgtttagtttgttgtcaaatttgataaatacataagaagtcttgccaaaattttagcaatattgccatcttgttaaaattttggtaatgccaaaatttggtaaggtttattttggctacaatctgaacatgcccgtacgataagtgtacgataaaaaatactactgcgtattagtctttttgtgctcaaccaacaagaactgcatcttcaaggctgctaaagtttcataattccgttgtttcaggatagctttataaaggaaagtagtgttccactttgacaaattcctaagtttcaaatgagaatagattatgatacaagtgaaacgctatatggtctactttccttcggccatttgccaagcaactgaaattgatcaatgctttgagtgtttcattccctcgtataagcaaagttgttctgaaaactggaaaactagagatttccttgccgaatgccaataagaaaaatgggcactgaatcaaatggccaaataaattgaagttcaagctttcgaaacgttagtgcgatgttatcttcatatgaagaatcctttgaattaagcatggaatatgaactaacaccatgaagcaagcaatgagactcttttattcacatacaaaaatattctttccagggaatgcacacacaaaaaagaatttcagaacaatccattagtcacgattgcaatccaaatgttggctaagcataatcatgaatctttatgactgatggacgtcctctagtgataacagccaggaccgctccgtttatcttatttttcgtaattatttctgactcataaaaactggcacgtgaaagactactttgaaaaaaacttctaatgtatatccacagctcttcatgtatatacaaaatctcgaacataccctcataccttacatcagttacgattcattgtattttctatagtactactataaaagacgatagtggtgatggtaactttgccaccgactcactgccactacctttacacgttttataaatcaatccctaatttgttctgatattatgcaacagtctaatatttatttgattcaagtgaataacatatattgaaataagcacatgcattttaccttagtaaaatacaggtattttgttagttttcagaaaatcattgccaattgcatatcctcccagcaatgcactcagtttgattcaaagcagtgtcaagttcagctggatgctgcatggaagtgtgagcaaacaagtccagttctgggcacaagcttagctgttccatacttccattccaaattgagttgcgccttccttatccgaaagtcacgagcaatcgtcctagtcacgccagtgttgatgcaaaggcatcataaacaattatgccagccatgcccaggttagcaagggttttgagtatgattacgcatacatgcatcccagtatcccacagatcttttcagcagtagtcagtgttaagtcatgtaaagataagtagcagctcttgatgcttcttttcctagatgcttcttctgattgagtgttaaaacttatgagctataatgtcaagccacttctaattgttgggtgatacgcaagacatcaaacttaaatgcttctctctacgtacatgtatttaaatacagctgaatactgcagtgtaccagttgccgtagtaagcagcatctaagtacagtacagtacttggtactaatacatgagttgagtaaaagcctcaaagcagttgccgtaagggtccatgaactattcatctttcttcagtgttcttcaatgttagatattcagagtaaccaaagtcataggcagtaataacatttcagtacttcccagagactaatcactgcagcaagaaccctgcaataatctgcaaatcttgatgagctagtcagtgatcagtacttacaaaggtccagctcttctaaaaaagatgctgccactttactgtgtggatgagcagaagtcagataccagtcacacctttgtacactagtgcacatgcacaagcacatggccaaatggtaatgtgataagagttttttcttcagtggctaatactgagaaaattatgttcatgagaaagtagatacactgttccaacctgtaaattaaagaagagaccgtgtgaccccaggattgaataaaagagaataaaaagggagcaagaacctccttagaagcaaaggaggagaggacagggaaaggtatttagagagggaagggaactgtatgagggggctcacttagcttaatctgcaaataatagctgcttttaagggcactaaagctgcttcttgctgggttttggaggctcttttcttaagagatcaattgagcagctggtctgggaggctgcagtttcagtcacctgctaagcttctcccaacctgatcatctgtgggaactctgcaatctgcattgccaactcaggtactactgctaaaaccttctcaacatttcaaagttcagatttgcttttatatcgcagcttttgtgtttgattcgttctcttcggaatcttgagatgccctctgggctctgatcttcttttttcaatgacatttggcattgcctgttgttgttcctacttctttaatgcattgcatttaaaccgcatcctgtctgcgtgacaaaattgttcactgtttcatgctaagcttgatgacgagttagccaataagattcccaatagatgctctgatcattcgaccagtttagaatgacttccaagttgaggttttgattagtattcagaatgttcagctgcatttccgtattgcagcagaattcagagagggatcaaattaaagttcagactaaagaattttcacttatcaacagcaaagttcattcaaaaagtactaaactactaataaccaataaatcttctctttgggggaaaaaaacaacataatcattcatgcccaaaatagcttcctcagaaccactcactaaccaactcgcttacatgaaatctacacgtaataatcacaagtcccagtgcttatatactcccagcagctggtgtcctggcgctttcagaacgaggccgatcgatcggcgtgtcagcagcaggaacaccgtgatgtgtcgctcgcaatctcacatgcaaaaatacggcgagaagcaaacggctacgtgcaagaggctaaataagagagaacgcgcgaagcgtccagcgacgctcactcacgctcccaaatcgttgccgcatccctgtcgccgaggagcgtacatacgtagttttcatgtcgtcatgtatgtattgtatgctgctaatcgccatctgaatagggaccttttgttttcttttctgaaaccggtattagcttctccaagtactgaaaaaaaaagtgttgcgatatctgggggttttttgcgttgaagttgcacctcctgatcagcagaaattctcttgcagatagtcatctgtaacttaaaatattcttttaagataatggctctaacttaaaatgtagagtgatttgttagttcttaaggaggtatatca

SEQ ID NO: 80683 - DNA, 1350 bp, Oryza sativa
aggttcagtttgtcaatgtcggggtttttgccggttttcctttaattaaccgtgctgttgtaaagtttttgggtccggtttcccttataaattgaatcaactctcttcttctatagtgaattgcaggagctccctgcctgtcccctcgaaaaaaaaacacggagcagaagcaccggctgatcaatggccactccactcgatgcaattgcaaggtgaaaaaaaaaaagaaatggttggtagtagttacagttgtgctacattgaccagttaaaactttgtgagattaaagtcgttcgaatcgtcttccatgatattcctcccaaaataaaaggctaccatattcagtgcagaatatttggttgttctcgaccactttgagcatggatcgattcaggctggcgttcatccgacgcagctctagtcagcttgagactcaagttaatccctagtgatacaataccattttatacctccagaaaggaagaagggagagcccctttacagctagaaattttaatcagtgaccggtgactaggcagctgcatggtgtcgaaacatggattcggcaataataaaagggggtagcgcacgagacctaaaagtggatggatgcggagacaaaggatttagacaggttcaggccctctcaatgagaggtaataccctactcctgtttggggatttgaatccgccgggtgtgtattgatctgatgatcaggttatgtcatctgccccctagagggcctcctgcccaccttatataggatggggggcatgattacaagatagaaaccttaaccaatacggtatcggtttcctaaatctactttacaatattatcaaaccaggactttaggccgttccgtaatatacaaggaaacgtaatacccgagtcatgatctattacatattccatagatataagttatcccctatgactagtcggataaccatgccgtatgggtatggggtacccacaatatccacacatggtaatatatattagaggatataagggcccctttgaatcgtaggattgaaaaaacggaggaataggaaaaatataggattctgataagaatgcaagtataaaacagaggattgcaaaacacaggaaaaacacaggaatggccgtttgattggaccacaggaaaaacgcaggattcagatgagagagatagactcaagagaagttttccaagaaattggagtggatgttaaatttcctacgtttttcctctagaatcgtaggaaaaggaaagtttcctacgtttttccttttctcattcctacaaatcaaaggtatgaatagtgtaggatttcaattcctttgtttttcctccatttatc

SEQ ID NO: 80684 - DNA, 22685 bp, Oryza sativa
ctctcccgattcgtagccgccaccgcgtcgccgggccccggatctcctctcccgcctcgcagccgttgccgccgccgcctcgtcgcccggcgccgcgtcgcccaccgccggatctcctttcccacctaggcacggcgacctcctcccctcccaccggccaccgtgcagagagaagcaaagtgacagagagaggggatgaagggagaggagggaaagagatggtgatgatgtggcatattgacatgtgggacctatgtgggtcccacgctgactcagccgccacgtcggacaaacctgggtccaaaaccaccgaaggacctaaagtaaacggtttcgtgagttaagggatatcctatatccggttttgtggttgggggatgattttgtaactcgatgataagttgagggacctctggtgtactttttccttccatttttacctcattgctgtcaaactgctatcaatgctaatcaacatagtacaagattgcaatatttcattttttttttcacctacaagcaagcattaactcaagggactgtccaccagttgatagaaaccctttagaaatcatgtaaattttaaaccattcgattactttaagattcatacaaatcaatcaaaccctaaaacccatttgttcctctctctctccgccccccttctcccaactcccccacacgctgccaatgctatcacaggcgtctaatcgcgatctgcaccatctccaccaccttcgccccagcgtgccaaggtctggctggccgaaatgtgtcaatgactctggcaaggcctcccaatcttgccttctttcactccctctcctctcttttttctcaagccagcggggtgagttgcccccgctcagctagatccaccaccactgaccgtcgcttctaaccattccttctgctttgtctcctgcagccaacactagcccgtcgcatgcttatgatcccgtggcttcggcggcgccgcggctgcctcgctgctcaccacgggttaccctcccatgtccgttcctctaaagccgacgacatccccccttccccctccctccaccccaatgaccctaatccgtaggtccctagtgaggcttggggttggaaaagatgaggaggttgtttgagctgaaggagaagggtggtaacaggaatcacaaaagcacatccgatgatacaaaatctacaacatttggaagtccattttctatcaatgaaggttagcagtttcgttaattcaagttatcgacaaacagggtgcacgattgcaaacaagaaccgtcagccataatctcaaaggaacaaagcggctattaattacactgaattgaacacatgaaacgccacattcatcgatcgaaaatgcaaatacgtacaagatgacacactccatttaattaacacaaactaacagtttgaacttgaacaaacactgatcctaaattatcgacagcaacgacactgcttgaacaaccctgaattaagcaagttaattcgagcaatcattaatcctaaatgaaattacaatcctacagtagatattacgcgcttgatagtttatcaaagtgtcaaaccaagccggccatggccatcgcggcagccgacacgacgggagcgaagaacgacgccgcggcgaacgcggatcccgccgccgctccggtgtcgtagtccgtcgacggcgccggcgctgctgccggcggcacggcggcgaggacgttgatcatgagcctctggccctcgttgcagcggccgaggtcggggctggcgaagtaggcgaagccggggacctagaggtagaacaccctggcgccgtcgcccggcacgggggcgtcgccggcgtcgacgccggccgtctcgttgcagtggtagtaccccgccttgctcaccttgatcaccgagtcgttcctgtactcgaactctgccaccacacgccatggatgcgaatgcgaatgcaaaattaaagaagaggagatcgatgacgagttgacgacgatgagatgaaactgccgttgattcgttaccgatggagtcgccgacgtagaaggcgatggacgacgcccaccgggagtagtacaactcctcctcctccggcggcggggcgatccacccgtcggggccaccgacgcggtactgctcccctgccgccgccgccgccgcgccggcggcgaggacagccacgggaggagacggagacgagacgaagccgcgacagccgccatgcctgactgactgatgaaagcgccgatcgatggagcgattgccggagatcgaagaagaaagaagcggaaactgctcgtacgtgtgattgatggtgtgccgcggcgatcgacagaagtggcaagaatttataggcggaggcgcgcgatcgatcgatcgagccgttgagagggggagcgtcggcggcggttgcgtcaaaaagcctcgtcggcgccgcgcgcgcgggagggagtggagaacgtggccgtttgaactcggtcgtctccgcgcgctctgcagttgcatatgcgatgcgaacttgttcgtgtctgcaccgtgaagacgaggtttggaattcagcccatttgtttttcgtcaacaatttcggtccataggggtgtatgggcttgaattacggcccatacatgtggaccggtgggccggccctttaacgataatgggcctggagttgtctgttcattattaagctttggaataagttcactttaggtccctctatttcttcgtcagttcgattttcatcccttaaccgcaaaaccgggtataacccgtcccccaacttacgaaaaccgggcaaacgaggtcccctagcagtatggagcgtagttttaattgactgacgtggcacttgcatggctcctttgactgatattcgtcccacgtggcattgacatggcgtttacatggcaattttatccccacaaaataataaaaatcgtgggacccatatgtcagctacacacaaaataattcctctctctctcgcagccagagcaagcgatgggtggggccgagaggggcgggccgggccgcaaccggagtaggccggcaaagcggcggcgaccggagcaggcgaggggcaaggcggcgctccacgcactccctcttcttcatcatcgcgccgcggcgccgcctcacagccggcggagcggcggcggagcggagggccaggcggagtggcggggcggcggcatgccgcggccacgagacgagcttgtagatgacacggctccccgtacccatcgccacgaccgccgcggtggcgattgccatgtccatcctggcgctcctcccaaccccagcagcgctccccaccaccttccccgccgtcgcgcacctcgccggcgcatactccctagggtcacccttctcgttcccaaccacaccgccacctcgatgcaccgcacgtgcgccacctgcatcacctccctctgcctcatggtagggaggagctccatcgccgccgccgccggcggtccgttcgtcagggatgcaggtatgggttgctccgctcccgccggtcgccgtcgcgtgcccctttggccaccgccacgacttctcccccgccggccggccgctccgcccctctgctccgcccacgacgcaccgctcctcctcttcttccccgccgccgctccggccgtcgaccggccgctgaccaccccacttcgcccattggctccacccctctgctctaccaccgctccgcccaacggcttcgccacgctgctccggccacccctctactccgcccaatggctttgccttgccgtcggccgcccgcctcgctgctccggccgccaactggccgcttcgcgccatgacacggcgccgctctgaccgccgaccatccctatgctccaccccaccgtcgcccgctccggccgccacccaccacgctccgccggcttgagagagaggagggagagagaggatagagggagaggagatagagagaagaggtagtgatgatgacgtgtgggtccacatgggcccatcattttttattatttgtgtgtgaaactgacatgtgggtcccacaagttttattattttatcggatctaattaccacgtaagcgtcacgtcaacaacacgttagacaaaaacctagtcaaaatgagtcacataggtgctacctcagccaaaaccagatataatactgttgaggggcccatttaaactgttccgtaagttgggggacccgtcgtatccggttttgtgactaaacgaaaatcggacaggggcgacaaatggagggccccaaagtgaacttattccttaagctttttaatggacctctgttaagacccacaagtttatgtgggcctggtaattatctggcggcccatccagaattccagacaaggctagtcaactcggcaagggtttcctcgccgttgccgtcgccgtcgccgtcgccgctgccgcttccgcttgcgtgccctcgtcgccgtcgaatcgctcgcccgtcggtcgggtccggtgacctcgctgcctccgagatcctcctctcctcgcctgcgcgctcttcccgtcggctagaagggctgcttcttccgtcccggctccgtcgccatccccccgccggcggcgacttgggcggcctcggctacttcgcccttgttttccggccaagttgaaggttccggttccgtttccgatcctcaggtaaaagagcacatacttctccaatcatttgaatagctaacagcaatccattgtgcatttgtgcttcatgcggctacggatgtatccatcaattagttgagagataggatcgattcactgtgtgttctactgatgtgtaaatgccgctatgttctgcatcatctgtgctgtgggatttgctatttctgttactttgatgcggccgcggtaatgtataggagtaggaaggatttattggcatttcaccaatcgtccttagttaggtagctgatgcgacgctgaagttggctgcactgcctcaacagtataactgagggcctttccttgaatcattcgtgtgacttctttcacattcctctgttgtttggaggaataccaagggggatgggctcatctgtagagtattttttaaaatatagacagtagcatgtgttctggatcataaactatgcgaaattgcgagccaaaattttgatgcaaggttgctttgttacaaatatgatctgtatttccttgatttaaaattaagttgttgtgtaatttgttcaactacaaagaatgtaaaatcttgggactcggattgttggcctgtatttcacgcataaaactacaaatattgttatgcttttgtttaactcctcaggggttttgcagccagcactcgaattttcatcattgttttaggcatttgatattcttatcagttcatcattctaaaattaatctactcggattctaatagattttgagaaaatggatcctgaagatcttactgactctgaggaagatgaagatgatgacatgatgttttttatcttgcctacactatatcttgtttctactggaagcgaagagccatgtcatacatcgaagttcagtggtgcagagtggatttgtgaagtgcttgaagatgaccgtggtgaaggctatgccaaatttcgaatggagcctcaaattcttcagaaattttcagaccttcttaggtcaaagaatcttttgcggaatacaagaggcgtttctgtggaagagcaaattggcatgtttatttatatgctctctcgaaatgccagctttcagaaaatgagtgatagatttgagcacagtagggagactatccatagacatatcaaggcatgctttgatgcaatcacctcattgacagatgagtttgtcaagcatccttcaactgagactcattggaaaatatcatctgatccgcaatatgggccttattttaaggtaggtttaacctgtctctttgcattgtatgaagttctacacttctctgctacatctgaatcagtagtgtgtttccttgcagaactgtataggggcaatcgatggagttcatgtacctatcacaatatcagactatgaagcagctccatatcgaaatatagaagattccctttctcaaaatgtgatgctggcttgtgactttgatttgaattttgtccatgtgtgcagtggccacgaagggtctgcatccgacgcggcagtcctatatgctgctgtggagtctggatttgaagtcccaagtaacaagtattatttggttgataggggttatgcaaacacaccatcttttcttgctccttatagagaagctgcataccatattgaagaggaggagcagagcaattgtcagccaagtgactacaaggagttgttcaaccttcgtcactcaaagctgcgcaacaacataaagcgtgccacagcgctattgaagatgaggttcccaattttaaatgtcgcaacattctatcagatagaaactcaagcgaaaatcccagcagcagcagtggtgctgcacaatataatgcagggccaaaaagatgatgatgatgatgatgggtgggcatttaaccaggcaatgccagtttcatcccgtagaactgtagttttacccagtggggatgatgcttatggcaatgatgtcgaagaactgaacaaccaatgtagcatgggtgatgcttgagagattatattgcgaagaagatgtggacagattatgaaaggaacaggaggtaggtttccctattctgaggccaaacaacatataggtgaaaggaaagagctgctcatgtgtgatttgtatcttgaattctgatgtttatggttaaagatggaactaggcaatgccctgtagaagctgtactcagttgacacccaccagtaagatatggcattttcatgtcctccatttggctatcaatctgtgtggatgttgtggttgccaagatagtgccttgctagcaaacatggcgtggcatttaactaccgccacgccagtataaatggcgtaacaaaagaggaattgcctatgcatccgtcgggtgatttttgagaaaaattatctccctttagatttgcatcttacggactaaaaaaataccaactagaaatttcaattgtcaacaatcaacaaatactataaaatttccaactaataaaatgcttaacacgctcaggcacagcttccagattacacccgaatttaccgtacgtaacctaatttaccccaaaatcacacgaatttaccctcggggactcaaaggtggagctgaagtctagctaaacagtttcagctctatttaaaatgagtgtggagctgcttggagtgtgttctcacaaaatgaattagagaaaatgaactacagaggtggagctgggtttaggctgctctacaactccactctaaacccaattcctaaagttaaatttatgagttggagctctaccaaatatgtctatctttcctaagtaagatagaatatgcgatactatttttatatttttctttattcctgtgacgtgaaggctttactagtagtagtactttgaaaacagatcaagctgcatcccggcaacaaatcattgaactatacaagaatttttattacatgataggaattgctgcttgaaatgcatcagtaaataacagtgtgcaaatgtatcgtgttgtagcagcaaaaacatctgtagcttactgctgtagtgatcaagaaacttcggaagataaattcggcagtgctgcagacaccaatttattacctaacgttcatgcttcattcctcagtgttccacttctattgacaccattttattacctaacgtcaaatgctcgtggcgaaaaatgcttcctttattgacattacctcactatatacatcatgtatcaatggccgatcttttggcgactcttcagagcattccaggccaagtttaaggagttgtagagcacagatatccattatacctgtcttgtgttcatgcaattgcagggtatgattagaaggttgttctgtcatttcaggaataagcctggggtcaagtatgtctttgatctgtgaaagtgatgcattgacatacatgcggagtgtgaagccatcagtaaatatttcattggtagggtgtcttcctgttagcatttccagaagaataatgccataactatagacatcaccctcagttgagatttgactgcccatgccatactctgcaatgttttgaaaccaaaaagctcagatcaccagtaaaatgaaccatattgttaatcataaaatactgaagtcctttttattaaatgatactctgctttgtttgaaaacaaaagattcagataaccagcaaaatataggagtaccatattataatcataagagatttttttagataatgggaatttttaaaccccgcttctacagcaacgggggtgtataatcataagagatataatcgtaatttcgttatattaaataaatgattttctgcagtgtgctctgaaaagtgaaaaccaactcaccaggagcaatgtacccaatagacccccttggcccagccatgcttcttgatatgctttgagttccggatgaatattcacgaattgaccttgccagaccaaagtcacagacgcaggcaacatagtcatggttgaaaagtacattgcttggcttcaaatcgcagtgaacaacaggtggaatgcattggttgtgaaggtattctagagcagaagcaatatcaaatgctatgctaatcctttctcccaaactcaaatcaccacatggatcaaaccttgtgtgtagtcggctttctaggctaccattagccatatattcaaatactagagccttgaactcactgcccatcggatcataagttgagcatgcagttatcaccttgacaagatttcggtgacggatgttcttcaatgctttgcactctgccataaagctatccaatgcaccacactgatcgagcttgaacaccttaacagcgaccatagtgtcttctgtatccagtatacctctatagactgtcccaaaatgcccagagccgactatgttggctgcagaaaaattatttgttgctttgctaacatcactgtatgttaactttttcagctccatgtaggagtgatctatgtgctcattggatttccccttccttttcaggaaaacatttacgatcaacaaatataatccgaggattgaagaaagtaagacaatagatgaaaaaactgccaacattggaataacgagcttatgctttcttttggatgctgaagcagagcagacagtcaactcgtccattggaacattggtgcaaaggtgtggatttccttggacaaacaccttatctctgtcagaaaatattccaccaactggaattggcccctcaaagttgttgtatgacatatttagatactgtaatgaggtgaaagtcccaaagaaatccggtattgcaccagataaattgttcgcggagaaatccagcactttggtgcctctgaggtttgctaatgattgtggaatacttccctctaggaggttgcctgctacacgaagtgattccaatcggacgcaagaaccaagtgtagatgggatcctgcctgtgagtctgttgtgggaaatgttcaaagaagcaagatttatcaggctaccaaattttagtggtatggagcttatgaattggttgtgtgataaatcaagtagccaactcaattgatttagcttgacaaacatgtctccgcttatgcttccagtaagggcattacttgaaaggttcaatgccaacaattgttggcacctcgctaaagttgtaggtattcttccactcagttgattttctgataaataaagttcagccaattgattcaagttaccaatggattgtggtatttctcctgaaaatttgttttgtgaaaggctaaggacaacaagattgtttagttggccaagagtatgaggtatgctccctgtcaatagattgttatcaagatagagtagggacatgctagataggttcccaatctccaagggaatggtgccagatatatagtttgacgggagagcgagtgaagttaatgttttcggcaggtcggctacagagctgggcatgtccccacgtaggttattttcaccaaagtgcagtttcagcagattggagcaatttttcaaggatgataggaatgcccagtctccagcttctaactggtttgagtacagcatgacaacctgcaaatctgtcatcaaactaaaagaaggaatcacccctctcaaagagttgttggccaggtacagaaactgcatgttggaagcattagctagagatttagggatttctccaacaaaatggttgttagacatcatgagaacttggatgttaggaagtgtgtttcctatgtcaggaggcatcatcccctcaagattgttgttggccaaaccgagaaaactgatggacgacatgttgtaaatggagggatttacagccccagaaagattgttgtaagagaggtcaagatattgtagcgccgacagcttactaaaatccggtatacttccctgcaactggttttgtgcagctaaaaatgctgtaagcgatgagagattcgctagagatggtggtatgcctcctgacaggctatttgttgtaagatcaaggttggtgatccgtgaagtgaacatcgttacgggtggaattgcaccagaaagattgtttttcctaaggtatatctccctgatggttgagctgttgaaaagtgctgcagggatgctcccgtagaggctattgttcttcagtgaaagatagcggagtgacgacgcattagccaagaacaatgggatctctccggtcaggtagttgtccgcgaggccgacagactccaacgccgatgagctcccaagcaatggtgggattctgccatggaggttgttgctggttaggtccagggatgagaggttaggaagcgtaccgaggcctcgtgggatctcaccactgatcgcgttgaagctgaggttgaggtactggagcctggccacatcggctgtgaatgtgaggccacctgagaggccattgttggggaggtggattctcgcgagggacgagaggttggagatgcagggtgggatctctccggtgaggcctcctgcctccatgtccagggccacaaccacacgaggtcgttcttggagcttgatggagcaagtgacgccgcgccaggtgcagaaatcgggtgagatggtgttgctccatgtggagaaggcggacccgtttgggcttgaaagatgtgatttcaggcaaagcagtgcttcccgttcatcagctaatgctgtcagggtggagaagaagaggattgcagcgactgcaaccagagctgcacatgccatcttgcttaatttgctggtgtgtattttggacagtatgctggtggtaagttatgagatgcttgtgattcttaattatagtggactaggatgcgtcaagatcttctacccattaaaaccatatattggccacatctttgacccatgttgattgttggatggtgccatattcttagtcaaatagtgaatgcattaattcctgttgaacatgattaggttgcgtgcatggacttaattacggagatcttgttgaattaagctttgactagattgttttattatgcaaactttcagaccttatttttcagcaaaataagtaatggtaccttattagttagttataccaactgacaatttgcctgcctacgtacattttccaacatccgtctgacggtattttgcgacgcggtgtagaccagttctgaacttctgatggttcatttgaaaagcatgatctttttccaatttcacctaacaatccacaaagtaaactgtgctatcaaacctcttacatattttgtgcattagacaaacacttttgtcctatggtgccctgttgtcaggaaaaaggaatatcaatgctttataaaactaattggaggaacatgatggatattaattttaaacgtatttgttattttctttggcagatcactaatctatatttgtagagcttatatcgttattactttggattatgtcatcgaacatgtcaatcatgggaaaattgtcactgtccacaggtatgaaatagttgaaacttcaagaatagaaaagtaagaacaaatttacgtggtaatttcctcgacaatggaagtccattccattacattagtcaacacatgatctgcctcaaagtcgtatgaaattgataagtctggaaatttcaccttatcctttcgataccaatgatgtatctttgacatttgtgactggtttaggcccagtcactgctcattggtcgttgataagaaaacatcatataaaaacttctaaaatttataaataattagttataagttcaaatgcagtggctctacattcgttagactcataattttatgatcttaattactctgaattaaatgtagaacatatagtactactccctcagtcccattttaagtgcagttatgggtttctgttttcaacgtttgattgttcgtcttatttgaaaaatttatgagaaagttaaaaaaagtcgcagataaagtattattcatgttttatcatctaataacaataagattgctaatcataaaaaaattcaaataagacagacggccaaatattggacacagaaaccaaaaaaatacacttaaaatgagacggatggagtagagttaaaacttctaaaatatagtatagctagtaaatactacaattggtcacataacttgtaaaattcatactagctctaaaaatggaaaactcaacggggttgaatttcatagaacacactctttattgctgtaacccaaatctttatagaacttagatataaactatacttagaattatttaacttaaataaagtataactaacatagagcttggtaaattcataactcacaaatgctaagtgataaaatagaattattgcttaggttagaattgttgcttaggtttgagtgatgtgggaatagttgatcttcaggatggttctactaggggcctacccctagtcggtttgctgtgtgctaaggtagataggcttttcactgaacctttatctagttgtttctaagaccatgtttggaaccagggactagagtttagtccctgtcatatcgaatgtttggacactaattagaagtattaaacgtacactgaactacattggacatatagccgattgctcaaaaccctagcgacatcggctggaattaccccattagcttgtcagccgattggctctttgatctgctatttatatatcttgtcagttacaagatcgtactgactggcacgctagcatatcatctattttaggacctgtattggagttaagcggatctcccaggccttcgtgtttttgtcgacttagttcgcgttaacgcagatttggcactatcgaccgagcgcggatttttttatcaacactaccttgtcatatttggtgattaaagaatggaacggctttgattcaagttactcctgacaagtaatttgttttttttctttttgctgataaggaacgtaactttaatttttttccttaattgattctctcggatcgctcaatgtgtacgacttctcaccatgacattgattgtacatttttctaattctacttgtcataaggcttatgtggagctcatggtagaaaataagaatggcgtacttgtataacatacattgtaaagtcaaaaatcggattcaagaagatagctagttataaaactatgatcaagatatgcatgtgtgtggaaatgtgaaagtgaaatgataacccctttgtatgatcctcctccttgcacttatttagtgaacatggctatttttctcccttttttttttctttttttcatgctcgagaatattttgtctctttttctttgtgagcatttctctttttctcatcaacatttttttttggctcatgtctcattttgtatgaatagttagaggtaggattgtaagcgtatgaagtctttatttggtggatggatgactgatgctgattttcagtgtagaagtatcacatatggtagatgcatgcatgacatatttttgctaacctctagtgtagagggtgagaaaatatagtgggtatcagtgttaaggataaaacactgaatatagtaggtatcttctatagttgggtttgtactatacggaagtaccatatacctaattatacatgggaatgtatcttttgattaagagaatacgataaatccaaaaagaaattgtcttctcgggatagaaagtgtcaggaacccaaccgagaatgctcatgttacattctcaccccaaacgtggagcgttggggaccgcatctagatttgagagatattttgcagtgcgccacctcccaaaggcatagcggtggcgcctacttggcgcgtgtgtgcctccagcgcgcgtttcggacgagaaggtatagttagctaatcaattagttttagataattacaatttgaaataatgacggtagtagttaagattttttttcatgagatttttctaactaacaaattgaaaagaaatctatacctgaagtcaaattttcaaaattttaaatctagatttgaaatttttaactcgaaatttaaattttttaagtcaaattttgaaaactttcaacttttcatcttaaatttgaaaacctttcaactcaacttcgaaaactttcaacccagatttgaaaactttcaaatctagatttgaaaaaattcaagtcaagtcaagatttgaaaactttcaagtcagatttagaaacttttaactacagatttgaaactttcaactcagatttaaaaactttcatctgaaaattcaaaacatttaacttaaatttaaaaactttcatctcaaagttcaaaaattcaactcaaatcttaaaaattttcaactcaaatttgaaactttcaactaaaattgaagatgaaagattcaacttctaaaataaaaaaatcacaaaaaaaatgcaaaaagaaacgaaaaaacacagacggtagcttttccaggaaaaaagttacggacgtagacgctacgcgtgagccttatgggcctaaaaacgcgcgcgcccgaattagctctcgtggcggaagttctgcatcgcggtatttgaacggcggcctgaagccgcgtcctcatgcttcgccgggattgcgtcgcctggtggtattcttgattttctcaagtttggccgtgctatatgtgatgtcaggaaggatgccatcaagctcttgctgttgctcgctgtgttaatttgattctttgggcaagctgagagcctgagaatggacttcaacggttgttcggtggaaaggcatgtgtcaaaacccaaaaccgaatcagggagcttgtcaatagggtggtggacggttccgtggagatatttgaggaattgctcgtgcaggtagagctgcagtgcaatatgcatgcatagctgcacatgacttttttttctttttcttccgcggggaagctgcacatgacacatctggctggtgtgtattttagacaatatggttgtggacgcagtgtgacgtcagcgttcgatttacgtgcaaaactattttaaactgatttttcttctaaattacttatccaaatcctgatctaattgcaccattaatttcattacaattaaacttcaaaacaagaccacacgtggatatattccgacgaaaaaaatagcttattattgaattatttttaaatattgcacgatgttccaccaggtatatcggaattgtttcagtaagtagatcgaaaatgtttcactcgtttaaatcagatgttgtttcaccttatataaaaacaatgtttcagaaaatagcgaaagaatgttttagttcactgcaacattaaatctatacatagtgaaacattgtgagtacactatgtgaaacatttttcggtggaataaaaaataaatcaaattcccttaatagggggtttccaaaatacgtggtttttttttttttgttgcaatggaatgtttcgttcactacaacattagatttatacatagtgaaacattatgagtactctaggtgaaacatttttttgtggaacaaaaaataaaccaaattcccttaataaagagttttcaaaatatgtgggttttttttgcaaaagaatattttaattcactgtagatctataaatagtgaaacattgtaagtatactagttgaaacatcttttgtggaaaaaaaggggagggagaagtaggtgggtccagcagatacgcatgtagggggaggggagcgcccgatccggctccccccgcgccggtcgctcagagtagagcattatcgtatggttgtaagttgagacaatcgtttatttgacaatatttcaaaacctaactagtaatctagactttttttttttttgcttatttgaccctgcttttcacaatgaacacctgtctgactctgctttcattgcaccgttaaagtttcattaaaaaaagaaaaaatatataattacttttcataatgaccaaaataccctcgaaaaacccaatccacatataaccatgtcccttcagatcccctctctctctcttgtatcccgtctctctctcggcgagtggtggtggcgacacactgaggggataaagcggcggtgttggctcgtcgagggagggagcggcgggctatggagggaggggatccgcaccagcaccggctcgcgaagggagggcggcgcggagaagcggcgctggctcgtggaggcaggtagcagcagcgtcggggcgcggagggagagagcgccgccgtagagggaggtgcacgacgcacggaggggataagcggtgatgtgcctgcatgtggagggagggcacgactgtggcgccggtccgtggagtgaggagcggcgatggtgccggcgcggggagggaggcgcgggtggtggtgcgcttgcgtgtggagggaggagggggcagtggcgcgtggagggaggtgcgggcggcggtgtgccggcgcgtggagggaggaggcagcagagcgccatcacgcggagggaggcgctggcagcgttggtgccagtgcacgggggagtggcaactgttgcgtgtggcatcggcgactactgttatggcacttgccgtgaatttgttgtttggttatcatctctgttggatttgactataatttgtgtttctacatcattgtatgcaatttgcacggctgcacaaccaatctttaccactggttggcaaccatctgttgtcccagttatacaaccggaacggtgaattcggaataaatatcgctatctttagtcccggttcaatcgatctttagtcccggttggtgtgatgtggtcccggctagagggttttttccttcttttttttcttctctctctttttcactgttcttttgctatttgcccaaatcatctcagatcaaacattcatcattcacggtaatatagttcatcccaaatcattcacaacaacacatattgaatcacacggtaaggacaaaagaaaaaaaaatccaaaagcagcgccggcctccaccgcctaccgctgcactagccttcgcaccggccgcctcccccttcggatccggcggtggccggctgcctcccctcccagatgcgcagccgcccggccgccgcggtgcgaggccgccgccgccgctgccgcctaggggaggaagagaatgaggagaggaggaggaagaggaagagatggggtgaagaggaggaagagataaggtgagggtggaggagatagaacttattaactgatccgtctcctcctcctcgatctcacgcatgcctcagcctctccgccgcgcatgccaatctttttttccggttggtgtaactaaccgggactagaaatatatctttagtcccggttggtaacaccaaccaggactaaagataatagagaggtctgacattgcatgttgttcttttaaccaggactaaaaatgatctttagtcccggttggtataaaaaagtagctctaatctttcgaaccgagactaaagataatctttaatcccgatttttattgcaactgggactattgtggtttttgctcgaccgagtaaagatggtttctccagtagtgttgggatccacaaaataagacaatatgctgtcaaaattttgttaaaaattctgccaaattttatttgccttattttgtcaaaaatccgtcaaatttaagtcaaatttgttaaattgattcaaaattttcaaatttataaattgaagccaaatctgtcaaacttatctctaatctggtagatatacagaattcgttacaaatatgtcaaaagatccaaatatatgcacgttttgatgtaacagggtcaaataagtagagcaaaaggggccatttgccctttagttaacaccgttaactcgctttaacggaattgggtaagcattcatcttcaattttgaaaagcatggttaaataagcgaactaaaaaaagtatagtcatattaataagttaagcttcgaaataggataaaatgagcaattgccccttttaagttttgagatgcttttgattcttatagtggactaggacatttcataggcttttagtcaatatgattttaagatggcgtagctgcagatgacattttctacccatgctgattgtttgatggtgccagattcttaggtcttgtttagttgggaaaaaattttagggttagttgtcacatcgaatatacggacacacatttgaagtattaaacttagtctaataacaaaataaattatagattccgccagaaaactacgagacgaatttattaagcctaattaatctatcattagcaaatatttactgtaacaccacattgtcaaatcatggcgcaggcttaaaagattcgtctcgcaatttacacgcatactgtataattggtttttttttcatatttaatactttatacatgtgttaaaatattcgatgtgatgggtgaaaagtttttgttcgggaaactaaacagccccttagtcgaatagtcaatgtattcctgttgaacatgactagattccgtgtatggacttaattacggagatcgtgttgaattaagctggaataggttgactattgtttcgataatgcaaactacattaagaccttatttttccgcaaaatgataagtccttgttagtaaaatcaatggagagaacttccggcggtctgactggacctgtacgggcagtctaaccgggcttagaaaccatgacgtggagcaggaaaccaccgagttgtgcgaatggaagtccattgcattagttaacactctcttaataaattaaatattatgaaaataataatttagaaaaagtggtataaacaatgaaatcaaagaaacatttttgagaaaacatttatttttaaagatatccacaacaataattcgatatataactagctgaatggaaggtgtgctgagcggctcaatagtcaattctcagttgtaccggaacgctttaaactttcgaagaaacttcgtatgtattttaacttgtccacagggcgttgaacagattgggaagatcgcgaagaaaaaacatcacatcatacatggaaggtcgatggcttttgaaaaatttgttcggtgatgacttgacgttttcttagttcgcaccctttatattgaacggaaactagcaggatatgtagaacaacgaagaaagaagattaaggctctgtgtttagctatcggtgaaagcggagagatattcatttctgcccctatttgatcatggcttttagataccgcctgtttcttatattcgtgacggtggagatcgttgtgcttattgtccgaagcacagcatcagattttcggtcaggttcatcaggtgagtacaatatgagtcgcccttcacaccttatatatatactatatattagacggttctgtaaaatcgtcacagtttttttttttttactctgcgctctccagggatagccggatagaactatctgagatgaaatcatctcggacgggttttgttcaaggatattaaacttttgagtaagtactctgcagtgttttcttaataatcgtgtaaaaacaaaaaccatcttgagtactctctatctctctctctctctctgtcgtaaaacaacttactttagagttaaactttgtgttaatagattgatttttatcttcttacctacatccggtgcataaatatctttttttttatctcttcactatctccgtattctagcttgtattttgctttaaatttagaaccgggtattgatggtgccggataacgtattacacataatgtatcctatctaatattatttacttaatttatatctctaatacatactaatattaaatatagagagacaattatagtgttaaaaaatagatacattaatgaaaaaattatacaatattgtatctaaggtcgtaatataatgattaaccaatcttttatcaaatatggatgtacaatatattttcatatatgtttcataatatgagacatacggccagatacaagtttttcggtatccaaactatatttttttatgcgtctagatttgaaattggatagtatcggttatcctgttttctctcctatattcttaccgcaagcctcaagtcgagtgggtggtcaggaaatacctgttccattatcactcataatttagagggaacacatatatttgtaggcttatatggcatgatgccttccgcgttttgatagggaattctaatcgattaatcgtacgtaattttttttaaaaaaagtaaagataaaatgattcttatttaatctcttagcactattactatttgtaagtacttaatcccattccaagcatgctatatattacagatcagtgggaggttggcagagggagttcctgttttcaataatgtatatttttcactgttttcaaacaaacatcagaagttatataaaattagaaagacatatagaatagaagcaccgaagaactgtactgacctttcaaaataagacttcatgtaattttaggtcatttcctttagttcttttccttttttttttcttcaaatgggaggattttattttcagttatagttttttggcaaggattttaagttatttttattttattttggcagtcatgtttagacgcattatcttaaatctgtggtaatgtcttttctctttatactagtgaattaagtcgcaccttggtgcgactatgaccattctaatatgaatggtatgtgaaaagaatattaatgatattatacattagatttgaaatcactgtttattgtcccaactcatagatacttatttcacttctaaagatatttcttttccgtatttatgtttgattttaattgttgtcatataatatttttgtctaataggaatcataagctcaggtggtgtttcagctgaacctagagcttgctttcgtgcaactataatcttcctacctattaagtgttgttaaactagattaataccctgccgtgttgctgcggaaaattaagttgcataatatgtacaaataagatgtaatttgattatcaaaactaaaacaatttgatacaattttgagcctaaaaataattaagattgtatgtttttaagagagaagaaagaagaaacaatttggaccatagatctacaatccaaatgttataaataatttgggtgatatggcttaaagagagaagagagaaatatcattaactatacttagtggggattaactatataagtatatatataagtatatataggataacaattaacaataaatacccatctttcggctaaaacaaaatggtgagcgcatcgtataggcttaggatttatattcatcttctccatgccgtttcctccttccgattccccagacccttagcacctttattgttgccacttgagccgccgccttgccaccctattctctatctcaatgacatgtaggtccacatgtgtctatgacatatgggtccagtggcaaaaagttaattgccacatctaaatgtggcaaatggttaaatattcccttctttgttgcacaaccccttatcttcctattattttctacttatcctcctgcttttcacaaatataattttgttttacatacttaaattaatgttcagagaaagtattggcaaagaagtctaggtgcaacacaaatattttatcttgatctgtaataaacgtgtattgtcataaaaataaataatttactatgattatgctaagcttgtgatattatcgtaagaaccaaaattatagaatttcactattcccttggttcttgggtctatatttaagtaaaattgcacaacatggttgtaattataatcttgtaggctgtgtttgagaagttacttttgttctatatattgttttgaatattgctaactaatttaaacttttatatgtaaaataactttatcccctcaatgaacattatttgatggaataagttcatccaaggtcccttaacttgtcgacgaatccgattttcatccttcaaccagaaaaccagatacaacggatccctcaactgtcaaaaccggtgcaatataggtctcatggcgttttggacggcggttttaccttacgtggcgcctacgtggctaaattgacccggtcttcatctgacgtggcataaatgtggca

SEQ ID NO: 80685 - DNA, 40476 bp, Oryza sativa
attccagcctctgagatagcatcatagcagtatatactctctatacctaaggactacggctttcctgggggtgtgctatgcccgtaaggccttaaatttgttgatgcttgacatccatagatcgagttgaactaatatttgtctattttgttagtacttcttaaaaaaaaagagagtatattttatggttactcctcgttctagagactgaagtctgaactctagacaaagcattttggcttaacaaatttgcctaatgtgaaaccttctttaaaactctgctatgtgttaggtttggtgcgaaacaggctatccaagattagtcagaagaccaggtgacatagctctgacggggcaagttagccagcggtgtgcctgttacaaggaggaggagttggacaaggctggcctggttgtgtacgaagggtgtgattatttgtctacatcttgcaaagtgagttaggatatgtacatctccttctcttgcccatgtagttgtctacggctgcccactgcttatctgcaaggctgctaatggtaatcatacacgaaaagccccagtatgggcagaatacatcatgatcatcgattttgcaagtagtggatcgatctatgtctgaatttctggatatacagagcaatcgttttgcttctgaattgaagatacgcaattgattggaagactactcaccatcaaaccatatgatggcaatacagtactgccatgctttatacatgtagcgctgcgaaatgcagaggccgcccatgatattcatagccgtgggggcctggggggccttggctatcgattgatcaacgctagcggctagcttgacgatgcagtcaaggaggccttggctatcgattgatctgctgtttggtcttcatgatccttgcacctcgagttcttgagaggactgctcaggagttattaaagtctgaagaagtatcccacgacagatccagatttggctcacgtgagcaagaaatcaactaaccacaatgcccgcaagtcctaccgaattctcatcttgaacgatcgtgttgaatcaaatacgggatttataattgatcatgttgagtagaactacatcttttgttttgcatctccttacttatttcccaagcaagtctttggtagggctccaatttctaaatttgaagcattctgaacccaactctatctctttagtatatttcgttcagttcgcttcactctcttttcgaatgaaattgaaactgtttggctagcatttttaactccagaaaagtttagagttgaagttaaagctacgcccaacaaacccactccctccgtcctataatataagggattttgagtttttttttcattgtttaaccactcgtcttattcaaaaaatttagaattattatttaattttgtgacttactttattatctaaagtattttaagcacaactttttgttttttatatttacataaattttttaaataagacgagtgatcaaacaatataaacaaaaactcaaaatccattatattttggaacggagggagtagaatttagagtcctggcgcacaagcctttcttcttccattaccaccaagcacctctccctctctctcgttattgcaggtggtggcaaccagtactaccaactcgcctaccgaaattattcggctgggtgtgcatcaacccatcgtcccatccgcgcttttctccgagcgaagcacgcatgatgcgtcacgccaccatgggcagaacccgcggaagcgaagcgtagctagcatatggcagcgcgcctcctctgctccgcgatcatctcacccgccaccgctttcctccgtttcctcagatcacacacaccacgtcgcaggcccctgtttttttgtgtgcgcgcaagggccatgatgcccgatgccgatgcctcgcttgccgccgcgaaaggcgcgacgcgatgtgatgtgatgatccctcgcgtcgcgtccatccagcgtccacagggagagctgagaactcccatcccgacgctcctctggtcggtacggcccccgccccccggctctgctctcgccgagacagcaaatcagagcaatttggcattgggctgtgcctgtcacactgccacgactgggctgcatctgcttgtgtgtgtctgtggtgtgcatgattctcccgtgcaagaaaacatatggatccactcagggttgttgccaaactttcaatgcgcactagaagtactcccccggtcgtcagattcggatacctgagcatgatgcgattcggatccacccagtggaaagagaaagaaaaggcaaggcgccgtgttggcattattcgtcctctgcgatccggctcccgtcgaaaaatcaaccaaactctcgatggtaaggaggaaaagtagtttctgaggcttccgaactctggtgttgatgacggttggcgcgaaagttttgatcgggcaaccgaaagttttgatatatgaacacggatcatctgcagtattgcatctacaatagaagtggttgatagtatcgcagacaatctccactaatgatatacctagaaccaataaaaaaccattattgacgagttatgccttgtctacggtatttgtagagtatggagatcgttagtatcaggacatacgcgagattacggtaaaaatagatgggtgacaaggatttttatacaagtttggacaccccccctaactagcaggtaatagttgtactcctattggccaaagccaattgcagcaaaagagacttcactatttgtctaactatttgaatctatttgtatcgaactatcatccgatccaattgtacaacaagcttacaactaatcgtccacagccccatcaacatcaacgatcaaaagcgttcatgctaagtactagcatcggatcctcccgttgattctgtaccaaaccatcgactatcggctatcggctaacacatgcttttgacacactcgagactcgagcttgcaattgtcatcaacgttcgtgtctccaactctccaacagccgattgttccaccgtgtcagctagtcgttgctacatcgacatattgtcagttacagaatcaaactgactggcacgcctgcacctcatcaagatctataatccagcactaaatcttagtcgatctccggggcctcaatgctggcatgattgacacacatctagtacgtcaagcggaaaattttgcgtcaacgcattgaagtaacaaaaaccattgagaaaataggtgaaatgcgcaagggcataaatgatattatttttctttagttagcaccgctatatatgttatcttcacggaataaggttacatctaatcttacctgaccttagtttatttggtgtaaaagttgattattttggaacatgtgagatgtttcttgatctaagagcaggtacagtagcatgttataagtcagctataaacatattttaaagtgataaagaaagagagagaatagcagcggtttacagatttgtagtcagctgtagtacggactccacgacgtaatgtgtgtatgataggtaggaccagatattaatagtatagtaagtaactattgtatgaattggctattatattagctatacataatatgaagctagtagttggccgtactattaaacttgctctgatgttttgatgttccttatcaaactcacaagtgccaaaatttgatgacatgtccaaagaagagccaggatcttgtcaaacacgcatgattgacaccacggagatccagcacgtccgggctaacgtcggtctccagcacgtactagtagtagtcctccactagcttcgcagcagcagcgacgacgtcatgggcacgccctggacggcaaccaacaggagaggagcctccgcgcggtggaccgccacgaaaacacaccgtaattcctcctcacctcctctgcatgcgtgcgagtggacggacggacggagagctcgtttcacccgcctacggctacgtacgggaaaagggggagggaaaaagcagtggtggaatatgtgtgtgcggcctggtgaaaatgccctgccttcgtgaagcgcaacatcatcataggttgtcgcgggcagagcgagcaagggcacgcatcaaaagactggcacccgagggctatcatgaggttaccgcccacgcgctcacgctacgcagtaaatccccaccctagctacggacgtaacggacccccccactgccatcatccgccgtccatccctctctacgacggctaccactgtaccaggctaccacgagcactggcacggtagacggtagaagtagtagtagccgtgtaggaagcgctagctgttgaacctgaaaccccggccaatttcgtgtgttacccaaagaaaatgttacttcctacctctcaaaagatcaatacaataacaagactataaaccagctctaaacatattttaaaaagataaaaaaaaaagagaaaagtagcgggccatagatctgtagccagctgcaacacggactccaaaacataacgtgtgtgtgataggtgagaccagatattaataatatagtaagtaactattatatgaattggctattactcctacattggctctagatgatttggagttaatagttggctatactattagacttgctcttatgtagcaatttaggatgtgttcagaacccagggtccctaacccctttctatcgtattctgcacgcacgcttttcaaacggctaaatagttcattttttgcaaaaaaaaattatatacgaaagttgcttaaaaaatcatattgatccattttttaaaaaaaattttagctaatacttaattaatcgcgcgctaatagaccgctccgttttccgcgcacactgtttcggatgggaacgaggtggtgcgaacacagccttagaatgggatgagacccaacctaaaactatgaatctggatttttatgtctcatgtttaaattcgtagtcggttgctacattatgggacgaagggagtagcgtgttagacagagcgtgacatgatccaatgtaatactctctccgtcccataaaaatccaacttattatcagatgcgacatataaccaagatatgtcacatctggttctaatttgttttttacaggacaaagagagtaatgtattacagcgctcttctgttccataaaaaagttaacagtaggtattgaatgtgacacatatgcagattcattattatattagcatgtgtcacatttaattttagggttttttttttacttgagggagtatacccacagcttcaccgcgatgtacgccccgccagctcacggcatcgtttcgcgcccaaaggccaaagcgcgcggccgtccaagccgcgggtggcgcacggcacgggtcgtcgtcttctcgtcgctggcgacgcgcgtgcggaggcgagacggcggccgctaggcggctcggcgacggcggataaagaataggggaagagagggcgagggcggcggggcgcatgggtagcaaaactcgaaaaggcgggatagctttatcgatcggaggcgcagattattagccatgcgagcccctggttttatgcgatcgatctgggaccagaggaccagcttacgtgtgtaagcttgtactgctacgtacttactaccgttttctaataacacagcttccttttccccacttgttcaattatgtgtgtcaaatctcttcatccaaaataacttaacctcaaatcctaccataggttatatggagagagtagaaagtaggagtctggagcgtcccggtcaaatcgggtccccgtgcaaaatattaaaataggccctagtagcctagtaaattttttatagtaaaattaaaaatgggcgtgacgattaaccgatcatcagcgatgaagcagaagcggaggccggagagaactggggagaggagacgaagcggctgcggcatcaggacttcggcgatacgagacgacgcagactcttggacgagagtacgatggaagatggatcgattcaccttatgcagcgttttgggccttgtgtttgctactatttggactgcaaattaataaaattaaagcctctaatattattatatatagggcatacttaatattttaggggtccttaaaatttgggggccctattcggtcgcacggcccgcacgggccccctggacgcccctgtaggagtatatgtctaagcctatcccaaattatcatattgagctcaacactaagagcatgtttggaggggtttctggcaactgtaacttctcctacaatcagaaacttcccaaacagttcaactttttgtttaatttttgagaaactgtagctgtagattcataaaatgaactagaagctaaaaacacagctttttttaattctcagaatctactccatccttctaaaaatcttagacctatttcattatttggtttttcaaaaaatctaagtcttatttgtagttactatgtgctaaattaaattgttgatcaaaaatcaagaagtcattcgtacttattggttgcatgtccattatttttgccacatgatgtatgagttaattgctttttggtattgatgaaaaagaaataggtctaagatttatataaggagggagtacttcctttgtcccacaaaaaacaaatgaatgtgacatattaagactgtccagattcattatactagaatttgttacatccagttttaaatttgttttctatatgaccaagggagtaactacctagctgctgcttatcttaatcttgagcttcctcaaacagccagcctcttaacttgagttcattttgatagttcagctagaggagttggcggctttaaaaaaaaaacaaatcattagcacataattaattagattagatattgacaattataacattacgaatatatttcacttttcttacaaaactatataaactatcttttaatttataaagcataccgtttagctgttaggaaaatatgctaatagaaaacgagaaaattaccgtgacttcctctttccaactcagccttaggcccaagaccggtccaattcgagcagaaccgaccgggttcaggccgggtttccgtcagttacccggcccaagcccgaagaggacgaggacgagcgcacgcacgcacggacacggaggctgcagctggaaagacggacaggtaggcccaccccatcaccccccatactgtgccataaacattacgctgcgcgcgtacctaaaaaagcagcagagaggaagaagaaaaaaagagtttgggctgaaaaaggcatcgagagccacgcaccggcagcacgtcgccggccatccgtcctactaccaccagcagcaacagcagcagcagaggcaggctggaccgcggcgagagagctttctattcccctctcgaaatcggcagcgaaagacgacgtcgtcctcgtcccacccgcgcccgcataaacgctacagtggtggtggcaccctgcaccgcccaacgaacgccaaaagcaggctgctcatttcaaaggcggaggaggaggaggagaggagacaggaaagccttccatccaaccatcgctgcccccttgccccttcttggcctcttgcggtgagcctctagcttactcctcctcccaatctctctctctctctctctctctctctctctctctatctctctctctatatctctttcttgttctagcctggtcgactcgtcctacctcactgcagcaacactactggcattgcgagggtggcgtggtgagctttgtgtgggcactcgaggaggcacgctggcccggcttcctgactcctgggtgctgcggccattggaggaggacggagtacaccaccctgcaaggccactgaggttaattgccacaccgtcttttctcacaagcatgcacgcttgacaaagctgaagtgagcgataaagagagagagagacatgcacatgtgcaagcacacggcggatggatggatggatgcgcacacttgcgtggctgcatccgggaggaggaggaggctggaggcgccactcgtcttcctgaccagttcttgggttgagattgaggaggaagagtagaggagaggggtgggtctcactgttcctctttccccggtcatggctgatgctgccctttagctttgcctttgttcgtgtgcgccttgttgcgtaccctgttttgttgccttccccgtgttagctataaaatctcgatgcctcctcctcccacatgcctcctctccctcatggctgtcacattgtggccgcgcttgctgtgtgctcttcgtttttaattctccccctctttcttttcttttcttttttaaatttctctagatcatcacatctcaccgtatatactttctattacgcatcctctcgtgtcatcgcgatctcaggctccggcacaaaaactgtgagatcttggcacattggtagtaaaagattccccacacaagcacgcacgcacggagccagagcttgagagagagcaagtggccgttcttggtctctccattgcctcccacaccttgcattataaaagatgctcggtgtctcctgctccaatgcgtgataaagaaaaaaatatatactgacccttgtgttttgccgttgttgttgctgcagagatttgtagtagagagatcacctgcttggggaacagtgttggtggagaggaatgtggactcgttgtttatgagagagcggtgctgcattggacacaagatcttgcgtgattcttggttaattaaaacaaagttgggcgaggtggaagaagggaattatactaatcgcctctcagatcagcaaggacaggcagcaattaacaggtagcagcaggaggaggtggggttgtgtcagctttgtgctttgtgggtgttgtccctcctggctccttgcctccctctctctctctctctctctcttcatataggagtagtttacttccattgaggtgcttgtgctcctcaccattcttgcctcattgcctacgatagcagcagcatcagcccgcataagtaggttcaacttggagtgtgcttgaagcagcagtttgagtgctgtgctgctgttgctgttactggcttgctgctagccgcatcagggcctgctactatctcgtagtctgttcttgttttccgttgtacgaacgatctcccgggcacgttgcaatattcggtcgccgtctcagccgcagccaccagcagggtgcagcaagttgttctgctccttgtacttgtttgctcctgggtactagttgctgttcatcttgtgtagataaatatgggctagtagtggagttgttgcattggttgcagcgttgttgttgtgttagtggtggtggtggtggtttgtgtgtttgggcgtcgatcaggagagataagatttaagatcagcgcgtgtgcgtctgttctttgcctgtttcaagatgaaattcatgaagcttggatcgaacccggatacttttcaggatgatggcaatgaagtcaggtgattgttcgtcttgtcttgttcagttcctttgccttgttcttgtacatgatcttaacttgtcaactgttctcttttttggggggtttacctggtagtagttttcatcagttcttactcttctctgagtgtactactgttgaacgtctgaatatgtccaagaaatgtgtaatacatcctgtttggtatgatcttgaataacttacaaaatgcagatgttaaataacagagaaatattctcctgtttggtttagtactgtaattatagaaactatatttctcgatcccattatataggcccatttattccaaatagcctagatgctagatgcacaaaatctactgttcatttaggcacaggctgcttgttcttttctcgtttcctgacttatcacttacgagaactgttccatctttgcagcattgtggcaactgaattagtgagcgatgtcactgttcgcatagggactacaaagttttaccttcacaaggtaaaaatgtccttcctttccattcatgcagcttttttttttcagagaaatgccttcataaaacttattgcaatagtaatttcttgtggttcagaagataatggcctcatgtaaggtttgatatttgcttgctggcatattctcttctctaaatgctaaaccacttataactagagcaaatgcttccattttttcttcttttgtggtttatctgtttattgaaaccttaagtaatattttaactttatgctacttttttttccttgttctttcaatgtttaatatatacttttctgagcgatgtcactgttataagtttatgctactttaactttatgcttccattttccacccgtgcagttcccacttctgtccaagtgcgctcgctttcagaagatgatcccaactactggtgatgaaaacattgagattcacatccatgatattcctggtggcgccaaggcttttgagatctgtgccaagttttgttatggtatgattgtcacgctcaatgcctacaatgtcattgcagcccgctgcgccgcagagtacttggagatgcatgaaactgtcgacaagggtaatctcatctacaagattgaggtcttcctcagctcaagcattttccggagttggaaggactctatcattgttcttggtactacaaaggctcacttgccttggtcagaggatcttaagctggttagccactgcatcgactccattgcttcgaaagcctccactgacacctccaaggttgagtggtcatattcatacaatcgcaagaagctcccaactgagaatggccttgatttggaatggaatggagtcaagaagcagcagtttgtgccgcatgattggtgggtcgaggatctcgcagatctcgacattgattcatacaagcaagtcataacagcaatcaagaccaagggtatggtgcccaaggatgtgattggggaggcaatcaaggcttacacatacaagaagctcccttccttaagtaaggtttcaatggtccatggcgacgcaaaagttcgggccatgctagttaccatcacatgcttgttgccatcagagaaaggatcagtttcatgcagcttcctcttaaagctactgaaagcaacaaatttgctaaaatgtggagagctctgcaggaaagagcttatgaagcgtattggacggcaactagatgaagcgtccgtgtcggatcttctgattcctacagtggatggggagaccacagtttatgacattgacatgatactcagtatagtggaagaatttgtcaggcaagacagtaagaatgctcagaaacataatggtggtgaagtggacagtcatgtccaagcacctagtgcatccatgatcaaagtggctaaagtggttgatgggtatcttgctgaggttgcaaaagatccaaatacacccattttgaagttcattcatctagccgagacaatgtcgataaattcaaggccagttcatgatgggctataccgcgccatcgacatgtatctgaaggtactcttgcaaatttcaacttccaatcaaaaatgcactactcataggacatgttcacaagcacactgaatatctagcacatagtcctaatgcatttcagctcgtgacatttttgcttcaactcacgaatttattcatatgcattgctcatataaattcttctgtatttacggttgtacaaaatttgtttttaagtataacatctgtttatttttcttaaatgagcaggagcacccaagcttgggaaagaatgagaagaagaagctgtgcagcctcatggactgcaagaaactctcaccggacgcgtgtgctcacgcggtgcagaacgagcggctgccactgaggaccgtggtgcaggtgctgtaccacgagcagacgagggcttctgcggcggtcaccatccgagccgacagcatctgcgtcggctcgtacgagagctcgaggtcaggcgccaccaccaacacggaggacgagtgggacggcgtcatggtcgtggaagacctcagcctgtccaccaagaccaccaccaagctagacggcgcagccaatagccattgcagcaacggcaaggcgaagaaaggcggcgcgtcgacgccgaagaaggcggctcaccggaggacgacgacggtgccaaccggcaaagggcagtccggtgagcgcagcagctcggactcgtcggacagtgcgatcttgcagaagctggagcttcccaagaggaccccctccaggagcacgaagccggctgctgtgtagcgttagcttcctgcatgaattctcagtggattcgtaaggatcgttaggttcttagctgctgcttcttttctttctttcttcatgaatgttgcatagaagcaagaactaatggtttacacgtctgttggtagggatgttataatgtgaggtctgcttttaggtgatcttgttagtagcattgtaggcttgccatgaaacctatgaaaatgttggttgctactttgaggttttatgccatactcagaagttagtagctgttatgaaaaaagtttagaactttgttagaacttggaagcataattcatctgctgctagcctgtttatactggtatagtggtatgatctcagttcagatcgtgcaaagtcttgtgtaatttgtaattagacaatgctgtcctgagccaagaataacagagctgcggaccaaatagggatatcttgttgaaaggtagccagtgatgttcagtgttgtcgcaactgggctcaataggcattttgcagccattgttacctgagcgacttgggcctttttagtatttggattatacctctaaaaaagaagtatttggattgtagtatagtacgtcatactagtatcagctatgtcaagcgcatatcgttgtagagagttaaaattagtgctccttcgttaaaaaaaaaagaaacagtactctgaatatgtacacacttttgtaagaagcataatgtataatcctgtgaacgcatatgcaggaaaggaactatttttaaagtgtgtcttattgaacatagacaattacatcaagatgatagtataactatacagagaatatttttagcctatgtattgcaggaaatcagctaatgttttttatacttatcaaggaatctcacgcacgacaaactgctcaagaaaagacctgaagtcgatgatcatcctgatcgcctaggaattatgatgtgaatggaatgccatattttttaatttttttaatacatcttctctttttttaaagaaaattcataaccattcgagtgaatagttttccagaagttagaggctagtagcaaacaattagtgcaaattaaattatctctatccctaatataccatttagcattcaatagtagatttttttaagataatagaatagaatatctcggctttgcagcaaccaatagtagatactcactagtttgagaattaacgtggatactgtaccccccaacacagtaaaagatcatatccattgaattgcttttctgatccatgtaggaccggctaacagatttgactcggaccatgatccataggctcacctcgtccttcttgcttgcaaatcacttcatcgtgcatgcaaatcacgttgtctggcttgcacttgcagatcacctgctgggacccgttgacgcttctcgtttcgcatcgcatgtcttcctggaattacgactgcacgttagaactgcatgtatttttaaccattcaattttatgatcaatggtccagatcaatcactacagtgttcactatatagtactctaaacaatattttatggtacattacttttgctacagtagacaagctaatccttaccgtcagatttagatccaaagtagcagctacgactgtttaagttgcagtccatactactactcgtcttcctggtccgtccatcacctaacctgttcaaatggctgttccaaatgggtaggactggtacacatacggtttcccttctctttcaatggtggaatatatgtccggtcggtggctcggtgcacatcatcacggaggtgaaattaattcattctacaaataggtcaatgacacttgcacctaggacctatgtgtaaatttttaattacaagtatgttctttctattacagctaggtcatttttgaaagaaaaataaataggccatcgtttatgatattggtgtcgccgtccttcacattaatgatttagcttttattggggttagagggatggaaccgcagtaccaataatgttggtgccgtgaaaaaaattatttatagaataaaatttttagaggtttacttgtagaatatgttttttaaaaggattgaaaaatccagacacacccctgacggctgatttgaccagctacgcgtgcaaaggatccatgcccaagaaatcagtactacagtaggtcaaaggaggtcaaaggagtgtgatatgcctgcaacgactgactgacacaacccataccctgcacaatcatagtaccgcatctcatcacatcgaaagctccgccacaatccaggtcctgttcagaacaacaggaggttaaagaattgtgcctccgttcaagttccgtaccatcaaccatcacgtactccgtcgaaatcgtgtcgtgccaggcgaagaagcacaaacgagctactacctccgtccaaaaatgtaatatttctagcacaatactttgtcttaaaataaagctatttttctacctaccttctcctctcaaccaatcacaactattctttttcacctactttctcttttcaaccaatcacacaccttcttcaattattctcacatactttcttaatactcgtggcaatcttaaaaatacttacattttagaacagacgaagtatcaatcgatctgaactttgcttgtcgtcggattatccagggcccgtccttctcatcggcggcgattttgtctactccttgtcgaccggcgagagcatggcgagacgacgtgcccccaaatctgcaatgaccaatgagctttcggtttatctcaccctggcatgcatgatgcatccatacatgcctcggtcttgggctcttggccatttggatcaactcaccaacagccaaatgctgaaactacgacagttcaagtaatagcagatgctagctgctggcctgctgcctagtactccctttatctcataaaaaactaatataatactgatgtgacacattttaatagtataaatttagatatatctttatctagatttatagatttattgtaatagaatgtgtcacatttagttctagattttttttttatgatagagtagactgaacggacatatggtcatataccctgtgaaaatgcaggggtcgaatggtgcaaagcgtaggctggctgcatgagctttgttgattcttccttatccactcaatctgggtacacacgtacttaacttagccacctaagggcagccacaatgtggccataagaagaggccataaggttttatagtgaccatatacattgtgaaacaaagccataagacattaaatgtaaaagaaaaatttaagcttatggcttgaccacaagcaataaaataatagggtaaaatgaatgtgaggatgaaaaattggcatggctgataaaagaagtactagaatagtacattgtgggatccatcttaaagtttactcttatttcagacattgtagtaataaccataagaatagtgggacccaccttaatactactcatggtaataaacattggagatacctatagtgcaacacctaatatagtgcaacacccaatttgtgtgtgtccaatgagtaagtaccaatgtgattaagggagtagtagtaaagcgtaacacaaacatcaattcgtgcgtgcaatcagtgatgccaacatgatcagattgcaagtcaacgaggttggataatctgctttgtctgctgagaaatgtaagagtagtactgatatgaagaaatgagctcattttaatcctgagattcttaacaggactatttcgttgcacctgtcatcattgtcgctcgatctgatatgtagccgaatgcaacggacaaattgaattattataccacgagaattccaatcattgtgcttcatgtactacagttattaccagtaccccgatcgattggctttccctgttacagtacgtcgctgcaaagcgacgacgagtcgacgacattattcattgcaccatttgaaaaaaaaaattcgcctctgcgtaaacgaagcagctagcggtgccggtgcagagccactgcacatatgcaattctgcatgagtcgaacactactagctcacatggaatcgtacaacacgcggcactgcacagtggtctcgcacagtacacaccgagcgaacgaccatattgcctgcctgccggtcaaaagagcggaacagaagcttggattggaatcgtcagaacgaaaaccccatcatcagacatcagcaaatgcatcacgcacgcatgcatcgctgatgctggtcattcgaccattgttgcacagtgcagaaactcgaacggcatggcgaacatgagccatcagcatgtactctacagtacaggataatcagttgatcacttgttctagcaacatcagtaatttggctgtatttttatgattattaatgttactgtgtactgtgtaaaggtgaagaagatgttagtgcctgattttctactattgacaccgcaacattttggcaaaatggcaagttagatgttttagtaaagtgcttgatttgatacgaaggtttggtaaggttatagagccccaccacacaatctctgcatttccatgttagagctcgggcgggccacgtattctgtcagccgtcacggcacaaatcattacggatagcagcatcaacaagataagagctctcgatattgctatcgattccggcttttttccgattataattagggcagtgtatcctacaaaaactcgattgcctcccaaaacgaaccgtgtaaaaggctcacctaaaccaaaggagaaaaataccgagatgcagaagagaaaaaagaaaagggtttagatcgtacggtctagctacactcttgactctggtcgccgctgatttcttttacttacacttctctggggtcaacgaagatggagaggccaggaggtgacctggcccaatcccagccgtccgattctccgacgcggcccagccgcttcatgcaccacaggtcctcggtgcacgagaggcggcgccagtgcgggatgcggcggcggagcgggtcgcaggccgccacctcgacggccacggcggccgccctgccgcgcgccatgttgacgaacgtcgcgaacagcgcctcggcggccaccgcggcgtcggggccgtcgccgccgaggccgtacacgaaccacccggagaacgggcggaagaagtccggcacggacgggacgcgcatccacctcgccgcgcggtccagcgcgcgcgtcgcggccgccgcggcgcggcgaaggcgcgacgcgccgcgcagctcgaggcggaacacgcccccgcagtcccagaggctcgccagcgcccacgacgccggcggggacgccaggaagcgctcggccccgcgccactcgccgtggcgccacctcccgtcgtcgtcgatgacggcgaggaacgtgccgatggagagctggttccccagcacggcgccgatgtcggcggggaagaactcgacgtgcgcgaacctgccgtcgtacagccgctcggcgtcgcgggcgccgaggcggaacacggccgcgcggcgcgggacgcggcggcggtgcgcgtgcacggggtgcaccagcagcgacggcgtccggaacttggagtagccgcaccgcaccgtgaacagccgcagcgacgcctcgttggacttgtcggtggccatgtacgcgtactcggctcccatccgctcgaaccacgcttccatccgccgcaccatccgcagcgccaaccccatcctcctgcacacacagccaggaaaaccccccgagcgaatcacgcgccatttccctttcccgaaacgatacgccacgccacgcgacgccgcgcctccgcggacacaagaaacgaccaagtccgctgctgttacctgtggctcggcgcgacgcggagtccgagaatgtagccgacgctggcgacggcgggggcgcccgggcagctcttgccggtggcgaccgacttcacggtgcctctgatgatgccgacgatgatccgtccgccggtggcgcccgacgtcgtctcagctacctttccatcccaagacacaacacacactacaaaatgaaaacacaaccaccaaaacagcgtacgtactgacacgatatgatcgtagtacgtaccaacatgaggtagtcaggggagtggcgaatgcgggcgacggggtcgccgagcaggtcggcgtggagcgacatgccgccggtcgggccgacgtcgcactcccggtcgacggcctccgtgccggcgcggtctctcgatgggtcgtactcccggatgatgatcaccaccccttcctcctcctcttcatctctcatcatggcatatatccgatcgatcgatcgatcgatcaatctcgcaaccgtatcgatctctctctctctctctctctctctctcgactctgctgctctgcataggaatgtagcatatatatatacaggcacccggctgcagtggggttccggccttctattttctcgcagggataacaataaaactgtgagatttttttaaaaagttgtaacgcacggacgtaatcacgcagatatcgcgcgaatgcacttccttctctgagccctctctctctctcccctgaatcatgtgggcgcggttgacgggagagggaaagtgcgcgcatatacgcgcgggcgcatatgatcggccatgtatgcaagttgcagcaacatcgatcgatcgatcaattcattcaattggcaagaagcatatgaagagcagaggtggcagcagaaaaaggagaggccgagatcgatccaaccgttaattcggcggccgtttggctttgtgattccttctcaagattttatctgcgtggcgttattcagctgaattttatccatgtcgatatcgcttatgttctccgttgctgtaatagtgttgcctatgatcttgccaaaataggcgctagttgggacccgggtcaatccatcgtttggatcgactccttccagaatttgtaaatgcctttgtggttcgtgatatcactaaacctgctgggtgaataaaaaggcatcgatgaagttaaaaaaaaaagattttatctgcgtggcgttatccatccacgactccatcaaaaaaacagttattattggttcaatttaattatgggttgtgcgatgaattaacttgcgtcggctgggagtggagcgtatgattggagtggtggggagaaattaactgcgtgcatgcatgcaccacagcaccactggatcttttcttttgctgtggattgaggcttaaaaatcctgccacgatgaagctcttttgcttagcttttaattaccctgttaacatgattgggtttgtgaatccacctgtgaaaaagatcgataattgtatgcggtgatcagacaaaaggtcggccactggtggcgttacaaagatttgcaacactaaccgtggtcggttttaccatgacgtttccgttgcagagggaatggatttccgagtcagtcaaaaatcaaaagcggcagtgcgatctctctcctaggggagatagggcccacccaggcgcccaactctccaatagttaagcttatccggcaaagttagaatacagtaacagcattttagcaaactgttcgagctagcgttcttctcaacttgtggatcgatccatccattttgcatgggattaatctatccttttctgcgtcaatttgtgccgatacaaacacggttattagttaggcgatacaacttgtcggatgaagggagccaagtggggaaacatttccctatttttctgttctatcctaaatggagcgtgaatttctcaatcgaaaggattatggacagtataaagccacgcctaattctaattggatagtttgatccctgaccactgcacaattttctaagagagctcgaggagatgccccggatacatctctcacactcatgccaaatgcacatgcgtgccttgtgctgtgttgtgcaatgcacccggccctatatgcgtttcagatcgagagttatcgagagaccaaaagcttcgcggaacagggggcgagctaccatgacattttgccctaaacctgcacgtattcattcgcacttatctagcattctacaccttaacaaagtctaatatcattgatctgaaccttagcaacagaatgcaattgatattccctgcagtactgctcactgacatgtggacctaagaggctgtgggatccatatatcaatgagcagtactgcagacgatctgcatcccacagactgatgcagtaactagggcactaggtgtacaagctaatatatatgcacaaatctttcggtgacacagaaacaccggagctccaatgaggccatgaccgaaaagtagtaaagcagtagtgtagaaatcttgctcaaataattccctgaaaagcgatcctgtctgtaagtggatgagcatagatgtgactagatcgatcaccagaaatgcaccgttgaacagtagtcgaaaacaaaccgcatcgtacgtcctccttgtcacgacgacatgcctacggcctctactgttcgataggagtatatcgcgccctccctagctacgggctaccactcgcgaaaggacatgtgaggcgagcgaggcaagcgccgcgcatgcacgaatctgatgccgacgtacgcgcgctcgggcgctcgctcggctccgcgccacgggagtacgggacacccggccccccagcagttaacggcaacagcatccgcccccgcgaccgcgtatccgcgccgaaaacgacgtgccgccgcgcgctcggtgatctctcgtcgtttcctggttgggcgcccagccgggcggcgcgtgtcatcggcggctcatgatcacaaggcggggcgtgtacgcgtcagtcgcccgactcgagcgcgcgagacgcgaaacagctggtggttacccgggacgtaacgacgcgacgtacggcggaggcacggcgcgcgggggtgggttttgttgtgggtggggggtgtgtgtggccaatcgtttcggtggcgcgcgctgttttttccgccgtacaaaccaggggaaaaggccccactttacacagtggaaaggcgagccgtgtctgatagcgtggagcggtttttggcgacgacggtggtgtgtgatttcaatttcgcggtccggtcacgtgaaatgacccacacctgagagcttggctttagcacggatccgcaacccgatcgatcatgcggtttgagtccataacccctttgtttgtgcgtcccggattgggcataggagcttgtactacaaacgacaagccaagctacgtaacctgatctcgatcggtaacatgaggtaaaacccgatgtggtaaactgatcatcagacagcccgccgccggtgcattaaccgtcgaggggtgcaatcaagaagatgcaccgtacatgacacaggaactgacggggaggtatggagaggcggcggcgcagtaggccaccaccagttgccccccacccccccccccccctatacatgcatgggccccaactgctgggaatgtaccagtacagtattcttatcgatcttgaccgacaatgctacagcaaaatcagtcaatcatcagcacgcttgacaccccaacttttggtactatagtagtgccactacacctgttcggcccaagtgcacgtacgtggctgctctctccgttgaaatgaaaggtgagatcaagtttctcagacagttgacccaagatattactagtactgtactgctatactcgatagtggtagctatagctgctagctgctggtggtacgtggacgtagttgtcacgagcatgtccaccagagaaattatgcttgccatgacaggaggggaagcccaaagccccgcatgcacagcgcaggcttccgtgttgtacattctgatggtgacacggccgatcgagccgtgagaaagccaacgccggctcactcagcttgctctctccggccgggccgcgcgtgtcgccgtcgacaagaggtatggaggcgcgagagctgattgatatcagaagcaacaagcgcaagcgatgtaatcagaggcgccgccacctcaaaagagaaaaacagtgccgtgacgagcgcacagagacgaaacagcagagatcgacacaaacacacacagagagaggatagaagcagcgatcagagtcgtggcgaagttgtacatgcatccgcacgcccgcacgcatgcgcctagctagcttgggcaggtgcatccttgccaaagatggtcccaggcagcaagcaagatggatacaacggctcatgcgcatgtctccaactctcgccatgccggctttggcacatagcgagctagagatactgatcgacacacagagactgacccacaggcacctggctagctagatcaagtaaatgcacgcccgtatacgtaggggaccaatggtgccaaactcgatctctcgcaaaacgctgcagtgtgtcaaagctgattggaatgtcagctgtcaagtcctggatgcatgcaccttcatatgggcaatgcggccacgcacggatcgtgaaagcgtacaatcgtgggagccacacggggggatatctatctccaagcaagtgtacttccatcttccatgtgctgtttgctactactagtactagccagttcattgttgtttctatatcgactttgcgttcatttgtatttgtatcgtactcactgtgttcatattcggattcggattcttccagcaacagagatatgcgtgattgtgacaggttatatatggtcgtttaattgccgtttggaggtcatcaattatcaccatggtcagtcgcttgaggctaacttgcaacgggtttgttcagatgagaggaaagcagggtaggcacgagctcaaccgggtcgatcgaccatgcaagcatgcaaaccgcttccaacgctttccaggtgtcgtctccgtcatcagttcgttgcagcaacagaaataacagaacacgttgctttggacgaagtaacttctgcggttcagtactcccaatggagctgctctgatatttccaaatggcatattgtgatgggctgatggcatattggcaggtacaccatgctgttgccgttgtgttacttgctccatcctcgggacaaaagggaggtgtggctcaaagccaaaacagttcagctgaattttcttcagaaacagctcagctcaactgacggaagcaagacaagactcgtaataaagacaacggacaggcagatatttgagatggcgagtcgccgaatggactgggatgccaattttctggagcgtcgatgctctggtctactgattgagcgattgtaatgatgatcaagctaatgcattacgactagatcagaaaaaaaatgttcagtctacaggtacttccagtataattcttgacatgaacttcagatcaaatctttgaatgcttcttttggacaaattgttagaatgtaggataggtgggtcaaaaaagtgcacacaacgcaaggccacgtttttgtagtccaggtctctctgtaagtcttcctttctcaattttgaatgctttttaaaggagcttgagagtggtgaagtctactcgaatcagagtctactctatgcatagacattgtgcagtctactcgaatcaaagtctactatatgcacagacattcggtcgttggcatggagacctgtctgatactctgatctcacagtccagaaatgtttacgaggattgctgaagtgctgaacacttgagtgaaaggaggaaaaacttgaaggcagaaagagtggacttgcgcggttgctacggcaatatgtaatgccgtccaccagaaaaataccacttgggaaggaagactcgggaccgtggatttgtttttctagaggaacctgaaactttgtaggtttggattgtgaaaacggtgaacctagctgaagatgtaaagctaatgcctgctggcaagcaaacttgacaatgccagaattcagggggactgcagccatcccagatcgagctgaagacgttgaagctcaaggcctagaccatccaaaccgggctaactcattctgttggcccaacccaactactgagttgtgacgcagcgtcggtgtgtggccgctgcatgcagagcccacaaatctgcaccggcggctgtggcacatgcacacgccacatcccggattcccagtatcccaaccgctgtcccgccgccgccagcgacggcctcctaccagacgcaccggggggacggtggcctgcgccaacgagagcacgagggggtgctgcgcgctggtcggctcgcctgttcgcctcgtggtgttcccgtcgctctcaaccggaggcacccaggcagttggtggatgcaggcggctgctgccgcggcgcctgcgtcatccgtacgtgggcatgcaaaacgggggcgccctgacttgacggtggcgggttggtttccgcgacatgtaccatcgccgatgatgtgacgatgcgccaaccgaaacctctcgctctcccacagaaccagggccttccatttacggtacgtgtaatcttctcatctcctcggatttttctttaaaagtttttttttgaacatttttttattttaattttaaaaataaacccttccaaattttattttcaaaatctgaaccttaccacgtcagtctatctagcgtggcaaaacaacattgatacgccatctacagcggacgtgacatttttatcatgcgatgcccagaccgatgtgaccaaataacaatcacgccagcgccagcgagatcggtgtaactaaataacaccagtgtaacaatattgttttgccactccagctcagttgatgtggccaaaaagttcgaccgatatggccaaaaagttcggatctaaaataaattttagaatggtttatttttaaaattaaaaaagtttaaaaattaaaaaaaaatctcctcgccctcacgccgccaaccaagtctagactctgcattgcacgtctcaaaatgaaattttggatttcagtgtagttcaacatgtaggtgaattgtgtgttctagggacttctcggaatccccaaaactaaggaccaatacacgtcgcacaaggcacgactcaacaacagcaatcacaacaaggtttagtgcgctacgaattagttccaggataagcatgagacatacatataacgtctgtatactgccccggagcaagttagaatgaacaacttgcatgttaatttgccatgaaaacacccgtatcaaactaacaactgtttccattccagaatacaaaacaccaatcatcaacacgcgaggcacgcaacacagcaaagctaggcacgcaaacgacaagcttttttcatatctacagaaagctcatccttggtcaacactaggttctctgtatacatccactgcagcaactgttgcaggtaaaaggggccatttctatggtgatatgcactcaaaaaattacatgaatcagctacactcggtgagatcaaagcagattaggacacacttcacacccaacaaatggttacagcttttattacctgtagcacagtctccagtgtgaaaagatgaggccgtgtgatgttagttgaccaccaatgtggcaagacaaactgatctacacccgtgtctggctctgcttttgctttcgttgtagcatatgagcttgcaagctacactgtttaacctgtttttcaaatatataattaacacaatgagccaaacaacaatatacaagggtacaatcaaataaaagtattacagaaattctccatacatgtattgctgcgaccatggacaagagatctcttgattgatccaacaacatttgttcttgtgttgcaagtttggcaagctcagacaccacagagcttgttccttccacctgaagaccaataaaacatgattcagaggttgccacagcaaatacgccatgaattacatgaaatgcatgcccatgtaagagtcgcctcattgtccaaggccttacaaatcaagtaatgttcacataacaggcaaacacctgcagtacacctagcttatgtttacagacaaatcgcggttctggttagccagcttatattcaatgcagtgattcaagttcgatataaacataaaaaataggcatgttttccttgggattctaggattccaactttccataaacctgtaaatacctcaatagatttgaatgcacgctggatcaaatatatcattcatgaaagatttgcagttgttagctgtccactcaggtaattggccacaaggaaattgtcttatctctcagattttatagctacaaaaatatatatgccggaagagtacacaattatgtatgaccatagctacccatcaggatggacctaaagaatctacgtactttgcaatttagatatgaaaattacattcttgataaaagagatatcaaggagaagaaggataggacatatgcaccttagacaacaaagtacacattgaggatgccattgtgtgcatcacgtccaccgctgagttaacagcttccttcacaccttgggcatcagcctgctcagagagaaacattaaaactatccaaaggggtatatcaaatcatatcagataactatattgtattatgaaaaaaatcctaaccttcgcaccaccaacaactggaagacggagagtactagccttcagtgcttcgattgctgctgacaaagcacttgaatgatgtttttcaatatgagaccactcgtctagatagtatatctgaacatgtcaaatagaagcacttagatacaatcaactttgccagaaatgctaccaaatcctagtgcaaactgcataaatagctaaaacaataatagatataatctcttttacctgtcttctaagaatagcgaacagtttgagcttttgttttagaagctggagtttgctccttttagaactgacattgtctcgtaattttgatatttccttccatgcactgtgcagagttttctgaaaaatagtgaaataagcaacattagttagaatagtagctcaaccctttttagattttcattctatggagcatacagctcaatgtattaagtgtcagaacaaatacatttgaaaacaaatggtttattccaatgtacacagctatcaaagaaaaataacaaaacagtgcaccttcacataaatccatatctggaatctaaaacaatacatttgattcaaaggcattgccaaattggaaccaaagatggagaaatgtaaaatttggtatctaggctgtttctctcattaatcaaaggcagtacaaggacctaggtgatatatcccagatgactttattgaccaagaaataatttcaatcaagttatcagccgctaatagtgcaataaagttgacaagtcactagactacgatttacgagttaagtcatctaaatcctgacactgccaacatccctagcaacatcgcgccagtatccttttgtaacctaacagtacagaaacaaaggggtatgggtccaaccattcacactaatactaaaagaagtctccttgggcaaatctgccataacatttctttgaaatgtaaggcctggtttagttcccaactttttcttcaaacttcaaacttttccatcacatcaaaactttcctacacacacaaacttccaacttttccgtcaaatcgttccaatttcaatcaaacttccaattttggcatgaactaaacacaccctaaagctactgaatgcgattgaaatgcgctacagcactggttgtttgaagtggtacatacagaaaaaaatggtttaaataaaataatcaagacatgactgcggacgtgaaaatatcttacagtttcagtatatttgatgtgaaccaagtaattaaaggactactgaaatttatctatatacaatatagagtagattctctcgtaatatgacacccaaatgcccatttgcccaccaaactaagtccactacaagcactgaaccccacagtgctatttttattaatacgcttcatgggacttctgaatggatcataaacaatcgataggtatgggttgaaggtgaatattcaaaactcaattcttcaaaatcagggagcaagtgattagcagctccattggttctcctttagtcaagatttgcatgcaacgcttgcagcataacacaccctagtttacaatgcaactatcgtgaggactagtaaataagcagctaaccagtcccaacctttttagtagtctacaaataccaacttacttatcaggcttctacagtcctcaaagactaatatctcacaataaaaatggaacttttgtattctttcctcgtctgcgagatataacaaatactatgacctcagtaatcatattgatcaagcacccccattgagttgtaaattgttctgaattcaaacaaataatgaaacagaatgtgcagttgctgattacagataccccagaggcccaaatgtacccccacacatttgcatttaggaagtgaaataaacacaataataaaagtgaaactagtagaacattaattgttttatacatagagtggataattggatactatgagtaaccaacagtaagaggattttggaatgttatagcttaaaaccagataggtcaacataatttacctcagcattgaagctctgcaccaggagagctgcatctgtccgagcattgatgcatcgccactgcaaatgtcgattatcgagcagccgcagcctgtgtgcctcctcaattctgttctccccctttttcgccctcctcacctctgcagcaaagctgatgatagatggcgcatttgccggcgcctgcattgtgtgaccattgggtgatgcctccccactccgccctcttgctgggctcgccatgcccctgcttccgcggcttggagatggagagcggccaggcagtctcggtgacatttgactgtctgagaacgatctcctgccagaggatgatggtagcggtagccctggttctggaagccggcgaaggcggctgttggtctcctgccagaacctcgccggcacgctgatgccgcggcgtgggggatcaccggcccccgagttgctgccggatgaaacgctgtcggtgtcggaggatgcagagaggtcgtgggccgcggcggcggcggcggccgggtccgaaggggagagggatgtggtggagtcgaacgccatggagcggcggagcaggtggacggcagccaggatggagtccttgcggtccaggctgcagtcgaggctgcgggcgagggggtccgacgccttgggcttcgccgccggccatcggtgctgcggccgcgtgttctcggcctcgggcaccgacgacacgctcttccgccgctccggcgtgggcccgcgccgcccgcctggggacgacggcgacgccgcccgcggcgcgcgcgacgtctggtagaagaaggactccccctggaacgacaccgagaggctccgcatcgtggtcgccgtcaagccccccgaagccaccgccaccgccgccgccgccgccgcgggggccggggtgggcgacgtcgagtgctgcggcgggggggtggacgacctcgcgcgctgcgcggagagcgagcggcggttcgacgacggcgcggacgacgacgacgtcgacgacgacgacgaggtggaggaggtcggcgacgcggccgccgacaggtagcgagacgagaccggcttgctggagcgcgcggggcggcgcgcggcgggggcggagttgggcttgtcgagggccggcgtgagcggcgggcgcgcggggtgcgccggatctggcgcggtagccgctgccgcagcagccaccatgccgctgccgcggccgtccaaggaaggaggcacaggggggaggagatctagctacccgctgccctcccgcggcaatgcaggtcccctcggctccagattcgccgcccccgctcccactccggctgctgctgcggcggcggcgtcggcggcgagcggcctccggatcgacgcgcgcggccgcctgcgaggaggaagaggaggaagacgagcagcagcagcagcaaaactgggtgagtggttgatggatgcggagaagcaagcagagtactagagtgaagtgggggatttttctgcgtctttttttctcttccaatgtttttttttaattttttttggggccttttgctgttgtttttacttctactcgttttgtaatctgcctttggctttgtgttgtgttgtgcagctctgccgctgattcttccagccaggttgtgtgtgggtgtggcctccttctggttagtgtggctgtcaagctgtcccagaggagagaagagtgcctttttctttctctttgatctttctaaagtgatgttaattagaacattttacagtatcaaccatggggagataatccttctgttttacaattcgataaatttagttaagcgcaggaattagacaggagtaggttacatgtttgtcttaaaaaaaagtcagcagaagctactctatctataattatgtacgtcttttttttttaaaattacatggcacaacgtagaaactcacaacgcacgcacactcacctctataaacacacgagtattgaaataggagaagataaccaaggtaaaactatctaagaccgttaattttacacgtcttgtattatctaagaccgttatttttacacgccttgaatttcaaaatgtggggaatgtaaatgtgattttttcccctcaaaatagattccaacatttgcctcattgggttgacatggaaaataatactgtaactgaagatttaagaagtgggtgatatgaatttatggttttgttttatgtattcccgttggtagctaaggtttaatggaaaaaaacaaatatgggaaattaaattttctcaagaagtaaaaggtgattggtcgtgtcaatttgttacttgggttggacaatgacatttgtgcggacggttgaagcaaggtggccagtataagattccatatatgatgatgattcaatggtagcgtttttacttgaaaaaaaaacttggtaaatgcaatagcgtgatgagaaatgggagccaggagtgaagtgcaagggtgataaataataggaaattggaatacatgttttctcaacttataaaatatatattgtatttgaaatagataaatcaaacgtgaagaagaaaacgatcaataagggacaaattttggtgttggaaagccaagtactggctgagaagatttgggtaggttagctagactgaatatgtctagtagtacttcctttagtttaggatgttagcgaacgaatcgaaggacattttgtcctgtttatattgtttagtaattgggtgtttgtgcgtgtaacttgcgggaggattaggcacacgtaccggattgttttttgcttttttaactttatcttgttcttcaatgaaatgatgtactcctaattcatttccaagcttaaagaagttgagttgcccaaaatgctatagtacaatccgtgctgccttcatttaatatggataataatacatgacctagatctcaaattttgtagaaaagttaagatacataattctccattatggaattaataaacatttttactgtattggctatatatgcttgacttgatttcctacctcgtatctacaaacaaatagccatcctgctttgtttgattgctacatgcaaaaaaaaaaaaagaaaataagaaaacataatagtgttttttctaggtaacaaaaagttaattgaatgcgtgacagggcgatattgatgcaaacaggaaggcaacgttgttataaacgcggacaccaatcacaccaaagaaaaaaaattatcaaaatgctctgcattgttttgttaatttttttttctttttttggttgctgaaagagaaagtgagaaacacctgaaagctttgagccacgatggttacgcaccttatgagtttgactaagatcatcagctaatcaaaagtaaaagtagtggacatatagatttttttcaactagagatatttacgcttgaattaattttgatggaggagataacacgagttcacttcaaggcttgaaccgcatgttatgtggcccggttgtgaactcgtgtgatggctacttatgatcttcgttgttgggactgatttagttttcttcagttaaacgtcacaattattgatttttatcacacctctgattaaacctaaaaaataatagcaacaatatggatgccccaccagaacaactctttagtagaaaagttcagtgtaaatggctcgacgtataaaaattgacatgagcagtttctccgaaaaggattacttaaacaatactagcaagaaacgtatagtttaatttttttctcttttgataaatagaaagagtgatggatagcacacaaaaggtaaacaggggaaagttgtttcctttcgctaaaagaaaggtaccatctccaatttcttgttggactttctgtactaaatctccaatttcctaaatggttgtaccaagaagtaagaacacaccttaaataacaagtcttttgaaatatgattgcttatgtgacccattagaaagatcaatcaagaaagtctgaatattaccactaaactagttagttggtttctttgtgataccaaaactgtaaagtgatataatcattcgtgtctataatgatgagaactttactacatgtatgagtaaagaaaataaaatcaaataatttgacctcaaaacttaattgtttatatttgtggagaataattgtctagttttccgatgaagggaaaattgcaggatctggccaaacacataaagttggatgaccgtgtatacttatacttcttagtctaaaaatgctaagaaacatctatttatttttatattgaaaatcttgtttattatttaaaaaatatgttgaatacgttgtaaaacattgactaccaaacatttttagggtacaaattaatacagaagaatagagggagtgataatctataaaaaacagttgaggtactccttttccacttgctaatggatcaattagcacagcacacaaactaccaccttcacatatttgattaattaatgtcattttcttcctttttctctggtttaggtaaacagtgcctttttaaccacagctagctgagaactgcatgtactttgaacatctggctagctttgttcccatctcccctaacccctccgttatgactcacatcatcatgttaactatagtatttttcgctaagtagtccttctcacaacgatgttgtggcctcgcctttcttctcctataaatctcattgtttgcttgacatctaaccttcctaatttgtttacttgaggctctaatttgttttccgtcctgtcaggttcaggagccactacagggcctagtaaaacctgccaattgggaaagaggcctcttcatcaagtgacaataattctcaagccctaaaaaaggcagccatatattattcagaaggatattttcctgacatggctggactcatttaaaattttatggcgtgcccaaaaaatgttagctaaaaaataacaccatttagtatttacacaagtgcgggacaaaattcaattcctttgttccaaactatgccccggtgcttctatgtacttcctccggtcatagatataggatggttagaataagattttatcaaacttttaatttttttcataattagaacattctttaaacgcttagtttaaaatcataaaaaagaagacatcaatagatatttgtctcgataagtgctatcataatataataagaaaaatatattttacaaacctatattctaatatataaagttgattgtctgaatttcaatatttcgatctaatcttgtattaagcaccaaacatttatgacctgagtatctaaagcatatatattttctcgatgaagagagatgtataactgtcggttgtttaattagttgtgtccggtatattattgcatcaatgtgggcacactagttctctgacagatgttattttaaggttcagagaggagaacaagcaagcacactcgtcattttgggaaccacaacatcacaaggccgtctcgtaaacgaaaacaatatgctatgggaacctaattgccaatcacatgtcaatttctttgccaaactatcgagtctatatgatcttgaaattggtcgccccataatatattggagctcatcacatggccactggacaagtgcgtgaggcaacttttaattaattagtgtgtgacttgttaagtaacacgggctaattaattggcaaaaaaaacaagcccctaattggatttgattgatcatttgaacagtggtcaccgtacgtacatacatcctgtacatctctgtgtgtgccatggtcagaacagtacgtgcttataattagcaaacactataaatacgtcacatgcatagaagcagtactcatgctccaagttaatcagatgggtagttagacaagcatagttcaccaaacttggcaataccatggagaaaatatacatgatcggtagctcagctgtgctaagtagcagagctatctcatcagtcatgttcaagcaaccgccccaactaaatggcgccaatactaattaagcacccgtccttagtatcggtgtcatccgggacagtagagtatacaaacgtaaacggatatataatgtgttcttgtttcaagaaaaagtcattatctaaaaaaaatctgtatttggaagtattttttgtatgacactaattttgtggttgctgataatatattataaaataaagtagtgttcaaagtggtacattgtaattgcgtaaaaaccttatacgtctgacatgaccatataattagttgattgtcttttcctcgttaatcacggttagttgtattgtatgtcaaagtcaatatatgacaaatgaaaagtgttagtagtatttcacagattaagaactgagcaggtaagtatttttttgctttgtacataagctagctaaccatgtgtccatgacgataacaatctttttaattcgtctgtatataatatggggttgcttgaaccactaaagttgcttagcttagtctgcagcgactgtaaaattaagtacactgcactgtacactttgtagagttgctgtacgtgtaatcagtgatgctgtgcatttgtcaagtcataaataaaccatgcatgatcaccggaaagcaaagctaattgcgttagtacgcaaatttaatcggtccctacttgcacgcaccacctacgcatgaagctacatgtcacgtcgataaaaatgttagtatattgctcatggctagctgctacgtcgcctaaatcaccaattaaatgttgatagatacagagaatttacgtctgagtactcagtcgagccagatcggaattaatgaatttgttgaatatatggatcgaccgggtgaatgtgccaaacaacctgagagggaagttcaactggtcatacatgtatgtgccaccaccggtccaaccataagtaccaaaccactccattctctatttttttttgtttatttttctaaagaatctcatttcacagtgtttccgttttaacaaatcccatactgatcgcatttcgtcacatgttcaccttttgcctacgagggttttaggtaggaatgggaacggtaacgtctttttcgaaagcgaatctcggtcaatcaaaaattacatatttacttttttatttttacgaatgatcatatttatcagtttaacgccaatgacaatacattactaaggggaattagaaaaggaaatccaagtttatatatggctagaattgtatcacttatatggaaatgatgcttgatctatcgggcatgactttcaggtgcaaacagctgttatgttaaaattcctatagactctggttgttgtgttcgtccagccgaaatctattagactactactcctagtgctgcctgcctgcctactgaccgtgaaacccacaggctcccgtgggcgaggctgtaaagcgacagcggccaaccaagccaccggggtccggagcacaccatctcacattctcaccctcctcccctctcgcaacgcactttgcacagcgatccgctgatgcgaacgctgtagtagttgtacaccctctggtctggtccctcggcctcggtctctcgctgtggataagaaagaaaaaaagaaagaaagaaagaaataaagaaagctggtgtgaagtggtgctgcctgcagcctgcccctgtaaagggtaaggtggcattaagaatcatcttctttcgaggcacacactgccaggattggaatggatggatcagtatccatctgcaggcttcaggcacagcctgaaatgaacgggattgattggcccatgccaatgccagccacgctagcacgatcccttggccgcagtggcgtttcggcgttgcattcaggggaccaaatcaaccaaccaaccaacgaaacgaagagccgcgggtgcacatgccgcgccgcggacatctcatctcgctcgccagcgttggcacgccgcacgctggccatcgaggcaggcaacggccgcatgcgcggtgcagcgaagagatctagaaacggaaggcgcgcgtggtctcgatcgatcgatcgggccgggcgctaggcgctagcacggcctggaccacgcacggcaccggccggcctccatcctccacacctcacacttgaccggatatgatattgcctgcttccttgccgttttctcctgtacgtactctctgtcgtatccgccaccatcggtgcttgctatatctggccctcctttctgtcgcaggtgcctcggcatggcttctgctggatgcttcatctagtacctccatctcaaaataaaccaccttacgaagtaagcgtaacttaattggttatttttttttaaaaccaatccatccatattcaagtccaaagacttgacacatatactcgtatttatagttaattattttttcagtggttggtgacatatccatcgacagcgagacgtctgtggtgacttcgtcgatctcaaaatatgccagtccatgcacctgtgatgacttcgtcgatctcaagatatgtcggcctagtctttcggaggtcttcataggggtagggtgtgcgtttatatgggtgagtgtctatatttatggtgtgtttctaacaaaaattaaccttagatagatatcttacagtacaacaaatctagaaaagaaaaccccgcacgcagtaacgttcatgagcattttgaaaccacatgaaggatcaacatggctcgaccttattggacactaaaaaaatcgtagcccctcctaacacacgagcaaagaaaaaaaaacgatggatcttttcagaaaattgaacatttgatcccctcctaacacacgagcgaaaagtcggttgattttttttcttcagaaaactgaacatttggtttctgtatgaacagtgcgaaaacactgacccgttaacctattggcctgctgagtctctgtcggggcagcagtgcagaagcagaacacaataacaatgaacatgatttgtcatctttgtttcactaattatggatccatgtaggcagagcccagtttttggccaagtacagtgaaccaatagtccactgacaaatggggggtacttaattagaagcaagatactccaagaaagattccatcctcccatgcatggatggagccatgcaatgtacggagtcataaacatttacatattcccccagattttggactagaacggatttacaaatccaccccaatcatcagcactgtttggttatctttgagttcaatttgactagagatggtgtgtgatgatgtcaataagaggcacgagatcagacaagggaagcatcagtaatcagacgcccatgatgattgtacatgtttctgtctactactcagggttccaatcccgtcatgcacatgtgtaacatgtggaattgctaaaattactcctatttgtaaagtactcctacatctacatgcagcgtaagataatgtcgctagtgtacaaaagatactcgatccactgtggcttttgtttgtgctctgcatggaaattagtagagcttgtgtcaaattttagagccaaatttgcccctcaacagattaccttgcgtccttgccaatggcacgcaggactctgaatcagtaacgagtggtttagcatggcaaatcatcaaatccccgacctaagtacatggccaatatttctcctaaattcctcccaaacctaaaagtagagggttttaggtgaaaaaaaattgttccaattgatccttagtagcatgaccaacaccctccttaatctaataactagcatgatggcccgcgcagattgcgccgctagtatcattacattttctctcatataatagcatatatgttttctcattatattattaaaatatattaaatgacaacataattttaaattttgtaataactttacgaaactactaatgtataatatttatattgtattttatatatgtattagttattaattatttttaatatcaaattttagttatttgtaaattatatatatattcctatatggacactagactcgtcttttaatatttctttttttaattctaaatttttattatttctaattgtatttctatgtggactctaaactcatctttcaatattctttaatttttaatttcaaatttcaattacttctaaattgtattcctatattgactttaaactcttcttcctatttttttcttaatttcgaatttaagttatttgtaaattgtatttttatacggactctaaacactacttttcattttattatgtttattctgatttttagttagttttaaattcctacatggagtctatactctacttctaatattccttatttttaaattccgaatttctttttttttctcaattgtatttctatatggactctatgctctacttctaatattccttatttttaattccgaatttctattatttcctaattgtatttctatatgaactctatactctacttctaatattccttatttttaattctgaatttcagttatttcctaattatatttccatatggactctagtctactcttctaatattccttattttttaatttcgaatttcaactatttctaaattgtatttttatatggactctagtctcctcttctaatattcattattttttaattctgaatttcagctatttctaaattgtatttctatatggactctgctttttttctctccgattaatgtgagaatttctaggtcataaaagcgaacgtggaggctcctttttattccgaattttagttagttttaaatttctatatggactctatactctacttctaatattccttatttttaattccgaatttcaattatttcctaattgtacttctatatggactctagtctcctcttctaatattccttattttttaattctgaatttcaactatttctaaattgtatttctacatggactctagtctcctcttctaatattccttattttttaattccgaatttcagctatttctaaattgtatttctatatggactctgcattttctttttctctgattaatgtgagaatttctaggccatgacagcgaacgtggaggcttcgttttctattccattaataatataatagattcccaacttgtcttccaataatacaggttcctaactccggatatctcgttacccacttccggcgatcgcccaacgatcagatccgcccccctcctcccacttcttcccttccttctccccttattctcttcctactacagtacaccacaattttttttaaaaaaacaaaagttagaaaaaattatgtatagaaatactatatataaaaaatttgaattcaaattcaaatttgaattcaaattcaaatttgaattcaaattcaaatttgaatcgggtatgtaaacttttgacttaaaaactttggatttataaactttaggtgtataaacttaagatgtatagaaatactatatatagaaaatatttgaattcaaattcaaaattgaatcagatataattcaaattcaaatttgaaacgggtatataaacttttgacttataaactttaggtctataaactttaggtgtataaactttagatgtatagaaatactatatatatatataaaagtttataaactttaggtctataaaatttgaataaattcaaattcaaatttgaataaa

SEQ ID NO: 80686 - DNA, 1808 bp, Oryza sativa
  unsure (1)..(1808): unsure at all n locations
atagtaaaaaagcaccgagtccacagtttcctcagactataattaaccattaccatcattcaccggagtcaaccaagagagaccctagatctcactctgcttaatcccctctttacttttttcacacttcctttactcattagaacttatgcaagacatctaattacaaaagatgtgcaatccttatgtgcattctcaaaaagatatctgattaaagataagacaatcaacacacatcatagcattttgggaatatgaaaggtgttacagcattaatctacaactccaacttcatgccagtaagacccaaagcaattatgcattaattaacagcattttggttgcttgaaaaagtaccacaaagaaccaatgccacagcgaaacagtgtgttgcatccaacagaaattttaatgaaaaacagagaacaaagacacacaagatagcactaataattggtacaatgagccatttatccttttctcggttttattcgaagtatgctactatagtatgttgctttggtgttcattgaaatccaattatgtgcctacagagcctcagaaaatgagtattcacagtatctcagtccaatcctcttatttgagaaattgttgatagatagtaaattctgcattagttctaatgaaatccatccatgacaaaaagtagttacccatgcaaatggtcaatgttttgcaaccgagcagcatcatggcccctgcattccaccacagccaccttctctcgcttgttctgtcaaatgagcatcgcagtttcatgaggatatttaactcttatgagcaaagatacttcttatagatccaactccaaggaaatatatagcacaaaaatagtaggtgcttgatggtggacaagttagaatttctcaccttaaaatcaattatggaaagctttatcaggcggtaatcttctcctcgactgcactccctctcacaagatatcgcttacatgacagacaagaaaagggaaagaataatgtaagttaaatttttttttctatctagcagatacagatggtgcacaattccacccactttgattctcttatactagatagaacatattatctacctcagaacatattatcttactgtgtatcactcaagcttccattacatgtcgataaggcaccagcagttaatcatgattttttttcataaagcacaaaacaaaccccaatttcctagataataacaggtcgtacaattttatacacattttcttttgaatgacacgctagtaaagggcattgtctaatacgatttagcacgtcttatctcactatgccttcttttcttttgagcaagggaggagacccctcccccgattccattaccagaaatttaagtttaacggaatccacagtttcatccggcaaaaaatgaagagtaaagtgcattggcggtccttaaacttgtatggttgtctcatataggtccctaaactctcaaaatgcatatccaggtcccagaacttgtaaaagtgtatcatctaggtcccaaatcgacacatcccctctaggatcctacgtggcgctgatgtggcatgccacatggatgacgtgccattttctttttttttcttcttttctttttatttttcttcgttttccccntttccttaatttctttcttttttttttcccctttcttcgtgctcgggntcatagagaaaggagaagaaagggaaaaaaagagaagaaaaaaagaaaaaggaaaaatttttaacgggacccatttgtcagtcaaaatgatgccacgtcattccgtgtggcatgccacatcaa

SEQ ID NO: 80687 - DNA, 1971 bp, Oryza sativa
ttcccattttcatttgtcattcccttgttagttttcttaacaaatgcattggccagtggccatttccaattcagattgctcgttaggaagcaaaaggcaaagcctattattatacgagcgttctcaaaaaaaaagagagagagagagagagaggccggggagtcacctgatggactggaagctgctggcgctggcgctcctcctcggagagggcggcggcaaaaggcgaggaggcgccgtccttgatgggcgtggtgggcgccgaccgcttccgctgcagcgagtggagctcgtcgatggtctgcgcccgcaccggcgccgagctgtcgtcgtggcatatcccgttctcgtgcttcttcgtcttcgccccgtgcgtctcgatccgcgccagcccgttcggcgtgctcgccatggccgtctccggtcgcgcgaaaccttcaaaaaaaaaagtaaacagtcacgttaattagcaacgccaacataacagcgctagttacgatttacgacccggttctgccattgatgcttgcagcatccaaatgccggtgcaaaaaccacggagaaattaaaagagatgatgaacacgtacgaggcagtcgaggaggagatcagcaacgcgatagtgtacaagatgacaggacaggagtggagaggtgtggggcgtattgggcggagtccgggtgcgcttttaaaggggcagcgagttaaccatggttaggtgctctaaccatgagtaggtgttccaacctgagttacgaggcccaaataccgacgtcgtcgatcaggattgagaaatgggaaaatatacggtgaaaactatgtatacggtgaaaacttaaaacctaccattaaatcgaaaaataaacgtctaagattcatctacgttatcacgggtaaaaattttactcgtaagtttacttatgagtaaaaattttattgagacttatattgacatggacgattctcgtacatttaattttcaatttaatggtaatttttgagtttctaatatatatgatttgcaccgtatatttgtcggactttctgtcccacgggaggttgtggttaacgtcggaggctcggagcgagaggaatcaccaccaaattcgctgcatgcacactttgcacggttgcaccaggtttgggacttggataaatgaattcagacggcggttaactggaaattggttggattagctaagctacgaaatggatttgtcacacgcttttccttttgtatagatgctcagagtaaattatagtttacagtagttatccatcgaaacgttccacatatacacttataatttttttcctttgaaatcaacaaaaacaaattcgtggtaacttgttttcctaattagcaaatttggctcagtagattcagtgattcacagtagtcaccaccgttgtttccttctcaaaagagtatatctatatatttatattaattaatttttacaaaacttatcttttacaccaactggtactatgctcctgcttttcaacaggactaaaagaaatactaacaattagtttgatggggttgaattttatctatccacttttttatgggttgattctcgtgcagaaacactcttttattttgtcttttaggcaatatggttttttcatgtggcggatgaagatgtgcgagaagatgtagacgactatctgattttaatagattttgcagtattagtagagatacgtagaagcagaaagaaaaggaccatcactaatctcaattgcaaatagagcaatgtgattaacattattcatgtggttagcttttataaacggagcaggagatgacgagatgtagctgtaaattcattgataggaataggattaacacccgtagcagtgagaactggattgcctaagatatataagtaaacaaattggccaagtatgtggaaaaggcattagtactacaaagtagagtaatttacaaataggattattatg

SEQ ID NO: 80688 - DNA, 24817 bp, Oryza sativa
gcaaaaactcaaaatcccttatattgtgggacggagggagtactttattatccaaagtactttaagcacaacttttcgttttttatatttgcataaatttttttaataagatgagtagtcaaacagtacaagtaaaaagtcaaaatcccttatattataggacggagagagtacaataaatacagttataaagacatactatatacattgtagagatattttttatgatattaattgctaacgtagttcttagctatatgggttgcccatctctatatcttctattataaaatttgaaaatgttttcaccaaaattttgatatatcatccgtgtttgaattggttttaatttgatgtttctgttaaattctttctttttttttttcttacgccagagtgtccctctaatccgagaagcgcgataattaattgggcccacaccttttcacatgtcccttgcgcgctgcctcaattgggcccacaacgccctcactcgcgcgattttccgcatgcctgattaggcccacgacgccctcgcacgcgcggtttgcccttgccacatgtccaatcgcgtctcccttgtccacgatttaaaaattaaaaattgaagacgacaaatcgagcttatgcttattcctaaaggcaaattttaaattttagaacttaattttaaattcaactttttggttttttttatcgtaccttattttatatcatttgcttttgagtcgcttagaacatgtttagtcgtcaacacatatatataaaagatttgcatataaatagtcttttatttggtaataagtgtctcggataagcacatgaataaacaaaacaatacgcgatgattatttatccactgacacatatgtacaatttaaattggctcctcccgttgcaaagcacatgcatcttttctagtaagaaaataaaatataatgacttttgagttaattgtgtacaaatgaatatataaaatataaaacggttggtgtgctagggatccgttgaagtagccgttgtctactgggtgctggctctccatgcggcctgttattagctcttgattttatcaggaactggatttatccaacaaaaaaatcatagaccttctaaatcaagactctccaaaccatgtataaatgcctagccacaatctcctccccaaccattccccaataaattttcccaatctcagtttacccaacttcaacccacattttttacacaatttctatccatttggttccccagtcaactatacaccatatggtcattctccttcaagctttcaagctactccatatcaatgaaattgggcacaatctaatctagccagcttacaaggttttcatttgcaagaaaatatggtgcactcaccaaatcaggccacattttgtttagaccactctctttgttgggggttatatggcccagttctttttctcaacttcaaacttcaactttctcatttttcgttaacatgttctaaaactgttaaatgatatgtttttggcaaaaatagtttatgtagaagttgtttacaaaatcaaataaatccaattttatttttagatagttaatagttaattaatcatgtgctaataagttttcttgtttcgcatgctctaaaagtatgagagaaagaacagagcgtaagttagtttatgagtctaaaatatctaaacctaaacaaatagtagtaagtagcttttccatttgacttttttaaatccataagccactcttgttgtattaagtaaaagttatgtttaacttttttaaatccataagttatccttaccgtattaagccaaaagttagttaggtttgagattttttttttgcttatttaaggtaaaggtatagctttacacttaaatttagagcttaaaattcaccgacttataaattatattagctaaaaagctatctttaaattctaaactaagctttgaaaaggccaaagcttcaatttttctcctgaggtggaggagacgagaaagaggaggcactcatgcagtgcagcgaggcaatccatacacactctaagataaaggagatagaaaaaaaatggtaaatcaaacaaaataatattattagtgttagtacatcatatattgtacatgttattttttttgataagtagcatatggataagattaatgatggcaatcatcataaaactaaaattcgctctaagagaaagctgacctggtctatatagatagctagaagtgcttatatatttcataatagagagagtatcattgtatttaaattgcactagttctaagaaattggcacatcagtatgtttgatataatagttttaagagtaaagtgcatggtcggtcccaaaacttgtgcagttgtgttatttagatttctaaactctcaaaatacaatttttttataacttgtcaaattgtgtcattttggtcctaaattgccacagctcatccaagctagatcctatgcgacgttgatgtggcatatcacataggcgttgacatagcatatcacctgtcaatttgttgtaccgtctgtgtaatttactctaaaaagaaaaaaggaggacttttttagtgggcttcaatgggtcggtccgtgtaaaattggtgaatatgccacatcagcgtctatgtggcatgccacgtcagcactatataggatctcagagggaccgtggtaattggagatcagaaaatacactttgacaagttttagaacctgaatatatattttgaaagtttagagacttatatgcataaccgtacaagttcaaggatcgaatgtgtactttactctagttttaaaattgagcatgcccatctgataattcggcaggatgtattaaagtatgacaacttaagtatgtcgatgcgacgacgtagatatgcaaaagtgctttcccggtcaaagaagaaggaggtgccatgcgtgactttttttttaaaaaaaaaaaacgcatcatcagggcacattgataaaggaatcacctcagccgcttggaactttcatgcaattttgttgcaaaattatgtgaatttgatattttcctcttttttaaaatataaaaataggaatgtggaccatttatttgcaagaggtatacatttactatttaacaaagacatacatggaatgaaagattttaaaaaaatactaaaagtttcaaaacacttacatttatgaaaaggaaaatgagaccaaaagaacacgcatttggaatgagtcgagaggatgcaaggattattttggatgggcacaagaatttaaaaagggaatgaaaataagagaaagaagatagaatgcaccatatgccaccatctatcttcaatttgcaccaacccaacaccactcttcctccctggttttctccagtcattttcctcggcaaaagtagtgccacactgcatgctttgttatgcaaatcaacaatcaggcaaaaagtatagcagtagcaatttgagttgagaaaagctagagatgagcctccatatatatataattcaactttcagcacgttgggacactagaggattttctgaatggcagggcaattctcctttggcacggcagtgcgtctcttttttaggcctctcatgccatgccagaggagaatcgcactgtgattctcaccctcatcagtcatcacacagtcactaacacaggcagagcgccagagcatgcatgtatcactttctgcaactaattgtgttcatgctctttgacgccattgttgcattggctgctagctgcttctttctttctttctttctttctttctttctttctttctttctttcatcttcgccttgagttggtactagcttggggagaactctgaaattccagctacctatatatatcctggcatggcaaggaaatcagagaggatgatcaagaaggccaggtttctggatatgccatgatatatgctaccaccaatcaggatcattcttggcctcttgggaagctcctctctctctctctctctctctctctctctctgagcttgcaattgcacaagcatggaaagcaggaaaggtcatgcaaaaaggggacggtgctttccaatattcttcgtttctttcctccaaaaacttttgttgaattgcaactgttagaagttagtagatcttaataagcttggattggaccgttgatcacctgatcggcttacctgaatgtgtgagagggtcttcatcaattaataaattctgctagttgagcctagcaattccatcatgtggtgattcgcatctcatctttgtcgatggaatatggaattggcgacagattgcggcgctgtgccttgtcgctggacattctcaaggatcttcttcttctcctcctgctgctgtgttcagagagctgaatgaattacgggggcgtctgttcatctggtgaagagctactggtactggggcttcgaaaggccgatttaacagcagtgcagccaaataaccttttgagatcatggatgctctcagagtctcagtcgtttttgcttacatgtaattcatgtggtttgttttttctgaaatttagttggccctttcaactgtttttacacagccatgtctctctctagctaacagctatcatgggcattgataagcaactctttctggctatgcacctatacttaaacaattgatttcagtaattgaaagagaaaatataaccattgacaaacatcctattccaagaaatacaatcaatgaacacaattttaagcaatttgtcccagaaatttaagatacacacatcaactcactagcactcatgatcatcaatacaatatatatttatcttctcagtacaacatatattatttagagataattgcacaaccgtttattttaataaaaagaacacgatgacaaatcaaagttagtttgttgctaacgaacagcaacacatctatctatctatctatctatctatcttctattatatactaaaagtccattaaactttctacaaacgctctcaatccgccacgtgtcactcctacaaacactcctagaccgccacatggcactatataatctcaccgtcgattttcacttaaattggtggacccgatattttagaccattggattagatctattatttaagaaagtaatcccttcctctgctgtgggccaaaaaaaaggaaaaaaaacgtacgtacgtacgtgtggcttaaacttcctacatacgctttcaatctgccacgtgtcactcctacaaacactcctaaaccgccacataccactgtataatctcaccgtcgatttttagttaaattggtggacccaataaagtaatcccttcctctgctgtgggccagaaaaagaaaaaaaaacatacgtacgtacgtgtggcttcgtataaccgtgggccggaaaaagaaaaaacataagaacttagtacgctctccctgtctcttcctcttcctattcttttatatctccatctctttctcttcctaattcttttatgttatcaaattaaaaacgagttaagttgaccatttaaaataatttaaatgtacatagctaatttatattctattaaaacgttgctctatttataattaaattgacaattttacatccaatgttttgctatatataagcaatatgttattgtggtatagactgtgcattttgcaagtttgcatgccatctaaataaattaaatacttattaacaacatatattatatatctatctatctatctattattatatactaaaagtccattaaacttcctataaaccctcttaagttgccacgtgagactcctataaacactcataagccatcacgtggcactctaataaattagaaaaaaatatataacttgaactggtgggccaattggatttatctcataaaaaaaattcttcctcaactactacagtacgttctcatctccttcccctcaatcccttctcctcatctctttccttttttctgtatggtagttaagatttttgttttattacttaataattaatttcttcacttctatctaacgagaatggatgtggactcttgattgcatgtcccatgcctaaatatataaatgattaatgatttgatgcatgcttttataaataacaaatctatttttaactaacaatttagaaaaaagataatagttacatagcaaaataatcataattttaaaaagttactccctctatatcatattataagccattttaacttttttcttaattaaatttctttagatttgaccaaatatataaaaaaaattaacaacatctatcacacaaaattgttttgttagatataacgttccatatatatccataatatgttttttttgaaaattttactatattttctataaacttggtcaaacttaaaaattgacttaaaaaagtcaaaatgacttataatataaaacggatgtagtatatctgtttttatttagtttgtttgaacggttgtttcataactagacagctaaataatttaaaatcaatattaccaatatttcactataaaaaataaaatatgttatttgaactgccacctattctttacctgacaacccaaataacatcctatttttaatttatttgaactgtttatttatgttactcatattttactatgtaaaatttaaaatacgtaatttgaacatacaccaacaagcaaacaacactgaaacattgaaaatttgacaatatgtattatgtcatcttaatcattctacataataaaaaatagaaaaatacaaagtcaccatgtatgaccttttagatacatgctaaattaccaagtgtcacattttaaaaattagtaaaatcttatatattaaaagaaaaaaaataaaacatctagctaacggttttcacctagatcgatgacctattaacattattttcaactatctaatctacttttagaaaaatatatcttaataagtggcatgtcacatattttaaaaaaatcttgcaaatcttaggaaaattacatctaataattggctttcacttaatcacttagaaaaattaaaaaaaaaatcccctccacacgcgcccatcactacacagccgctccttcccctctctggctcaagctctaaacttttcattcctcttacgttcctatttaactaaaatataaataatctataattataagtttcacgtctgatttctaatctaactattgctctgtttataatcaaaccaacgatataagatccatatgcctatagtttactatacaacaaatacgacattttaacacaatcagcctattacttacgagtatctcaaatgcagcttacgatacatgcccgcgcgaatgcgcgggctacctttctagttaaatataacaaagatattgtggagattatgggtaccccatacctacatggcatagttatccgactggctataggggataacttatatctatggaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatgatgagacaacctgatcgtcagatcaatacatactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtagggggtgcgtcgaattacctgtcgaaaagtgcgatggaatcaacttcagaagaaaccccgagatcaatctcatcaatttcgatggctcaaatcttcaatcgggtctaccgttccaatttaatctctattagattaatttttaatcattgtttgatttcctgatattttgacgaatttcatatactggatgagatcgaaacacgaccatcatcgtcgcctacttgggtgcccttgccgtgtccgagtgctcctctcttcctttccttgcagatggacgtgttgcaggagtggcacaggccgccaggattcgattcctgtttgcatgtatgatggttgatgggctccgccggctacctccgatgatggcatcatgccgaaagaacatcgagttagctgttagttgccggggcttatacatgttgcatggcacgtcgccggctatcactcatgatccagcctcactgctcgacttgagtttttcgtttcaatttgttatcaatatatattagattgatttctaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccaccggcctgcctccgtcgccgccgactggtgtccccgcctatacggttggttggtcacaccaccgttcatgggcgtctacgacttcaccgccggcctgcctccgtcgccgccgactggtgcttctgcctacacggctggcctattatgccactgctgttgggcgtctacgacttcaccgccggcctgcctccgtcgccgccgactggtgtttctgcctacacagctggcccattatgccaccgctgttgggcgtctacgacttcaccgccggcctgcctccgtcgccgccgactggtgtcctcgcctatacggttggttggtcacaccaccgttcatgggcgtctacgacttcaccgccggcctgcctccatcgccgccgactgatgcctccgcctacacggctggcctattatgccaccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgactggtgtcctcgcctatacggttggttggtcacaccaccgttcatgggcgtctacgacttcatcgccggcctgcctccgtcgccgcggactggtgcctccgcctacacggctggcctattatgccgccgttgttggatgtctacgtcctcaccgttggctcaccttcgttgccatcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaattctgatccgtgaaactttgttccattaatgacgaactcatgtcactcatatgcatgtttgggaagtgcctaggccgactcccggtgcttgatggtcatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaagatccagatccagatatgcataaaagggattcatggctttaagcttatctcttacgctccaggaatggatcagtcagaacatcaccgaccggcttgccttcgccgccgccgactggtgtttccgcctgcacggctggcctttatgccgccgttgttgggcgtctacgtcttcaccgactggcttgcctttgccgctgccgactggtgtttccgcctgcacggctggcctttatgccgccattgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcgtcaccgaccggccacctcgaccgccgccgactggtgtttccgcctgcacggctggcctattatgctgccgttgttgggcgtctacgtcttcaccggccggccgccgcatccgccactgactgatgtcaccgctagcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggcctattatgccgctgttgttgggcatctacatcttcatcgccggtcgtctcgtctgctgctgactagtgcccttacctctacatcttcatcttccgtcgccgactgattatgctgccgccgattggtgcttttatcttcacaactacgcgtcttcactaccggtttgcttctgttgccgccgacttgtgttcacttcattacggcaatacaactttgtcatcatggtggagcgacttcatctttattatcttcggcaccggcaaactctattgctgctacttcgcaagttttactacttcaccaaccacgacgtctttgtgaacctcgacatctcggcatgcaatgccatgatattttactacaacaagtgactctccaatattcaggatttctacttggacaccttcaacacatatcttcaatcaagcaatgactactcgacgacaagaagctataattctcgactctatgttcagttgtttctcaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagccaactctgctgccgttgatgggaaacttcgtcatcatagtcggctatctctgttgccgccaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgttctttcgttgttgttgggcgcctacatcttcactgctagctgacctgactgttgccgactggtttcttcacctccatggttatgcaacttcattacatttgattggtggcatctttactaccactgacatcttccgttacttctgatgagcaatttcgtcttcatgttggtcatttcatctccatgccgactgcgtcagttattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattacttgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatataagtcaaggtgttgtttgggtttttaagcaattgattagatacaatatcattgcttttcgccacgtaagtgtgcatttttattgaccaatattatggcttaggctgattatatattgtggtcatttttcaggcggttggtaaatcctttatgagtttatttacttggattttataccacatatgtcatatatttccgggtgtggtgaaaccatgtgtcttttagggacttaagcacatctgttaaagcagtgtgcgcatggcgtatgcccaatactttggaaatttctttattcacaatatataagcttctttatagctgttttgctatgtgaattttcaatgatgtaaccaactttaggttacactcatcatattttacaaagcagtcggtatatcactcggatcatgttattcagggattcacaccgcatatgctacatattaatatcaggtcgcttggttgactataattattaaaaccactcggttggttggattatttattccttgactatatgcttggtttgttcaattaaccacatagtcgggggctacacctattaggtgcatctagtcgatacacctgactttatttttcagccctccacagtcttcgtatttggtaaaagtacttcggagaccatggcgaagatgattgaagcactcagctttggagtaatctagttcgagagaagattatcttttcgactgtgaaggtctcaggggctactgtggagattatgggtaccccatacctacatggcatagttatccgactggctataggggataacttatatctatggaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatgatgagacaacctgatcgtcagatcaatacatactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagatatataggcagcatcgcatcctgagatcgcaagtggcaattcctctttggtgcgaaagaacaatggcatcgcattctgcaaaactgttcacagcacaaatggcagcctacctttctctctctatctatgtgctgtctggactgcaaaatatttttacaaagaaaaaatcagacaagaagagaacaaacgctgggcatcgcatgcagcagcggcctctcgtcgcgtaacacagggtccacgtaggctgtccaggaaagacgcgagatctatctccaaaatcggaataaagctaactcggattcttggcatttcaccctctcttttcttttcccttttttttcttccatggcaatatggcatcgccgcatcggccgtcaaatatcaatacgacgaaaggggaaagggctctcgaattcagctggagaagcagcaaagcattgtgctgccggatatgccgtttccggcagcaaataaatgctgccaccgccgtcgccccttcgctcatcatcacaccaacacgatctcgagcaatcacaatatgtacaatatgtaatactacttgctactactatctgaggcattctgatgaggaaaatggttgagatcgagcctgtggatgtgcattgcagggcaactactccattggcagagggatggattggatatggatatggctgatgcttccatttgatcccatccctatctgccaaaggagatttgcccagcgattcactcctacttgctcatgttttttttttctatgtgggaaccgtgtaagagaaagaatatttaggctctacattatgatttaaaggcaggggctgacccagccttggtcaaggcctaggctagcccattgcactttgggttaagattgaacttacatgatggaattttgtactacgtagtgagatttcaatccaaatcctaggcattgacccgtggcctgggtctgcccctgtccaaaagtatgcatatgcacatgaaagcatcgaggtgatctcaattatatggaatatatatgcacgtacatgcatcactgcacatgcacatacctacgagtacatccttttaacatacaactggagagatgaaagcctgttgatacatccacaatctcagttaagtatccacacatgcataattatgaacatcagaatttagaccttgtgagtgaagtcatgcaccacatctaaggtttttctccattgtaatgattttctagtctggtttctagaatgaaatgccgttataactagcggcggcaatgcgagaaaatctaaaatttatcttgcgactagttaagctaatatgattgaaatgtactcgagctacaataattacaactagcggatattttcgtgtaattttttcgtagagcaagatttcaaaaagttgagttgtattttgagatacaactcttaggtccctcaaatatttggattgcaatcaaaatctataataatataatttgattttgattttgagattattctttgttggtcatatctctttttatgattgctcatacaaataaaattacgagtaaattttataaaactacagtactttgatcgaagtattataaaagtacagatttaaggcgtcgtattataaaactacatatttaacacaaaatttatcacaaaactatagatttaatactagagtatcacaaaactacatattttacagcttaaattcctaccactactgctatgttagagtgataaatgtgtagttttgtacttaacatgatgcaaaacatgaactgttgtgataattttattactaaatttatagtttggtgatcttccaccttaaatatgtagttctttgatgaattcggtcctaaatctgtagttttgtgatacacctttttaaatctatagttttataatagtttgtcaaagtatatgtagttttttgaaatttactcaaaaataccgaataaaatgttcttaccattagaacatttaaaatcccaaaaataatccaaaactcatcaagcgggcacatttgtacgtggtagaatttgggcttttggcccattttgtggttgcatcgaagcattgggccattcttttcgctgtcgttcaaaaggccacttaccacaattgggcccatccagaaacctcttggtcgcagccaccgcctagggttgcgctctctcttttatcccagcgccgccacgccaccttccctcctccctcctcgccgccgacgaactcccggccatctccgccatggtcgcctcctccctccctccttcccgactcatcgctgttcatctcctcaacctaacacccctcttccgcgtgcgtgtggtgagttgtggtgcaggcgtcggagaagaagcagtcgaacccgatgcgggagatcaaggtgcagaagctcgtcctcaacatctccgtcggcgagagcggcgaccgcctaacccgcgcctccaaggtcaccaacccccctccccccaaaattctcccaaccctcctctcgccaacctccatttcaacccccctctctctccggtttcttgcaggtgctggagcagctcagcgggcagaccccggtgttctccaagggtaggttaagctctccgccattgccgtctctctactctagtttactcttagcttcgttgtggtgatgacgagagtttgcggggggcgctttctttgcagcgaggtacaccgtgcggtcgttcggaatcaggcgtaacgagaagatcgcgtgctacgtgacggtgagaggggagaaggcgatgcagctgctggagagcgggctcaaggtcaaggagtacgagctgctcaggaggaacttcagtgacaccggatgcttcggcttcggtatccaggagcacattgatcttggcatcaagtaaaggccccgttactctttctcggatgaaacatttcgcttttcgtatctgcctgtttatgttagtcctgtgcctagaagattttaaagcattcattgtctccattcccttttgtgacctaggatagcgcttccaatatttgcttgaaattgcctcattcaatagatttgttttggattgatgtttacaagtgatagaattttattagttgtaagttgctaaacctgaagatggtttttttaagtgttctcgggtcattgacaattcatttggtacctaggaattgttagcatactgctaatgctatagatgtttatttgattgaggcataaacattgatgcttttgtttaagtggtgttgtgatttctaaagagcattgagctcgattttgaagcagaccatggactagatcttttataatctggtccatttgaaaacttactttataaatagaccttgacaaaacttataaaataattggacctgaatctcggctccaagatcattagcaccaatattcatggtctatttagattgtgcaattacctttgcttggcctagcaagctcaagctagcccatgaaagctatggcataaaaaagcaaaagtacaatgcttggatgtttagcccgacaaattgccatcggatgctaaccgatttggctttttgtcttgggtgagcttttctcggtagttagttggccttactaagcaatactttttttttcttttgctaatactaagcaactctccttgctaggctaggctatgcttttccttgcttgggattcaaacatcctcaatatcttgtcaccaaagatcctagcattgataccatggcacaagtggcacaaaatccacattactagatggtccgcgccaataactttggttctgggctcatatgtttctaacatattaacacacccatccacataatggtacatgaatggtgtagtggtaagatgtctaaacttgccacctagttgagttcgatccttggccagtgcaatttttttagtgatgtcattaaacaattggtatattaatcaacttattatagaatatagctcattatcaactgtcatatgagctcacatatgcattaccaggaatgcgtaacacaacatggcacaatattgatgcacaaaaattgtatctaaaatattttgttggcgatgagctcatatgagattaagaatttaatgggctatcatctataataagttgacgagtgcttaaagtggttaaatgaactcttacgttcctggaaatcatgtgatcaaatcttcatgatgggtgttttttcctgtctagtcttcttttgctggtccattcaaggtgtgcatgccacttaaaaaaaggaaaacaaaaaagattcccacccaatgttcgaactaagcttgctaggaggcaagagcaggcatctcatcaccacaccacacatgtataattgttctaatggtgtgttaatattttaagaagtatataagcccaatgcctgatggaataagccttttgttgttctgttttgtttttagcatcttaggacaacatcctttcagttttgcttttagcatcttaggacagcatcctagcgatcctaggacaacattctttcagttttgcttttagcatcttaggacatcatcctttcagtgcccgtcgatcctcgtcgtagtcgacgtcgccgtaccgaactgcctcccacatgtgccgcacctggagcctcaccctcatgaccgcagctcactcgatgtagttggtcttggtgaaggcaggccaaccaccgccggggctgacttccctgatgacggcctgaatcccgtggtgtccacggtaccggtccggggagggagagacgagccgcctgcaacggccgcgatctccgtcgaccaagccgttgccgccgggagcaccgccgtcatgcgcacccctgccaaggggtccgccaatgcgtccaagcccgtctgggctaccgctgccgcgcgcgctcctgccaggaacgccgccgacgcatccacgcccggctgggctgctgctacggcgcgtgtggggttgcgcggctgcccgttgctccacccgctcacgagctgcctccctcgtcagctcatcagcagggatgtcgtaggcggagacagagctgctggagctattgtcgcgcagagccttgagctctgccgccgccgcttgcgctgcatccgccgctgcttccacttccacccttgccgccaccaattccgccgcaggcagccttgacgccctcgctgccatcgcagcagtctctgctgccgcttgctggcgttcctcggccgcggcgagctcggcctcctgccggagccgcgcgctcgaggcgaccgagcgctaagactgtcctgcgggcatggcatgctattgggggcctgcagtgtgggggaagagtttgcctctgacgagctgctgctcgtcagtgcaggggaagagggatgagcaggaatagccgatgttccagctgccggttgaggacagaggggagctcgtgaaggggatgagcaagagatgtctagactacaggatagagtggctctagtaccaagtcatactatccgggggaggttggatacatatttatagccatagcttgctagctgcgggctagtctaaaggtgaaaggaaaacataaagcataaaagggatgctgtcctaagatgctaaagagcaaaaccgaaaggatgttgtcctaagatgctaaaagtaaaactgaaaggatgctgtcctaagatgctaaaagcaaaacagaacgacaaagaccaaaaaccaacaaggctactaagagcacaaggcttattccatcaatgccaaggttcctggagctgaccatctagtgacgtggatggttcctggagctgaccatctagtgacgtggattgcttacaacgtgtgacaaggtcttggcgccatcatctttgagataatccaagaaatgctattgacaagcgtccaaatccaaaaaatgccattagcaagtgtgagttccaagaaataccatcgtacaaacgattttgtcccaaaatgccatcgccgttagggttctgtctattttgcactgttaagtacactgttcatcctatagcacttaatgtcgcggagttaagtacattgttcatcttatagcacttaatgtcgcggaatggacggaaccctaacgacgataacggcgatggcatttttggacaaagtcgtcgtatatagtgtattgaaattcttcattgaatacccataaaaaatctttagcgaagaattcccttagaccgtagcgcaaaaactgaaattaaatccaactccagaatatctttgatacgaaaggtgttaaaaagaaaacactaaagagacaagcaatcatacaccttcacttgttttgaatttaaactcttaaaagccctgaaggctatctctcataaagaagtacacatccatgggcagaagggacactaaagagattttaagggactactccaaggggctctaaagggacactactttccctaacatccacccctctatttatagtcgaagatgacggaaatcccactacgaaaatgttcaaattgccctctgggtgaaaccctagctcagatgaaatctaggccatccgttgttccttctcaaaggaaataactcggatgtcctccatgttgttgcccgctccagatcccattttccacataaaatatgcatcgaaccactcctcccgcgcaccttgctagctaggcccacctaccagtgagatgagctgaaggctgaagcttctccggcacgagcaatctacggtggggcctgctatccgcgcgtatgctccttggccaatcaccacacgtacttggtcgtcgttgatccacgtctttgccgctcgccgaatacccgttcaccacgcgtctctgggaggcgcgctccacctatgcgaccttatgcgcttgtgcggcgagtatgagacaaccgcatgtcccgtacggctttcgcctccatgccctcgctgcgtcttgcatctagccaggcctcatctgcaactatcgtcttggaccatcacctggaccagcatggttcggcctccctgccaacaaggctgctagccggacgccttaccgcctccgtcttgggtcaacaagcaagagcctaattggcttgacctcctccaagccaagtcgatcagactcatgcacaagtgcatggcattgggccacgtgcacatatgcgcaacccaatcacttgcttgcatgagtacagtacacatacgctgtccaagtgcatgtatcgtctagcattgtacattactcttcgcgaatctcagacacttgcacacttgaccttgtgaatctcgttgcgaagtactactgacacggtgttcgttcatcgggcaccgccttgtactcaaccgtgtcaactggcatcctttactcttctggacctcaactcttccatgagtttagtcccgatctgccgttgacctagagagacctccaaggatcctgacgtcagtcccaccttgtcacatggcctcttgactgcgtcggacctccgttcctccctgagcatagtcccggtcctcgccattgaccaaggttgacttcgatcacctgcacacacacgtaaacaaaacgcccgttgttcgggcatagatatcacaaccttactcgtgttagtcagcacacatttcttgcacttccgacactcgccaattttccatcacaataaatcaaaaccacaatttgtttcacaatctcccccttgatggaaacattggcaacttcaagcaaaattttgaaaatttgattttgctccacaaagcaaataatattgcaagtcaaacttggttatttgaagagattgaaaaatcaagaccaagtgacagataaggatgcaaatgcaagcaagtgcgtgcggtgattggccgaggaggcgttcgcgcgaatcacgggttcaccctggagtgcgtgcgcatgagaagcttcggctcgtttggacatctgagatatttcctttgaggagaaggaacaacggatggcctagatttcatctgagctatgggttttgccccaagggcaattttgacattatcttagggggatttcatccatcttgggctataaatagagaggtggatgttagggtgagtaggctccctttggagccctttggagtagtcccttagagtcactttgccggcccatttgcccatgggtgtgtacctctttatgagagatgtccttttgggcttttgaagtttaaattcaaaaccacaagtgaaggtgtatggttgcttgtctttgagtgttttttttgtgacaacagtgcaattaacattgttaagaatccggttcaacattcaaggaccaagcacattgagatacggtaccactttctccgaaaatatgtttagaaatgtaccattgtgttaacgccaaaatttaccaaaatttggtaagattctttagtggatttggttaaggaaagaagtcaagcagccgatgtaattttatctagaagagatcgagtttaggaaggaatcgtgaagaccatggcataacagtttaattctatctaataattaggtagtttttagtaattttccttaagttttgtctagtgtctgatcaagacttctatctttctttttatctttaggaaacttgtaacgtgtccgattaggactcgtatcagcccgagggtataaatatgtacacttggggtcattgccatttatctctggatcaatattggcgcataacaccctcttttccgaggtttttgttacctgcagaacttggcacctaacgcggggctgcatgtctttgatcttcggtgaaggggtaacccctaagttctgccggccctggtagttgtattggttatattggtgttgttcaaggctccatcgctttgacctcttggattgctctggttcggttggtatattttacctacctgatatttgaattgtatttttaattgcattgtgtttagagacgcatcaatttagttaggactatcttggttaggtctgatcttgtcttagccgacatatctctacaatcacaatgctattttaaatagatttgttatatccatcgcattagaaagttttatcgactcattgagatcagattattaaacgcaatctcgtgctgcatcggttaggtccgacctcaattgttattaataatcaaagtcttgttaagccgataggttcgtgctaatgtttcatcggggggtttatttgatgtgttaaatttctctttgatgattttactgtcttagtcaaatttaatacatgatcactttgattggtgtcatattggcttgcttaaatctatcaggtaattatcaaccttatgctacatccagttgtgttcgccctgtagggttgtggttgtaagttagatttatttaagttagtaaacatgaatcaatgtttcattggggtttcagtcgataagttatttaaatgttgcatcggcttataaggattatatacaagttggttttagccaattgcagcaaggttttattgattgcctaatcttttggatttaaattctaatgacatcagattcccagccgatgtatgctttaaccatcagattaatatttattctatcatatcattgttggctaattggtttattggatatttatttcattatattatcatcagtcgattgtctttatatcattatttatctaagtgtcagaatctatatcggacatatagccgatgtgttcaaaatcctatcaacatcgtctggtatcgccatatcgccttattggtcgatcgactatgtgatcatcaatttatctatcctgtcagtcgcaatatcaaactgactggcacgcccgcattcgaatccaaatttttggacctgcactgaagctaagcagatctcccggcagctaagcagatctcccggcattgtgtttgtcgacatagttcgcatcaacacagatttggcaccattagctgggcgtggatttttcgtcaacacattgtgctagagtttgttaaatccgagaaacgacatgctgatatttttacaaaacctctctattgagcatgatgtgagttcttgcaaagtgagttaggggtgatccacccctgtggattgcgttgagagggagttcttttcttttgcatgcatttgtaacatttgcatcatgtttactttcttgcattgtattatacatcttttcattaaagagctttgttaacaatttactggacatctttttgatactcatctcttacttttatgcaagctagatcttttgtctaggttacacgtgcttaagtagcttgtatgttcatgctatgctcttcatgcgcattgatacttgcttaaattgaatctacacttgaacttaattaatgtgcacaacttgctctagaagtttgcttttgatgcaatatccttctcatagatatgccatgtttttatcatcttagcaatagctttcggcacatccttttgaatgctcacgcttgattgttcatgggtgcatcaattatgttctttctatgctttatgtgttttaccactgcttttgtcccaggctactgagtgtgtttacgcataagtagtgctgaagatagcactgagactacctgtaacaggagctctaactggaaaacttgtttgagatttgatgacactgtttggcgccctcatcactcgctgactgataagattaggcgtaccatcgcgattgtgctatagttttcttcaaaaatccgaaaaggaataaaatgcaaatgtgatagagctaaaagcccatgttctatgttttattaccatcttgatactctcttgaactgggcattagcatggtatcatgggttcatttttgtttttgataatgttaatcttgcatatttatgcgttggattgcttactctt

SEQ ID NO: 80689 - DNA, 43406 bp, Oryza sativa
  unsure (1)..(43406): unsure at all n locations
ctatagggcgaattcgagctcggtaccctggatgcggcaacaagatagccgagaaatggaccaaaagctggagcacacacgcgcacacagtagccactatcatcggataaaaaagagtgtctttgctaagttgctaggccacagggatgaatcagattcccacgatgtgttatccatctccctgatcatgactggacacttacaacctgatccacatgtgtgtatgcaccgcactgtgcaccaggtacccttgggattttgcttcagcttaatttcggtttgtagtctaacctctatgaagcaattggccaagctcttgtgattgatgtcttatctaccccaagcactgccttaatcattcattttgtcgaataatggttcccgtattaaaaacgtgcatatagtttggacttaatcgttaagctattcgttcctctcttttttgggttagtggaatgtgatctttgtgtcttatactttggtgccaagtatatatatattgctagttcacctggaagtttgcactttgcactttgaggacgtgctgtaaaatccctctcctgttttttgttgggaaaaatataaaagccactccaaatattatcttaggtttgagattccctcctataagacaatttgttgcaaatatctccttcctaattcccttggtttgagattctcccaattaaaccttgttgggcagtgtgatgagtctccatgcttgaacatcatggttatcggaagatgggctgttgcgcttgcctcatgaggaagggcgactggtttctcagcaaagacgacgaaaataagttttggtgtgaagctgttttgttgagaaagatgtgctaaggcctggtttaattccctaatttttttttctaaaaacatcacatcgaatctttagacatgtatggagcattaaatatagattaaaaaaactaattgcacggttagagagggaattgcgatacgaattttttgagcctaattagtccatgattagctataggtgttacaataacctacatgtgctaatgacggattaattaggctcaaaggatttgtctcgcggtttccaggcgagttatgaaaaaaaattttcatttgtgtctaaaaatcccttctgacatccgggcaaacattcgatgtgacaccaaaaattttcttttcacgaattaaacggggccaagttatataacacatacagaaagaaggaaaaagaaagtgaacctagggaggaatctcaaactaaggtatagtttttcaaaaaaaaaagaaaagaaaaaagtttgcatcgtgggttttgacttctggcaacatctttgcattggatgaaatttctcgttcattcgttgaatatctgtaaaatatttgcagcatcaaccagaaggagaagttcatggtttccccactaacaaaagagcagatgtgttggtcaacctgaaccccacgagttgacccaaagtatttccatgctcaacccaacccaacatgcaccaggatttcctctcccatcttcgcatgcgcaatctgcaattctccccctccttttttttcccatcaagatattgttcttgatttgttagttccagttttgtcttgcagccatcatgaggcttatcttcaaccatcatgtttttacataggatgcacaaaaaaggctagagcttcctggaggctccatcctctcttttgtaccctttgttgctgactttttggccctctaacctgcactactactgataccagttgcaaagctcttgcctccagtttacattgggccacgtgtgccaatgccttgtcactcctagtcagcacacttctcccactaaccagagaagtccaagcacaaaagttaaagcctctcaaatcgcgcgttccgtgcactatgcaacctcctaatccatctaaattatgcacaggcatcttcagtcataagcccgtaaccaattttgaattttagtatgagggaaaagttcttttcattattatttttgccactcaactttggttctagaagttagaacaacatggagtataaagtttatcataaaatccagttttaccaccaaactattttccactacgtcgattaggatccccagcagtcatcatcttcaatctctcttgggggtgatgaatgttgtgaaatcccatgaattccattcaaaactcaacaagggaacggccgcaatgaaattcaaacagttttctgaatgcagcaaagccgcagcctcaaaaaaaaaaaacgccttgccatgcataaataaagtccaatggacacttaatatctgcacaggagatcagaggctcacgtcacccgatctgtcatgaggagccagagtcctttggtcctcagagcaagtttaatagtataccctattactagctctatagccaatctaataactaattcatacaatatttgcttactatactattaatatatggtcctacctgtcatacacatattgcgtcttagagttcatgctgctattctctttaatcttttactccctctgttttttaattgatgatgtcgctgactttttctcacatgtttgaccattcgtcttatttaaaaattttatgcaaatatataagatacaaatcacatttaaagtactatgagtgataaaacaactcataacaaaataaattataattacgtaaattttttaaataagacgatggtcaaacatataagaaaaagtcaatggtatcatctattaaaaaacaaaacggggtagtatttcattaagggggtgtttagatggggctaaaactttttagtccgtgtcacatcgaatgtttgacgctaatttggagtattaaacatagactaataaaaaaactaattttataaatgaaagctaatctgcgagacgaattttttaatcctaattaatctataattatgaaaagtttactgtagcatcacattgtcaaatcatggtgtaattagactcaaaagattcgtctcgcgaattagcccaaggttatagaatatgttttataattagtgtatgtttaatactctaaatttgtgtataaacatccgatatgataagtcctgtttcccaaacagaccctaaaatatacatgctctcaccggcgagaacacccgtcacccgtgccgtcgtccaattattgggcccgtgtcccgtcagaaatcccgcacgccacgccagagagaaccccaagccgcacccgcgcgtcgacacggcgacgcgtcgcagagccagtggaacagaggcacgacacgaggttccaagcccgtgtcctgtagcgtatgcatcctccgcgacgcggggagacaacgatcggtgcagcgccagcgcgagcgctaccgtttcgcgccggtggtggtggtactacgtacgttgggacgtacggcgcgtctcgtactcatcgtgaaaaaaaatggcagggaaacgatggcattttccgcccacggcgttgcgttttttcttcgtgttgtgttgacggggggtgaggctgtaataatgctggtaatgttgacggtttaggggcgtacgtgtgcagcgctgcagccagtcgtgagggcctgaggggcgctacccgagcattgtctggtgtgttacttactgattgggcaggtctgggccccggtgtttagtagggcttgggctcggatggtaagctttagtttgggtagaaaaatagggtcactcactctgacttattactatcttctagaagtgcagattatcatcggagtataaatgcaatttctatactaacgtaaaaagtagtagtggtggtggtggcgctaccaccatcctactaccatatggaacccataaaatatgatataaaactttactggtttcttagccttcatatgttagacctggtcgaaaataaaatatgacaataaaaatttatagaatttttcatctttatgaaatgatggcaaaattatcacaatgataatatattagagaaaaaaaccattgcaatgcatgggcattatactagtgatttaaagagttaaaaagtggcgatttcaagagttcgataatttcatattagaaaagtttcgtctatggctacataggagagggttaaccagatctactacctccattcgactttaaatataagcatttctgattatacaagctttttgtaccattttttacattgaacttagtctgggtacttatccaaacatttttgttgaatgaaatcaacatgagattgtgctatttttaatatagtagaagagaaatacaacccctgagagtaagttatgcagaatttagtataagctcccgaagccgatttgctccaaccgaagccatcttcttgctttctcctttattttcaccagtaggctaggtgctcgaaaactcgctggtttctctctttccagatcccaaacaaccaagagaatcagggcacgcaggtctttcttgggcacttcttttttgttggccagcatctcacaccaggctcgaacgttacaactgttgatatgccacccaggatgctattaggcttcgaatccttctattatatctatattggacgagtatgtggcatgctgactttattaaaacagattcacccatataaatatataattaagctagtgaggaaaggtgaacaatattattcttatctgctcccacttgtttagcctacaaactcttcctttggagcatgtttcgaactcaagacatctttttcgaaatgagaaaaatatggattgctaaagaggaacttagcaacccggccgtgcacgagagggttcgaatcgaacacaggccagtccaaagctcctgtagctctcataccactgtagtacgacaccgtcttcaacagcgtgggtctcatgcatgaacgtaaacagctgatcagaagggttttccagatggtgatgttgctgttttattgcacgctctatcacgcaagcttggacttaaaggtttacgagaagaatcgaaacaactgacggatgcagagacacgcacacgtacaaagggctgatagcctgatattgtctgcgatttgtggactgcgtttcatcaggatcacattctcagtgtcagctatccctggatggactgctgcatgagcgcttagacctaacgcattggcacaaaggcccagtgagggagagagcggctcgcgcacatctcctaacgtggacaaagaatatcaccaataaaatgagagagagagagaaataaaaatataccaatatgcggcttaagaaaattttgtggtgataaggatgtccctaatgccgacacctcaacaaccacagcaacaaaaaaagcaggcttagcattcttaactagagctctccaatcaacagcttaccagtgtactcttggccaccttctcttttttctttccccttttcatttggtcagctgtgaactgtatctgaacatatcttggtatgaggatcaaagggcaatttatatatcctcttctatcatcatgcatgcataatatgaatttcctaattagtagaacatgttgataattttaccaaaacggcttagcaattttatattgttatatgataaattttacggtcatcgaaagttataagaaggaatcatattttttgaagtacaaaatttggtgtatctagcctcggttcatctcaagatatgtaagatcactcacatatgtagagtatttatatacattaaagaaagtaaaacggaaaggggaacaagtttatgtcttgcagaaaagggagtgtgtgctagtaataagatggttcttgacaaaggtaccggcaatgcttattcgaagtactttcgtactatatgatggataaagtagaagtagtgagctttagtgctctacgacttttatgaggattgaagcaaattgggtctttgcatcagtagttggtaacatcagctaagaaagaatcaaatcacagatgactcggatgaaaataactatcttatccttgggccatccacctattgttttctttcattattgttgtacctcccagccgtagttgtctttgatgagatggatgtgatggattttttctagtaatactggagtcctaaattattctaacttggttttacattaagctaataagcttaatgctatcagacgatcatcttccagatattgattggccggatatatcctgaatacagagtctggattgatttctattatcagaaaaaaaaaatctgccagtttttttatttctagtaggtgtcagagcagaaagagatgttttgaaggttttagaaaacaaatatttctctttaaagaaaaacagcttgtcttgaaagaaaaagaaaaacaactttctgctcaagccaacgctacttgacagccgacatataggttccatctttaaaatggttcacaataggattattcggtggtgtccagttgctttcagcagaattttccttcagataacacaaggctggtggtgtagggtcgccacattcacctgttatttaactcattagcctcttaatttttgtggtggataaaatcctattttaaagtataacataatgtgctagtctggtattgtttgtagtgaaaatgttgtgtgaacataattgccatgtcccccacaaatcatatgattacaaaagatccctgaaatgtcaaacagtcagtgcactgcataaagttaatctaattaatccaaatcacagtctgtcctagtgtccttcaactaaattaaggttaattataactctagatatgttttcatttacttgtcattcttaacccatgttaatatttttagaagaaattttcatattttgttgaacacacatactttgttaatatgctgtattttcaaatattttatgaatcgcattgctcaaataaaattgtccaaaaagttgaatgcgaatagtgtctgctgacaagtatttaaaaaggagcatttcaacaacgatcttgctaaagccttgaaattaagtgtgacacaagtactataacatcaaccaaccatgtaagaagcacggtttacaaattaaactgtacggttgttgtcgtggttatcacgtgcggtgatcttctcagtttttgaaatatacctcgcgattaccgcggtaactgtcaaaccatggggtgacggtacccacgtcctacatggtttggtaaatcctgaccaaatttaagagtaatgttctttaaaaaaaaaaggctgcaatgccacccccaaccccaaggaatccaaattacaagtcccaagatgcctgcatctctcttcagagttcagacagacaagccgatctctgatctatccacgagaaaacgaagcagggaatgcaggattgatccatccatccattcatccatggatatatagctttcagtacacatgtgtagagataagaaggcttgtagggcccgggagggatacgacatatgtggagcacgagccagcgttgtgcattgccctcgcccccgggatctttctcctttacctcccgatcgattcggtcggcaagccgtgtggctgaaggtgtaaatcagtcaaaagcttttggcatatggtgtgtgtgtgtgtatatgttctttgcaaatattgggtaaaaattcctgtgcccacgggcttactctaacctcaccggaaaagaagaagaagaaaacaaatagacgacgacaacaatagacataccataacccatgatatgggtttggaagtacaaaatttggacaatgcgattgcaagatccaaacaggaacttcaatcaaattgatctaaacaaaacgaaatcgtgatgacgatatcgtagttttgtttgctagcactgacgattgacgaacaatttgcctattggttcttaagattaaacaaaaaaaaaagggggccacctagttggggtttggaaggtagcactagctgggcaaagcttggagagcatcagcacgcgaagctacacgccaatacatgatgatcgatcagaggacttcgttggatcacagaaacaaatatttttggcttatctttggatgaagctgtgtgaaggtgcgacccagcaacaaatgctgttgcaattgagctcgcataagctcccattgatcgacggcgacgtgccaatggtttcacgtgggttatgaccaggacaagctcgtgggttcttatccgtagtcgtcgcgacacactgcctttttttttctcggtgttcaatggagtaatggaccatgagctatagcttctttgtcttcaacatattatacacctttcgtgggctccttggaatagatgagctcacgcgaaaattctacaaaattcatgtgttcattttgaatctaattagataattatttaatggatgaatctcaatatagaaccaataatatgagaaaaaccaagtgaagctctcttcaagatgtttagcgagatctttaattcattagtatcagaaatgaaccgcataacagtgttcgtgcggtagtttgtgtgtatgatgcatcttccatgtaattgaaaaataaatgaaaatttgtggactcaaagaatcaactgaattattcaccaatcgagataggatctttcaggattgggtgtctggtccatggaacttttcacccaatgaacttgcaactagttcaagtctcatccaatgaacagcaagtctggccgagcgtgagcggtccaagaaagcagctggtttaggtaaaccgttctctttccattttatgtggctttgacaagcatagcgcaccaggtgatatttttttaaataaaaccctataggaaaatcaccttatttactagtgaatttggttacatactaagccagataaaaaccataagaatcggtagcatctttttaaaaatgatgctcgattggtcgagaaatgatcatattatcaatttttatatgtagctaaagatagttcgattggaaatggtaccagcttcatctctcaaaaaccactcatcatgcttggaagaatagtcttggatcgtagtgtaccaactcagattcagattccagagaacatgaaaaacttggtaaagaatcctgtatgattgtaccagacggtacggtatgaggtgagtacatgctaaacagctacgcgtagtaggagtactagtcatttgtgtgcctaaattatgctattccctccatttcatatcataaattattttatggttatattctctccgtcccattttaaacgcaaccataagtttctttgtgcaactttaatcgtctgtattatttaattttttaaaaaaaataaaaaacataagtcacgtataaagtactattcatattttagcatctaataacaataaaaatattaattaaaaaaatttaaataaaatggacgatcaaagttgaacccagaaacttatgggtacgcttaaaatgggatggagggagtactaaatcaaatcttcttaagtttaaaaaagcaacatttttaacttggaataaacttgtaaatatactataaaaacatatcgaacgatgaatttaatgaaactactaaatgttttcatctgtttttgattaagatatagattttacctcaattttcgttagcacgcttttcaaactattaatcgttgaatttcgtccgaaaactttcgatataaaagttgctttaaaataccagatgaatctattttcaagttttaaataataaaaattaaattaattatacgctaatggttttcttgttttacatccgtgtacttaagttttatctacatcactaccaaaacattaccttaaacttgttataaatgttgctatatttttctataaatttggtcaaacttgataaggtttgacctatgataaacttaaattaacttataatataaaacggagggagtcccaaaccactactcactaaagtataactactttcaacagtataaattctatctaaaatataactacttctctacctactccatatcttaactaatcatacatttaactttcttcacttaattctaatctctcatcatttactctacaagctgatcagccataaaaaataaatgaagcaattaaaattgatctatggataaaacttgtatatctttgttcttagtgcttttaaaagtcgatcctgaaaattaaactacgatgcaaacaatctcaaaatcaattctaaaattaaattttaaattttagctattattaataaaccaacaagcaaaacaatttgtttacttattttctccacttatttatttttttaaaaaatatataaccattcctcattcgatttcacaattatccatggtctccgtgaaaaattctaaagtgattacatgttgggaaggaagtaaagaattgatctacgaatcatattttttttagataatagaatgaaatagcatcccggtctttactcaaaagagctacagccaattattacaaaatagcactctgtaagagtaaaatccaaatagaagcaaacacaccaaccaaactagacaaaataacattattctagtctattggtaaatctccattcatgattggcaaacagttgtataatcttcgtttcaagcttacgacatgcaacaattaagaaatctgtattttcatcacacttttgtaactgtgacaacagatgaagccaatatgttgccttgaaaatgacctgcatataagtaacagtaagtgatttatcaaaaaccctatcatttctactcagccacagagcccaacacaaggcagaagctccaacaagtatcagtttgctctttttgtttatgactccctgaagccaatcatcaaaaatatgagatatgctagtaggaatatataaaccaaaagaaaactaaactgctctccaaataaactttgcaaaatgacaatcaatgaacaaatgttggatagactcatttttcgtacaaaagcaacatcttaaattaccattccaattccgtcttgctaaattatccttggttaacacaactcccttaagcaaataccacataaagatcttgatcttaagcggcatcttgagtttccaaattaacttatttctgtcaatgtaaccattattaattaaagctaagtacattgatctaactgagaattggtcattctgatgatagttccatctaaaacaatcagaagtattattcaattgaatatgaacaatagatgcacacaattcatgccaaagtgttaaattctgaccaactaaagctctcctaaaagaaacattgagcggaacagaagccatcacactagcaacagaagaacttctccttctgacaatagcatataaagatggatacttttctctaaaggccatatttcctagccatctatcttcccaaaatcttatttgttccccattattcacaatccaagaacccatagttaagaaagtgtttttgacattcatgagtcctgaccaaaaatgggagtcaccttgtttcctgtcaacttgggttatagacttattataaagatactttctcttcaataggtcttgccaaacaccattttcatttattaacttgaacaaccatttactcaaaagacatctattttgaatatctaaattatgaacccccaaactcccctgttctttgggttggcaaataatatcccatctagtaagtctataatttttcttatggtcatctccttgccaaaagaaacgaaatatataataatcaatcttttgaagaacccctttcggaatctcaaagaaagatatcataaacatagctaaacttgaaaggacagaattaatcaaaaccagtctacccccaacagacatatgttttcctttccggctgctaaattttttctctattctttgttcgataactttccaatcattattacaaagctttctaaaatgaattggaataccgagatatttaactggaaaagatcttaacttacaaccaaagatattagaatattgctcataacactccttttcctgaccaaagcaaaataactcacttttgtgaaaattaattttcaagccagataatttctcaaagatagacataatcaattttaaattctttgcttgttgtaaatcatactccagaaaaatgatggtatcatctgcatattgcaaaatagacaaaccatcatccactaggtgaggaaccaccccatgaagagatccattatctttagctcttttaattagtaaagctagcatatcagcaactaaattaaagagaattggagatagaggatccccttgtctaagacctttatgcgtttgaaaattattaccagtttgatcattaactttaataccaacatgaccaccttgaataaaagaggcaatccactcacaccatttagtagagaagcctttcatcctcaaagtctgttgtacaaatgaccatttaaccttatcataagctttctcaaaatcaatcttaaaaattacagcacttttgtttttacgatgtaactcatgcaaagtttcatgcaaaataaccacaccttccataatatttctcccaggaatgaaagcagtttgagtaggactaattgccttttgggcaaccgtcatgactctatttgtggcaactttggtaaagatcttaaaactaacattaagtaagcaaataggcctatattgctggattttcatggcctcaacatacttaggtaaaagaatgatcgtaccaaaattaagagagtataaaggcaaagtatcattatgaaattctttaaaaagatctaataagtcacattttatgacattccagaaaacttgataaaattcagcaggaaatccatcaggacccggtgctttgttatgttccatttggaagatcgcctcattaatctgtttttcagtaaaaacatgcgttaaagcctcattctccaactgagaaacttgaggaatgtcagcaaatttattctcatcaaactgaagagtagaatcattaggaggcccaaataaacctttataataagtggtaatatgcgatttcaaattcgcatcaccatttattaattggtcaccatcatgtaattgaaaaattctagtcttcctatgttttccatttgcaaccaaatgaaaatattttgtgttagaatcaccctctaaaatatccttagatttcaccctctgataccatttaacttcctcttctctcagaattgtagataatctatttctacaaaaccatctaaaatccaactcctcctgactcaaaagcatagtttctgcctttttatctagcaaatccaacttatctaaaatctccttttttttcttttttgtacaagccactagtatgtttagaccaacccctaagatgctgtcttaaacgacgaattttcgcctgccaccgctccatggcagaattgcgttcatcaacactagaccatatctcctttaccatatcaacaaagccatcacgtaaaagccaaccaaattcaaacttgaaactatgttgagcattactcaaagaagaagtgtttgtatttaaaagtaaaggagtatgatcagaaatatctctattaagagccaccacagaagataaaggaaatttatgttcccactccgtgaacattaaaaccctatcaagtttctcatatgttggattcactaaattgtttgcccaagtaaatttcctaccagacatctgtaactcccggagacataacccatcaataatagcattaaaaaggaatggccatctatcatcataattatcattattcttttcatcagggctacgtacgtagaatattaaaatcaccaccaataagaattggtaaggtttcatgactgcacatattaactaattcagcaaggaattgatccttaaattcactttgtactggcccatacaccagaactaaagcccacttaaacttatcaactttattacataaatgaaacttaatgtagaaatctccctcatcaatcaaaccaatatcaacattaattaaattgatgcccaaaagcaaaccaccggacctacctctatgaggcttgcaatgccacaaaaattatttgccagcacacagatttttaagaacagccggactaaaatctttcttaatagtctctgacaaagcaataaaatcaaggtgatgttcctttgttaaatcagaaataaacttatgttttttcgggaccttaaacccatcacaattccagaacaaccctttcatttaaaaatattctttttttttctttccccttttagtctttttcttactattaggagaggtatctaaagaatataaagtggtctaagaataattatcatccacaccactaaaatccatcacctcctccattaattcaccacacaaatgttgaagtagagaattatcatccacctgatcatccaatatctcgctatcaacatttgaagtatgtacctgattaacagaagaactaacatattcacttaacatcttttcctctatactctttaaatcatttataacatcatctaatatgtctacaacgtttgctgcaaaaattcccttaacgctgataatcaaacgctacattacagacactaacagcgacgttcttagcttgtcaaaactctcaactacgagtaatattaattgcagtggcatctctggttgggattgtgaagtcaaaaaaaaataaaacaaaacgataagagaaaaaaaaacttctcctgagaaaaaaaaatccagagaattataggtgcctcactgcctctcctttttatctgctgtggattggataattggacatggagacaaaacccaaacacccccctaaataactgaagcaatcacacaccttctctgcaaaaatcccaatctaccaccgcacccaacgaagcttaagacagtggaataaagcagagagagaaatcaaagcaagaaagagagagaagaagcgaggcaagagtcaagaccatctcccatggccagtggtgatagtagtagtagtagtagtatataaaaggggagcgcgccacggcttgccaatccgccgcgctggtgtgatgctgcgatcgacgcatccgccgcccagtagcccgagcagcagcagcagcggcggcggcgggggcggggggtcgtcggcgtcgtcgagctcggagaagacgatggtgggcggcgggggaggagggggaggagggagcgggtcggcggcgccgagcggggcgaagctgctgcagatcctgaacgtgcgggtggtggggagcggcgagcgggtggtggtgctgtcgcatggcttcgggacggaccagtcggcgtggagccgcgtgctgccgtacctcacccgcgaccaccgcgtcgtgctctacgacctcgtctgcgccggcagcgtcaacccggaccacttcgacttccgccgctacgacaacctcgacgcctacgtcgacgacctgctcgccatcctcgacgcgctccgcatcccgcgctgcgccttcgtcggccactccgtctccgccatgatcggcatcctcgcctccatccgacgacctgacctcttcgccaagcttgtcctcatcggcgcctctccccggtacgctcgcttccactgatgtgaatcctttctcgctcttaaaattgaatctgatcgggggcgatcggggagcacggacatgtgtgtgcaggttcttgaacgacagcgactaccacggcgggttcgagctggaggagatacagcaggtgttcgacgcgatgggggcgaactactcggcgtgggcgacggggtacgcgcctctggcggtgggcgccgacgtgccggcggcggtgcaggagttcagccgcaccctcttcaacatgcgcccggacatctccctccacgtctgccagaccgtcttcaagaccgacctccgcggcgtgctcggcatggtccgcgccccctgcgtcgtcgtccagaccacccgcgacgtctccgtcccggcctccgtcgccgcctacctcaaggcccacctcggcggccgcaccaccgtcgagttcctccagaccgagggtcacctcccccacctcagcgcccccagcctcctcgcccaggtgctccgccgcgctctcgcccggtactaatccaacgccccccgcacgccaccgcggcgcgccgcgcgtgcgcgtagccgcagcgacgagtcaaaacgaaggagaaaaaaaaaaaccaccgcagctgcggctacggtacgtgtggcccagtagggggacacgcatccctctactgtttttttttttttaccgcgtcggattttactgcatttttaccctcctcttctcaggcctagaaaatatttcggcgcgacctgccaagaccgagagtgtactgtagcattagtgctcgatttttacctaccttactctattggaaaaaaaattacattactggagtgcttcgtgcatacaattatttttctttgtattttttcactcgccgattggtgatggtctgattgatggacgacgccgtgggccttctcacggcgagtgttcgcgacggcgcacacgggttcgtttgtttgtttcttcttcctccttgtcccggcttgacgtcttgtcgtttcatttgtcaatatctagccgcagtaattttttcttcgtagtactaatatgttcaattaatttaaatcgtatcattatttgttattaacaaatatataacgatatttactttgttatatagagaatttagcaacatcatatttaatttatcctatcaaaacttaataatgttgtcaatttatcaaatttttgataatataaatttttgaaaatgtttatttaggcagtaatttctactgctgctgtagaaattacccttcattttttgtacggttaaaacgtctcaaggaatcgtcggttgtgggagcggtagcagctaagcgatggcaaatcattgtcaacgacatgcatggcccatcttatcgccatttatatcgccgataaggaggttgaccctgccatctaaccgcagcctacggccccccagagaaatcacaagtcgccacgtgtaccaacctgattagtcaccagtagctttgtctgccccagttggccactactctctcggtcttaaaaaaatccaatctaatataaggacggacataatctagcacaacaaatctagatagtcttttgccaagatctagatagtcttttgccaagattcgttatgttaggttacgttacatctcaatcctagcacaacaaatctagatagtcttctgccaagattcgttatgttaggttacgttacatctcaatcctatgttagttttttttggtacggtccatacggaggaagtatgttcttgctgagagattcctatgctctaaccttacctacacctgccatctcaaaaatttggtagcctttcacacggataaaacgagatggataaaaagattgctctataaaataagagcgggtacaataatgaacggtattagtttcacgtaggattttgtgatgaattggaggagaggggggaagagagagcgcccacgactaatttgtcgccgcacgcgctgcttaaagaagttgtggggctcgcctgtagatgaagaagcattcctacatcagccatggtttgcgttggtgctgctcctcgatactccatggctaacgcccttgtccatcgtgtccattggactgtcaccctcggcttggccggcgccgactcccgcatctaccctagccgccatcgtctctcgcgttcaccagacaactgagctcgtctagcccagctgtcaccgtctttgcgtccgccgcacatgcaccgttaccttccgcctccaccacacagccgcctttgtcttgcacgacaaccactgtctcttgcgtccgccagaccgccgtagtcacctgcatccgccagatcaccgtcatcgtccatcctcgctgactgctcaagcccaaaatcgttgacgaatcgaaggtaagaaaaggagaaagagaataatacaggaaatgatgaggtatgaggaagaaaaaagatggtggatcccataaaacaataaaatatttatgttataatattcatattataggtattagttactatgcttactatagatgacacggtcagctaataacatgctatcttaaccttgctctaagtgaggaatatagatcgagacttgttgggactataattaagttaagtggtaattttttttatcttataagtaattggttgatatatttagaagaatctgctatatttttgaacggtctccgttaacgatgtaagtacctttaaaatttgtacacgaaatttataaagtattctatctcctttcaaccacctatcactaaattctcgtcgaaccacaggcttcagcctttcatcttgtctaatcagaagatggcaaccgcacttgaataagaggcatcaaaagtcttttattttccttcttaataatgtcataacaatcttagaaatgctctacacacgtggatggactatggagggagtagcattactatctgaatttgattgtcgtgtttttttttctttcagacgatgtgggcaatcttgacactgttttaggatgctctacggtgcgcgtctgtgtgtgagagtggttgtgtgggctgtgggtgggggccttgatggggagccaacgtgatgatctgcgtgatgcctagcttttgatacggtagttgtggtgttgttagctggccaaaccaaagcctttaagcttgtggacaataatcaatgctgatggataaataacagttgatcatggagtattagcatttggcctatctagtagtccgcatattcttatccacaagtgataagtatggattatgtctgcaatcagcgtcttgctagttgctactatgaacgaaccaagccaaactaatccaatcgagttcgtgctccgtaatacagtttcagccaattgtcacgtaacgccaacttttgtgagccccatcgaagccacatcaatcagtcacacacacatgtacacacgagctgtgagcacaccctggttatccatgtagtatgatccatggatcatcttgctggatgtgttgcggcagagaaaccagcacagtgataagcagtgttacaactttttttttttttgcggggaagcagtgttacaacttgcaagcctgttgctacagtgcactttcattatttcatatttgttggattgaaatcaagcctagctcagctgggtagtttcgttgactcgttgtggacttgtaacctgaccaccggtatgatttagcgatgtgtaaatgcatggacaaggggggtggcaaagaaacgaagaggataggtgaaaaaggaaaggagagggattgggaaagacgacacatggccattttggatgagaccaagttgcaatttggtgcatacactttcgtctaaaaaatcaacttctaatcttctacagacgtatatggacaaatatttgttcagatatatctttgtgatgatatgaaacaaagaagaaagtacaaggtaatttttttcatctcaatatatagtaacttagaaccggatgaaactataaatatgaataaatcataattaggagtagatatcaagccagctcgcctcgatctagctcgttaggataacttatccaaacgagttaaaaggttgactcggttgccggctcaagccagctcgtttagcttgtgagaccgaacaagatatcgaaattaggatggagcaagatacaactttttttttgaacgactcgcacgagacggtgcgaagttctattgatagaataggaaaaaaaatacaggattaaaaccttggtagatcgtaaccaagaaaaaaggggaaaaataccatcacccacacaccgacagcgccaacacacaggtccaggagaaggctgacaccggaccggtcgccactacgccaacaacgaatcatagacgagatcgccaaaaaaacacccttacaaccaacacaaagcccaactctatccacgtcttccagatttagggagagagggtgagagagaagaacatctgtccccgcccctaggctctccgacgtggcaaatttgtagaaactaggacgccgccacaagaggatgagaatctagagcgtgcatgcaccaattgttcgagtggttcggcaaggggatgcctaaacgacgtctccaaggagagaagcgacgaaaagccgctgacgtcgtccgtcagggtctcaaaagagccaagactgggctttcacccggcaaccacccttaagggatgagacagcacgacaacgctctcaggagagggaatgacaccatcgttgtcagtctggccaaggccgggttaggttttcagccgccgctcaccacctgctccaccaccgaccgatgctccaccatcacccaactctgccgacatgtcggaccacttcaccggcgccccccccccccccccccgccggccagccttcgtacgccgaataccgcgccacacctaccggcagctcctcgcaccatggtcacctcctcctccgtgagcaggccttatcacgctgcgccgacctcctccaccaccggacgcgccttatcgcgccaatccggcctcccaccaccgttcgtgtccctcacgccaagccggcatccaccatagtcgggcatgcttctcgcgccatgccggtctccactgccatcagccgtacctctctgtgccgaggaccagcctccgacccctcctccaatcgctgtcacgctggccagatgcggccgtctgccacgcccccgactagccattcgagaccgtcgtgcctccttccatcgcaaccacggtcgccaccgccgtgcctcctcccactgcagccacggtcgccacagcagccgatgctgccgtcggccagccacctgctgttgccgctgttgccaccgtcgccacaagctccgcgccactgtcgccgctgcgacggcctctcccgccacgagttcaccccgttgacgctgacgctgtcgccacgagctccgcagcaccgccaccgccgcaagctcgccccacaccagatctgccctcaggagggccggatccgtccagggcggctccctaggttacccaagcgtggtcccgccggcgagaagcgatccccgccgccgccatccttgcagccgctgacaaaagccggcggccgctcaggcggcggcgaggcggaggagagaggtgggggagagggggtggccggagctcgcctccctagccatccccggggagggcgacaggagaggtggggttgacgttccttgattaattccaagatacatcaaattcataatactatgccatcatatatggggagagtgggagtaaggttctctgctctctagcctgctctctagagcgggccccctctccgttggggtatcgaaggaatcccgatccctgtacgcgataagatggggccatgccatgaaccgggtcggcgtcgtgcgtgccgcgtacgtacacatcgccttggttgtgcctagttgccctatagccgcagcttatcctccccgtcgtagaggcgacaaccgacggcgagccatctctcgagtccgaggcccttccgcttttgtcgtgcccggcgcgacgttccgtgccacattcatcggccgcacgtcgcgctacagcgggcggcgctgtgtgcctgtgttggctcgcggccaaaaagcccaagagaggggaggctgggagaggccccccatctccatgtcgagtcgccacatgcagtgaccagtgatacagtcatatgtacagtagggcactatgcaagtatgcaggtaatgtgttggaggcacacgcgcacgggcggcggagccggcgggaaacactgcaaggtgcatgagattgatgtgagagacggcattttgatccattgttcgtgaatgtggataatttttaccgtaattttgacaatttgacccttttaaaaaacttattttgaaattgaatcatcccaaaaactaatttcaaaattaggccgttttctcagcgccatatagattagcgccgagatgtcatccgaagtgtcacggattttacacgtcatccgaggtcatcgccaaatactctttgttcaatttacaaatattagttatctacaagcttccattgcacacacaaagacaagaaagcttggtgaactctaggtgctaaatactgcgaggtaatgggttcgatcctcagccaagcaagtataagcatcttttgctgttctatttaaaaatctcacatgcttttcaaattcattttatttttaaatatggatgttttttaatttattttatttttaaatatggaaggagcaaaattatgtatgtggtatttatagcttaatagttggtataaaattacatctttcattttttttcaccctctattttgctacataattatgtatgcagtattgatcctaaaaggaaaaaaaagaaaaataagaagttacggggttcgaacccttgacctcttgttatgagaggcagcccttcaccaccaggatagaccttccataaggctagaatgtacatgcatactatttatacaactataccatggaggttagcaccaaattctttagcgctgacatcgcatcgcatgacgtgtgatttacgtgacacgttggatcgcatctcaacgccaaagaaagtggcgctaatacgttgtagctcagcgccaagtacgatggcgcgagaaaatggtctatttttaaaattagtttttgacacggctcaatatcaaaataagttttttcaaagggtcaatttatcaaaattacggaaatttttactaggcgtatatactagtgtgctataagatgtaaatcatgtaatgtactgtagctgccagtacaagcgctttttgaacactagcactgaaactccaaagtgattagctagctagtaaagcgactaaagcgatgtcagtaagatcatttcttttctgattaaaacgtagtaagggttgattgtgtccgattgtacatcgaattcgacggtctgaaggctgaagcgatgcggaaaggctaatccgcgcgctgccggcgcacacgctggcccacaagaccaagacccatgcacgcgcgcttttgcgcttctctcttttttttaacgccgctgtttctttttttttttcttttttttcgccgtatgttgttcctgccgtacggataaaagaaaaaaatataattagtttagattagtttcctatttttactagtggttggtttactagtaatttttaaattttaactttaaatttttcaaatttagacatgaaaattttcaaatctcgagctgaaagttttcaaatctcaagggagagagggaggagaaagaaggatagatagggtcatagggatgacatgtgggtcctataattactttttgtgtgaatgacaaatagggcccatatagtttttaattctaatgctacctaagcgccacgtcagtaccacaaaccaagtcaacatcgccacatcagcgccacgtcagtaaaaccgccgtccaaaaccaatgagggagtcaaattgcactggtttgaatagttcggggagtcgtcttatttggttttatggttgagggtcacggattagattcgggtcacttttaagggagtcaaagtggacttattccaatgcacgatgcacgaacgactcaagccaccggttggttggaccgagcctcgctgcgaggcgctcgggttggtcccggcacaccgtgcggagtggaggcccgtcaccgtgatgcgccgttcactttccggcctttcccatcgcagagaacgacgggaagtccagaacacgcaacgtgtgcgcgtgggggtgcagaccgtgcagcgcagtggtgggtggtctcgtcgtttccaccaccttccccgcggagaagacgcggtgcacgttcctatcaaaagcgcggtccttcagtactccttcgcatatcgtcgccatgacgttgaccctggaccttgagagtcctgctaaaacaggattgagatcctcaacatttgagtgcaccgtgactttatcactaacatgtgaatccggagatcatcagatccacatgtcaataataaaggcacggcgcagtcgactgcaaaagattatgttccgctaaaacactccccgaggaaaaggagacaggaactggtgtactatgtcgtcattgacaccttgtaattgtttcctgattgtctctcagatttgccgtacagggtatagatgcctgtggctgtgtagttagctcgccttggagtttcgaatataggccttcccaggatgaggagggggagggggaggcctggaggccggcccccctccgaacgcggtgatggctcgatcgagtcgccacatgcggggagccacatgcagtggatacagtcatagcgtgtttggttacctacacatgggttggctcacaaggagcgcgagtttggtttctcgcacgggctcctggacctgattccacttgtgcaaacctaccttcctagctaggcccgagggaaacgctcgatttgagcttcgctcgccatcttggctgggcgcgtgcacgcgcgggtgcaagaggaggcggggatgcatggatgcatgaggcagggagggttgaagcatccactcacctcctgctcacatttggtccttgaggccatggggtgagtgtagattcggggagaggggcagtgacctgcgtgccaccggatgactggatctggcgtggctggggacacgagcaccgagcggcacggcgatggagaggaattgcagagcggaccgcactgagtagttgactagcgacgagatctactagagtagtacatccttaggctgacctctccacttggccgtcaccgcacgatgcctagatctagcagttggttggctaccttcatcgagagccaagggtgtgacgtggcgggtgcgtgacgcagagacagagctggacatgttgctatggttccacttccacctgatggatgaggagatggagacgtgctgcctctccgtgcatgccgccggctacctgacccccgtcctcatcatcacctagatattgtttgggcgttgggagtggtgccaaacctgtctagtggtgcactacctatgcatgcatgccgctggctgcctgcccccgtccccatcatcgctgagacgttgttagggtatcgggggcagtgcctcttctgcatgcgcgaccgcaagtaccccaatggatcccgccccaaacacacattaccgagttgctatgtaccagccaccgtcagcatcggcagtggaatctgaattaagggcatagaaagggtagagacaaacacatagagaagggggagatgggtgtgtcactaacatgttagggccaccacctttttttatttttcctaactaaaatgtcacataggccgccacttaggatgaacccgtcatcgaaaccacttagggacgctaatcgatctggtactctccctatatctggtatcgaggttcatgacagtattcaaactcgacgtgtggacgagatatctaaaatgaacttattccatatgtcgcggacctcccgttcggccgtttggtctgggcctacgaccgtgcggagggaggcacaccaccgcgggggaacgaccggctcgttgaacgcacgaggcacgacacggaagaggagtgggtgggcgcgtcgcgtgggcgtggtggcctcgttgtttctttccgcctccccgcgccccgcggagaagacgcggtgcgcgttcctctcgagcgcggtcccatttgcgtcggacggcgacgttgaccgctggacctggattccggctaaaatactccgcgaggataaatgggaatcggtgctctaaccacattttcctgtgtccttgtctctctgattatttacagaataagtaagatgctcgtatggtttagctttgctttggagtttccaatttatgcattcccgggagtcctgtcctgatctcctggaccctctctagagaaatgcgaagtcattttctatggtagttgcacgtttacgacgacgcggattcgaggacctcatcaggcgaggattgtaaaatcgtgccatcgtgggaccatgttctagttacttgaggccccgtttagagggttcaccttttcctctgtttcggtaaaaatcaaaagttgtttgccacgagaaatagcgttcagccttcaacttatgtgttctctctctctctgaagactttatgtgttctcttcaataatattcaatgttaggcgcgtccgcacatgaggctagagagccggtaaggaatgaattttccgttggtttttccaatttgcacacttctacgaaggcaacacctcgcgatgacacaatgatgacaatggcacaaatattgcctacaagagatgctcaagtaatgctcaagtcactggaaagttgaaggaaacgtttggggctttctcatccggccgtacaagagaccaaaaagaccgaacgtctctcctacgcatgtacgtacgtgcagcagagctgcatggaatgtcttgaaaagttgccccccaagactcggttcgagttttgacccctgaattgccggcgcattgccagtagcgaacgaaataggagagaggagctgcccctgcatgcgcgcgatcatgcatgcacgcatcccctcccgctgctgctccctcctcctcctcctcgcatccgtcaggtcacttcctaaaaaaacacaggaaactacgcaaaaactcccatgattccgaccagccgaacactttccccacaaaaaaaattgcgctgaagttgccgtcagagagtcgccttcacgaacgccattgtgcgagttgacgcgtttcttcgcggaagaaaccaatgcccgcgttggctatatagaaagggtttgggttggcggtggggaggagatcggaggagggggtcgttggattgggacccaattgaaagggaaaggttgaagaggcgcaatggagagctacctgaaggagaatttcggcggggtgaaggcgaagcactcgtcggacgaggcgctggggcgatggcgcaggttggtcggcgtcgtcaagaaccccaagcggcggttccgcttcaccgccaacctcgacaagcgatccgaggccgccgccatgaagcgatccaaccaggtaactgccgccgcattcaacgccgatatatgttatgttcgtgtgttgcatcggcgtcgtaattgccattgccattgccaccgcttttcttggcatacttcggatgtgtaaactatcgtaatatatatatatatatatatataatgaaaatcattacgggctggggctgtcaggccttattagttcatctgtaaattactgagtgtaagctgcaatttttaggccgttcgattagattttactgtttcagatgtgaacctgattctgcattgatcaagaaaaaaatatttttaaaaaagatgatattcaaacgtacctgtttgactgtttaatctttatccagtttgaatgtttcactgttatccattgagctgtttgtgaagtttgtatcttaaaaaaaagatcattttaactgaaaacttaagattttgtttagcacctcccttgaacatggtaaatttaaaattttccataacctctggcaaacaaaatttatagtgagtaacatgttcctctgttacaaacttacaataatacaatccacactatgtttcttctggcaaaatcgcaagtataaagtataaacacgttacacgtctgctgcaagtctgcaacacatatacacatgtaaaaggtgcagcatttgtgcagtactgaagcttccacaacagtttccaggacaaagttctgcatcactttgtaaaatcaagtagtactaacgcgattaattaagtattagctaattttttttccagttaggaacccctcctcccatgcacgcaaaacgatgcttgcattaacgcgtgattaattaagtattagctatttttttctaaaaatggatcaatttgattttttaagcaactttcgtatagaaatgttttacaaaaaaacgcaccgtttagcagtttaaaaagcgtgcacgtggaaaacgaggaagaagtgttgggaaaattgggtgccgaacacattgcagttgagcatggtggccgtgtttagattcaaacttttttcttcaaactttcaacttttccgtcacatcaaatgtttggacacatgcatgaagcattaaatgtggatgaaaaagaaaaccaactgcacagtttacatgtaaatcgcgagatgaatcttttgagtttaattacgccatgatttgataatgtggtgttacaataaacatttactaatgacggattaattaggcttaatagattcgtctcgcagtttacaggcgaaatctgtaatttattttgttattagtctacatttaataattcaaatgtgtgtccatatacttaaaaaaaatttggcacatgtactaaacacagaaactcagcctgtgtcctgcgtcagtgtgcgtgttgacaaaccttcagccagctcgactattcattgtgtgcaatctgctgctaaaactgcacgttctttgagcactggaagattaaacgccagcaaactcatgtttttttcatgaattttcatgcaattgttccactgtaaaattcacgaggcttaccatcaatgcacatttttctgtaccgatttcaggagaagctgcgagttgctgtgctagtgtcaaaggctgcacttcagttcatccaaggtatgaacgatactgataccagttcacaatcacatcccagaatgaaatcaacatttttttctcttttccatggagcccaatcatgacattggcacgatcctgcaggacttgctccggcgagcgagtacacggtccccgacgacgtcaaggcggcgggctacggcatctgcgccgaggagctgagctccatcgtggagagccacgacatcaagaagctcaagtcccatggcggcgtggaggccatcgcggcgaagctgtgcacctcgccggaggacgggctcccgaagtcgaggcgccggcaagccgtccgggaggagctgttcggcatcaacaggttcgccgagacggagtcgcgcagcttctgggtgttcgtctgggaggcgctccaggacatgacgctgatgatcctcgcggcgtgcgccttcttctccctcgtcgtcggcatcgccaccgaggggtggcccaagggcgcgcacgacgggctcggcatcgtggccagcatccttctcgtcgtcttcgtcacggcgaccagcgactaccggcagtcgctgcagttcaaggacctcgacaaggagaagaagaagatcaccgtgcaggtctccccgaacgggtacaggcagaagctgtccatctacgacctcctcgccggcgacatcgtgcacctctccatcggcgaccaggtgcccgccgatggcttgttcctgtccggattctcgctgctcatcaacgagtcgagcctgaccggggagagcgagcccgtcgccgtcaatgccgagaacccgttcctcctgtcggggaccaaggtgcaggatggttcttgcaagatgctcgtcacgacggtcgggatgaggacgcagtggggtaagctgatggccacgctgagcgagggcggcgacgatgagacgccgttgcaggtgaagctcaacggcgtcgccaccatcatcggcaagatcggcctcatcttcgcagtcgtcacgttcgccgtgctcaccgagggcctcttccggcgcaagatcatggacgcctcgtacctgagctggaccggagacgacgcgatggagctgctcgagttcttcgccatcgccgtcaccatcgtcgtcgtggccgtccccgaaggcctcccgctcgccgtgacgctcagcctcgcgttcgccatgaagaagatgatgaacgacaaggcgctcgtccggcacctcgccgcctgcgagaccatgggctcggcgaccaccatctgcagcgacaagaccggcacgctcacgaccaaccacatgaccgtcgtcaaggcctgcatctgcggcaagatcaaagacgtggagagcgcctcggacaccaagagcttgttctccgagctgccggagtccgccatgacgctgctctcgcagtccatcttcaacaacaccggcggcgacgtcgtcttcaacaagagcgggagtcgcgagatacttggcacaccaaccgagacggccatcctcgagttcggcctctcactcggcggcgacttcctggccgtgcgcaaggcgagcaccctcgtcaaggtggagccattcaactcggccaagaagagaatgggagtggtcatccagctccccggaggagcaatgcgtgcacacagcaagggcgcgtcagagatcatcttggcatcttgcagcaagtacctgaatgatcaaggcaacgtcgtgccactcgacgatgcaaccgttgctcacctgaacgccacgatcaacagctttgcaaacgaggcgctccgtaccttgtgccttgcctacgtcgatgtcggtgacgggttctcggcgaatgaccagattcctgaagatggctacacctgcattggcattgtggggatcaaagatccagttcgtcctggtgtgaaggaatcggttgccatctgcaggtcggcagggatcatggtgaggatggtcacaggtgacaacatcaatacagcgaaggcgattgcgcgggaatgcggcattttgactgaaggtggcattgccattgaaggaccggatttcagaaccaagagtgcagaggaactgaatgagttgataccaaaaatacaagtaaagttttcgttgcttttgctggtcagtttaactgaattttctggatttcatttgctgatgtgttctggtttcatgtatcaggtgatggctagatcttcaccacttgacaagcacaccttggtgaagcatctccggaccacttttgatgaagttgttgcggttactggtgatggcacaaatgatgctcctgctcttcatgaagctgatattggacttgcaatgggcattgctggaactgaggtgattttcctcaaagatagttgatagtgttccccttgcatgaacaatataattaatgaattgcatcacttcgatttttttagaagtgtatttttgtggcaatttagccgctaatttagttgtcttgagttgtactaccatccatttcatgccctcatagttctatgcactttttcactcccaaaatttctcactgtgctatctgtttgcaggtggcaaaagaaagtgctgacgtgattattcttgacgacaacttctccactatagtcactgttgctaaatggggtcggtcagtgtacattaatattcagaagtttgtgcagtttcagctgacagtcaatgtggtcgctctgatagtgaacttctcctcagcttgcttgacaggtacagctaaatgttgatgttttttacctcattctactgtatagaattgatagtttcgttccgattaaaataacctttgatgttggtttcttgtaataactgcactgctgatacatgttcatcttttatacttctccttcaccactgttcctagtctgctgcctactgtttctaagttcaaatactgtttagtgttagtgcagcagaaatttttcgttagatttcaaatgagtggcagaagagatgtgctaaaacttaaaaaaataaactaacataaaatttattaatgtggaaaatcaagaatttcctagtttgtttcataacttactcttgactgttctttgtacttctgcttggcattcagggagtgctcctcttactgctgtccaactgctctgggttaacatgatcatggacacactaggagcactggcattggcaactgaacctccaaacgatgaactgatgaagagaactcctgttggaaggaaagggaacttcatcagcaacattatgtggagaaacatcctgggacaggccttctaccaattcattgtaatatggtatctgcagacagaagggaagtggctatttggactaaagggagaaaattccgatctagtcttgaacacactcatcttcaattgctttgtgttctgccaggtaatttgaaagtgcttgtcacatctatttagtgtctaaaataattctcttgcatacatttttgcaaaaatagaccttagctcttgaataatatgttggcaaatatgttttccaaggatcaatactcacatgaatgtagtacttcagctgtaaaatgatgaatgaaaaatttcagactatattttgccaatattagtgtgcagtttcattaaaattttcattgttgtgcaggtgttcaatgaggtgagctcaagggagatggagaggataaatgtatttgaaggcattctagacaacaacgtgttcgtcgccgtcctcggcagcacagtcatcttccagttcataatagtacagttcctgggtgatttcgccaacacgactcctctcacattgaagcagtggttcaactgcattttcatcggtttcatagggatgccgatcgctgctgcggtcaagctgatcccagttgatttctaagtaggaaagcagaactaattcaagacacgggactgaagtcggtagggattagaggcagtaccatgggcataacaaagttctctttatgcgcttgtttagatgtgaacctctgccccccccccccccccccctttttttcttgcagagtatgatccaagattgtatggtgtttaatggactcgtgtagatctttccttcatgtcattttcctcatgttctttccttggaatgttggaacttgcaattgtatatggatcgcttgataagtttgacatttgtttgattctacacccttgagtccttgacagggtgtatgaattgactcgtgtaagtttcttcccttgttgccatcctactgtttttttgtggccaatctgggactgtagcaaagttacttgcaataaaatcaatcgatttcattgtactggaaactacaatctttgttctttactcattgtactggaaactacactctggttgtcactaaaacgtgctttactggactgcatgtctgcagatgctatctttggttgtgtcatgatctgccatgttctcattcattcgacatactccgtattacagtcaggcaattttcagcatggttagctgtagtaggatttgtgaaatgcctccgctaccttccaagatccaagatataacgtcacatttaactttgaccacgaatctcagttgcaatccaaatgccagcatcagcagataatatgtactggttgcatgggcctggcaggctgtcagttaccttccttttggcatcccaggcttttctctcttcacacatcgcatgcaattgacacacacaatcaacaggcagcttgtgcttccatcactactgcaccacttcaccagtgccaatacaaaatgctgctgaccagtcaagccagtgactgggcatgttactgcccactataaaattccaacagcgtcggccaccagtagccatgcccctgtgaaccgcggtgaacccatttttttaccttgctgccaggcacaagacagcccaacacaacagatcagtacatgaaaaaaaaaattttaccatgtctctctctttctcatgtcatgcttgtgcagcgcttttgggttttgaccgcaatgccagttgctaccgcccacgacgagtcaccaggggctagaggaatccagtgcaagggttggtcatccacagccatctgaatcagattcagatcattcatggggagttgtttctttgcgtggtgtttagttggagggactaaattggggctaaactttagtccctctaaaaaaacataagtccctccctgtggtagggacttatgtttgagggacttatgtttttttgagagggactaaatttagtccctagttcccaaacacccccttggtcaaaaacttcaaagatccagaccacacaaaacacagcagctcttgtactccactttcatcagaggttttcacagtgctacactacacgcactgtcttcttggaggcagttaaaaaattggagggaaaggggaaagaagcagatccactcacatgctccccaagatgagcaattcatcagaacctcggcagctggtgagaggaagctgaagagtgaagaagagtctttcttttggcctgttccacgtgtcctagtggagtgtactactactggagtagtgatttgcattgcatgatgcacaattcagagagagctaaagaaggcagcgttacagctgctttcatgcgagagagacaaaccaacagtggcagtcacctccaagaaggcaaagaacagcaaagccattgctgagaaatagcaaggcagggtgatttgatgacacggcacaaaggcaacatcagaaaggcaccgagcaaacgcatttcttcctttcgtcccacagatatcaataaacaattcccaaccactcatggtcagcaattgcacacgagacacgagagagtagagtgaagtacagtgagagagatggcccctgccccctggctatccaactactatcaatcagttcttgcaacaaaaatgtactaccactgtttggctttagcatcaggaaattgctaatgaaccaaaatggcatgactcaacagagagtaacagataaccatacagtatccacaaaaaatgacttctactcaatacttgggaattgggattccctctctctgtctccacatctcagtgaggacttcctccctactttgagcaagagctctttatcagttttcaggccttttcctctgctctttacactagtacctttctgggccagggaaagatctccacaaaaccagaatctttccattgctaactaatcaatcaactgtaacaattgcataatcagaagaagaatcaaatgttggcccctccatttggccaaccccccctgaacttgcaagagcactgactagggctcagctgaaacaaaagaaaaagggtgaaaatgatcaactaaaaattgcagagctggactccaaccaacatgctgtccagctccagcctccagctcctccctctactggcgctgaggcgagtgcaaccttttcctcttcttgtccggggttgcctccaaggtggtggcattattggcccctcccatggcgctgtcctccgatcccccaatgtgggcaacagagacacccgaggaagctacctccgtcgtcgattgcatcgacctgtcctcttgaatcatcatcttgttgtagcaggaatacacatgcccctgcaagagaacaacagcgttgcagaatttactctcgacattgtcatttctaccaagaacttaaacctaatgggatgagatctcgcaaaagagaaagttgggagtgcttacggtgtctagttgctgccataacgagcccacgaccgacttgagctcgtctagattaggcgccgtctccttgttccgagcgatgaggattgctgctagagcgatcgttgatggctggtaccccaccgagctaatgactacgagattgcggaaatgaaatgagattcttgcgatccgattcggtgaaatgaaagcagagggggggaatgatcgacctttgatcgaggcgaagatgcattcgatggcgcgcaggacgatcgccttccgctcgtcgtgccggaatttcgcggtgaagcagttcaggtaggagaagggtgtctcggtgatcatctgccacttgagcgtggtgaggacgaggagctccatccgcatcaaggacgcgcagtcgtacatgtccagcttgaactccggcagccgcggcggccggcgctcctccaccttcgccgccagcgacaggcacgccaccgagaggagctgcagcgcccactccttgtccctctaaaacacccccacacacaaacacaaaaaaaatggcaatacggagtcaggcattacgtcgaacacgcactcggcatcacgacaacaagagtgaggcggcgcatcaaggcaagcagggaggatcgtcattacatcgacacaccggcgcgccaagaaccgatcgagatacgtcaccgcgacatacgccgtcttcaagctgaaccggaatcccgcgttcgtctgcaaccagcaaagcgaggaggaagccccccccccccccctccgaaaacaagagtcaatacaaagatccgatctccgcgaaaccgtgtggagagtaatctcaggtcaagggggcgacaaagagaggaggagacgcgaaacgaccttaacaatccagccgacacaccaggcgcgcgcgttcttcatccactcctccaccatctcctcctcctcctcatccccacgctcgccgccgccgccgccgccggcacacctctccttggacagcatcagcgcgaggtactcatcgtcccggtccatgagcaacacatggtcgtcgtcagcaatggataactcccagtcgccgccgctgccgccgccgccatcgtcgtcggcggggtcggcggagaagaggtcgttgccatcctcccggcagatgagcgtggacgtgggcgtcgcgggcgcggaggtggatgccgaggcgtcccccatggtcggcgtcacagcccgccgcgcatgcagaagaagaagaaaaaggaaagaatcgagaaaagggaggcagaaatccaccgggacgaaaaggcggcgtgcgggtagcgggcgatcgaggcggccggaacagaaagggatcgattcccaccacctcctccgccgcctccgcctcgtgccgtgcctccccccaccacccgcgcgcgcgttgaaaggggagggaaatctgcagttagagagagagagcgaaggaaaggggtggactgattcaggactggattggaatagagagagagagagagagagagagagagagaggtgtgtgcgtggaggagtggccgcgtgggggggttggatggtggtggatggagaaggcgacgcgcgcgcgcgagttggcgcctgcctgctctctgcggtgctcggctggcctgcctggctggctgcgtgcgtgctcgcgtgcgtagtagtagtagcatactactcgtggtaaagctcgtctcgtgtgatggctgctaggactcggctcttctctcgtctcgtctcaccacatgtactccctccgttcccacagtataagaaattttaaatttttctggtaacttttgaccactcgtcttattcaaattttttttacaaatataaaaaacgaaaagttgtgtttaaagttatagataataaaataagtcataaataaaataaataataatttaaaaaaaattgaataagacgaatgatcaaacgttgtaggaaaaacttaaaatcccttatagcttgggacaggggagtactctgtacgtatgcatgcatcttgtgtgtttcgcttcacggtctatttctactgtaagataaactgatatatgtgaaagtttagaggtccaaaattgataaagagggttttcctatagggaacgacacgcgagtggcgcctctcctctgcgttggcctagccgtctgctcgcgtgtgtagcaatgtactactggtggtaacgctcgtgtcgtgtgacttgcaggatctgctctcctctcgtctcgtcttaccgcacatacttcatacgtttgtacacattttatatgtgttttactccatgctccacactactataagatcaaccgccgtgtgacaagtttagatgtccaaaattaataaatatactctaaggtattttagtaacacacgagtagcgtctctgcgctgctccgctggcctagttgcatgctcccgtgcgtaatagcatactactggtggtagtgctcgtgctgtgtgacaagctaggtctcgctcttctctcctctcgtcttactttgtacgtatgcacgtgtcttctgtgtttcggtccatagttccactctactctgagatcaaccgtcatatgtgagaagtttagaagtttaaaattgatacatatactttgaattatgatgttatcttctattatgtcgagtagcttagtcataaggtttattaaaaaaaattctcgggtttgcttaaccttgacgcttgtattgtaaccttgtccctgatgctgctagcttcgctagtcaagtaatccacgacgcgcgtctgttgctaccaaacaagcctgtacagtatggtgtgcagaatgagtgagggcttctaaaatttttgtttaggtccacaccaaaccaatttgttcaagttttagaacttcctcactcaatttcttttaagctgtcctttctccttcggcgattatgctaaaagcctgaaatatgttcgtctaataacaaggtatagctaaagagaagaacattagattaatcgctagctacttttctgatgcggatacatggcacaccacccataataggcatcgagtataaagagcaacgtacagcggtgaactgtacttttaattttatttttacaatatttaaggcaccggccgggcctctaattcgtagatatagccatactaccaacgtgtgatatatacatgaccaaggtcatgcaaactacatacataaaagttttttacctatttggtcaatcggacaaaacacatatatgtgcatatcatggtggccacatgtccacaaatacacactctttaatacacgtttatatgacaaagagacaaagactaagaataaatgcgtgaatcttgtccatcgatttaaaccttaatagttaataggtaaatcgattgtttaatttgcaatgaaccattatattggtattaatcaaataatttcgacgtaggtgtgatttttaaaaatctcattaagaggatataagggttccaaggtagtgattattcttattatcaaactttatgtacaagtactttaggcgtgattaaaatggaatcacgtaccaacttttgctaaggctgggttgtgtcacatattctccaacaagttcctatagaaaatttacatgcgaatagcttttggactgtagaactcaaaaatcaaaattcatgttaaagtttcttgtgggaaacaactttttttttcctgaatcatatgaccaaatttcacgagatcccgaaacccttatctcattgtttcagaaattagcttgtcaaggggaaagcaccggtagtgtgtagagtcattggaatacatgcggtgtattattaataaagtttagttagaacaaggacatgtagtttggccttcacctttttttttaaacgtttgttagtggaaacatttactaccatgtatagttataattgtgctggtgcatacacgtcttttgtgtaatggaaaaaaaagaaaaaaaatatgaattatcctcctaaactatagcggtcgatcaaattacctcctaaacttgaataccagacattttacacccttaactattgataccggacaaataaccccctgagcactgtattgagtagttttgacttgagtttgcataaatagccggtaacgtggcaatcaagtcagcaataaaattatttttaaaaaaaatcaatgggcccacttgtatatctttcctcaagccaatcctccccactccccatttcaggtgcaaatcaatgggctctctctctctgtgcacctttggctagagaagtaggacagagagggaccttgctcgaaaggaggcggatcaacgcaagctcgcctgggcacgcgaagctggctctcggaggtggtgggccaaagcgaagctagagctatgcggaggttgagctcgaaacggccaccatccgctacaccctcacgtgtcgcggtcacggtggttgggatggcaacaacgaggcaaaggttggggacgaggatggcacactggagatcagaggtggggatggcgtagtggagattggggggggggatagcgtggtgaagattgggcacatgggtggggcagaggttgggggacaggaatggcgcactggagattgggggcagggatggcacggtggagattgggggcaagggcgacacgacagaggttgggggcaagggcagggccacacggtgaggcggaggttggggatggggacggcgcactagatattgggggtggggatggtgcggtagagattggaggaaggagatttttttggggggggccccaaacccaanggncnnggngnaanttggttntngnnggngngnancngngngngttgggggcccaacgcgggttgagtgcggagggttgaggacggggatggcaccgaccatcgggtgaagggaagagagagcagcgaggcagaggttggggatgggggcagcacggtgcagtgtggcggaggttgggggagggggcagcaaggtggaggttaggggctgggatggcgtgccggccaccgagcggagggaggagagggagagggatagtaggggggaaggattaggctgtgggagagatgacattgtttttttaataattttattgctgattggattgccatgttggtgcccatgtacgcaaactcaaggcataactatctaaaatgggaggttaggggctgggatggcgtgccggccaccgggtcggagggaggagagggagagggagagtaggggggagggattaggctatgggagagatgacattgttttttttaataatttcattgttgattggattgccatgttaacgcctatgtacgcaaactcaagtcaaaactgtccaaaacagtgttcatggagttattcatccggtattaatagtcgagggtgtaaatggctggtattcgagtttacgagtttagggtaattcggtcgactactatagttcaagagggtaattcgtaccttttaaaaaaactactccttccgtcccataatataagggattttaagtttttgattgcaatgtttgaccactcgtcttattcaatttttttttgcaaatataaaaaacgaaaagttgtgcttaaagttatatatataataaagtaagtcacaaataaaataaataataatttcaaaaaaaaatctaataaaatccctactaccacttctctacaagaaaatgccatgccttacttgctatgtttggaatcattactgtcttactgatccgatcttgccatcccactacgagggagcctacaaaattgtcactcatgtgatcgtgcgcagtccggtgttacagaaataattcaatgagtaaggaaatatttgtatcgatgtgcagtatataatagagaaatcttggagaggaccactgtccactggccagatcgccattacatgcacgccatttgctgcctggatagaacttcgcgtggtttctgatttctttgtggtttacccccgagctcgctaggaccacaattcagttagtgaatagttgcatatctcacttgctccaaattgcaaacaagatctgttccaagcttatctagttatatatatactgtatctcactagactagagcaattaggctgtgttcgggcattcttgctcccatccggaacagtaatcatagaaaacggcacggtccattagcacgtgattaattaagtattagctatttttagaaagggttaatttgatttttttaaagtaactttcgtatagaaattttttgcaaaaaaacacaccgtttagcaatttgaaaagcgtgcgcgtagaaaacgagggagagttgttgggaaaaaggggtgccgaatacagccttagtatatatcgattaagaccccctctaaacaatggatttacatataaattttataggattcaaattttaatggttttttttctctatttagctctttgaaacaaaggatttgggcttttatatcctataaaattcctaagaaatgacttaatgcctataaattttgaagaaagttagcaagagctttattttttgaaaaaaaatatttgagtccatctatgttatctgatttttttttctttttgttttttatgcggactattcaaatggtcgttcatagattttccgatgttttccacttatatattcatattaaaattccgtatttttcatgtatatcctacaaaattcctaagaaatgacttaatgcctataaattttgaagaaagttagcaagagcttcattttttgaaaaaaaaatttagtctatctatgttatctgattttttttctttttgttttttatgcggactattcaaaaagtcgctcatagattttcctatgttttccacttatatattcatattaaaattccgtatttttcatgtttctatgttttctataaatgttgttggcgattctagcaaccacgctgctatggctacttaattaagattaagaagagcgcacagagagttagagctaggctgtgtttagttccacaccaaaattagaggtttgaagaaattggaacgatgtaatagaaaagttgaaagtttatgtgtgtaggaaagttcaatgcgacggaaaagttagaagtttgaagaaaaaaattggaatctaaatagggccctaattgcaaatttgcaatgtaagtgctgtaccgcatgcattatctaatctgtcaatcagatcctaccctacagaatacactatcggtctattttggaaacaatgtgtactaactttgtagagttttaatcctatagaaaaattttctacctagtcatttgaaacatagggttgaagcttcctaaatcctatgaaattcctcagaaatatctcagtagaggttcaacctattagaaactttcattctagtctgttattctcttccggttcctatattttttttctatattctatttaaacggttatttcttattcctatgttatcttgttgtgttttataattttctgttttgcatatacatttctattaaaatcacgtgttttactatttcagtgtttaattgcaaatggggcttgctatattatgtgatggttaattcaattacaaaagaaactgaagtacgactgtactgcttgctagttgcagagacttgcagtcattgttcagtccggcatgcactgatcgatctgctacctgccctcactgatgtatcatggatcaatccaagcaccaaacggttacagtagtatatgcatcctatgaccatcctgtcagtaactagggaccatgcattactacggccagttccctcccccatttttccatcctaaaacttaagtgcactgcataaagcgcatatggttccggtaagactggtttccataattctaactccatatatcgtcttctctgttcagaggcttgcacaagctgtgaagatgtaaccagtaatctatcttatctatccgtctagtgcacttgatattcctccaatctatcttatctatcgatcaagtgcactcgatattcctccaaccaaccagaccagtacatctcaaagaaaatcaactgacagtaataaacgtatatgaacacgcacgcacctgcaactcatcagaaagtctgaagtcaatccttgatgatgcgaatatagtagtaaatgcaa

SEQ ID NO: 80690 - DNA, 45423 bp, Oryza sativa
aagatattatttatttatttatttttcatgcttaataagtcaattagacatgttataaaaaacattatggtctaaatcatgtccactgttttgtttaaacaaggttaaaagtatatgttgtgtccatttcctcccatggacctatggtccccacatgtcagttggtaaggtggtgacagaaccaccaccatcgccgttataactatcaatttgctacatggtagaaaaaatagaaacaacaatgatttaagagtgcatataaacaagaaacattttaatttatgaaactcatattctaaaaaaaatgtgtttttaagaaaaaaaaatgaagcgtatattttaaaaaacatgtgttttaagaaaaatcgaagtgtatattttatcctgtttgatgaatgtaattacttttttcacacaagcgtatattatttcctatatttttatgagattttaagggaattgaatttattatttataaaatagttgttcgatttaaatgcactttatataatatgcacaggtacaaaataacgagcgcgtcaacagacgcgcttatattctagttacaggaaaaggattgaacagtaaaagactaataaatctgtttgcgtttattcaacattgatcagatcaagaaagaaactaatcagaagtattccatccatctcaatgtgttgtgcaaagtccatattcattcattgcaaataaaatgtagacctactgtttagaaatgaatgcttcatgttcccaagtacatgtcatttagcatcctatagtgcctgacaaaatctgtttcttgggtgttgattgcaatgtgaaacattaaccaaatatttcactaactgaatgaaggttacatacatacagtcatcataaactggacttcttgaataaagaaattcagcataactaacctcgataagaggatcccgtccgacaatagagaagacctcctctgctagctttcggatgactttagcacggggatcataattcttgtaaacacggtgcccaaaacctgacatctttctcttcctaaagaacaaaacagatctcataaaaacaagtccaaacatatagatttaaaaaggtaaaagcttaaacttcattaaactaaaaaagacctccatgattacatttcagatcagaaaatataaatcaggacaggagttatatattacctgtttttcactccctcgatgaaatctggaatattctccacacttccaatttcatttaacattttaagtaccgcctggcatgttagaaaatggcattagtgcttctgcatcataataattgagtaatgccttaattacttctaaaaataacagatgtagagtcaaggttaaagcgaaacaaaggttttagaactaaattttcaattatataaaaaaatccaagaaaataaaaacctctctatcaaggaggtgacttatttacattgttaacagaacaaatttatagagtacatagactgtatgtctttgttacttgtgagcttgatccttagattctgatgatgaatgtgtatataaactattagcagtccaatgcaagaaacaaaagtgacaactgctcattgctcagcattgtttacctcatttgcaccaccatgcagtggaccatatagagctccaacagcaccagaaagagcagtgaagacatcaacaccactgtaaacacaggataaataatcaggcaaggtcagactcccaattcttagaatgaatggcattatctaccttgaagcaaggtgcctagcagcagctgtagagcagttcatttcatgttcagcatggagaataaaaaggatatctagaaccctagcaagtctaggatttggcttgtattctttgtcacccctgcatcacagtcgaaaaggaaaatgaagtcaatcacaaaattgaattgcttattgatttctaacaaaagaaaaatgaaagagcacatgagagaacagaatacaaataattccaaagtgatgtgacttacaaagagtctagcatatacaagaagttctctgaataagagagactatttgtaggaaggataggaggtcttccagctaatctcaagtacgctgcagctgcaattgttggtgcctatacagaaaatcaagttaatattgcatcaattattagtaaaaccaaacatatataaagctaactgctgggctttgcccggcagtgcttgtttccggaaaaataacattatataaatctaaaagagaaacatcattgtgatatgcatcatgaccttccatagaatatctctggctattttatcacttcactaattcaagaaagagggtgtatcatttaactgggaaattatcctcgattaacttcactagtacaagaataatcggatttcttaagtcataccttcccaagtactcgcacaatctgcttatccctaacctgcttcgacttgtaaagatcttgaccctacacgagtacaatatatgtcattaacaacagcaaactattacacataacagatggtgcatacataattcagatattaaaaaatccaatttttggctgattctatcatgttaagtaaaatcatgtgaagaaacaactagctcaattagtgcatttagagagtgcttactctaagagcagggtttgcatccggatggaagacagaaagcgtgctcattgcactggcaagggcacccatgggatgagcgtcatgaggcattgcttgtatgatatcctgtcaacgttaaaagaacaccaagccattagttattagtacaaattaaacagaaaagctgtccatatatactgcaatgatacacaataagatggcaaaacataccaagagtccctggggaacagcagagtgctgagaaatcgcaaattcccatccagccaattggctctgggtaggcaaacttccgtacactgcaagagcaaacatgttttcaacaacaaaaactacatttgcattaaagaggaaataaaggtgcagaacacttactcaggaggtaggccacctcaacaaatgagctgctttcagccaactcttcaattgggtatcccctgtaacgaagaattccctcatccccatcaatgtagcagatggatgagcgaactggggctgtgttgagataaccaggatcatagatcttaagacccttgtcgtcctttccagtggtaatctgcaacaattaacccaaaaaaaatcctatttaactctgggatgatctcatatagcaaaggcatcataatatgcacagagcttgagctgtccacacattctcttgaaattttagtcctaaaccaaaaggtagtgaagtaacatttgcatagttatctaataattcggtagttgcattctagtttgttcgcaagaagtacctgccaatcaagcagaacaatttactacaactacgaagtcacatgcaagcactagaagatttaggataacttcattgtgaacaaacgggtaagctgcgacctcatcgaagtcaaccaggataacaattagaaatcgccacacctacatccatacagacactataatgaggaactaaactcaataatcatgctagtttcgactttctgacatctccagggagaagatttgtccaaaggggggtggcgattgggcgaaatttacacatcggttttgtcacccaatcactagcagcagacgaaaattgagcacaaccaagatcgcaatcccctaatccaagccgattccacagaaatccagcttgatccaccaaccaaaacccgcatcccgaaatcccgcaacaccccccacataacccggcgcggatcacggcgcaggtcgcggcaacgaagaagccagcagtaagcgtagcgctcctaccttcttgaagtcggtggcgcgcacggtcccctcgtccgacaccttgacctcgtacctcttccccgtcctcccatccaccaccgccagcgcgccgcctcgcgcccccgcagacgccgccgacctctccagcggccccgccgcgtccgcctccccgcaggcggcggcgggggaggcgaggtgggcggagagcacggcgaggcgggcgcgatccatcggcgaggagagcagagcagagcagaggtgggcgcgggtggtggttgcttggacgactcgtctgcgttgggttgcaggttggggtttgtttgggtttggcttccgctttgcgggaattatcgagtcgtggatgctgctgctgttattattgtggggggagatggagaaggtgcaggaccactgggggcctcgtggggggatcagatgatgatgacgatggtgatgacgacgacgacgatgagatttgttttcggtgagtttgcacgtcttacggtttcattttcaacgcgggcttctatttgaactcttattaaaatacatcttccaattacttaaacttattatgaaggttattccaattctaaattgccacgattttcttgtgtcatatatcacgtgggtgctaattctttttctccttttatttttcttttttcaaaaccaccttgagtaataagaacggttttacaaaatttagagggttggatgtccggttttaaagtttaaggcgttaaacggacttctatttaaagtttagaggggtatttggaaattttccattctttttctccttttatttttcctttttctcccctttctcttcttccttcctcttcgtgtgtaagaaataaaaaaagaggggaaaaaaacaaaaacatagagaataataatgaaaaaaatgggataggaatgtgtgtatgacataccatgtcaatgttatgtaagatcgggtaatttgaaatcagaataatacactttaacaagtcatggatctaaaaatctctgctacttagaaaaccgatatttttggtggtgagtcctgaacaatcaaacagctaagttgtttcctaagatcctcccacaagatcaacactccaaaatgcccaatccttgtatcgcgctccaaccacccattcgtgcatccactctcttcgcgctccgtcgcacgcgcgccggctccccttttgccgcccaccttccaaccctgctcccttcgccgccaccaaagtcgtcgtcccattgctcatacgcctctacccatcgcaccgatccacactgccaccgatgacgatttcctccgctcatcccctaaccaccgccccatccctcccaagtcaaggtacacggatgttcgcgcaagggataatttcaggttgacgtggcatattcgccaaggtgtagtttgttagagttttgtgtcgaatatgtgtacgtagtcggttgcaatttaggacttggagttgtaataggtgtttggactagagtaagagtcagattttatcttggttgtaaccgcaagacgacaatagcataggtatggatacgactgaccgacggcctagccgatggagggtcgtgaatacccggatacactgtaatatgctggatcggggaagaccgctcgtaatcagtgctctggggatgtaggttttgactgaacctcgttaacaaatatcatgcctcagtgtcgccttcatgtttagatcttctatggcgtttcttccacgttcggttttcgaggtatatatcgggctggttttataacagtgtgcgcgtgcggctgcgagggagaagggagtggggaggcactcgaatgactgtgcattacataatataatttgatggacataaagaagattaattagatcaccatcctaaagatagagacaacactatccacaattagtgaaaatcctgcaagctacatgtagtcctagttcaaacctaaaaacagactccatgaaattagcgcctgatggttctaccaatgagaacttgcgcacattgcacatcaccgccggcaacattgaaccgaattagaaggtatcatcagagtgtaactgcattgcaaatcaaccactcgtccaagtgtggtcgcaaaatgcgaagaacaaccaatgactgcaatcaatcggccacgagccaatgtggggtcccacccacggcatcaactgcacgaagaaggttctctcaagcggctctcccatagaggatgcgatatgattcaccgctgccgctcatccgaaagtcggagagaggttttcacccatagatattgatgtggtggagaaggagaaaacccatcataacgatgtctataaggaggggagcggtgccacatataatcacaggacattatacatgcatgaatatatgaatatatgttgctgcattactctagctaccaagtcagctcaaagcataaatggattgaagcctcgctcattttggagataagaatttgagcggcagaatatcatgtcgagatgagtgggtgagatactttttttgacgttggtatctcatcattgaagtatataccctcatatgtcccttccttttcctttcgtgaggtatatgtcggatatgcacctttttatatatgtatcttttacagaattgatctatctactgcagaatcttatctattttagccttacatgcaacataaacttactcttctgagaaagtcgatttacaacacgtgcacttatcctttgtatatcatctaaatacaatccattctaaaatatatagctatcttatatatctagtcatagccataaatatatagctatgttttcggagccattgtttcacttattcgcgggataagcaaaacgacatatttgtaaaagaaaaataatttgtgaataaaatttttatatacatgttcctagtgatctaaaagcaaaagctgaaaaataaattttgatgaaaaaaaatctcaaaatcagctccaaatttaaagttgaaaattcaattttggctaataataagcataatcataagtgaaaaaatgaggcccaagagagggagggtgaagtagtcattaaaaattctagaacaaaaataataacatagtgattacaacgttataatgttatatgctaaactatgttttttatgttatatttatccatatataactcactctgtatgtaaaaaaaatagacatagtaataagagaaaataacccctattttctctgtcttaaaatgtaatagtagctatttctatctacagaacatgcacttatccatatccacatccagaaataactacatttcgaggctaagggagtataaaaaaccacttctcattaacatatttaactgggacagattgggagtaaaaagttaaattaaatgcgtcttagtctcttaataattgaatcagatatcttgaatcatatattcgatccttctaaattgtgctatatccatatcaaatagagaatatatctctactattataaaaattgaagatgtttttaccggtactttgatacgtcatacaatccgtgtatgagtcggttttcaaatttgttcatttttagaaataaaaatccatacatatttgagtcggattcttataattccgttcgcttttagaagtacaaaatgagtcgtataagaaatatctttaaaaaaactcgcatattaacttgacatgatattttagaaaaaaatatatatccaaatgaattctcacagtgaatttcacgttgaacaataaaatagccttcacccattgcaacgcacggatattttttctaatgactatataaagataaaaatgatgctccgttcatcccatttaagtgcggttgtagatttctgtgtctaacgtttcattgttcattttatttgaaattcttttatgattaatattttattattattagatgataaaacatgaatagtaatttatagacgcgacttaatttttttttcataaactttttaaataagatggacgatcaaatgttggacatataaacacacaatttcatttaaaatgagacggagggagtatatacgatgttccatgcatgtaccacgtggagcatcgcaccacacgcatgaatgatatatgttttaatttattattatacggacacacatcgatcttacataaaaatacctgtttgtatgtgtctatatatatatacatatatatatatatatatatatatatatatatatatatatatatatatatatatatatatatatatatatgatccatttcgtttactacatcacataattaacctataagtgtatgtataacagtacatatatcgcacaccacatcctctcactatatataaactacaccaagcacaacagggataatattgcagctagctctagctacaaattaaacttaaagcatgcagcatatacatatagatatataagtacatatatatatcatcatatgctacgtttttattcgatcgttgaccacattgatctatataatatagatactgcatgcaaattataaatgcatgtaatatagctaattaagctatagagcttgattaattaggcttggcggcggcgggaggtgtaaggtccggtgaacctccggccgccggagccggcctggcgctggcagttgaagtagacggcggcgacgggcgcgccgaggttgtagcggcgggcgaaggcgcgggtggtgaagttgtggcgcaccgccggcgcgtacaccgtctccctccccagctgccggaacagcaccagcaccatcctgtggatccccgtcgtcgggttcgggctctcgtagcacaccacctccctccctgcatccgtatcgcaaagcaaccgcgcctctcagatcatatatatcgccaattcattaaatattttatatataacgttggtcagtttattttaacctgaccaacagagaaagtatatattatactattcgaatctcgatctcatgtctcatcgatctataaatctagtgttaagtagagattgcatattgtacgtaccatatgtagcatcggttgaagccgggatgtcagtcaccatcctgcaaatacacgcatggacatatatcgataagtagctagttagcacatagatccatatatagagttccatatatgtacatattgatcgatcccgatacatatgatctagctgtactgcatcacggatcgatcgatcgatcgatcgatttatgtatgtattgtgtggttcgagatgaactaacgcacacaccgatcgaccacgtggacacaacgcatgcgtgtacatccatgacatggcgcacatttgtacggtagctgatcgacgtacacgcgtgcagcatgcattgttacaagtgtatatttggtccctagctatctatactatacacaattacccacagttttttctgcatgcaagttgcaagctgcatttgcaccgtttgttgcgcacacaggggggctgtaagtgggtcagccgcgaacccacttataggttaaaataagtggcttattttagcctataagtgggtttagcgggttagccacttataccgcgcatgcgtatgcacgtgcgtgcaaaatgatcggtttaatttattttatggaatgtaaaaaaattgacactaattaaattgattgataattaactgagatcgatgtagctagctatagctactatatagtgctcaccagtggaggtattccctcagagttggattgctagggttaggtgcatcaggatcaaccatcacctacaacatagatgggtattcacacagttagcataaatccacgcatgaactgatgaacatatatattatatgcatatatatgatcaggtggtgccaattcggtaggtaacataattaattaacgcgcaaaagctttatacgccaatgtattaacactaaaattgtataaagatggcacgaaaatagtaccagagtatatgcgacgcgaagatcgtctcccccgacttcgaccaccggtttctccgcgaccgccggtgcgcgaagctccacgccgcttatgaccggcatgccatcatcaccatacatgacggtgagatcgacggtgctgatgaagggatccaggacatctccgatcacacgccctgtagccaatgaatcgttggccatttctgacgatttgcttaattggatcgaattgctagctagctatattgtgctggggattgagctagacagcagtgagaacaaatactgcgagctacaggagcttgcagctggtatatatgctgtatatgttttttgggtgtgtgttgtcgtcggcgatggctagctgtgtagatagaattggtttgtgttgtgttgggacaaaagctacaagggttgcgtgctatttatagggtacaaactgccgaccttgcacatcacacattcgcatgcatcgttctccggccggcgcttcggtgacaaattctcctagattttgacaggtctgacaaatttatttctagcgtgtctttaatttgatttcctaggacggcagatgtatgttcaactacatatttgatgtagagactcgattcaattgtgtttgtttttaagaaaacaaaatatgtatgtcaaaatatatctctactattataaaaattaaagatgtttttgccggtattttgatacgttattcatgtttgagccggtttttaagttcattcgcttttgaaattacatatttgtatttgggtaggtttttaaattcgtttgcttttgaaaatatagaaagagtcgtataagaattctctttaaagaactcgcatgctaacttgagacaatcggactcctaattattgtagctcatgatcttgtaaaaacaatattcaagtaaattcctatagtgaatttcagtttagctaaatcgtataacaataataagattaaggctgtgttcgctccaaccggttcctgacccaaacagtacgcacggaaacagaacggtccattagcacgtgattaattaagtattttcttttttttttcaaaaatggatcaatatgatttttaagcaacttccgtagagattttttttttcaaaaaacgcaccgtttagctatttgaaaagcgcgcggacggaaaacgagagcagggagttgtgaaccagctcttgcgaacagagcctaagccctaagatatatagccttcacccattgcaacgcacgtgtattttttttaagtatatcttcatatatagagactggattcatctcgattctatcattgaaaaagaattgaggcatgcgtacacaggtcgtaagcatttctcttttcctttttaacttgaaaggaatttctttttccttttctaacaattggaatgaaatatggataaagctacatacgcatctctagcgtgtgtgctgtgcgtgtgtctgttaatttgtatgtgacagcacatcctttttgccatgtgtgtgatttcaataggcttatggatcaacttttttttttcaaaaaaaaagaagggaaagcttagaatctttgagacttgagagcgccctggagatcactgctggtacgtattcttggcctttttcgggtcaaatattctctccttcactattggcttattggttttcaccttttttttttttagcttggcccggaatggataggccgacctacagatgtgcacccatttttattaaccaaggttgaagccatacaatattgctgttgagttcactgaatttttaggagtcacactatactaatatcaatatgatctacattttaatttgacaatgattttatttgggcgtccaacatgatccatgcgattggataccctgaagcaccactccactttgtgttctacccttatctgcacctcgttcttaggctgatccatacataccccttgcccttctcccccttcttccttcctctcttcccctgggtttggcaaacgtactctagctaagggcatgttctttttttattatcattgtcagattatcgcgttcatgcatgcttttcaagtttctaaacggtatgattaatgcaaaactttcttcattagtatgtcttattagtgaactcttttaaatcaacttatcatatttctaatatttaattcgttcgcttgtgtcctcgaataattatcataaatttagtttcatccattactatgatggcaatgacttagggaccgtttgaaagtgctaatgggccctaagtcatattgcttatcctacaagctataattattctgcaatttgcctcatgctggtccttgtcaacaatgcaaacccttctctctctctctctctctctctcacacacacacacacacacaccccgatcgaggtacatctcgttgggtgtccgcatttgagttattagctcgagaggacgaggagatcatctgcaagggaggagatgccaccattggagtggggatctagctagatggttaattggggactctgcttgatccatttggtgctaattagagcaaggctaatattatagcctattgccggctacacttcattctatagctaatgctgaagccaactactcatacaataggttgcttgttggctagctacatctcataaataaaataattaattataactagcacatgtcaatgtgtatgatcaagagtgaagtggatcattattgtagccaattttgttttgacattaacatttgtatgctacagaagtaatcacaaaacaccacatagttcacacacttttctaaggaccagtagagctcacgatggcctaaggagctagtgctacctccctcttcgtccggtgagacatggtgttggtggtggggaactatggttttaggcaggaatttctcacgggggcgggagagattattcaaggtggaagaggagcagggctgtggtcgaggtggccagcggaagaaggagatcggaagcggcgaaatattgcgatggggaattttggagcgactggattttttttgtcatatatataggtagtttcgcgagtgcgggagggagaggtggagaagcgcaggagctgcgtcagagagaggggaggagaagcacaggagccggagggggacattgcactgtcggaagagaaatcgtcacggtggtctcgcgcgttgagaatcaatggggcggaggcgatcgagaggaaggggatcgggaggggagggcgatgcagatggggagggcaatgtggaggggtagtatgatccactgtggttgcacaggccccacaatgtgtgtttttaatcgccgggagcagctgcaagcgagcgataccaactaaaaaatctctatcgccgggctacaaattagtcagtcgttttcttctatccctcttctcttctctcccctctacacaggaatatgatgatgtggcatagttttgcaactcattattttacctgctcttaatgacattgatgtatagagcgtagttctagcaggaggaggaattcattagaaggcgccaataggtacttgtatattttttatgattttttttgcgatcattttctttattttgttccatattcgaatgtatggcaaccaaccaattgtttttagagatgttgcacaactttatttttcaattaatgtacaaatttctaacattttaacttaatttattaaattattctaatttcacaaaaatataaattatcctaactaaattgttcttttattgatgtggggattttcaaaggagcctctaattaatagtactagtttgataccccgcgcgttgctgcgagattttatggtgatgataaacaactttgtaaatatgtgcttacaaacataattgaagaattgaaatatcaaaaataaacattctaaaataataaagtgtaaagttggcatttgagtagtagatggttaacggatatagcagtggcttaatatggtggatggatgcaatgtatgaccaggagcacttaagtgggtcatccattgatgtgcctaattacccatggcagtttccttacttaaagcatgcacagttaaacaaacaaagatgcatttgatccgacggctattgattatcgatgatatggcttaacctggatgcttctttatagtgttaatgcttgtagtggataccaactatataggaaaagagaatgcatataaattgtgcatcaccagcatgctgagatcatgtgcaaacctgatgtacttttgaaagggagaggatcatatacctattaattataattttttctcttgttatttgtaaaatttctgatacaatatgatatgatgggacaaatcatcgatgttaactagatagcgtcccgtgtgttgcggtaatagggtattgagatgtgaacatagcattttccaaattacaatacacatagtcttatagagatatgcctaatcaaaagcaaaaataaaataaaatcaatgggccatcaatccaaattagtgaaaggtcacgagtgatacgggtggttttctgtggcagctatttataattaataattaataattaatgtgggtttcaactatatatattgtatactagttgatatcctacactttgctacgggatatgtggaataatgcatgttacgggcccctttgaatcgcagggttgaaaaaatggaggaataggaaaaatacaggattctgataggaattgaagtgtaaaacagagaattgcaaaacacaggaaaaacacaggaatggtcgtttgattggagcgcaggaaaaacgcaggaatcggatgagagagatagactcaaagggaattttccaaaaggttagagctcttgctatatttcctccaaaatccacatacaatgtgccattccataggaatttcataggatttggaaaacttcctataggatttgaatcctatgaaattcctagataaatcttttgattcaaaggggcccgacacattatataaatggtagatgtatatgtttaaataatgtgaaaatgatatggagataatgatttgacattgcttgcatattgagttctaaaaatacaacaaaattgtaaatgatatgtcatgttagcatgatatttaaaatactctagataataattactagtgagtgatgatgtgacacacttgcatgttaagttttagtagttagtgggcatcaactttatagtaaaataggatttgaaataattaactatttgccactcttacgagtggttctagaggatttgccactagacccacatgtaatagatacacgagggcccacatgtcatagatacatgagggcctacatgtcatagatagcgaatggcaaatccttaattgacacatcttaaaagtggcaaataattaaatgtccctttatatacatataaccggatgattttgtgatcactattcgatggtacaacttaattaattaattattgtatagttgaaaattgaattgaaaatatttatttaataaattgatatacctctctagtttttacaaaaatcggacagtttagaggcttagaagcgtgttgcatgcattaatccattcttccattcattcgaaaaagaaaaggcatagattcttagcatgcagtacgtgtatcaattatatgtagaaacctcatgtaagaaaataatagccacaaaatttgtcaaacttgattctgtcttcactggatgattaactgaaattgacataacagaaacagattcaataaagtacagcaaacagaggcgtagaaaattctatcaaatatattggctggctagctctagctagctagctttgctctcttttcacaaatttcctcacgtgcagctagcccttcccagcttgtaatactactggtcccttgcaaatctatccaagctagcgtttgtgatggctatggatgtcacgtcgatcgaccggaccgggtgcccatccgatcgatatcgataaagtccgaccgtccgatcgctttcgtacattttatttacttctttgattgatcctgtttcgtgatcatatgtgggccggccgatagttgtccgtgatgaataccgatcgacggtgtgtaccttggaatgaatcgttggcgcagccggatttttgacattctagctagcgatgtttacgttatctagatcaggaattccatgtctttttagagtttaggcaggaaagaggcggatagtgtgtagtgtctttttcattgcaaaagctactcgagataaagttaattagaagcggtgaaatacttttctggagagatcatgacggatgaaactaaattttattatagtacatttgcgatgtaattaagagccatctactaccttcactacaagagggcgaatccctctgtaggtttgttccaaaaaacctttcagtcctcccacgagtttaagtcctcccacgagataagtatttaattatcccaaattaatataaattggttcttttaggcggttttgatcatattgcaatcaagatcagaagctattactactacagaaaagcaaatagggaacgggcgtataggtgccggaaacacaagaactggcacccatatggcttttcccgctcacgcgcatgcccgtgggagcgctgaaggataaaaaaccggcattaatgagatgttattagtgccgattttattctttgtaataaaaccggccggcactaatgatattgtatcgattcattaataaaaattggcacttatatgtgtttcatcggttcttataaccgacacttatatgtcatatattggtttcgttctttttaaaaccagcacagatggatcgtggtgagacattcgagtgaagcgtggaggccaccgacaaaatagttttttatttcatctgaatcgctcgatcgtttatttaatttcgcctctggatccttctcaacctcatcgtttgccacatttctctctccatcgctcatccctagattcccttgccccttctctctcgcttctcccagcctcctccacctcgacggtgatctcctctccctctccccaaacgacctcctccttctcaacggcggcgtcatgtgctgacagcggggacggctagatccgaagctgggatggcttcatgggcagccaaatctagagttagggcaacagcagggtggctcctcagcaatggtggcgatgcagggcggtgcagcccgttcgactgcagcagctccatccctcttccttggagcagaggcagggacaacggtgctccgagcaagagtagggtcaagtgctatggcctctgcctcacccccaagtaccttatcgtgttcccctttatctttcaccgtcactgccacccatcccttcgaggcttcgacaatgagaagaagtgccaacaacagtagaagttcactgatttgttaagtggttttgataacaatccggcccaggtggggttggccgaggcccaacaaattaaggttgtccgaaccccaacagttcttaggcccacccactcggggaaaggcccaatctccctaaaagactagtccattaggggaatggtggctctcccttttaaggtggcttcctcctcccaagctaagcaaggtgggattattcaaaggctcacacggtcgccgcccgacttttgcgtcttttgccaacgggtaatagtggaggatgtcctcatcaggtttagttctttagcttccaagtcaaatagttagaaattattatcgtcaaatagactatttaatttatctcacattagtaaatgacttagtatttgcggatcgtggaacactaggcgacatagttgtggatctcctcctcaccatcgctagaggggagcgtcggattccggtagtcctcgagaaaggtgagtggtggtagggattgcggcgacaccctctagctagaagttcctaggacatggcgtggcaggaggctgtgacaggtggcactggcgaggcaggggggacagtggcatgcaggaaggcaaggcaagaggatggtggtagcctagtgtggagatgtcaagtgaacgggctgctcttggacccaccaatggatctagccatgccttgtgcggcgacaacaagaggatgacgtgcggtagtggtggacgtggtgacggtgggcttctctattagtgactaaggttccccggccagatttggtggcaatggtgggtgcgggtggctacaatgccatttctagtcgccactgtggaaaagccggttgtcgttagagtcatgacattggagatgccacctatctttccataggtgatgtcgtgatgcccctccctcatttgtaccttagggtaaactctctgaataaaatcattgttctagatattcagaatagtgatgacgatattctagatgtcatgaccttcttataaccgttgcattggaagttccctaatgacacgatgtccttgtggtggtgtacccgccagatcgggttcaataacaatgatggtgaaaaaaaatctagacaaataactgatttatatattatattatatataatgtacatatgtgacttgtaattaatatttatatatattatatatgctacatgagactctcctactttctttcatagtaaaagttactctcctgatgttataatttgctttggttaacatcagtcgccggtggtgatagtagcaacaaaataattaaatcgacaaagaattagctattgatttcgaagattttgagccattgtgacaaataattgttatacatatatactctggctaaccatacaagaaaatcgatctatgtatttaaggtggtatttttaattactccctccgtccaaaaaaaactaattctgggtttgaatctatgtgtggtttgaatctatgtgtctagattctctatgtccagattcaaacccagaattggtatgtccagattcaaactcaggattggatttttttttggacggaggaagtagttttctagtctttagttatttgtcatgtaacctccataataattggttagaatgaattaaattatttaaaaagatctcatattagtcaagaaagatatactccatccttcccataaaaaccaacctaatactgaatgtgatacatcttagtacaacgaatctaaatatacatctgtctagatttattgtcataaattcgtttttttttggatggagggagtacgcatgttgctcagatcgtacatggtaggtgtgatcatgtttgcagatttccagttcgatttctaccagccgcacgccaaaccttcgatccacgcatatgcacctagtaaaacctgaagatagatcgatgtgacttgcattgagaacgacatcgatgcacatatatatttccacatgcatgtcaccagagcaaaacgtgagaaattgccgaacgaacgaattgaaggcatgtgcttattaattgtttagcacgtacgacacatatacacgtacacgtgttcattgaagtcgtcgtagttgcacccccgccgttaagcaacaccgacgcgatcgagtcatatgtctcgaagaccaagaaaacggctgtgctactgtgctcccatgcaattgtacaccgtccagccaaaactgtggtgatcacgacagatcgagatggcctccgtccatataatcaatgatcaagatgcaattaattagctgcggggaagcatagatggtgtggtggtgtgtacgataaattgaacccatcaggatttacacataaatattgcgcagatgcatgcatgttttttatggaaaaatttagtaaaataaaaaagtgttgttggttttagtcccgattatctaaccgagactacgaattcgaaacaagatcgatctctagtcgaactaaagagagaataacagcagttcggatggtcccctttctttttttttattttctcccgaatcaagtggcatgcatatccctaaatctcaaatcaaagtaacatcccaaatccacatcacaaatcttaaagttacttatacacataaatcaaatacatcgcaaatcctaaaaaaattacacacaaatcaaattacatcacaagttctacaaaattcatcgcaaatacatcacaagttcacattgcacacaaatcaaatacatcacaggatcatgcaataaatcacaaattcaaaaaaaaaaccatagaggcgccgcccggccagccgctgccgcctcctctctgcaccggccggccaccgccgcgccgccgcccaccgccaccgcgcaagccgccgccgagccggccgccgcctggccggcccgctctcgcgctcgatctcgctcaatcaaaaaaagaggaaggaagaaagagataaggcaggagttagagaggaagaaagaaagaaagagatagagtttgctgtgtggacgagagaagaggataagtaatagggattttatagtacgtgttgatttttattcccggttagtaacaccaaccgagattaaacttagatctttagtcccgatttataagatcctaggcgcctgacacggaaccaatcgggactaaaaatcatctttagtcttggttggtgtaaagatcatttttagtcccagttggtaacaccaaccaggaataaagatcatctagtcctgttgttcttataaaccgggactaaaaatcgtttctagtcccggtttttaatggaaccgggactattgtggatttgggtcaaccgaccaaagattatttctccaccagtgttattatacgtgtattaggaaatacatattcatagatgtgtgagtgtgtttttgcatgtgtgcacttttaccgtgtactactttgctcatcggattatgagtgtgtacaatttgtgagtgtgtgagtgtggagtaataaaaaaagacatatagttaggtattgttagttactttctctctctttttctttctttctctttctctttctgttttttaaattaaagttaagataagaagattacgtgaaaaattaaataaaagatgattatcatcatttgagatgagagtgaaaaattaataaacaagatttaaattttagaagtaaccacaatacgaggacggagatggtaaaacgtaacgggaaaggtgaaaaaaaaattggcattcacctttgaatatatattcgatctggtgtaatgttgactgaagtgaaattgaacccttactttgcctaccgctttcaataatcctgtaggctttgtgtcgtactactcatcggtccattcgttttgctcatcggattattcaaaaaatgagagagggagcgttgccatcaataactaaaaaaaatctacatcatcatcgcgagtagcagtctgccaggtaatttagcacctgcggaaacatgaccaatagaagaacgcaggttgacttcaaacattctcctgttctccatttcggctctggacggtggcttttttcttgatacttagaaaaccactgctaggtgaaatatatgctagtacacgaaatatagtgactaagaacatttccaacagagtggtcatcccactctccaagttaaaatttgatagctatggactaaaaacgagcttcaatagtattgctaaacggatggccaagccatctggctggccaaactggctctctcagtagccaaacttggccagtccaaattagcttaccaatcgtgggtcccacgtgagatgctctctccctcctctttctcccccccccactctcttccggtggccgatcgaggtcaccgtcgccagcttcccttgcccgtcgtcacctccagcctcgcacacgcggggagccgtcgcctcccgcctcacgcgcgtgtgtactcgaggatggatcgatgggccgatgcgggagaagagaaagaggaggaggaagaaggcaatggaggctgacatgtgggtcctttatcattttggagatgtaaatatagagactgttgaagtgaacacctagtttaactatccaaaccagttaaagagttggctatatcagtatttggagagtctaatttggagatgttgttggagatgctctaatcttcttgggctgtaccgcaggttatttgcctattaatatatatactccatagtactgatcatttataatatttaataacgaaatttggttgtaacctacctatttttttcatattctcaccagctgacttcttaccagctgtttctcaaaattttaaacttatctaaataaggtctatatacccaattataatcgtaaatctgcataaaagataatatgttaccgacaacatgtcatgcatcaatttttcccacctacctattctacccatctccaccttctatccatctctaattctactctagacccattgaataggtaagtattgagctcatgagtagtcaatgctatggctatggatatggcgtagctagccgtctactgctggcctgcggctagtagttggctattagcttaccttccgatttttgctgctgcagctagctagtgcagccgagtaagctcagtagtaactataacctagtcaatacaccatgtttgttatagaattgtttgatttttcaattacctgaaaatacccacaaatttcaatcacctttagatggtatagattatgctacaactcgtatgctacagaaaccttgtcctaatctcttctcccctctcaccttgtccttaagaaataccttttcatagacgacttccctatagaattataggcgaggccttcaggaggaccacctatgataaggccatttcgaggtaacgctagatcgaacgctcgcctccccaatgagcgccactacctcctcgaccactaatgcgtcgccttttataattgttcgcgccaacgagactgctctaactggcttcctcctcctccccttccccaccttcccaagccgggcagcagtgaggacccctgccatcttccttgtctctagcggctcgcgtcattgaagacacccctaacacccccccgcctcttaaccacccaaacttccacgctcctgccgacctctccacccattgcccttcaattctacaactatgaaggaaccactcccgcctcgccacccacctatgtttgccgcccaccgccattttcgtcgccctcggctatccctctaaatccgtgaaagctctccgtccttcctctccccaccctttctcacatcgactcccaccctggaacctaaactctaagttctctgcaagagtttcgatgctttgagcaccgtcgaggagtcacatcctctttcaccgttagttggtgagttaattaccccctactcccttcatccgtccccactcatggaattcagtgttgtattaaagggagttcagtgttaggttaaaggtgattgaagttcatagcatcctcttttttttttagtttgaactatggatcacatgacgtatttaacttgtgacatgtgcgcaacgactttgctaaacatctctgatatttgatgttttcctgggcgtaggatcgtgtgtcaagattagtgcaggaaattacagttctatataactaaaattacattcgtaaattcagttgatatgacatgtaaatgtattgtaattggtaaaaatgttgtgcaagtaaatatgtatttgttattttctttaaaatataaaattacagtgctatataactaaaattacatttgcaaattcagttgatatgaaatgtaagtgcgttgtaattttgataaaaatattgtgtaagtaaatatgtattgttgtgttcttttttagttatttggatgtaaatctaagggtagaaaaaacctgggtgatttttttttttagaaatcacccgacaaatggatagacagttccgtgtcgtaaacgcctttgacccaaacagaaaagtgtagtaaacataacgaggcatccccccacgattcatgattttttttatttttacatttttattaaaatatttacaaaaacatttttttcaaaatttacaattctagtcgcctctcgccctctggaagggcattttttaaaaatcgtccttccagagggctttaggggacctaaatacaaattttttatttgtgttcaaactctttccaccggttttaattgcttaaaaactaataattcttattcgacgctccaaatgattttaaatggaaaagtgataagctacaaagttgtagatatcatccagatctacaacttttatataaagtttatctccatccaatgtcgtttgaaatgtagatatgagattttttaaaaaataggttttgcattttgtaacgaatatttggatatctaaaagatcttaaatgaaaaagttgttaactacaaacttgtatatctcctcgagctctaaaatttttatataaagttttatttcatttgactttatataatataattttaaattgtaaaatcatagagttgacaagttatactggaaaatttacatttaggtcccttaataccctctgtgagggtgatttttcccagcgggcgagaggcatttgtaaattttcgaaacaaaagattattttttaaaatattttaataaaaaaatatataaataaaaaaaattccacgattcatctcattagcccactaagcaaactagtgggcccaatagcccaattccgtggccccagaaccagcgcctccgagcccagtgggcccatcttgtcagtgactgacaccaaggacaccgcgacgcggccccctccgcctcgcaaagcaattttgccattctcccgtttcaaacccgcgctctctctctctctctctctctctccccctccctgccgctgctgccgccaccgccgcggcggcgccccgattcggtgatcccccgctcgcccatctccgccgtgacgtatcggcgacgcggagggagccccccaccccccacctccggatctagggtttcgaggcccaggtggcgttgcgctgcgcccccgctcctccgcctctcctccgccgccgagggttcgcgtgaggtaaccgacgcgcccccgtttggtaatcgcaccggcagatatcgtgggggttcgtttctccgtggcgtgttttggtgatggatccgatctaggtttgttttaggggctattttgacccaaatttcaggtgttttgcggagattgtagtgtttctacctagaaatactgcgattattggtgcgtttggagatgccactggctgtgaaatttcctgtgggaactcgtttccagttcgctggggatttatggaatggttacggttttgcaatattacgggttttgcgaactaaggcttcggtttggtcgctcatgggagcaatatttagtacgattgtcatcgccatttctgcaattccaccagcgattggttgctctgttcgtactcccaatagaaagcttgctccgctgctgatatttaaagtgcttcgttggtggatttcaactgcagatgttgggctctgaaggaaatggtgcaatttcttcgtgcatgatgctcgtatattgtgtctattatgtagtcctgcctgcttcggtggttctagatgctacagctttatctgccattctatttatgctgcattctatgttcagggcatgcgcaaaatattattgaaatgatcatttacttgaagataattggatttatttcattaattgctccgtaagccttgattcataggtagtattatgctttttttactactaagtctgtagaatcccatctctcctgcaatagctcataagaaagtgacatgttgtgcgatgcagaactggttctgaatgcatagtccttagtgcattttgagctaccctttgtcaggactgtagtctctgtaaatagtgggagaattcattggctaaaaagatgacaaaagctagctgcttatcagtattaagtgtcgcaccatttcttttatcatgcgagtagtgcaagtgcctgaagggttatcccatttagctattccaaatggcacatacgaaatatgattatttgttcatttgatccgtgatacttaggtagctatgatctgtctctgctcggtttgtttttctgttcagacatgcagaatacaactgctgtctgtattcagtttatatcttgcaactcataattctatgtttctacctgcaggtttctgcgtattaccagctctgtacttaatttactagtgagaagcaaaatgaagtgcaatgcttgctggcgggagttggaagggcaagctgtatcaacaacctgcggtcatcttttatgtatgcctgcaatcttccttactagttttgcttaaccagtttctcattgtaaactaacattgtctgctgctattgcagtatacataactgatccttgctgatgattatccgttgagcaggtacagaggatgctaagaaaatactgagcaatgatgctgcatgcccgatttgtgatcaagtgctttcaaaaaggtctgttgtttactcttgaagttgtattcattatctcatactacattttctcttctttcctgtaagctatttttgaatgtacatcatgatttgacaattagggatgccaaaagtacctcaaacgcatacatatttatcatctcgatggttattgccatgtcatttcatccgaatgggtgcttaacacatggagtttactttctagcatgctttgaagcttttatacttctttgatgtgttcgagtgaaaatggactccagtggtttactattttgagacagtctaaacattataattttttttctcagccatatgagacctgttgatacaaatccaaatgatgattggacaaatgtaagttcgcttacgattcattgtagataaaagcaatccttctttttctaacagccagtctgctcattggtacagatgtcaatggctggagtttctccacagatacgtatccttattattttctcattgtccgtaagattcttgtgctacttttgttgaaaatcatcactaactgctatatggaatctatggcgtagctagcctcttgtcctgttttattgtcatagtaatgcaaaaatctgaaagatcaaaattgtttatatgattattgtctaaggcttggtgactattcagattttccctaactatgatgctaatcagttatgaagagtgcatacagaagtgtcatgttttacattgggcaaaaggaactggagatgcagtacaagatgaacagaattgttggtcagtgtaggcaaaagtgtgaacttatgcaggcaaagttcactgagaagctggaagaagttcatactgcataccagaaaatggccaaaaaatgccagttgatggaacaagaggttgaaaacttgtcgagggataagcaagagctacaagaaaaatttgctgagaaatccaggtcagtatgtacagtacatttctagtttaattctcatatgaataaacctctgcttcatccaacttatatggagaattgactgctgtcatttccaggcagaaaaggaagcttgatgagatgtatgatcagctgagaagcgagtatgagtcggcaaagcgttcagcaattcaacctgcgaacaactacttcccaagagcccagccagacctgttctcaggcgtgcccaacataatggatagcagcgaccctctgagacaaggtaatttaacatgttatcattcagcttattagttctctcataccatataactcatcctttcctctgtgcacacccttttgttatgcttccaaccagaaaaactgttaactgtaatgcttggattgctagtagccactattaaatatataaaagttaaaatgcttttagccctccacaaaaacagcttattcactggctgcaggattggctggtcttcctgaaactccagggcggagagatgagggatgggctccaccaccaaggcaacgtcggtccacctctggaccatttgagctgtctgcgggatctcctgctcacaatgcggcgcctccggttgatattaggcccagacagccagcacggcccgtattcggcactgccatgaataatacttctgcagctctgcgaaatatgataatctcgcctgtgaaacgtcctcagctttcccgaaaccgtccacatatgttcacgtaatgtcctccttattgctcatgcatgtatttcacatctaaatgaagcagtttgggaatgaaaattgatgtccaacttgctcaaaagaattatttcaacagtaacatgacatttctacgcttgccctttcctatactaattcatggaaatgtgaaatgccaggttgtagaattggaagagctgatgtggcatcctgctttggaatctgtcacggtcttgtcatggacttgctaactgtaaatgcagtaagatcaatctgtctctttccctcacttcaatttctgccccatcatcttggtgtatagaaactgttacagaagtcccttgggagaagattgttagggaggttctgatatatacttggggcgcaaagtcactccttcctgattgcaataacacgtagtgtatctgcagctaaattcttggactttgtgactgtcatcacactaaccatctactattagtagtaataatttactactgctcggggtggactaacccctgaatgatggggacggtttttctaggattatgttctagggaccagtactgacttgtcggatgcgggttctatagctggaaactacaaagggatctgttgtaatcgtgccttctgttgtttattatatttgtagttacctaaaatgcacttaaccagttcttcattgagctatagtacagcacatcgtggtcctgaattgtagaagtggtacgtggcatgctatttgtatgcaccctagcaaactcatcagctcgagactagcgcctttcggcctacctggacgaatttttatacctttctgtcaacaacccaagggatatgtcacgccatcgcccatcgatgatcagctgacggccaccgatcgtgaaggcgagaggtacaggataaatactatccgtgatggctgcgtctgcattttttttttgtttagcattgttcgggtgactatttatggcagcgggccagctgctccaccgagctgaagcctcgtcaccgcccacgtacggtgcggcgattggctgggcttgcgctcgccggagacgctcctgatttaaattaatcgaatgatgaggagattttgttccagctaatccctcttgaggttgacagcgaaagcggagaaaacgaaacctgccgctccaatccggagggtgacgctgggccggctgagcacgtcagcactcgccattgaaaaggattacggggtgtttgatttgatgcttcttgtcgcaacgtgatagtactttaatttgaggaatgtgttgggttaattgtactaacaatcatggttaatcgtactactctgttaaaaaaccaatcctagtttatatgaactaaaaaatcaattctaattatgaacctaaatataatcctagttatgaactaaaaatcaatcctacataactaaaaatcaattctaattatgaacctaaatataccctaggtttgtagttaggattgaatttttaatgggggtggaggggtatttcacttatttgcccacctggtaaagattattttacggccaacgcaaataagtgaagtacgatttgaattaggagagtattattgttcagttcggttagtgactagctttagcaaaccacacttaaacttcctattatgtcttaacaagaatgtgtggcttacgttggaaagaacggctagcagaacggtagccataagtaaattgatgtacgtcatatatgggaccatatagctaaaatgagctacaatgcgtggtgaatctcatctaaaaaaaatgcgtggtgaatcataatgatggcaataaaatcaaacaactgctatgctaagatggtctaaagataaagtgagctaagatgccttgtgatagtctaaagtgaaagatacaaagatagctatcgcgggaaaattcctgtgtattctctccgtttaccgttaactttttaaacattcctatcatttcatttattattaaatatacttttatttattattaaatatagtttacatgcttcacaaaatattttaaatgacgaacggttaaacgtgttctaaaaatgaatggtaccaaacatttaaaaaatatttttcctttcataaccatccaaacaaggcacactcaacattcgattccaacattcgattcctaatactgtgcttttcctgtttctgtagtttttgaaatcttttgttcaaacggagcaaattttgttgaacttagatactaccagtactattatttttttttgcttgcgcatatacacccggctggcccacaagtcaggcacacaccgagaccaaaaacccccaacaagggggaaaaaacccaacatggctactaggagagctacctagcttccttccttcgccgttcacagccacttcgtccaaacactttggggagggcaaactgaaacggaaaatactactgcgtacacaaatcgttggatcggcaacaagagcacgaatctcaaagcggttacagctttagtagccgctgtccaccaccgggaacgcgtacgccggcgggtagtcgacgccggcgtcgacgacggcgttgccgaacccgtcgccgccggtgtagaggccggtgaagtcgaccgcgtcgtccggcacgaacgcggcggcagctgcggcctccgggccgcagccgccggcgtagaacccgtctgcggcggcggtgacgaggtggcggtcgccgtgggtggtggtggtggaggatgagtcgaggaggaggcgcggcctcttgacctgatgatgcacggcggagtcgtcggcgttggaggcggcggcgttggtgttgtccctgtcgacgaggcggcgcagcacctgcgggtcgccgacgaccttgacgaggaaggcgagcatctgcttggggcggcgctccgtctcctgcacgcggcgccacatcgcggcgacgcggccctcgatctcccgctgctcccgcctcagccgcgccacctccaaggccaccacggcgctctcctcgtcgacgtccccggcggccgcctcccctccgccgccgcaaccgccggcctcctccttcctcttcgctccccctccgccgctgctccgtcgcacgatccggcgcagcaggtgcgtctggccgcgcaggaacgacacgtgcgcgaactcccacctgtccggatcaaccttgcgaaacccctgcacaatccattgatgacagaattttgaatataatcgagcgagcaggaagcagggaatgggatggaaggaaagcgagagcgtacgtaggtgttgagctggcggacgaagctggagaagttggagtgcttgaagtgggcggggaggagggtctgggagaaggcgaaggggtcggcgacgacgaagctgttgctgtccctgccccaggcgatgacgccgtcggtggccgggtcgtccaccatccggtacgtcttcgccacgaacggcgccaccccgccaccgccctccgccgtcgtcgtcgtcatcacccttcttgctatactagtagtgctagtacagtggttggtgttggtatgcagtggaggaaatgcgggatgcaggggatggtggagtgacgcaaattttatacggggatagcgtagcgagaggtggcaaaggtgatcggcagggggaggacgcgtgtgcgcgccctggaccctcccagccacaagttctcgcgacctttttcattccttggccgcggtcgctttggggtattttttttttggctcgcggcgcgcgtgcgtggacttgagggagggggtggggtgatcgcatgtcatggtcgtggacgaatcgcgttggttgggatgtggagtgacctggcggtgtgggccaatggggcttcgacgtgtccgaactcgagtagctggggggccaattaacccaacgcaaccatcacgctacggaaagggcaagtactagggtaccgagtaactacggctactcctcgacggtccaatgcgagaagggcatagtaaggccgtggggcgtcgcgccgctggctggggtgtccgtacagtcggcaaccacacgcggcagcgagaggatatagatcacagtacacaggtcaccccgcggcagcgcgagcctacctgggcgcgccacgccttgcatgcaggtacgcgtctcacgggaattcgcgcgctggctccgcttgccccgtcgctcctccgtactccgctactgtctccccaaatgggccatgccagcccgtctccaactctccgtgcatgtatgcctgccaatacttcggtttggataattttagtctctctcacatcagacgttgagatattaattagaagtattaaacataaactaatgataaaacctattccaaaactctggactaatttacgagacgaatctatgactagactatgtgacgctacagtaaacatgtgctatggattaattaggcttaaaaaatttatctcgtgaattagctctcatttatataattagttttataattagtctataattaatacttcaaattagcgtccaaacatttaatgtgataggaactaaagtttagttcttggatccaaacaccagcttaccatgcccaaataggtcagtgttgtggataacggttggtacggccgtatattcgggcattaatacgttggcgccgacccctccgtcacgaatgagcaaaacgctaaacattaatcgttttaggatgtataatcaccgtcattagtgattaatcggccgtttccgactattcggccgaataaacggccaaatcatgtgacaaggccggaaggccctgcccagccagcccacgatactggcccattagttgtgtaacctagcaatatatagctacagtacgtcgtttgtaatcaaaaaccctcgcaactcattcctgaagctacaacctgcaagtctagggttagttcttttcatctaatcctctttcaaatccaatctccatattttgttgttgtcattttaatcttctgtttgaatctcgaacaggtgagcatgcttgaagtttttcttctatcaaaaataataagctattatgagttatgtacatatatttgtacaaaacattaaatttccgtcaaataccaattattcgcccgtactccgattaatcgtttagcggaaccctctccgtccgacatccgtgttccgtcatccacaacactgaaataggttatttgagaatagctatatatatatatatttatcgataaatcttttttctaaaagtttttaacaaatataagtatagtatatttattgtatattgcatgtacctataatacaattgatatgtaacttttaaaaatctcatggtaacatgttatttttgtgaaccgaagattatgataccgaatctcctcactacgatgccactgctgacctccctctacacaccgccgcccccggtgccgcgcgccgcagccaccaccgccccccgaagccactccgccgtgtgacgccgcctccgaagtcccacgcagcagccgccaccactccgccatgttatggcgtcgccgcagccactggcgtgcggtgttccgccgccgccgccgacctctccctctgtgcgccgctcgcaagagattagagagagataggattggcctggatagggttgaagtgtgtcgagggtattttggtcaatttaaatagtaaatattttttttttctaattgaaatcctaacggtgtaatgaaaagagggttaaacggggtgttcgattttgaaaaacgtggtcaaataagcaaacgcgtcgatcggttccatggatcggtggctgggtgggcatccctgcatccaactatgaactaccagtgccgatcaggttgggagttttggatttgtcctcccccacgtctcggaaattaacgatttcacgaaaagaaaatttttgggtgtcacatctgatgtttgaccggatatcggaaggggttttcggatataaatgaaaaaaactaatttcataactcgcatgaaaacagcgagacaaatttattaagcataattaatctatcattagtacatataggttactgtagcacttatggctaatcataaactaattaggtttgaaagattcatctcgcgatttacatgcaaactatgtaattaatttttttatctatatttattgcttgatgcatgtgtcaaatattcgatgtgacgtttttagaaaaaaaaaattagaactaaacaaggccatatataacgggcggcaaagtgatcgatcgaggtgattatttttccttatcttttttcaaagagataaagatgatcttaacagagagagagagagagagagtagcggtacgtaacctggggcgagtgtaacgccttagattcggagatgggttttttccacatggcgcccacctcgtttaattttcacttgtgtagagttttttttttatttttttttatttttttatggagggagtactgtcatctcgtcaaacaaaacggtaggcaggcgggtttgaccgacggcgccctttctaattccgtggagtcccagtcacgtcacggcatgcgcatgcctaatctgtacaccgagccttaggtggtgtttgggtccacggacttactttagtctctatatttagataataatttagagtattaaatataaactacttacaaaactaattatataaacgaaagctaattcacgagacaaattttttaagcctaattaattcataattagagaatgtttactgtaacattacacagactaattatagattaattatgcttaatagactcgtctcgcgaattagtccaaaattatagatgggttttattaatagcctacgtttaatatttataattagtatataagcatccgatgtgatatggactaaaaaaaattttttagtccctgtcttagccaaacgaaacgactacttgtagtaggcagcaagctaccgttacaaaacgacaacccaatccgggggtatggatgcaactgtctttatctcctctattagtagtattgtaaaaaatagctaggtggcctgtgtaattgcgctaccccatacgtttatcatatcttctttatttgcttgcttgatttactactatttctattcattcttcttgaaacctttaaaagttagatcttgtagtttttagagtttattgtctcgttatgtttcatttttataatttctagaagtcccgtcaaacgctgccattatacttctctacggctcgtccactgtcttttatctttattgtcattaggattttaaaaatcgaacataattatcgtttggttttatttttttcctttctagaagtcctgccaaaccgtcaacggctttggcattgtacttctgttaacgaccaaatttggtaatatcagcatcagaaaggaagattagatcgaagcggaatcaaagataaggattatcgcggaaacagagtaagaatcggctggaatccggatcggctacgactgggatcggctgagtccgagttagactgggttaagtgatatagccgattccgacaatacgacttggtggacgacatcgggtctagttgatatgcttcaagataattgccatgcatggatagagtccagggaaggcaattgtatctattaatttagatattttatgtaatttccttagagatatgtttgggtaaaaatctgccgcaaaggcttatggtatcttaaagtttgttagagataagagtcgtgtccgatatggacatagtttgtaattctcgggtataaatagatcccgaaccccatgtaattaattaacacacacgttcaatacaatctcggcgcatcaccacccttttttgctttcgttttatttcgacgagttcttgctttcgggttgagctgcatcggtttcgattttcaacaataggtaaaacttgttatggcagcttgcattctcaagattagtacttccatctttacgatactctaattttgtttatgtaattcgtcgagttatcatatatgttgtataatctgtggcaatatcatcacaggggcgaagctatagccatctatcggggtccactgaccccgacgatttcttgtgtacgtttcttactccacttaattttaccgtgtatgaccccggtcgataaaaacactagaccctggtaaccatgatttgttatagcctgattaattagcaacttgaaacgacacgtttgagattagcaagcaacaaataggaattagctagcgctaatgattatacgtcagcccaaaggcccaatatacattttggtaatcttagcagtgagtatttgtgcatttaatgtctactttgtttacatattaattatgtccggtttttaatacttcctccgtttcaggttataagactttctagaattgaccacattcatatagatataaatgaatttatatataatatgtagattcattaatatctatatgaatatgggcaatgctagaaagtcttataccctgaaacggaggtagtataatttatagacatgtccgtgcgttgcgacaatctcatatgggccaatggttgctcgtagcattatttaggatatggattttcatccctcgaggggatatcccctcattgtttgcatgtcatctaaatagttataaaaaaattgacaacataggttgataagaaatatatcactctacaaacatgcaaaatcaaatttgacttctacaagttacaacaaaaaaaataaactgaaaatagttatcgtacattcgcatttatatttgttatttttgtttcaatttgtagaagttaaattttaacttgcatatttgtggagtgatatatttcgtattaatctagctatttagatgagatgaacgaaacgagggatatcccctcgagggatgaaattactttccccgttatttagttttctgttgggtctggtttttcccccttttttttttctttcagggtggatgataaattctgtttttatgtagtagagataaataggcaagcaaagtattatggagcgattcttgaaaccccccccattattttagaagatctaacaatgtatcatacactaaattagtattgaccccgtcgaccatttatcctggcttcgcccctgtatcgtcatctaacctacaattggctaacatctgctaatagagggcagccgattaggttaggatatcgatgttggtttagattatatatgatatctaccactctatgaaacttccaatggcttgattgtctagatattgctcttcttttcatacttatagctgtatcagttgtttgatcttatgagtcatgattaaaatctcaatatctagcctgcttcttggttgccgattagggtagtatcggggtttcagccgatcttacctgatttaactatatttgctttatatgctttaccgacatgttaaatctgccctttatgtcaagatcttattgcatttaagtatattaggcttttgtttggtatattttgcttggtttaatattttaatatagagttgtatcggagtattagccgatacgtgctagatctatttgatcggctatgctatgaacatatatagtcttgttgttagtatatattttaatctaagtgatttatactgtctcggtatggcgaccgatctatcccaatcacttgatttaagtatatatcgacataaggattatatattgttaatatctacagccgatcgagtagatttagttctttattatctacctataactgccgatcgatgcatatatgacatcggctcgaagataaatgatatgtcatcggcacttagtcgatcggctatagtttatggatttaaccacgttttctttgcctttgtttcttgttaattgcaggatcaaatcaactggcacgctagcatacccgaaggcgagttttggacctgcactggagttaagcagatctcccaggcctcgtgtttttcatcaacaacttctttatggctcgcattctacatcccttattatgtcattgagattttaaaatcgaacataattatcattgggtttttttttttacttttagaagttctaaacctttaaaaattaggccttgcagtttttagagtttattttcttgttgggtttctttttttataatttttagaagtcccataaaacgatgccactatactcttgtacggcccatccgccgcctactctttattgtcattgggttctaaaaattgaatataactatcgttggaattcattttttattttccagaagtcccgccaacgtcggcagctcttcaactataatcctatacaccccgcccgctccttctcctttttattgtcattgagattttaaaaatcgaatatgattatcaatggggtttattttttttactttctagaagtcccagcaatcgccttgcacgtttgcttcacggcctgcctgtcgtccttccttttaatcgttattaggattctatttggtgtttattaacaaattttatatgtcatatcaaccaccaccactctacccctttatacacatgttactcaatttatctcgtcatgtgttttagatggtcttttctttcaatagtctttatttttatcaccaattttagttatttacaaattgtattcctaattgaaatcttttttttctttttctaatttcagaaattttttttcaaattttaattaataccgtacagtgttctttcaatatttttattttttatttttgaatttcagttgtttcaaaattgtattcctacttgaactctcttttattttttcaaattttggatattgttttatttttttattctgaattttaattaatctcgtattgggttcttatatggactcttgtctcattccttagttttaattcgaatttcagttatttttaaattgtattcctacttggactcttcttttccttttctaatttcagattttattttttttattccgaattttgattaatctcgtattgtgttcttatatggactcttcattcaacaatgcttatatttaattccaaaatttagttatttttaaattgtatttctacttggactctccttttctttttctccgattaatgtgggaatttctagccccctagtaaacgtggtgcctcctttcaaagccgcgcaattgcgcggctagcacccatataaaattatatatttatttaatatgattttacttaaaacttattaaatagttatctcattgtcttaggattttaaaagaccaaacataatcatcctcatgtttctaattttatagtttttaattgtcacatagttgctaccccttacttctgtcatattattatttattagcttgctcgatatactactatttctattcattctccttggaacctttaaaaaatggatataaaaacttatagtttgagtttattgtccagttgggcttcttttttataatttccataagtcccgtcagacgctgccattatacttctctacgaccatccaatgcatcttctcattattgtcattgctattttaaaaatcgaacataattaccgttttggttcattttattttattttatttttattctgaattttgattaatctcgtattgggttcttatatggactcttctttgaatagtgcttatatttcattctgaatttcagttatttttaaattgtatttttacttggactctccttttctttttttccgattaatgtgggaatttctagcccccacagtaaacgtggtgcctccattcaaagccgcgtaattacgcggctagcacccatataaaattatatactttttaatatgattttacttaaaatttattaactagttatcttgttgtcttaagattttgaaagaccaaacctaatcatcctcgtgtttctaattttatagtttttaaatgtcacatagttgctaccccttacttctgtcatattattctttattagcttgctcgatctaccactatttctattcattctccttggaacctttaaaaaatggatctaaaacttatagtttgagtttattgtccagttgggcttctattttataatttccataagtcccgtcaaatgctgatctaccactatttctattcattctccttggaacctttaaaaaatggatccaaaaacttatagtttgagtttattgtccagttgagcttcttttttataatttccataagtcccgtcaaatgctgccattatactcctctacaaccgtccaatgcatcttctctttattgtcattgctattttaaaaatcgaacataattatcattttggttcattttttttactttctagaagttccgccaaaacgttagcgactttgtcactgtacttctctatggcctgcccgctgccgcccttctttattgtcatcgaaattttaaaatcaaacatgattattattggggtttatttttttattttttggaagcctgaacctttaaaaattgaaccttatagtttttagagtttattgtcttgttgggtttcatgttttttataatttttagaaatcccgtcaaacgctgccactatacttttctatgactcgtccgccgcatactatatattatcattgggattgtaaaaatcaaacataactatcgttagaattcattttttactttctagaagacccaccaatcattggctgctctgcaattatactcctatacgatctgccccctgtctctcatttttattgtaattgagattttaaaaatcaaatatgattatcattgggatttatttttttactttctaaaagtccccgccaaccgccttgaccgattgcttcacgacctacccatcgtccttccttttaattgtcattaggattctatttgattatcaaccgccacaactctgctcctctctaggcttattacttaattaatctcgtcatgtgttttagatggtgttttctatcaatagtcttaattttttatcaacaattttagttatttataaattgtattcctagttgatatattatttttctttttctaatttcagaatttattttattttttgtaatgtgttcttttgatattttgatattttatttttaatttcagttgttttaaaattgtattcctactttaactctctttttaattttcctaatttcggattttattttattttttattctgaattttaattaatctactattggattcttatatgtgctcttatttcaattttgcttatatttaatttcgaatttaaattaattttaaattgtattcttacttgaactcttattttcttttcttttatttaatttcaattttttttatatttttattccaaactttaactaatgtcgtattggattgttgtatggactcttatttcaatattccttatttttcaattccaaatttcagttattttaaaattatattcctactcgaactcttccttttctttttctaatttcaaaatttatttaatttttattctgaattttaattaatcacgtattgggttcctatatggactcctattttaatgttgcatatttttaattctgaattttagctatttttagattgtattcctacttgaactcttcttttctttttctccgattaatgtgggaatttctaacctccacagcgaacgtggtgcctcgtttcaaggctgttttaataatataatagatagatagattagtatagggccccgtaaattacgcggctagtattcttatcctttctctcatataataacatatatattttcttattttattattagaatttcttaaaataacaacatatttaaattttgtactaacttgaccaaactatccatgtgtaatattcatattgtgttgtatatacgtgatactacctccgttccaaaatatatcaatttttagctattcatagctaaaaatgcttacattttgggaccgagggagtagttcttaattattttctaatactaaacttttgttattttaaaattatgtttgtatatggactttagactcctttttccaacattctttgtttttttaattatgaatttctattatttctaaattttactcctatatttcctattttagatttaaaatttttagcgacaccgccagtgacgccactcccctctgccagatctgggcggagagggaaggaaggggaggggaggggagccagaatccatacaggggttgaccgccgcctgccagatccagcgtctccaccgctagaggggcccgctgtgcacggtagagcgtggaggaggccgccgcgcgccgtcgtcatcgcctacgcccaccgccgctgtcgccgtcgagagggaggagaggagaggagagaagagaaagagatagagaggagaggagagaaataggggaaaatttgaaatgggtaagagggaaaagagggaggggcatttttacgtgcggacttcttaataggtccgcctgtgaaaaatatgctcattttcacgtgcggtccatttaatagatctgcatgcaaaaatcgatttttccgtgtgatcctcttaaggagtcgcacacaaaaatggaggacgattttacagacgcgaccaattatgatccgtctgcaatctaaatgagtccctgtacaggaaaatcattttttagtgggactacctagagaatcaaaatagatcctactcttaaacttactagaggatgcccccgcgcgttgctgcgggacttggttaatatcaatttgttagataagagatataatctcaagaagaaatagaagaaacaaatagatttcttggagaattttttttagcagccctatcaaaaatttatagataatttaggtagcacatatcaactgaaggagcgttcagccataaaactcttttatacggattgacggactggatacatgtagatgtgtgtggagataggccgatgtgttcatgtgggctatatttgacattgaggaggcgaagagactcactcggtgactgatgggttgggctctatactgcattccatccaacgtctgagaagcaatctaatacattcatccaacggttcacaatttgatgatgacgtgaaagcacaaggtttgagcttttggccttaactttatagaaagaagggataacttgaagagcctaaaaaaattttaaaaaaaagagaaaaaaaagggtacggttttggttgttatcagctgatggtaagccattgattgatgtgttgaattgtactacatgtatgtgcttctgaattggtatattacaaaatagaacctgatgaggaaatacaaaacatcaaaacaattgaatttgatcaatgcggttacgaagagaacaacgacgacatggtaatgatcagcatttgcatgggcagcatggacatgcgttgcatatcggacttgaccctgcaagaatcgtttacatgtcggtgaaaatgactagcgataaatagaagcagaagttatgaattccgtataaaaaatgaatcgagaattggctgtaagcatgattaaaaatataataactattcaatttttagaatattttttgatgaaaaacattaggagaggctactagtagtactggactatatatattaattaaattgggaaagtaatttacacatctacctaagtgaaaattgaaactcaataagcaaccaaaatgagtcatgtcatctatcaaataatggcagttggattcacaaaatgacaaaataccaaacaagaattctagccatcaaaatgaggagtacgtcttctaaaaggggtaaaatatacaatgagtaccgtaattttgacaatttgacccttttaaaaaacttatttcaaaattgaatcatgccaaaaacgaattacaaaaataggctgttttctcagcgccatagagattggcgctgagatataacatttcggcgccactatcattggcgctgagatgtcatcacaggtgtcgcggattttacacgtcatccgagggcagcgccaaagtattttgcgctgatctctgttcaatttacaaatattagctatctacaagcttcctttgcacttaaagagaagatagcttggtggagaactctgggtgctaaatactgtgaggtaatgggttcgattctcagtcactaaagttttcccatataagtacaagcatcttttgctgttctatttaaaaatctcacatgtttttcaaattcattttatttttaaatatggatgttttttaaatttattttatttttaaatatggaaggaacaaaattatgtatgcagtatttatagcttagttttttaaatttattttatttttaaatatggaaggaacaaaattatgtatgtggtatttatagcttaatagttggtataaatttacatctttcagttttttttcaccctctattttgctacataattatgtagatcctaaaaggaaaaaaaaagaaaaataagaagctacagggttcgattccttgacctgtagttttgagaggcagcccttcaccaccaggatagacataccgtacggtaagaacgtacatgcatactatttatacaaactagaccatggaggttctttggctctgacatcgcatgacgtgtgatttacgtgacacgtcggaccgcatctcagcaccaaagaaagtggcgctaatacgttgtagctcagcgccaagtacgatggcgcgagaaaacagcctatttttaaaattagtttttgacacggctcaatatcaaaataagctttttcaaagggtcaatttatcaaaattacgggagtaggaaaaggctgagaacactctttgatgaagtggttgcctcacattagtctctcaaataggcctaatgggctggtttggtcgaacagaccaaatggtcctttggaccatatgaccaatcaaataagtaataagttcatccaaggtcccttaacttgtcgacgaatccgattttcatccttcaaccaaaaaaccagatacaacgggtccctcaactatcaaaaccggtgcaatataggtctcatggcgttttggacggcggttttagcttacgtggcgcctacgtggctaaattgacccggtcttcatctgacgtggcatagatgtggcattgacgtggcaatttgatttggaaattaataaaaaaagagtgaccccacatgtcagctacaccaaaagaattaattaaaaaatggtgggtcctacatgggcctcacttgtcattcactcccctcgtcttcttccgacacggccggccggtggcggcggagccagggatgacctcgaggacgaggacgccggggagctgtgcctggacggggacaccgacggtgagtgcctggacgtagacgatgaggaaggcgaagaggaggtcgatttgatttagaaattaataaaaaaagagtgaccccacatgtcagctacaccaaaataattaattaaaaaatggtgggtcctacatggaccccacttatcattcactcccctcatcttcttcctctctccctatctcccctctcctctctccaggcgccggcggttcggcgacacggccggccggcggcggcggagccagggatgacctcgaggacgaggatgccagggag

SEQ ID NO: 80691 - DNA, 1319 bp, Oryza sativa
acgaaaaatgttggatcgatgtgcagctaccggtagagtttagctagcttcctataagtttcatgcgtgtctgttaggttctgtcagtttgtctagcttgacggtgtgtatgcagtatgctccattcccccttcccctgtacacatctctattttctgaattggaatttgaaagcatcttgatttgatcatatgtccagtgcttgctcctctgttactataccatcagacacctccattctgccctgcttgttccattttgatgaatggattaatgagtatgcttcttgaactgttatacagtatgattttttataggaaaaaaaactaattacatatgaatttcttacaatactgttctatattcattttctaactttataataattattcatttgtttgtaccttcaaaaaaattattctcacacattcaacacaaaaggaatacacatatttttttacgataatacaagtacaacttacgataaggaggttcgttcccttcgttaaactgagaagatcagaactgcacggcatacaaatatcccagagaaattgatcgtgtcagcattaagggaatcacttaaaagatttccaagaaatgttgttagtcagaactatgacttttgaacctctctcccgagaaaaaagtaaacgagaatcttgttcacccaccgtacactggtacagcactgctgctctggtacgacagccgtttgacataggggtgatttccttttcatggcgacgccatggattagtgcaatatttgctctgccaattcgttgtcgaaaggtcagcgataatgttgattaaacgagtgataaccttttcaacatagtgccggatcgtgcacgagtggcaaactaccatggcttcttcctgacattttctctttgattaggattattcaggcataaccgcataaaagagtaatgaagaagggggctgtttttcaaagaaatgaacgacaccaggtaaacgttgtggtgctcgacatcatcccgcacgctttatattgcagtatcaaaattgagcttcagcttcaagaaactaaactagcttgagaaaaaaattgagaaaatttatttgagaaaattctagctttcaagaatggagatgttagcatggaaggaaccatttgcaaccatatctattgtctatatttcagcttgcaggagttttggtgagaccattcaaatgaaagcaaaagtgatattaggaattgtcaaaaaaaaacaagcgatttttccctaattattgcacacgaattggaccttcgtctgtgaaattcttaaaccgtgaaatgtggtcatataa

SEQ ID NO: 80692 - DNA, 564 bp, Oryza sativa
ccctgaatcgaaaaattgaagtcaccgatgagaccatttgcactgtaggtaaccaaattttttgtcttttgatattttcagctggtttgttttctcttgtttgaatcccttatatttttctccattttcctcttaaccatttttccatttccctctaaccttttatccttttcttttcgggaataaatcgtgcaatgaaaagtactcgtgctgacgtgcatattcacgtgccgcagcccgcaaggtcagtgtaaccatgtcatgtggaggtttttttttattcttttttctttttttaaaaaactactgtactgttggttacctctttcataatttggagccctggcccatcctgccagccgagacgctgagttcattgcagttggcccaggagcacaggatattggcttttctcaaacaggctctcccggttgtaaacttgtaatttgcacaggaacgggaatcgagggacgagagacatcaattcatccaatttgccaaccatctccatcaagtaagcacaggagcgttcacgaatcgtcgattagtgagagagaaaatcgc

SEQ ID NO: 80693 - DNA, 51714 bp, Oryza sativa
gcctaacgcagcagcctccccagcatgaccagggacttcttccccccggtcgctgccatcgccgcgccacccgccccgccccccgcgcgctcccgccgcacgcccccgcgcacgcgcttctccacgggctccacccccgacaccaaacaggtgacctcgccgtcaccgcggccggtgcaaccctccaatgcacccccacctccacctccaccgccacctcccccaccaccaccgccaccgccgaagttgaatacagcgccgaaaccacctccaccaccaccaccaccaccatccgtgccgtcaaacaacaatctcccaaagccggcggagccgccggccgtgccgacatcgaggcgccggttgctcaagcctctgccacccgaagggccgcgcattgccatgccgatgccgatcaccgcggcgacgacggtggacaacaacgggagcacgtcaatgcgggaaggggacaacgccgccgccgacgacgggggcagcggcgagccccggccgaagctgaagccgctgcactgggacaaggtgcgggcgacctccgaccgcgccatggtctgggaccagctgaagtcaagctcattccagttgagatttggtccacactactgaatgccgtgattgctacaggtttggtctttgaattacgcgtgtgacgttgaggcgttcctttcaggttggacgaggacatgatcgaggcgttgttcatgaacaactcgacgccggccgcgccgccgagagaggtcgggaggaaagccgccggagtgccgtcgttccggcaggaggagagggtgctcgaccccaagaaggcgcagaacatcgccatcctgctgcgcgcgttgaatgtcacgcgtgaggaggtctcggatgcactgttggatggtgagtacttagttcagtttactgcttttgacattgcattgttaattcagcgtaccacgatagaatcatcatttcatttttgttggtaatagtagtcgctatctgatttgatatagtatttggtaatagtacttagttgtgtttgtttagcacatttgttgctttggtaggatgttttattcagattttgttgctcggtccgtactttcgatgatattttgttttgttttcttggtggcatgcccgtttgatagtgctaggtacttaggagctgttgaattaacagaaaaagtcaggtcttgataataaagacctcaacagaacttacagtgacttggaagtttgaaacatccatcatatgttacattgaacattatttttctttatgtcgttgtcgaggtaatagtaatactactctctatacagtatacagctgcaaaatttatcgagttaataatattgacaacatcaacggcagctagaaaactatcagttatcttggttgtgcctgttttaaattcgaattgcacaacttttcctttggaaacaaaacaaattggaaaactaaacttgttgtgtttcgtgaatcctaagttctctcaagccatcggtgtttttctcattgttatcatatttcatcttttctaagcaatcacattcttaaaaactacactgtctgaaccaaaatcttcctcatcctcagaagtcagaacaatatatgaactactccctccgtttcacaatgtaagtcattctagcatttcccacattcatattgatgccaatgaatctagacatatatatctatctagattcattaacatcaatatgaatgtgggaaatgctataatgacttacattgtgaaacggaggtagtagtttttttcattgcggcatactgtaaatctgtaatttagtatgccatctctacatgagggtgtccagtgaatatgtgtaatttctattgttcttttgagcaggcaatgctgaatgcctggggagtgaacttttggaaacattagtcaagatggctcctactaaagaggaagaactgaaactacgagactacagtggtgacttatcgaaacttggttctgccgagcgctttctaaaggctgtgttggatataccttttgccttcaaaagagttgatgcaatgctataccgagccaattttgagactgaaataaattacctaagaaactcttttgaaactctggaggtatgctaagtcttttagttttccatgttgaatatcatcaccattttcaactattaaacctacaattagctgacatttcttgtcatgtttttactttttaggctgcttgtgaagatcttagaggcagtaggttgttcctaaaactccttgaagcagtgctgagaaccggaaaccggatgaatgttgggacaaataggggtgaggctaaagccttcaagcttgatactctcctgaaactagcagatgtcaagggcactgatggtaaaaccacattgctccattttgtcgtccaagaaattattcggtcagaagacgcaaaatctgaaaaagaaagtgccatgattagtagctctaaagatgaccgtaagcatggtctcaaggttgtatctgggctcagcagcgagcttggaaacgtcaagaaagcggctaccatggacttcgatgtgcttcatggttatgtcaataagctagaaacaggtcttgaaaagatcaagtcagtcttgcaactcgagaaaaaatgcactcaaggccagcgattctttatgtcaatgcaagactttctgaaggaagctgaaagggagatagagagagtcagaggtgaggagaggagagctttggggagagtgaaggacatcactgagtacttccatggcgacaccgcgaaagaggaagcgcatcctctgaggatattcatggtggtgagggacttcctgtcaacgttggatcaagtttgcagggaggttggccggatgcagcaggacagaacagtcattggtggatcggctaggtcattccgcatctcagcaacatcctcattgccagttctaagtctctatggacaacggagagaaaacaactccgatgatgatagttcatcgtcatagggtaagaaggataaggaacatactgaattttggaatgaacatagacgcacaaacttttacagcttatagcagatgcagcaaatgctacattgctgctacaatgacgatgacaaaggaagcacatgtgtaccgtggggaacaccatgtttaggagagatcaggggtttatacacttggatcatgtggaaattcttttgtacaaaagaataataattataacaaagctctttttgttgagtaatttgcaatcagcaggctgagaaaagagtctcacttcagtagtatcttgcagttgcttgcaagataactgcaatcttcttatgtaattattatattcatctagtttgccaactagtaactataacctggagaccattcacagatggtaatctttagtctgtgcccataatctgttgttgtcttaaaaaaatgaagcaacttatattcaggccttctctgcacttccctctttcagatttgttggccatatgctgggagcctgggacaatagcaaatctctctcatttttcgacaatactcagtggatgaatgccttacatcaacatcacaagtactgcataacatgggctgcaatggccatccttccagatatcttctagcaaagcaaaggtaaaaaagaaaaagtaaaccatcactatgtttgtgatggatgtaaagtagcagtcgagtgaataataactgccagcaaagcgaccatcataatctgctccatcgccagcgcccagccttcttcgtcgctgtcacggcctttgctctgcaatgtacaggagatagtagataataagtgatgaatcgagcatgccatctttgcgtagaggtaaagaaagcaatgtgggtcagcatccatccagcatagctacggagaaagtatccatctgaccatttttcccctcttctcgtgagaatgattccaggactcatgatcgactttgatgagtccctctcgtattcttgtctgcagatgaacagaggctctacatctgggagagaaaacaaaggaagcatgccattctgcaacatagggaagcaatgggcaatgggaaaaagaaggcttgatgggtccatttcgaatggtggtgccatgataacctaccctttgaagtagtaatattttagttgtatatgtgggtgtaatggattggaggggatttacatacttgcgctcattgaggaaagtagtttgatgcttgagtatttgattacttggtgtgttcttttcaaaggattagaatggtggataaattcactcggttctcgagttactaaatggcatgattttttttatttaaatttattaaatatcgatttaagttatattttaactttacaatatttaatttgatctatgtgttaggccgtgaggagtaatttagtaagggctatagccactaacaaactatccgacccaacccataacaccgcagctaaacataataggaataagttcacttgaggattcttatcttgttatcgagttttaaaatcgtccctgaaccagaataccagatataacacatccataatcttataaaatcaggttatattgggtcccaagacaatattaaggtgactttggatgacgtggcgctataagaaaaataaaaacccatgtgagatttgtatgtcagtgaaacaatatagtattcttcttatttctctccccatccttcgggtctcgagtctcggcggcgacagatgtggcggcggcgtgcggggtgaggagatggcggccggtgtgcggcgtgcctaacgacggcggcgaaggaggctcaacagtcggcggaggcacgccgcatgcaaaccgagcatcgacgtcgctcgctcttcccgcggcggagtggaaaggaccgcgaccaacagggagaggagcggcttccacggcggattggaaggcctcctagtctcctcctatggcgtgctcggtggcggccgaactaaggagatggcaaagcccatgccacgcacagcggcgaggaggacgtacgtgcccatggcggagacgctgaaccgcatcgtggattggttgccggactatgacgcgaaggggaagaagtggaggcggaggacgagtgtaagttattttagaagacagagatccctataaggattgtgaagcaatggacaatccaatttatcttttactacctccgtttcaggttataagacgttttgactttggttaaaatcaaactgcttcaagtttgactaagtttgtacaaaaataatagcattttcaacccaagacaaatttattaagaaaatgggagcgaattttccaggatttaatagctttgtgctttcagtggtaagtgacgtacctgtctacagcgaggcgtctgtggtgacttcattaatctccaggatagatttgccagcccagtcttcgaagatggcaagatgctcataggggtatggtttgcgtgtgtgttgtgagtatctgcgttgtaccatgtaattaaaaaaatattaatttaataaaactaatttaatattataaatattactatatttgtctataaacttgtatttgaagcacaatgatgtgaaaatctatgtctcgggaataatgatgagaaaagcacaatggtgaagcaacgcaaagctgggatcaatcgccctgttgaaataattttccgctaacaaagaatggattctttgctattgggtacactgtaaaacagattctcgcaccctgtaaaaatgatgatttttatttttcattcgatgtgtaatgggctagtctggtaccttgattgggtacagttatcattggcatagacgtcacccaacatgttcttcactgctgatttgtcgtaattctgaaatctgactttctgaacattagccgatctccctgatgcaccatgatataccacctacgttttagcagaactcgttagatcatcatcctggttttgccaaatcacaagcacaacgcgtcctgaatttattgcaaatactttgcaacatcacagccaggtgatatcagatactccctccgtattttaatgtatgacaccgttgactttttaactaacgtttgaccattcgtcttatttaaaatttttatgcaaatacaaaaatgcttatgtcatgcttaaagaatatttcatgataaatcaaatcacaataaaataaatgataattacataaattttttaaataagacgaaatgttaaatgtttgttaaaaagtcaacggcgtcatacattaaaatacggagggagtagtttgcatcatcaacatcacaatcagatataaggagtattgtaagcccagtagtgttaactttgcgatatttttgtctcgttttttgtcactaataacctgacttattacccaagtttacagtgtttatggaccattgtgttaggccttgatcgaggagtaatttagcgagggcgacagccactagcaaactatccggcccagcccattagaccgcaattccagggatggatttcgaactcggggacaagttgagggatcgaaagttaacttattccaaaccgtaatactcgcacgggctttaacgctgtttgggccacggcccaaacatatcccctggtgggtgcgactaccacccatttcagcagcaactccggcgatcgatgccggttgccctagccgccgccgccgtcgcccgctgtaatttccctctccatcctggctctacgttcgccggatcgatgctctagcggcttagcggacaggtattagttcgttttttttttgtcctttcctgggcgtgttttaaattcatcttttgctgctggttttcattttttagaatatatgcatcgatgctctctgcgagttctgcaagaaaacacaagagagaagaagcaacgatcttcttctgtgattcaaagcgatagaagtcaatggaatctcccttcttttcttggtttccgaggataaatttcataggttttcataagcgactgcatgcaaagagcttagtggatttctttaatatatctcgtagtctgtcatgttgcctcacaaaactctttctatctacgacaatgttttttgaagcagatctgtgtcaactactaatcagctgtgaccagttgcagcaactaattctgcatctttgtaaacttcgggattcgtcaaagctgaagttggatatgccaaattcaaaactccgcctcgttgaactctattcgtgcagtatcaagactgtagagtttctctgcctccctaaactagagcatctattatgtgaatcttggttcttttcagttgcccctttatcttttggtgtgattccatgtcttgaggggttaaagcttgtttgtgctgcgtatagtaatcaatcagggttcaaattgactgatcttatgtgcggtgcttcaaatgtaaaggatcttactttggatttccaaggagaggaggcaagttattttattacatgcaaaatcatcgtatttactgtcatgtggtggtggctgatagccacatgtttatatgcaatttagactgaaactgaaagagcattttaaaagcaccttttatgtgattagatgttgatggcaactactgtttaacttctttctcttgatcaaatttcaaatatgtaatacatgctctcagattatcttttagagtatatttgtgttattactatcgcgactagggttattgagtacataatgattggactgattaagagatttttgtgcttacaattaattccttgtttattttgttaattttgcatagatttggattaaatttcaaggaaaagaactacgcaccgccttgaacaagataacaaagttgcttctgcatggcatctatgtgaaattttttgaacgactcacacgagacggtgcgaagttctattgatagagcaggaaaaaaaagtataagattacaaccctggagagtcgtaagcaggaaaagaaaaaaataccaccacccacatgacgacatcgccaacacacacgcccaggagaaggctagtaccggatcggccgccgctaagcgtggccgaccgctagtagaccaacaaaggcacggctggcgcaccgatgctccaccaccgcacaagctttgctgatatgtgggacccctgcaccggcgtcccccgctggccaggcttcgtgcgccgaagaccgcgccgcacccaccggcagctcctcctcatacctaggtcgcctcctccaccgccggccgcgcctctctgcgccaagccggcctcctccaacggacgcgcctctcgtgccaatccggcctccctccatcggccgcgcctctcgcgcccagccggcctccatctccgccgcccgcgcctctcgcgccgagccggcctccgctgccatcggctgcacttctctgcgccaagccggtctccgaccccttcaccgaacgatgccgcgccggccagctacagccgtctcccatgccctcggttagtcaaccgaggccgccatgcctccggtgaccgcaaacacggtcaccaccaccacagccttggttgccgaacacccagccacctcgcccccgactccttccccgccgccgacgtcgccactgcctccagagtcataaccgccgtcgccgctgccaccgacgccaaccgccgcctctgcaaatcgctgctccgccgtcgccctccaccaccgaacagctagcagcccgacgccatgtcttccgccgccgttgccagatgacacggcagccaccacagccgccaccgccgtcgccaactgccatcggccaactaccgccgctgccgtcgccacaccgtcgtcgccgtcgccgactgctcccatcctccagatccagccgagaggcacggatctgggggcaccgctgccgtcgccgccaggcatcgagccaccggccacagcagctgcgcctccgagcctgccgctgctgcccgtgcttgctccgccgtcacgcctgacgccgccgcccggccgcccgtgcctgcgccaccgtcgcgtatgccaccgcctgtcgcggccgccagcgcccacgcctcgccgacgccgtgcccgcgcctccgtgaccggatccagctgcgagcgcgccagatccggtggtggcgacgccggatccgccgccatgcgcctcgacgccggcgccgctccggtcggccaccgcctttgcgtccacccgcgccaggagctcgggagatggccgccgcgagcccagccgccgccgtcctcgcgagccgccggctttgccggccgctcgctcaggcgacggcaaggcagaggaaggggcggggaagggcggcggcggcggcggctagggttccgccgcccgagtcgcccgacgcggggggcgacgcgggggccaggagagagttccctcacgggacattcattcatgagaaaaaaaaaatctatgtgaaatttaatctcctatggacattggttctacttgaatctgcaccatctgttaagatttttggtgtcaaggtaccttatatcttttttcattgtttatttatcatgatttgatttcagctatgttctcattaaagtctttttgatgataagtatgcatgacgtcaaatatttaattcttctcatgtcttgaatttaggtgtggaaccattcatgtgaccaggatactgtggacagagaaatattttctgaaagaagaaatgatttgtgggatgttgcacagttggatagctcggtacattataatcagctagggaagttaaattttggtgggttcaatccaacaataaaagaacacttggatttggtaagaactgtcattgagcgtgctcccaaattaaagtcagtttttttggaagatagagaaccctgtaaaggctgtgaagcaatggacaacccaatttatccttcaacaatatccatgtttccacaaaatgaagatgagaaaagcacagtggcgaagcaactcaaagctgggacctctcgccctgttgaaataatcttttgctaataaaacatggattatttgttatagggtacggagtacgaaaatgctttatactttcccatgatgcacttgaacgacatgcatgactgcgtgagcaagcgcggccactctgggctggaccgattttgggtgcaacaaaaatagtttttcattttttcaacttatagtttttcatttttgtataccaaatgtttatgtgtataaagtttctatgcaaaaattttatgtgtataaagtttttatatggaaagtttgtgtataaagtttctatatgaaaagtttgtgtataaatttttaagttgatttttttagttttgcataatgattctgggtggaatttttttattcatgcatagtattacagtgtaaactttttaattccatataacagtgttttttatgtagagtatttatcactagaagttctaatctagttctatattagatatatatagagtttcatggtgggcttggtgtgcacaatgaacatgggcataggcgattgtgtgggttctaggagtgtgacgggctgcgtgctaggagtcccctacggagtacttgtaaaacatatcctcgcaccctttaaaatgatggtttttatttctatgatgtttcatgtgcttgtctactacattgatgattggtcacaggccataataattataaattttgacttgtgtctgaacttatttccccggtagcccattagccggtcttcctgaatccacagcaataatctgatcgatgatctgaatcaaacatgactcttgtttctctcatagcccattagctggtctacctgcatccaccgcaataatctgcttgataatctgaatcaaacagggcacatgttgccttgatttaccttataaacttgcacttcgtttacagtttaaatttggcttgagagagagcttatcttgaggttctgtacagattttttgtgatactacatatgccaaaaaactcgtgtcttgagactctgcacagatatgtccatgcattatattcccaaaatcgacgtcgaggcaccttgtttaagccatggcacaatattttccaggactatgattacccaaaattttgacaaactaacccttttaaaagaattgtattttaaaaaaatgaatcgtgccaaaaactaattgaagaaatgaatcgttgtcttgatggtgcttaactataacgttttagcgctacaaatataggcactgaatggcacggttcattattaaaaataactttttataaggatcattgtggcaaaatttcagctaagactacctttgtcactacaagattcatgcggtcatagtttcatgcagggcggatccaggaacaaaaaaattggaggggctcagttacatagtatcttcaatctctagccatttaagaacctttactttatcattcacggtgaaaaaatcgaggggggagtgttccgggggtatccatagattttatgggtgcaggggggaccacgttggatccgcccctggtttcatgtcaatatgccatgctttcaagctatgcacaatccaaagttccaaacttctgaggggtaacgtccgcaaatttgtatcacaactaagcttgccaccatagcaaactgaaatctagctagtacactcaataaaagtacttatctacttcgtactttgcatttcacaagaattatgatcaatagtgataatacagtcaaacaatgacacattactgatgatgttaatgtatgctcagttacagagagacgaccgcaatcccccccccccccccccctcttctctcctctttcttctcgaactcaaactgctgcgttttggcactcacaaaccaagactcgcaagtcgcaagagctacatagctaagaatattaacgcgagggcagtttactaccgcgtacaaatgatttttgtttgcaatttggttgctgggtcattcttggcatctggattctccatgttttcttcatcagagcttatgttgtcacattggccactgcctgcagcacctcacgggcctctgccaaagcagcagtagtctggaccaatcctagagcatcttaagttctatcagctgggctgacaaagtatgaacctgggaggaacatatgggcacgagaacctaaccaaataaaataacattcagcaaggtcccaaatgtgtgacagcatgagggattaataataaaaaaatctcgggcacaaaatatattccaccaaatacatgaacatgaaaaataattgaaaaagagctaaatgtacctgaaattgcatatcgacgaaccaaggggcttccatgctaaaggagattctagcctgtgctgatacctggggtatcagccaatctaacaagagccacggttcagaatttcagaatgacaaattaaccgaaggaacaaggatcaaataacaatctcttcaggcttcactagttggaaacaagtgggtttaattccctaatgtattcttcatcactaggattctattcaacatttcaggtgctaattccagtaaaatagtgtttaaaaggcttatgataattcatctgataagaaagtgttttctagtttctgactaaagatggaagctcttgaaggaatattttgatatcatagataagaatgggcattaacttcgtaagttttgtattggattaggtatctaagtagatatcagtaaagtgaagtatgccaccactgaacctgcaagtcccagtttaagttttggtttagcagacttcacaactcttcagaagcatgcaggagtacgaattcaatgcattgatgcttgctaatatcaagaaaaggaggaactcatcactcactagagatcagtttccataaaattaatgtgatttaattttcacgtaatctgagaaatgtgaagattaccaaacaaaagaatctgatgcaaaacaacaaaagaatatgtgatagtgtgaagtcttacatgctcacatattcataatgcacatttatgcagtgtgaagatttttccatgatgagttctgcgggctttgatttagcacacattccttccttacacactgatgacaaagattccatatatgtgttcagcttctgattcatggcaatttagccataatctggggaaacgagatcatcaccgatgtgctcaataagaatacttgcaggttgctgcaacaaacaacattatagataagaacaagatcatcggcaaaacttatttgccattttgccccagtctgcccatcccccatatttcatagatgccaacatggttaaaaggcacttgctacactcagacactcagggcattaacttggtttagtttaggatgtaatgctaaatttactggacttacacctgcttccaactgatccatctcataaattataaaggtgttgctaccttttatcctcaatgaattatggtactacaaacaagctaaatatcatcagaaactggaagtaattactaaattgcctgacagatcatcataagtagtagctacttttgttgcagaacggcgttcaactcttgcattcatctgcagaacaaaggactagaagtaagtagtagttgctagcacaaagaagctactctattgagccccttaaaatttcttgttatatcattttcttttcggtgcaagctagatggactaaaattaaatacaaataagtaattttcatggcattactgttcccgacattgctttcctatacgtccaggcaaagcttgagcaatggttaaccatttcttcggtccaagtttgtttaccatctgaacaatgatctcatcttcctgaaaaggggaacatgtcattgtgagtataagatgactaaccaatattatataagaaatgaaaataaatggactagcatgcttacttctttggaccatggccctttgaccaattcagggtgtagaaccttttaattgccacctgtgcaagcattgtacatcggttctattcgcaagctggaaaattagaaggtcctctgtcaaagcttggatttttaacaatatacaggaacctcatcaacagggtaggaaaaagaatgccagagaagcatgactagagtgtaagctaatgaaacagcacaatgctttactgtacatgagttgtgatagcatcaaagaggggaaaaaaatgcttgcgtggcttaagatatcctactgcactgaagtactaaacaattgtagcgcaaggtgggcttgagaacaatatggtaaaaatgtattatatatcaagtataatattgtgaaatattactcctgttacaacctgacatgtattgacatataactgtatgtaatcacaaagctaatgtgtaaaaattaaaaaaaaaatccaagggagtccaacatatgcatggtaggctatataaaatgcagtgatatagataccaaaggtcacacttttgaaggtgctccccctatgttatttcatctctcaaaaaaaatcagtaaaatgatatatgaattggactttagaaggctattttgtttatattttccagcatacaaaaaacaaccgcaacaaagttgaagaaaaacaaaaaatatgacagctaaaagatagtagaaatactatgataaagagtaaggacaaagtatgccaaatagaaccaatgcactaatagaaccaatgcatcccattgtatgtctgaacagctctgaaacgcacctaactttttcccaattcttcccattgcatgtctgaatagctctggacaatatggcagcctccattgatcagctaaaagctaaaacaaatggtatggtttccactctccatttgtttctacgacacgacctacattttagctgaaatggagaccagctgcagaccacgttcaatgacttcaatcagctaatcaatgaagacaatcaattatataattgtgagcattgttcaatctatccatgtcatcctgattttgccaaataacaagcacaatcagatatccagacaaaagatcaaaacttttgccaaatcagaagcacaatcagagtccaaagatcaaacttttgccagatcacaagcataatcagagaccaaagatcaaacttttcccaaatcacaagcacaatcatatatccagtagataggaaatgcatcacgaaggttcatcgcaaatacttcgcaacattcatccattggtagcctgagacagttagtagtacgatctaagcctcggtaccttctaattaagcaacactagacgatagatagcataatagcatccctaagcaaacattgactataggcatcagtgatcagtggagttggccgttgacgtagtggcggtgggggtcatcggcgcggacacggtcatggagtcgcgggcgaggtcgtcgacgcggcgggggcgggggcggtcgatggggcgagggcggcgccgatcgtcgcaggggcgggcggcggcggggcgtcgtcggcggctggcgtgtcggcgggcatcttcgccttgaccttgtcgaagatcttagccatcgcagcctcctccttctcggagaacacgacgacctcatcatcgccctcgtcgtcgctcgcgatcccggcctggatgcgcttcttcttgtcatcgcggatgatcttgcgatgcggttttccctggacgccactgaaacgatcgaaacgcaacaagggttagcagcccgcgaaaccagatgagatctagagcgctcgcgcgcgcgcgcgcgaagccttcttaccgactctcggcgctccgggaccactccatcgcgactccggcggcggcggcggcggaagaatggaggcggcgcggtcgggacttggacactgctcactgctctccgtgtctccctgctcggaccagcaactcgaggtagtatatatagccatcgtattgggccggcccataaaccctgggctggaaatgttcgtatgggccacactaggcccaaattttgggcccatgaggcgatagaaaagcagcccaaccacgagttcgccggcgacatctgcttccccgaggatcgactccggcgagtaaccatctttctcctcccgttgtactccctccgtcccataagtgcaatcataagtttccatgtccaactttaatcgtccgtcttatttaagtatttttgttgttatgggatgataaaatatgaataatatttacttgtgacttatgtttttaaatttttttaaaaaattttcaaataaaacacacggtcaaagttggatgcggaaaaccgtggctgcacttaaaatgtaacggagggagtaataaaggatcgagttatccgcatccgtattcctaagctttaacagatttacgtatccctgagaaaaattacttataaccatcctggtttttgaacaaaatcgactatccttaaaggtcacactaacacttgcactatcacagagatgggtgtagtgcgcaagcaccattgcagagcagctactccaagtctccgaacactactacttgcccctccagaattgtaacagctggagtacgtagataagggagaagtgaattgtaaatggtccactcaagtattcaaatcccattagtatgtagataattgagaactgaaaaataaatgatcggaggtttcagcagttccacaaaacatccgtgattaaaatgtgattagatattgatgctccacaaaactacctgtcggcaatcaatattctttaaaatattatgggtgtttgtttgtttgttgcccgagtaaataaacccaatactgtccttacgtatatttatatttgaagtatatactttcagtaatactcgcactaggggtggaaacgacggctcggcttgcagtggttcgcaacaaaactaggcttggcttggcttggctcggctcggttagggaaacaagctaaaacttgagctcggcttggcttgtttcctggctcgagccagctcgagctggcatgcaagtcttcctgttgaaacacctcttcatatatattttgtaactattaaaaaaacaagaacaaatcatcaacttgtaaaatttaaataagtttatatattcaattcttcaaaatcttaaagaaaaatttcaagttggcaaataataactccataaaaaaataaataatcgatataaacacatgatggcctaagctcgcgagccaaatcaaacggctcgcgagccagctcgggctcggctcgtttcaccaacgagctgaaaaggagacttagacttggctcgtttggcttacgagccgagccaagtcaaccaagctcacaagtccgagctttttttcccacccctaactcgcactgtcgcacatcaaacgtataagacgtaagaaatacttcagtaaactagcaaactatccggcccagcccattatactacaattaaaccgtaatagaaaaaagtacaccgaagatccctcaacttgtcatcgagataaaaaacgtcctcgaaatgcaaaaccagatatgcggggtcccttaactatacaaaaccggtcacccgaaattcttcggtggttttgaccccggttttgttctatgtgacggctgagtcagcaagagacccacgtgggacccatatatcaggtgtccacgtcaccctctctctttcccctttcttttttttctcttctttttcctctcctctttgcggggctgagcggcggcttgcgagcggaggcgcggaggaggaggcgggaaaggaggagggcggcgccgcgacagcggccgccagcggcggcggcagtggggaggcggcgtgcgggcggcgccgttgtcgtccccctcgtctcctctcctcttcgttggcgtcgtcgtccctctcgtccccgccagatcacgccgcggcgcggtggccggcgtcctcctcctcctcttctacgtggcggcggccgttccatggaggccgacgctccagtctaagccggcccggccttatcctcggcttcgccggagtcgagctctaccggcaaggcgctagcccggtggccgtctttcggtcggccctggtgggccctcgccacgaccgcctccaggtcggagccatccaagcgaagcacggcctccatgcgctcttcgccttcaagcccgaggcctcctccggcggtctgcgctccttaccttgaacctcccgtcgctgttccccctgcgccgagcagcctcgccgactgcacgacggcgaccatcggcgcgcccaacgcctcgtagcgccgcgacgggtcacgcacgtggatggccgctaccagtgtgatgcaggcgccgccctcctccgcgcctctgcttgcaagccgcctcttgcactaagcacacgctgacacgcataagttaacagtttaggacttggcaacatcagctagcagtagagcacacgatcagatggcaatcacaagcagattaagcatatacatggacgaacgacttaatcattacagtttttttggttgtcacgtaccacgaagcataccatatatactcctacatgatgatgccattttctttcttaccatgattttctagctagctagctaatcgatcagctgcttgattgatcagtaggcagcagctgcggcggcggcgcactcaatgtcgccggccttgtcgtcgacgaccttgccgccggccatgacggtcttgtacgagtatctggtggcgacgaccacgtagaagacgaggttggcgatgccgatgcatgcgagaagccagtagaagaggtccagcctgctgttgttcaggtccttgccgaaccagccggcggcgcggccgccgtgcgaggtgacgcggacgagcggcgtgagtgggctgccctcggggaccctgtaccggtagtggcgccagccggcgaggaagacggcgagggagacggccacgacggcggcagcgccccagccgaccttctcctggaggtagacgatgatggtgacgccgagcaggacgccggcgcagagccctcctcctttcccgcctcctcctccgcgcctccgctcgcaagccgcctcgccggccgccacgcgctcgcaagccggccgccgctcagccccgcaaagaggagaggaaaaagaagagaaaaaaaaaagaaagggaaagagagagggtgacgtggagaactgatttgtgggtcctccgctgactcagccgtcacgtagactaaaaccggggtcaaaaccaccaaaggacctcgggttaccggttttgtatagttaagggaccccgtatatctgttttacagtttgaggacgttttttatcccgatgacaagttgagggacctttggtgtactttttccaaccgtaatattcgcacgggctttaactccgtttaggccacggcccaaaactatccccggatgggtgcgactgcaacctatttcagcagcaactccggtgtccggtgttcgatgccggttgccctagccgccgccgccgccgtcgccgtcctctctctcctgtttcctcgttcgtaggatcgatgatctagtggctttgcggacaggtagttcgtatttttatcgtcctttcctgggcgtgttttaaattcatcttttgctgctggttttcacttttcagaatatgcatcgatgctctctgcgggttctcaagaaaatacaggagaaaagaagcattgatcttcttctgtgatcgaagtgatagaaatcaatggaatatcccttgttttcttggtttctgagggtaaatttccttgtttttccaaggataaaccgattcgacataagttaattaccaagtcggtttttcaatttcagtatgaatccaattcgagcatatacaagtaagtgccctaattcgaatcaggctctgaggctggtgaaattccctttataaataagctcgacaataacactgatctcatatttgcataccatccgagtggaaaagccccattgtcagtagtcatgcagtccaatagcatccaaagctatgtaagtctctttccctctctctgttagtaatttttgttagtagtttttccagtgtaaataaacctaataccatcctttatatgtttagtatttcttgtaaaattaagagaacattttaaacttcagtttaaatgattgagcactttattggtgtaggaccaaggtagattcaaccaattgccggatcatatcttactctctatcctagaaagagttgatatgcgcacagttctaaggaccagtgtcctgtcgacacggtggaagcacctgcctcttttgctctctgatgtcgacttagatgcagatgaattcatccaccaaaattcctcaatgtcggccgatgaagcgatggctgttctagttaaattgatgagcagtttatttggttctcctcggagcgaatctatcattaaaaagctaaacctcaggttctgcttgctcactgatttggagacatcattagattatttgtttaacatcggtgagctagtttgcaatgctattgacagtggtaaagtaaagagcgtggagcttgcgatcacaactgagaagcggagtgtagattgcacgtctagtgatatgctgctgcatgcaaagagcttagtggaattttttaatatatctcgtagtctgtcatgttgcctcacgaaactcctcctgtgtacggcaaggttttctgaacaagatctgcatcaactaataatcagctgtgatcagctgcagcatctaactctctattattgtgaacttcgggattcatcaacattgaagctggatatgccgaattcaaaactccgcttcgttgaactcaactcgtgctatgtcaagaccgtagagtttctctgcctacctaaactagagcagctatactgtgactcatggcgcttatcaggggctcccctatcttttggtgtagttccttgccttgaggaactacgccttgtttgcgacgtcacgtatccagtcggggttcaaattgactgatcttcttcatggtactgcaaatgtacaggatattgctttggatttccaaggagaggtggtaagtaatttactaatttaattacatggaaagtcatctttattaatgtcatatggtggtggctgttggctacatgttgctatgaaatttgcactgaaactgaaagagcattttaaaagcttttttttttttgtgtgtgatttgatcttaatggcaggtactgtttgatcctttttttccccgaccaaatctcaaatactcagattatcttttagagtacaccagggttactattggcaccagggttattgagtacacaagtgttggcctgattaagagctttttgtgcatagaaataattccttgtttattttgttaattttacctagatttggattacacctgaaggaaaaaagctacgctccgccttgaacaagataacaaagttatttctgcatgggatctatgtgaaatttgatctcctatggacattggttctccttgaatccgcaccatccgttaaggtttttggtgtcaaggttatgctgtcattttttcttgtttttttatcatgatttggtttcagctatgttctcattcaagtctttctgatgattagtacgcatgatgtcaaatgttttcttatatctgaatgtaggtgtggaaccatgcatgtgacgagggtactgagaatagaaaacaattgtatgaaagaaatgatttgtgggatgctgcacagttggatggctcgatacattatttgcaactagagaggttagaatttggtggattcaaccaaataataagagaacacttggatttcataagagctatcattgagcgtgctccaaacttaaagtcagttattttagaagacagatccctgtgaagactgtgaagcaatggacaacccaatttatccttcaatatccatgtttccacagaataatgatgaaaagatcacaattgtgaagcaactcaaagccgggatgaatcgccctgttgaaataattttctgctaacaaagaatgtatttctatgctattgtgttcctgtaaaaatgatgattttttttttcgttatgcgtaatgggctagtcagatacctagcttgattggtaaagttatcattggcatagaccactgagcatgttctactgttcttcagtgctgaactggtcgtgatagtagttcattagccgatgaacttctcacgtagtagtagttcattagccgatctccctgatgtacaatgataccaagttgcagatccctttcaataaattatataattgtgagcatcgttcagaatctgtatataccatcctggttttgccaaatcacaagcagatactatgcaaatactttacaacatcacaaccagatatgcaacttcgcaaatcgcaacatcaacataacaatcagataggtacttggcaacctaacgatcagaaatcaatctgatatagattggaaatgcatcgcgaaaccagatactatatcacaatcagaaatctgacatatattggaaatgcatgaaaccagatactatatcacaatcagaaatctgatatagacaggaaatgcatcacaaaacagatatatcagatacttggcaacatcagcatcacaatcaggtatatcacttggcaacatcatcacaaccagatatctgtcatagataggaaattcatcgcaaattgtacttcgcagcatccatggatcgataacctgggatagttagtacggtagttcctaagcaacggtagctcctaagcaacataagactagcatccctaagcaaaattagacaatagctgatcgcatcagtggagatggggattcacgcagtggcgatggcggtggtcatggagtcgcgggcgaggccgtcgacggggtcacgggccgggggcgatcgcgtcgggggcgtcggtggggacgggggcgatcgcggcggggacgtcggcggggacgggggcgatcgcggcggggacgacggcgggggcgggggcgatcgcggcggaggcggcagccttcttggccatggctctcgcgtggatcctgttcatggcggcctcttccttctctgagaaggggacgtcctcgcgatccacgtcgccctcatcgtcgcttgggatcccggccttgatccgcgtcgcgtccttttgcgagctgtcattccggtacggcttccctccgacgccactgaaacgaatcgaaacgaaacaagggttagaagcctgcgaaaccagatgagatctagagcgcgcgcgcgaggccttcttaccgggtctttgggctcgcccaccgccccatcgcgactccggaggtggacgacggcagcggcagcgggcgccgcggagattttaggtttagactttagaggaatggaggcggcgctgtcgggacaccagtacactactgctctctgttctcacacgggccagcacttcgaggagacgaggtcttactatatatatactcttgctattgggccggcctgtggtccggcctttgaacaggtcccggcccattagtttgttccctgtgatattttgcgtgatcgttgcggttgaatttaaattgatttatgcataccagaaaaatccgtcacgtgattatattagtactagctagtttgcaacgatattgaattattgctagtggtaaagtgaagagtgtggagagattttgatacgctgattgctgttggcactatacttgtatgtgctgcaaacatgtgatcagccatgattcatggcaacaggatttccaagccgatgcatgcatcatgccaccattactttggacttattttcagagccctgagtgatgatggtgttctaagagatgaaaaacagtggacgatttgttagaacgtaactctcctgtgtcatcagatatattcagacacaatggcgccggctcatcacagccactaatttttctccctttcacgtttgaacctgaaaggtcgctattcaccggctcacagctgctccatcggtgttgaagtggccgctggaggtggcgacgccgacgacgacgttgaaatgaggtttaggatttgggctagctgcagctggtaccgacgacaatgtgcgtacttctttggctgagatccctccggtgaccgatgccggccgatacccgattcgattgccctggccgcgcgcggccgctattgaaaaccgatacgtcacgtcacctaacacgtggggtacaccgtacacccagaaaaccgatgcactgtccgtctatatggcggatgcgggcacacggtgcgcggcgaccttagcggagggtttttccggcagaacgtcgcactgcttctgcggcgtctggggtaccgcgtagctatataggctggcccatctggatcattagcacagcattagtcacatggcttcgagtacctttagcaccgggcctcttagctgacgcaaatgattaatgatttataactattcttcaccacaagaaactagagcaacacagatttaactttcatttatgagattcaaactttgtattctgtccgaagctacaagaaatatgatcatcaatagtttgattccacatgctatgggtaaaatatacgagtagtaatcataaggatgcttcaaggcatcgtatgctttggccgagtctagaccacgtcaaaaaaaaatactgtcacatttacagttcccgcaatgaaaaacgatggtgaaaaccatcaactaaagccctgtcaatccttgcatatgcttcttcatcgcacggtctctccggtgatggttatcccggccaccacctctccttccacctctgcctccacgaggtgcaggccctcctcgagcgaagccctgtgctgcatctggatcttcatggtcctccgctggatggtcatggttcctgcctcctcttgttgcgccacggccaaatccacgttggccattcgggttctcgtttgcctctggctggttgccgtgatttctgccccctcttcttccaccacggccaaatcctggtggcccgtttgggttctcgccctccggcggtgggtcgccgtgatcccttccacctcttctgccatgatcgccacggggatatgagcctcctctgcctatgttggagcctcctctgccgaagttgtttgcattgctaccctcctcttcctccatgtctctgtgttgttgcctgttgggaactccaagaggtacatttccaccacggccaagaccatgaatggtatctttctgaacattgcgcaggacagccgcttctcgggcactagatacagcaactgaaccagcaaccttgtagctgtagttcttcccgtccttaacataaaactgtgtcttcttttgtgagctccaccgtgggccctgtgaggaactctcggcatcattggcaccatcagtttcctcataacttgattctaccacactgaagccaagatcatcgaacgagtcatcatactcatcatcatattcatactgggattcaagcacagctgatctaacagcatcttttgctttctgtgagtctagagttgcagagtcaggcacgtcgtcattggtcttccttgtaaatctaccttgcgggactgatggtacagatgaggatggtccctgggatgctgatggaactgaagaagatgaagaatgttcaacatagcgatgcatctcagtattaaccttatggggtttgttcataatttgaggctcagtctccacaagtattcctttgcccttatctttcccaacagtggctgcaggctttagctgcggcatctcttctaatgaagtatccagagctagaagatcttgatggagggttccatctaaaatcctttggataacttcctctgggttctggttgtaggcttccaggcatgcagcgaggaaacccttcccataatcaggaaagaggtcccttatttgagtaatcttggactcagtgatggcagtatcctcattcttatgttgtagttcaccaccataggaagagacaggcaaatcaggcacactattccaagatgtcagagtagatccacacaagcgtgcaatgaactggaactgctcatcatccatgtgtatccatcctgtttacgattggaggaacatattgaatacatcaaccaaaggttttggcatcaatataaaactatgacacaatcaataaacttgagataacaagaaaatacagcatatatgtcaacagaataatgctgacagtttagcaaactctttcagtcttcacaacagaatctagccaaaacagaaaaagtgatgtcttatgaacacaactcaaaagtgccagaatgatcaaacgcgagcagaaataaaatcaaatgtagggtaatacgggaatattattggtgaactttatgagaacaaaacaacagaagctagagcatcttttccttttactagccaaaagtccatgcgttgcaacggaaaacaaattgagtttctagttaagtcaattaagcacatagttaatccaagtagtacttttatgattttccttattgaacaagtaggtgattcaaaatttggggagaaccagcagtgaaataggaggacttgttggagggtgatgtaatagtatagattgtgggacccaaatgtcagtggtaaggatggtgtggcagaacagacaccaccacgtatacattttaagtagtatagatataaatatagataagattctgttttggctctttctctttccattcattgagatcaatatgctggatcaagctggaagttttaagctttctaagaaccactcatgcatagatggcgagagcaggcatagtaacagaatatagaatcataggcaattcagtacatatatgtagaataattgtatgacaacttctgaataaagttcctagatcgtatatgttgtttatggatgaaaaactaaagagacaattttggctgaaataataatagtgggatactaaggttgtgtggaattttacaaacatgaaaataaccaagcatttaattgagattttttatcatttacctttctttcgaatatctccaatccggttcatcaacttgaactccttttcaagagcttggaggaatgtctttccaggatgatcttgtgaaaatgtggcttctctattgatatccttgagtgtttgaattatgatgtcacccctgatcataggatcttcgactttagctggaaacatctttgtacaagcttcaacatcacgctccacaagttgattgttcaaatagcagaactccaataatctccatccgaaactgacagttctccttgacagcatccttataccaagaactatgtcactcagtataatgtcagatgcagtctctccattgctttgggaactggacataacttgaaacccatgaagcaaagatggcaacaatgagtcatacaatcttggaagagtgttcagtagttcctcaactccatagctgcaaattaagtggtagataagcatcattgcctattaagggaacagcgaacaaatattgtgttggatgagtagaagcgcacctcgtctcaaaagaggtacaaaataataaagcagcaggttgataagcatcgacaaaggcatccagagtgacaattgcatcgtttacaaaatccaacacctgaaggaagttggatttacaacaatatagaaaaatcagatgaaaggacagcagacatatcataaactatgcagtataggtaaaacttgcctctgagaaatctttctgaagttgggtatatccactatcattcggtccagatgaagtgagcgcctaaaatgaatttattatggttaagttctttttatgcatagttctccaagatcttctgtaaactactaaactgtcatcagatcaggaaggtgtgaaactacaagatcaagtttatatcaatatcataggtcctcaacttttaatcgtggtgagaaaacatacttcaatctcaatttaggataaaaaagaaacagagacaaattaatagtaaacatcataatcgtcactttctatctaacctaccaagcaatgtatcatggttgttgaaaggaactgggaagaaagtatttgaaacaataacagatataacaagtaataacaagtatattcgtcaatagcacaaatgaataacctgaatcctttgcagaaaacgataaaagttttagcatatgcgattgggactacagactaaagtgaaaacagctgttataatgatatcatatggatgttcataccagataaaggaatacagaatcctataacagctatgtgcagtgatttatgaagaagatcacaaaataacctgtaatgatttcatgcacctctcctgcattgtgtggaaaatgcccaggaattggggaaggacaatattaatgccatccagaatatttggctggacattgatagcgttttcaacctacagatacagaaaatgtgcacttgttattaataaaattataaaagtattcatgccaatgaatagaaaaaggttatctgagactaagggaatgaattagaatttgcatttaagttagcatctgtctgcaaaatgaaaaggagaaaaacaacaacaataataaacacttcaggaaccaaccagtgaacttgtcaatttgcaattgtcatgcccataaatagcacaaatgtccaacaacttgggtaaatcaagcaatcttttctcctgcaggagggctacaaccgaacaacgtgaatatagtatatttgaaccaatggtcactatccattctgctctaaaaaaaggtaaactcaaacagtgatcatatgagtagttctaatctcacctgcatgctccttcatgctaagggattcacccctgaatgctccaggatccttgtttgaagatctaccacccaaacaagagccatatcatgacaaatctcatgtgaatctgaacagtgtgcattatcttatgaaaaatatgtatacaagaaagatagcgaaatggtataaatctcacatgcggtacaggaccataaagactcgacggcaaagctcaagctccccgacaactaagccagcaactgtccctttgggtgcacgatgaggcaagtcataccaccgatgcctgaattgtaggtaactgtccaggaactcatgcagggaagtattctgtgccactgggaaaaggtaacgataagcattaggaaaccattggtaaagttcaaatgcacgcggatttattcataagttaaattctaggagtgaaacaatggataatcacagatctaggcgtgtcctcaactcaagcttttatgttgactcatctactcgctcaattattgttcaggcttagtttgcataagaaaaaatgccaaattcctctgattgtagggtagttattcctgtcaatctgaagttcctgtcaatctgaagggactaggattaattccttcccattaaaactatttcaaaggatcataggtcatgatagtgataagaatatgattgcataggctttgctttgcttatgcaactactagccacttcaactgcaaatgtagtaataaatttaactgcacgcattttatcttgcgcttaaaagtgcaaactgacatttgaacaagcatacactagaattttacacataatccgtagccttagataatcacagagaccgaagcatcagaagatgcattcaacaaacacaattgaagcaaacaagcagtaaacaccgaacattaagtggttaactagttatcgcttccaagctttcagctctgatttcccaatcccaaaataacaattcacgccttccagctacacggtttcatgagcacagtaatgcacaagcgagcgtttcggttaccctggcgccagaactcgcggggcttagcgcggaggagcgcggcgagggcatcgttgaggaggtcgacgacggcctgcgactcctgggcgtcgggcccgccgagcccggccgcgaccacctcgtcgtgcggcaggtacgccacgaacccatcggcctctccgcccaccctgccggcgccagatgcagacggggaagccgatgatcggagggcggtggtgagcgtcggcgggggcgagggtttaggtgcggcgggcttggggacgtagcgctgctgcggctgcggctgcggctgcggctgctgctgctgctggccgtggtggtgcctcggggcggcgttgttgtggcggcggtggttgtaggagggtttggattgctgcggcggcggcgcggacgacatggctggatcggggggaggagggagaaggagaagccgtcacggcgtttcaggacagggagaggagtaggctttgtagattccggaggggtttcccggaattttggggagacccaaggtttcttgtgacaatgtacaatatttaaattgccatgtgacaatttccacctttaaaaattgtaaaaattggaaggggcgtatttcgatcatttttgttttttttttcgtctcaagctcttcatatgatttggtttatagtttgtattttgtctgttcaccctgtcgggtagaaaatcaaaatactaagccatgttttatgaaagagtgcatatctgaatattagtaggagcagtactactattatttaggcaaaatgtgctctaagacactcaaattttatagcctttgtcgtagaacacccaaaaaacgtgtatttattgcattacaaatttgtacttttcgctttgttggactcttctatcgagggagtgagaatggactaggtctggtttggttcaaacaaagttatcttacaagccgattgacacaagggcaaaattgtaacttttctcttggtgtaggtctgatccgaactagatctggttgggttaaaaagaaacatgcaccataggtaaaaagttgtcttttttgaaagtttctctctccatttagatccgatataataaaataatacgttcagcatccaccagctaattaccatgtttttagtggtgtcatgtaataaatacacattctttggatgtcatacaacaaataccataaactttgaggatccttttttgcctgatatttatggcgaattgaggataccttagctactagtaaggtttcttatgatggaacctgctaatctaagtttaagttctaattttagcacgaatacttgtatttacagctactacctccgtttcaaaatatagcaaactatgatgggatgagacccatctaagactatgaatctggacatgagacatgtccggaaggagtaattattttcactggtagcgatatacatgttgacagcgagtctatgatgtgcttgtatttatagctaattatttttagtggtggacaacgtaccatattacttgtggtgacttcgtcgaactcaaaatttgtaggtatatacagacaccagtggtgaccggtaacctcgtcaatcttaacatattactaactcaatcttcaaaagtattcattagaaccaaatgtacacgtgtgtattatataagagtgagcttatatgtctgtgatgttttcatcgagctcaagatatacggaccaatttttttagaggtgctcatgagataggttaagtacgtatgcattaagaacaaattcgataaatgaatgataaatcagcaaaaattaattatcaaaaaaagacactaatattacttcgccatttggtgagattgtggttgcatagagctagcgtagaagattaagaagcaataattcaaaaaagatgaataaataaaataaatttagacgattcaaaaaagatgaataaataaaataaaattagacgattaagaagtcaaaaattaattatcagagccaggtttcgatcctgggacctgtgggttatgggcccaccacgcttccgctgcgccactctgatggtgttgtttaggatgttaaacgtttctaatttaaacaatgctctataactaatcattcggctaagaacactaaggcatcgttcgtttaggggtgataggggagattggctctcgttttccgcgcgcacacttttcaaactactaaacggtgtgttttttgcaaaaaatttctataggaaagttgctttaaaaaatcatattaatccatttttaaattttaaaatagttaatactcaattaatcatgagctaatggctcacctcgttttgcgtatcttcccaatctcctcaatccccttctcctcaaacactccctaactcattcattattaggtataagaacactaactcatccattctcgaacactaactcatccattatccattctcgaacactaactcattatacattctcgaacactaactcatcattctcagtataataacttcactaatcattcggtattcagatataatataagaactttctatctcagattttttccgtttgtcaactgagcacagcctgcgatgtgtaacaatcgaatgctatatatctcccataaatgctcgaagaaaagcgaaaaagtacaaggacgatattacagtgctttggtatgttaagcatttttttatacaaaaagtcagacttcataagaatacaagtccgcgtaatttataactcagatagcaaaacatcgggaacaactagcactacagcaaaactaatactatgaaaatatagaaatctcagatgaaaaatacacttctgattctagccagctgttggctcctcacataacaattcgattcaagggttcaattgttcgttttgcattgctctggcctctggagcacacttaacatctatagttagaacacattatctactgtaaatccatcacttggaaattccaaggtgtggggatataggatgtcgtggagatagtaaccatctgattcttcagctcaactcgttaattgcatcaagatgagtatcgtatcaatattcacagtttacatcctacggttcaagctctttgttttcctgagttgatttcccagttttctgtgcttgactttctttcttgcgctgcatcgattattagagagaaaaaaaatatgaggcaaagcagaactcaattgaggtaatttgatctagcctaagctctatgtgcagaagttagaaaagcggagaacataagccacataaacaaataacaatggcaaaattggttctagagcatccaaagttcatgtgttttaattttaaagcaccgaaagttaatgttcactttaatagcactgaaaagttccctccattcccgctcttagcactcccgtttctttgggtgagagatggggttccagctgcttgatttagttgatctgaagatgtgttcggctatttcagttgaaaggaggatagggttggaatttcaggtgcttgaatgagtcaatttcggtcaaaactgacgtcacatgcaagaaaagaaacgggagtgctaagagtgggaacggagggaacttttcggtgctattaaagtgaacctgtaactttcggtgctataaaacaaaaacatgtaaacttacgatgctctagaaccaattctgccaataatttaataaaagatcccatggattcagttcatgcagcacagagagctaaaagggcctcaggtgctgttttatcaaatatatatatatgattaattctggtttaaaaaactgtggtttagttcttgaagtcacaggcacacagtggaaacctatctaccgctgtcgccatctcctcaatatcagcaatctaatggatgaatttagatatctcctcaatattagtaaatgcttatcattagtaaaacatgacaaactcttacaaagaactgctattctgccagtcatgtatcaaccaaaaaagaaaggtacaagaattttaagcaatagagacattaataactgcaaccagttaataacagcaagagattcagcactcaataacaagacagattaatctcccatcatctttcaattagttctttttttctcttgcatctataatgaactacagcatttggttcatggtgaaatatcaacagatcacttaatggaagaataatgatgaggtcagcagctccaagagaatatttaggggaaaatagcatcagaagtgtaacatttcattttcaaagtattagcatgtcggtgagcggcataccttcggaagaagtccttctgcagacatcagctcatataacttgcgcatgattgtttcttcttccacctgtacagaccaacattttcaaagtattactatctaaaaagttacttccaagacatagtgacgcctcatactccaatactctccatataaagctcacctgaactttatgcaactcgtgggacattgctcggtaagtttccattagggcttgattttgcttgtccaaatgcctgcagatcccttgtaagtagtgtaatgaactaaaatcctcaagaattaagggacggaaaagaaattcttacttggacatttcagctgaatgctttggttccattctcaccaacagcctgataccagttcctgcaaattgctttacattttaaaaatcatttaaaagcaagctagaaagttgaccgttattttatattaattgaggaattctgagttcacgccttgagggtgcagtgaggatggaatcgtactgctacattatgatctcattcaaaaaaaaatgaaacaaatatatgcaattgtatttgtttcttacgcataggagagctgccctggtaccctaggatgcaaggctcaattcagcaatgaacgacacatgaatgacatgattatttgatttgacatctaaaaacattgcacatatagtccgatgtcatcttgtcattctggttttctagaatcaagacacattttgttctctctttattggaaatttaaaagaactaagaaatagctaagatgaaaaaaaaaacaacatgtaatcaaatggacatggcaggctgctatttgacatggctatatttcaacggaacacaaagctcgttgaggtgctagagaacagtttacatactacacgggcccagtaaattttcgtgggggcatggacacatcacgagttattaacaccactgttcataaatcatagtagtatagtattattttgagaatatcatgcgtccaaaatatcctataggcacagttgcaatacaatctgcaggggcaatggcgggactaacatgggggcaatggggttgagatgaaccctaaataacaggaatcggcgtatgaaggggatgggctaattggagggaaactgggggaaaaaaaatcgatctcctatctacgcgacgctgactcatgaagtgggcgccgaggagggaggagggatacgagagaagaaccaataataccttagttcgattcgagcagcgatggaggccggccgtgcgcgcgaggaggccgcacggggtggaagcctgaagcaggctagggcgagttcaggaagaagaggggaccgtgctcaccgcgccgccgatctgctcgccggccgcggacacgatgaggcgaggcggagcaggtgcacgacggcgcggagcggggcggcggcgttggagctctggctcaccgtgctcaaaagtcaagacaggcaggaggtcgattgtggggcggggccgtgcagcgctctgctaccgcctgcctgtgggtcatatgcacaggcccatgaggctggaaagaagaaatttttcatctcggaaaaagttcacctaaggtcccttttcttgacgtcgagttttaaaaccgttcctgaactgaaataccaagatacaatgtatgtcacatttggtcccaaggcagtattactctatgattttggtgacatggcggttgaatcagtgtggggcccacgtgagcgccacatgtcagccatcaattttcttccacctctctcgactctcttctcatatcaacccaaacctctagggcagccgacaacgggtggggagaagggtgccagccggcggggacaagctcgacggcggagactgccggctagtgtggctcccaatagccgggagtgctcgtgtcatgtacctgactgcgcacccaactgcaattgcaatgtattcacctgcacacacaggggctggggcttccgccacgtcatgctgcccaagctcttattccccaaactcagagccatctccactgagctgctcaaaagccgatttgtttaggtgtcctcgagctttgtctctcccccgcggaggcgcacgcacagctccactgcatcatcttcgaggtcaactccatttactccacgctgtggtcgcgtcatcctcaacgcttccgcccttcttcccgccacccgccaccgtcaagcttctcgccggtcgccagccttctcccacccattgccggccgtcaccgtcaggcttctacttggcgtcgccgcccaacggccgctactcttctcccctcctgttgtcggatgccccagaggtttgggttgagatgggaagagagagaagataaatggaataagactcagccgccacatcatcaaaaccgaggagtaatattgccttgggacctaatgtgatctgattttacaagattagatatgtgttatgtctagtatttcggtttagggatgattttgaaacttgatgacaagataagagacctcacgctcactttttcctttcatctctctcgttgcttttcttttaagaatagtaaaccgactagcgaaggtgttctgccaatttctcagtagttttcacattccgttgcccaaaaataagttcttccatggcaggatctgctgtacgaggaggcaaggagcgaaatggtaaaaaagaactcgatcaatgaggtatataattaaggttggccatcctttgggaatgaatcaaatggattcaggatggaaaaatgtactgtatcaacagaagtagaagaaaaaaaaatatgtatttctgcgccagctgcaaagaaccatagcttgagctagcgtccgtggcgccatggctggagtacgtggatcattgctgctgcggtggagagatcttgaggtcgagcccgacgttgaccccgttgtacgcgatcggcgcgaacatccacatatcatccgagctcagaagctgcgcaaaacgatgaatcccattgctttagcttatggaagattagagaccaacgcgcgaattgaagcaaaacttgggctcttggattcgaatcaggggtcttatggttaccttgatttggagctgcaagaacttgacgtagtgaactgcttcttcaagcatcgtgctgatgtccacctgaaaaaaataacaagtcctcgcatgatcagagcaattcagtatcgtggaggcttttgtggagtattgtgattgatgcggttttggaatcagatggtttttaagtaacttaccttggttccatttgggataagattctgcagtatctttagccgttcattgatcctttctctcctcttctgttcaagcaagacagttaaaaaaaaattcagattcagatgagcaacaaaaatgtgcagcaactcgcgcatagttctacctaccctggcatagaggctttgcggatcggtcgccgccccgcgcccggccctcgccttcgcgccgccgtgcccggtcgccggcgatgacaacgacgacttcttggacgccgagctcacgttgctgcacgaagtcatctccagcgacagcgagtcgtcatcagagaggtagttggtgctcgagctctgcacattgccgccgtcgccgccgccattgctctccttctggttgctgctccggctgcacgcgcccttctgcgccttctttgactgcgcgttcttattacccttcttctgcaccacctgatgcacacatcgtcaggaatcttaatccgattattacgaaagattaatcagttcattaattgtacattttttttgtacttactgttgctgccgtggagcgcgccttcttcctcgcgacgttgtccgtgcagctctcatccttgtgatcctcaaccttcctcttgcacgccggtgtcatcttggtggcggcggcggcggcggcggcgctgctcccagcgccgccagcatcgccgccgtgctggtcctcgaactcgaggttcaggtccaccatgaagctcgggtcggccaccagctgctcctccggcacgaagaagtcgccgccggccaccatcgcgccgccgtcgtagcacccgtaatgctgctgctgctgcatgtagcagtatggcgccgagccgtagtactggtcggccgcgtcgtgcgccggccagtacatcgccggcggcgccgccgccgccggctgctgctgctcctggtcattgccgaagtactgcacgccgagcagctgcgccatcgcctccgagtcctccattgcgactgacggatcgaacgagtgccagctcgcctccgaggactccatcatctccaatggcgaagaaatctgtaacaaaatatgatctcgtagatggccatacctgtcctagtatttatatagcaggggcactattttttttttcatcagttcaggaacagaatgttcgagcgtacaattctgaccattcataatttaattcgaaacattttgggaaaactactgcacagttggcgatgccagacagctaacaaaaaccgctgaaattcgtgcaaagacgaatagaaaaaacacaaggccgcgaatcgcacataaaaaacaccatttcgtccgtgcaatgagggcgattgaatttggggtgcaatgagtgagagactaagctaatgattaggtgacttacatactagagtaatgagcagagctggtcttattatgtcagtgatttgtgttggatggtaggactgtagttggaagaaaagaaataagagaaaaaaaaatggtcgtgaaggagttggcaagatcgtggggaagagtttcatgtcatgtcattataatttcagagtgaaaataaatgtgtttgtttcaaatcatggattctgatcttttgcctccctatataggaacttcagataatgctaactaacaaggaataattttgtgtgttttttgtttgtgggctaaagtcggagggacagggaagctggtttgctagtgattggtgaaaaatatttggattaacttatgatccgtgcgcattcgcttgttagtcgcctagatcacgtcgatgcattatcagttctcctgccggcgagaagtgatatctttgaagctagcgaaactgtattgttccagttgttaaaaaaacgtcgagagaatatatatgacaaaacaaaataatgtattaaatgtattaggatttgtcatgacaaaacaaaatgacattgtttgtcatggagatatcactacactttcataaaagtacaacagagaagagtgtacaaaatcgtgcagaagtatatttacatgttgccaatagatattggtggtgattccttacattccaaactccaaatagtacatgcattgttttttttagaaactcttataatttgctctgttgaaactctaattacaaaatatagtaattatcattaatcttattgtatttcataataattagtaataaaacagattaattgtcctaataaacactaactagctgggtggcccgcgcaattgcgcggctagcacccaaacaaaatcatatattttccagtctgattttacttaaaatttattaaatagctatctcgttgtcttaagactttgaaagacaaaaccttatcatccacgtatttctaattatatagcttttaaaagtcacaccagctgctaccccttacttctgtcatatccttctttatttgcttactcgatttatcactatttttattcattctctttgaaacctttaaaaattggatcttataatttttaaagtttattgtctcgttgggtttcgtttttataatttctagaagtccagtcaaacactgtcattatactcctctacaacccgtccactgtcttttctctttattgtcattgggattttaaaaatcgaacataattatcgttcgggttccgccaaaccgttagcggctttgccattgtactcctttatggctcgcccgctgcctccattctttattatcattgagattttaaaatcgaacatagttattattggttttttttttactttttagaagttccaaacctttaaaaattggacctcgtagtttttagagtttattgtctcgttgggtttcattttttttttaatttttagaagtcccgttaaacgatgccactatactcctctacggcccatatgccgcctactctttattgtcattgggattctaaaaatcgagcataactatcgttggaatttattttttattttctagaagtcccgccaaccgtcggcggctttgcagctatactcctatacaccccgcccgctgcttcacctttttattgtcattgagattttaaaaatcgaatatgattatcaatgaggttcactttttaactttctagaagtcccaacaaccgccctgcccatttgcttcacggcctgcatgtcgtccctccttttaatcgttattaggattctatttggtgttttattaacagtttttatatatcgtatcagccgtcaacactctactcttttataggcctggtacttaatatatcttgtcatgtgttttagatggtcttttctttataaattgtattcctaattaaaatctttttttcattttcttatttcagaatttatttttttcaaattttaattaatatcgcatagtgttcttttaatatttttatttttttaaaaaaaatcaattgttttaaaattgtatttctacttgaactctcttttaattttgtctaattttggatattattttattttttattctaaattttaattaatctcgtatagggttcttatgtgaattcttctttcaatatttcttattttttaattccgaatttcagttaattttaaattgtattcctaattgaattcttcttttctttttgctaattttggattttacttttatttttgaatattaattaatctcgtattagattcttatatggactcttctctcagtattccttatttttaattccgaattttaattattttaaaattgtatttctacttggactctcctttttcttttctaatttcatattttattttatttttattctgaattttgattaatctcctattgggttcttatatggactcttatttcaatattgcttatttttaattccgaatttcagctatttttaaattgtatttctgcttggactctccttttctttttctccgattaatgtgggaatttttagtcaccacagcgaacgtggtgcctcctttcaaagttgttttaataatataatagatcttgaaatgaaaattattaattaacgaaaaaactaactatgtctaatcatttgcgttgacaaaagtggatggtctcatcaatcaatttagatgggggctcatccaacatcttaagagaatatatattctcttcagtgtccatcccatcccatccactctcgcccatgaaacaaaaacatgtaaaaatgggatgattatctttcatctattttcatcccttcaaccaaatagactcttaatggaccaaaagcttcaattttttttctcttcaaaaggcattcatagagggcttaacaagaataaaggaagagtctggagactcctagcctcttgggtggcctatcaacagttggatccaaaccaatgggagccttgcctcgatgtccaagcctgttgggagatacttgctaacaaaaaggaggtacccaagaaaggcatgcgtagcttaatcttgttggttgtctgagaaatctcgacagagaggaaccggcaagtcttcgagcacaagaagatagcgacacctggcctcgtggcgaaaataaaggaggaagcaagaacatggaccctagcaggagcaaaaaaagctccaggagctccttccaacctcggatagatttgtatagatttttttcattcttacgcctaggggttgtatttttctccttctatatttaatgaaatagcataacctcgtgccgattccttttaaaaaacaagaataaaggaaaacaaaatatatggggatattttcattttcttcagaaactaagctgtcagatattgtatacttcatatagttattcagactatatgtccttagaaaacacattgtagtcgctgagtttctaattttaaattatttatacaattttatatatgtaggctcggagccaagttttattttttgaaaaaaaacttgcagcaaattcgcattgcatccccaaaccgaaatatatatattttttattttgttccttgcaaagaaaaaaaagaaaagattaatttgttgaaagagatggagaatagttagagagaagaaacatgaacagagccgtaccagatatattcaaattagagccacgttataaccacgtccaacaaaccaaaactaaaaacaatcagagagaaaatcgaagccatatgtttggtctccttccatcaataattaatattctagcggggtataccagtggcggagccaggattttaaagttgggtattcccgtctaagcgttgagccgttggccgcttctacccctcgcggctgccggccacccaaccggcctgactgcctgagcttggcggagtggcgggcgccacccgctgcccgccgcggcaatagcctccccctccgtggtagcgcggtccagttctcgccgccagttgccgcctcgccgcgccgccgcctagggtttggaaatggggagcggcgcgagggagccgagccagggagggatgggtcatggagggagagcgagagggggccgtctggaagagtggtggctaagtggatcaactgatgtctgatgggtcatataggccggttgggctgtgtttggatcgaagaattgaggatttaggtgcactaatatatgtacatgtgtatagggctatgtttggatcgaataattgaggatttaggtgcactaatatgtgtacatatgtatatattagaaatatacttgtttttcgataaaaaagttgggtattcccgggaatacccgggaatcatggtagctccgcccatggggtatacagtaccgaaaagaaaattatctccaccatgctcggttgcacttgcacacgagtgcagaaccgccagatcgaaagctagcgaacgtatgctgctgcgatggcaaacggccgtagtacactagcctagcaggctagcactactactctactaggcgtgccacggcctttgctacatttttctaccctggtgcacacgacgtatcaggtagtaccctggtgttgtttagattccaactttttttttcaaattttcaatttttttatcacatcaaactttcctacacacacaaactttcaacttttccgtcacatcgtttcaatttctttaaacttccaattttaacatggaactaaacacaaccgtaatagaatttgtgatatgatttgaatctttagttgtttaagccctactaactacttcatccgttctaaaatacggtatggctcattcatgtattcaggggctatttggatggaggctaactttaccacagtataactttatttaccataagcctataactgtgtcaagccatacaaagtgtttgttggccacaaccatggtaaattttggctagaaaataaaaatatgacgcgtggaccattgtgctaataaagtgtagcttaactcaactatggcactcaaccagccactagcctaagaaattgtggcgcgtctaaggtttggtgtagcaaactgcggccactacccaaacaacctctcactctttttattacgcacaaccacacaggtgaagtgggggaacctaggccttattagtttggaaggatttctaaaggaaatctcaattcctttggaataagcactattcatgccttcggtttgtaggatttaaaggaaaattttccataggaatactatgccaatcctccaaaaatcctccaaaatgtactaattccataggaatgaaaatatctactctatcctcttttgtttagctcagtgtaggaaaaattcctatgttccaatcctttattttgcacgtgcattcctacattatttctacgtttttcctatgatttgaaaatcctgtgaatcgaataaaccctaagtggttgcctaggattgtggactctttgttcactagtggtactatggctatgttctttatagatgattcgacatatatattatggatattttttgtatgattagaaggatgaatttaagctagagtaatgcagatgaccagtgtgttggagtgtatgtgtgtccacctgcgttcgaaccctatcagaggtcgtcgcatgtgttcacctctcttattcttttatatatatatatatatatatatatatatatatatatatatatatatatatatatattcacctcccttcttattaccatttatatggaaactcctcttttcatatttagattttttttataggggtgagttacctattctatactccctctgtaccatactataaacgatattgagtggatgtggcatgaatatgaacacggagtgaatataaatttaaaaatagtagaactagttattcgagtaatgtcgatatgattattttttttttggagaaatcgtaatttgatatctgtggtacacctattcacaagtccgtaagttaaaaataacagggcctaataagagacgatgcacttaagtacttaacaagttaacatgcataacgttagggtattttgattttctcatcgtgcagcttggcgcacgaagttgagccctgagcctgcttagtcgatcggtctacgtccatcggtccatgacagacaacagtgttgtctggttgactgctcatgcacttggacgccaccaccatcatgtgcaccccgatgctcaaaccagtacgccaccaatcaccatcatttgcttgcaagaaaacgacctctatatccagtcaagaacacgtactctttttcattacaagagtcacaaccgattagcaatcgtatagaagttttgttgtcacttggtcgatcgacaggtgtccacaggatgagaacacacatgacatatagtttatgctttccattaattgctaagcgtgtgagttagtggtgcattagtggagttaagttttttttttttttgagaaagagttaagtattactagttaagtgatggatctagaacagcaaattaaacatgtcttttgacgactgcatttgagcagaaagtgaaatgatagtcaggattccggcaaaacacaggaataattaagagaatatgagttaaagaaaaggagtccgatcggatgattagctaacagataccttcgctctttggacataattcgatatccaaatgttgccgtaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaatgcaaattgctaactatgttttgtcaggccaatcagtgtgtccacgcatgatattcttcttcttcaacagcaatcgttctcgaaaaaaaaatactacttcccagtgcgaatattcagtgaattgttccggccatgacttccttttttttgatcaacttgcatgcggaggacacgtaaatttgatttccgtatcaaatctgtttagaccattgtactgtctacagctactctgttgagtaagaagactgaggttgtgtccaaacttcagccctttttcatctcatcaacctgtcatacacatacaatttttcagtcacaccatctctaattttaatcaaaatccaaactttacgctgaactaaacacagcctgaggtattttgtgcagccaagcaatgcattgcaggagtttcaaactctaaactctatttaggttgcgttcgagatgaggggttgggaaacctctttctcggcatgcaaaacaaaatacatattattacatgattaattaagtattaactatttttttaaaaaaataattaatatgtttttttaaaacaacatttatatagaaactttttgcaaagcagtttgaaaagtgtgcgtgcggaaaacgagagaagtgagttaggaaatctgggggaagaacacaatacaaggggtacagctatttagcgcacttgcattcttagcttatagtttttttctaaagactttcatctgcaaaactttcatccaaaaaaactttatctcaaaattttcataaaaaaacattcaacgaagaacttttatatgaaaactttcatatgaaaaaagtgtgcgtttgaaacacatgtgctctaaatagagtttagagtttgaaataactggaattgctaaccagggtggtaacagcttagctgcaaattgtttttatgatcctgcaaactatcaacttagcatatttcaagtctacataaccaaacactttcagcaaaagtacttaccagttaccagctaatcaaatgcgttgggaaaatattgatagacaatatacttattttgaacgcatgtatatcaggcccaaagttaaaaaaaaaggaagataagtagagcatcatgtcttgaaaagctgtgagtcgttacaccagttccacagatatattcagtaactcggtcaagaaagaacaacacgctttaaagttctgtttgatgtcttgaactgaatagtctactgttgatctggcaaaagaaatcaaccggaaccttaaacaagctggatgctaaagagaaaagaaagtaagacatgagctatctcaatattctcaagcagttcaaaacagacttaaaatcttcatacagattatacgaatgcagatatacagctagtgtattgttccctttctcattgaaatgaataatagttgacattgttagtcctgccacccggggaaatgtttggcttaagagaaatatactctataacatcgaactgtttggaccagtatactttttttttgtcgggattaccgaaggagatcatcaaatgtaattaagatagaggaaaaaaatgtttacaagaaagtttttcatcgacagcgagctgtcgagaaaggatgtgcagcaaagcacacgccccgacaccacacgccaaccacacagacacaagctacagagaggagagctgaacgccaaaccggccaccgctatgcgagaccggtcgccgccgggtatacaacaacaccatagaaaggatactccgaaaacaatgccttcacgaaggttgcgacgctaaaagacgctgtcgtcgcccgtccaaagaaattggacacggttttcacctagagatcctcgtcgagggaggaaggttcctcgacaacgcccccaagagggttactgcaccaaaaggcgtagccgctgccggcccaataaagcactaggctaggtttcgcctgagaccctcttcaccccgtcgctgtggtccgtcgcccgccaactctgatacctccaaccaaacatcagtagcgcgtggccttcaccgcaccggagtagggttgtcaaaaaagctcgagactcgcaagctactagaactcgactcgttataggctcggctcgagctcggcttgagcctaaaacgaaccgagctcgagcttgaaatgaggctcgtgcactttaacgagccgagctcgaatagctcggtaaagactcgagtattagttagtaactgtcatgtctcatgctttaccttggtctccaataaaaaatcatcgatgcttttccttggtctgctactactccaacattggtctatgtgaagtacagaagcaatcaattcttgaacactactcccaaagctagtagtagtagcaaagcagactactcctgtgctagtactagtagtacagtacactagtgctcccgtatggccgtatctctacacaacgtgcccagctacagctttctgtcagcttctctactttttgaaatatgtacacatgcttgtgttgcgttgatgcgagctcgattaggctcgaggctagcttgactgcaagctcgaaggttagtccaggctcggctcgagctcgactcgagttcataccgagctcgagcctgaggatctaagctcgctcgagctcggctcgttgacagccctacaccggagtttggaccagtatacttatcttattgtcagggccccaattggttttacatttcggctaataatcctatacaatataattttagatacacattgttaagactaagtttacatacacagccatacttgaacaaaatgttcctgtgggaagtaaattagtgtcaagaaaaatacaatgtagaaatgcaacatctcaacctagctcatacagattaaacactagactatactctatagtgcaacagctactgtttcatagaaaaggtacatccccaaatagaaatttcaccgtgaaagaacttcccttggctattggaaggaatcattcctcacctgagaggctgagagactcagactaacatacataaaacaatgttaattgacactactagcatcgaagtcaactaattaactagcacaaagtcagctaattataacatcacccgatcttagattagcaaagatgtgttaactaaaagagagaccgtcttatataattgaagaagaaagtgctctatcatagatccaactagtaggacaaaagcatatcattcaacaagggtgcaggaccattagctgaagaaaatgaactcttttatcataagtactcgaaaacatgggttggatatttgcatccctacaaaaccctttttccagaaatcctaacctattcggttcctaaagacaaaatgagaactactccctccttccctaaatgtttgacgccgttgacttttctaaacatgtttgaccgttcgtcttattcaaaattttttgtgaaatatgtaaaactatatgtatatataaaagtatatttaacaatgaatcaaatgataggaaaagaattaataattacttaaattttttgaataagacgaacggtcaaatatgtttaaaaaagtcaacggcgtcaaacatttagggatggagggagtatatagcagggtagtttaatcaatttcagatatgaaaagggtaatttcaggaaactgtttatagaagtctagagattatcttttttcgtttcctgaaaaagaaaagcagaaagagtatcaagtttcagttgagatttgctagttctgagcaatagcattggtttctcgttaggttcagatataggaatagatataagcattgtgcggttgttctccaatcgacttgggccaactacctgagcggcccaaaatccttaattgagcccattacccacatgggccgtagcccagactggaataacgcgaaccgccattcggccatcgattgaccttttcttctccaaaatgagggaaaaaaaacctgcgtgtaatcgcaactccatccggctcatcggcgagtcggcgtcgcgtcactcccgtgctccggcgacggcggaggaggaggcggagcggtcgccggaagccgtcccagcggcggcgggggggagatgggagtgcacgggctgtgggagctgctggctcccgtggggcggcgcgtgtcggtggagaccctggcggggaagcggctggcggtggacgcgagcatctggatggtgcagttcatgcgggcgatgcgggacgacaagggcgacatgatccgcgacgcccacctcctcgggttcctccgccgaatctgcaagctcctcttcctccgcgcgcgcccggtcttcgtcttcgacggcgccaccccggccctcaagcggcgcaccctcgccgcccgccgccgccaccgcgacgccgcccaggccaaggtccggaagaccgccgagaagctcctgctctcccatgtacgtggcctctctccccccattcctcttattggcgcagcgtattttaggtatcctcccaattgatactgtagggatgatggctgatttgtaggaaattttattcctaatccagtactagtagtgagtgatgaccagagaatttgcactatacactctattttagtaccagtacaacactacaatgacaaccaaatatgctatgatcatgtgaacaagagaatgatctacccaaggcccatgtattacttctctggggaaaaactactactgatttctgaaggatgatgccttgcatttctatgggaaaaaacgtgtcataaacatgtttctcagggttaatttacattccccacaaaaaaaattacaagcaaagggagcaatttatcccaccagcttcttttgtattggactctacccttgtgatcatcctgttatttgattgatctctttccactggaattccactattcagtttcttcaggaactgggagatttccctaggtcccaaatgtgtcctaaccacccaaaagtgtttgtagtggacataaaggagagttgtctaggctattaaatttgttctgatattttctcttaatttcctctagtttcttttcccaagagttgtctaggctattaaatttgttctgatattttctcttaatttcctctagtttcttttcccgagtagtccacactccattaccatactatatcatattgaaaaaaaaaattcaaatgaccattcgtttagcaatgatggtatggcattttaattttactagtattttaagtttgttggaaaggcaaaatcaatatctttatggttttgggcatgtggttccagctcaaggctaggaagcttgaagaattggcagctcaaatcaagagtgacagggctaagcatgacaataaaggcaagcaagttgagagcagtaaaatgggagaaattgagaaaattaatggagagcaaaagaaaaacaacgatggagaaaacagcggggggattgtagcaccaatcgaccaggagaaactggatgaactgtgtgtgcctccctatagcttccacatacttcttccttgttaagatcattaagttgatgtttttattgcatgttttaaggctggccgcatcacttgctgcagaggaagaggcaaatttgactggcaaaggaaaacagtatactgtaagtgttccattgcaagaagcagctgacattagtgaggatgatgacgaggatgatggagagatgatctttgtaagtatctggtttttatttgcttgatgaaaactgagtgtgccatctaagtttttcttattattcagtttcacataacatggtccctatctttttttagtgcacccactgctttttttttaatttattagttgattaaaaggtactggtttttgtaatccgattgcagcctatgacaacaggtgatattgatcctgcagtattagcttcactccctccatcaatgcagttggatcttcttgttcaggtaaagaggatgaactactggttctcatgtttctccttggtaccttaaactgtatgcaaccagagactaatttaagagaatatgattggtttagatgagggagagagtgatggctgaaaacaggcagaagtaccagaaaattaaaaaggtaatag

SEQ ID NO: 80694 - DNA, 628 bp, Oryza sativa
acacttggcaagttgatgaaggtagttggacttgggtcttctaatgtggtgcaaaggagtggtgtcaaaaccaaaagtcttgtagagccgaacgggattctcacgagatcctacagggaaatcatgagatgcccttccagccccagaactgcgaccaccacctctcccccgtcctcttgtattaggtgcatcacttccttgactactgtcaacatccctaatctgaacagttaggttgcttgattgccttgtaaacctgggagaagtacgagtgccactgccactgccgccctcaacaactttctctttacccaaacgaccacgagggaaccgaataggaggactctcatcaccggacacatcttgagaggctttctgtcttttctcacgagtcatagtgcttactgcaacaggaatcaacaatttggagtgcagtagttaggcaaaaattaagagaagtaagaatgacaggctggctggacagcgcccagaggttccgggtgcaagaacaccggaacttccggccggcaaaaaagaagaacagaggactcaaaaaaaagccagtgcatgtgaacaaatcctatagatcggtgatctacaaggtagcagaaacaagactatccaagtg

SEQ ID NO: 80695 - DNA, 151988 bp, Oryza sativa
tatgaggatgactcatctcgaataggaacatcaacttttgttttatcaaatgacagaaaatgggcctatagtagtacaggagattttgtgggtaatccagatgctgattacattgctagaaacacatcagaactcacactggatcaccctgagttatacactgaagctcgctctcacccctctcactgaaatactatggagtctgcatggaaaatggtgaatattctgtagaacttcattttgctgagattgtgtttacagaagatcatactttttccagcaatggcaagcgcatttttgatgtttttatccaggtaccattcccttaatctgtaggatttgccattttcctttatgtcataatcttgctggcatcttaattctttgctactcttagtttataccacttgtcttacttcattattaaaaaaactatcagaaattttgtgttgaaaagccatcattatatttggagaattcatattttgtctggagcaaatgattgtcctactaacaaaaaggatcaacaacaattgcttgctgcctaggggaacagttgtctcagttatagaattcttacttcattcttaataactatcagaaattttgcatggaaaagctatcattatatttggagaatttatatattatctggagcaaatgattgtcctactaacaaaaaagatcaataacaactgcttgctgcctggggaacagttgtctcagttatagaatttaccatgtttagtggcagtttcttggtcgccccttggtgtttagctcaggcgcttttatgtttccttcgttgagagttgtgtgaagttgtgtgagttgtgtgtggtgtgtgttgtagggctctagccccttttctctcttcttaatttaatgaggcgtagttctcctgcgtttttcgagaaaaaaaagaatttaccatgttttaatgtttgaaaaattccaaaacagaatcatgaatgcacacagagttgtgcaaatccacaaaatccaatttcaaatccattatttgtattaagaagcgacaaagatgaaaattggataatctgaaatcgtcagcaacccaagtggatataaaattatgaataaaatatggaagtttcttttcttggttactttattttttgttggtgtaagttatttcctgctcaaatgatttcttgggcacctgtcctcactttcttgaatataccatgcattatttaattcttgttaaagtagcatcatacaaatatggattactgttctcttaagacattattaactaagatttgcaataatctgccagggtactaaagttttgaaggattttaacattcaagatgaggctggtggtgtccatcgtgtaattacaaaaactttcacaaccaacatcacagataatacattggaaattcacttctactgggcaggcaaaggtaccacaggtgttcctgaccggggtgtgtatggtccattgatctcagctatatctgtgatacaatgtaagttctttgcactcccaactaaactgtcttctttccaacattttacatgtgcttttcaagctctctaattacgcatggatactgtttaatcatatcttctcatatgcttggaaattagctaactgtagtacttgtacagtaaacaggaaccatcatggaatctctactggattgatgattactataatagtagcagcatgtttgattgtcatacttgcgctaattctttgctatatcaaattcttccggaaaaagaatctgaaaggaaatggtaagttgatattcattttctaccttgtcctacatactatatgaatgtatgttatcttctctgtctggtttagcatgcttgtcattgattctaaactatgaaattcataaaacccctaggttttggccttttggggaatttgtagcgtaaaaccttaggttttcccatgtataaagcaacccaggtttttgggcaaaatgttcaacaaaaccagatttatgcaaagtacacatattcttataatgtgtggtattttcaaaagcatatactctattcgttgagaaaatgcctaatgtttctatgcacacaaaatactgcataatatttttgtccaaatattatgcacaaatactataccatgggaattagatgatgtaggatgtacctgggttttatgaagcatttccccccaattcatggggttcttcgaagcaaattgcaaaacttacgaatgccccaaaacctgggatgtgaaatttactaattttgaattcaagtatcagcccgtaaacttattattgaagcaaccaacttgagcaacataaaccaaaattgtgttaattcattacataaggaccaaggggatgctatcctttttctggctgtattatgcagttgaaagtttataactatctctaaactagaagaatgtcaataaaaaaaaattgatatgctcgtcagctaatattgacgacagacatccaaaatacactagtgtttctaccttctagttttaatattttactgtgcatcacaggtttacaattcttttaccatggaaggaagaccgatacttcagatcttcagacacggacacagtacttctttagcttaaaagaaattgaatctgcaacgaaaaattttgatcctgcaaataaaattggtgagggtggctttggacctgtttacaaggtaaaaactgtgaacttaaggttttctcccttaaggtgttagaatacagaaaatttactttgtattcatgacatcactgcatatggtatacacattttgggtgtgtttggataatgggaaatggggggtggtattgggaatgggaaatgaatgaagggttaagattaaatggaaaaggagaaatgaatggttaggatttaaagatgtcttttggtgggtgggaaatcatttcccctatcccattagccaaacactgcctttgggataagtaattcactgccactgcaacatactcagatgatcgaacataataactaagaaacatataaataataataaaggtgaatcgaccagcactcagatgtaataaactaacagtaggcattttaattcagtacctctttcattcctttctgagttgtaacacactgttaaccaatcttctatcttcagggtacactagccaatggtactacagttgctgttaagaaactctcttcccagtcgagccaagggaatcgtgagtttttaaatgaaataggaataatatctgccctaaggcatcctaaccttgtaaggctctttggttgttgtattgatggagaacagctactgctgatatacgagttattggaaaacaatagtcttggtcgtgcactttttggtaagactacataaattcagatgatatttccaaactggttttcctgccccaaaatgaatttccctacaattatctagttcaacgctcatcgtagttggtaagagcattctattctaatagtgtaccaatttttaggacgtggagatcatcaattgaaactagactggccaaaacgatataatatctgccttggaacagcaaaaggcttgtgctatctccatgaagaatcaacattgaaaatcatccatagagatattaaaccatcaaatattcttcttgatgaaagactgcaaccgaaaatatctgattttggtttggctaaactgaatgatgaccgtgggcgtatgagcactcggatagctggaacagtgtaagctgtcattctatatttttattggctacttcacctttcattttctattattgtatattgtaaaaatctttattatccaacatctgataccgttctttatttgaaccagtggatacatggcacctgagtatgccacgagaggttgcttgacatgtaaagcagatgtatacagttttggagtggtgacattagagattgttagtggaatgagcaatacaagtagcatgtcagatgacgaatatctccatcttcttgactgggtatgctattttagcttctttttttctgttactgcttttgtcttttaggactcgaattcataaccagccgtccagccccatagaattgggtatgatcttatgggacgaatttctgtcatagatatgttatcttttataaagtcagtttgcttaactttggagagctctgtcacattttaggctgataatatgctgagtaattgatgatttggattggctgttcaaaattatgttatgataggaataaaggtcaattgtaacataaaccaacaacattagttccaaaaatcgatcatttgaatggcagctattctgctatagccaatgaaataagaccaagtttcttggtactcacccaacggataacaatggataatcagtctgtctagtagctactgagattctgtcaaacaaaggctaacaatgaactaggtgtgcccataaacaattttctcttgatcaggattagcccacaaacaaaccaatattcttcatgccagaagaaagaattgcctagtgctaactgaaagtgtttcacatctgaaaggcgaattacccaagaaatttagccttgcattgcatgttaatatcaccaagtaaactgctgatagtcctgctacacattttaaacacgaatctactaactggatttattttctgcccacaggctgaaagattgaagcaggaagggagactactggaaatcgttgaccagcgtcttggttctcactactctcaagaagaagcacttaggatgctcaatgtagctcttctatgcacaaacacatcacctgttcagaggccaagaatgtcttcggtggtgagcatgctctgtggccaagcccctctagaggttgtacctgatgaagatttgagtggatacatcaggcccagttactcccaatccaatcaatccatgaacaacagcctaacggagtggtcctacgcgccatcgagcgatccttcgatcttgctgcagaacagtatggagagtggttacctcccatcttcaagctccccttcttcaaagctgtgagctgcagcaccaggattagctaggatgaaatgttggcaattgttttgagcccaatgcagcaactgtacatatgcatatgcatttgctctgtctgtaatcccctgtagtttggcattctgtcagttgtcctcagccttctcatccatggcatatgacaattgatatcaatgatgcattgccatgatgatatattcttcacaaggggactggaagcagatattggaatctgatgctgctgatgtgatggtacatatgaattgagcaacttctcaggggcaccacttgagtttcttgtttgttagccttggtcatcatgtatctagtaaatgcaatgtacaactaatctgtgcaaatgtggatatctagtaagttttttttttcttttcttttctagctaggaaggttattgtttggtgggcaagtagagaagacatgtaacataataacagttcagtgcaaactagtttctgcccttgttaacttaaaaaagaaggaaaaagtacactcaaggtccctcaacttgtcatcgagttacaataccgtcctcgaaccgcaaaaccggatatgatgtatcctccaacttaaaaaaccagtgcaaactaggtctctggacggttttcactccggttttgtcctatgtaggagctgactcagcatgggacccatgtgggccccacgcatcagccacttcttccctcccctctccacctctctttctctctctcctatcttttccaaactgcacgggcggcggccggcgggcgcaggcggcgtggggaggagctgcgtgcgggcggcgagcggcggaggctgggcgggcgggcggcggccggcgggggaggagctaggcggcggtgcacgagctcctcgccggacgaacgctagaccggctccgccatgtcggccgcgaggaggtggcgcgcctcgtcggctcgctcagccggagtgccgccgccgacgttaacgcaaatgacctgagaatttgagatcattgccatcttgctgttctccttcaagccctatcaacaagattgacacgattaagcactggatcgagatatgatcgatcgagcagcaccgacgaactagccgccgatcatagagtcaaatgctcacatctcaaaagcttcaatccacgtggacgaatcaatccattaaacttgtacgcatgcacatcacgcacgaacaccacaagaggacatgaagcttcacctgcaaatctctctataaatacatggcaaaaccatcaacctagctagcatacagcaacttacacatgggcctcgtgcatgcactcctccccttagcaggagctgctcctcgctacgccgccgccagcgacggccgacgacccgggcctcgtcgtctactggggccgccacaaggaggaaggctccctgagaaaggcctgcgacaccggccactacaccaccgtcatcatcaccttctacaacgtcttcggctacggccgctactcgctcgacatatccggccacccgcttgccgccgtcggtgccgacattgatcaagcactgccagtccaggggcatcaccgtgctcctctccatcggcggccagggcggcggctactccctccccaccaacgcctccgccgccgacgtcgccgacaacctgatctggaacgcctacctaggcggccaccgcgccggcgtgcaccgccccttcggcgacgacgcggcggtggacggcattgacttcttcattgaccagggcggcgcctaccactacgacgacctcgcccggctgctcaacggctacaacaagtattatgatgacctcgcactgcaggtttaacgtgctggtgagctccgccgtctcggcgaccacgctccacatctcctccgtgtcattgtcgtcgccggcggccggcccatcaccaattcaccatgcgagagacgatgtcgctggtgaggcccatcagcgcggcgtcggcgtcgacgtgctcgccgttggcggcactccgactgagcgagccgacgaggcgcgccacctcctcgcggccgacgtggcggagccggtctagcgttcgtccggcgaggagctcgtgcaccgccgcccgccgcctgccgcctgccgcccgcgcgcggctcctccccacgccgcctgcgcccgccggccgccgcccgtgcagctactccccgcgcgccgcccgtggagattggaaaagagaggagagaggaagagaggtggagaggggagggaagaagaggctgacgcatggggcccacgtgggttccacgctgagtcagctgccacatgggataaaaccggactcaaaaccgtcttgggacctagtttacactggttttgtaagttgagggatgcgttatatccggttttgtggttcgaggaccgatattgtaactcgatgacaagttgagggaccttgggtgtactttttccaaaaagaagtcatgttttgttcattggaagttcattttggtggggattgggcctggatttgggctccctaaagtctctctggatcactggatgggtcttagccttggtccatccacgcccatccaaacaagagcctaacacaaattaaagcccatccaaactcactgaacctgaaattgatcttatgaaaccaaaatcggagatgtgaaacattcagcagcactgcttgattttctacctttctacacgggtttctatttaagcaccatgaatccgtgagaatatatactgtcaaagaccatgcaagatctaatcaattttaacatctttcaactattgctaccacatatcatagatttcttcgaaatgctactgctcctagtccaagaaaagacaccacatcaaagccaaatgcagaaatgctagcaaaaggctcattttataagtaattccggtacgctttttttccaagcacaccggttgaccatggttccatttcattggtactattttttctcctcgattacatggaagacacatgtcttttgtcacttgctatgtacatggccaaattaagctcattccctatttcaaacaaaattaagttcccttcttatttcaaacatgtccttttttttcttgataatttagatgtcgaaatactgaacttcataagcatggatagaggggggaacttatcatactcacctatttaaaagaaaaccataatctgcaaggaaacactctgcaattttatcacgtggtccaaaacatactattccacacacacatatacatagattttttaagttctacatatataggaggcagagaagttccacacgaattttataggaatccccacatctaaaaacacacatcacagaattcctataaaattcctgcgttacaaaggaggccttgtggcacgtagccgagacgacaacgaactaacgctaattaaattactactatatatgtgtacgtcacaaatagtagttcatccatctcttcccttttaaatgcgatgcggtgcatcgatcaagcatctcgatatcgatctcgaacagaaagtagcagtagtagtactggcagtagtaattaattagggttcttggtggttagctagatagaggttaggtggaggagttcatccggttcatgctcttgaggaaggagccgctcttggtgatctcccggaggggcttgttggtgaagcggatgatgttgtaggcccaagctccggccaccgcgccggcgaccggcccgacgatgtacacccagatcgacctgtactcgccgccgatcatcgccggccccaggctccgagccgggttcatcgatgctcccgagatcggcctgaacagaaaatgcacatgtcatcaatctctgatttttttttttgaaaaagaattatctgaatctctgaatctctcatcccaaatctttattagggcttgttgatcattattgtccaatataaaatgatgctggttaaaggtaggtaaaagggtacaaatgaattttcttcaacaaaacacaaaaactctgtttcagctttttttacggactctaattaatctcaattatggacatttgtttataagaattgactaaacattatttatacattaattgaaaaaaaatagataagaacaagttatctaagccttagtgaaattgtgaaaagaagaaattgtagtttgagaaccgtgtaacaaaaatctacaaattcataaggtttaagtcgtagacccgagtgttcggtacaattccaacttcacgggataaaaatcttacgggctgtttggatgggactaaaattttttagttcctttcacatcacatgtttggacactaattagaagtattaaacgtagactaataacaaaacctattccataaccctggattaatttcgcgagtacgagctgtatcaaacggggtccatagtatcatgtcacaactatggttgtgtttagttacacgttaaaattgaaggtttgaaaaaattagaacgatgcgacgaaaaagttaaaagtttgaagagaaaaggtagaatctaaatagggcctgtatcaaacggtgagttattgagaggcaggcaccatgggtgaggagtgaagtggagtggagagtgtgaatttacaagctaggcggccggaggtaggaggagtaattaagttgacattaatgcttggttgcagtgcagtgcatggccgatcttcactgcaccaaccgcagcacactcaaagccctgcgctccacatgaccgaatttattggttggctttggctccttcaaaacgcactctccctaccgaaaaggacgcatacatctgatctagtctgaactctgaatctgacccattgttttcttaattttgactggaaattatatactactactactactatggcctggtttggtttagtttctaactttttctacaaactttcaacttttccatcacattaaaacttttctactcacacaaacttccaacttttccgtcacatcgttccaatttcaactaaacttctaattttgatatgaactaaacacaccctatatgtttcatgggcatggaaagaagtggatcgataccaacacattttcagcctctagatcctctttgaaatactttccattgtgaagagtaattaattaattatcatcatgagagagatgatgcgtgaaagaaagaaaaattaaaacgtacccagcaatcagcacgttaagcaggatggttgcaccaacggccagccctgccagctccccgatctgcatccatgcatatggtcaacagaattatcacttcaaaactttcagattaatcaggatcaaatcgatcctaattagtggagcaatcaaattacagatatatagaaactaattaaactagataattaattagcggagggagcaattaaattaaatgaattaaaatcgtgctaggtagcttacggctcggttgtcggtggcgacgccggagatgacgaacatgaggtagaaggtgatgatgaactcgaggacgagcgactgcacgtcggagccggcggggagcgtgccggggaagtgctcgtggcggccgccgaacatgagccggagcgtgccggcggcgagggtggcgcccagcatctgcgccgccgcgtacgccggcacctgccgccaagggaacctccggcacgtcgcgaacgccagcgtcaccgcggggttgaagtgcgcgccggagatgtgccccacggcgtacaccatcaccatcaccgccagcccccacacgatcgccacccccgggaacgtgatctgcccgttcttgctctggttgatcgtcaccgccccgcaccccgcgaagatcaagaagtatgtcccaaagatctccgcgatgatctacaccatgatcgatcaatgcgcgcgcccgccattgtcaagatcaagaactctcaagatcaggaggaagaagaagacatgaaatgatgatcaccttctggatgaaagggacggagaaggcgaggccgcagccctggccgtcggcggcgaactcctcctgcttcctgccttcctccatggctctctgctcgtgacctgagccgccattggtggtctgggagttgttgtcacctcctgccatctctctctctctctctctctctctctctctctctctacagatgcaggtgagtagagaaagaagaagaagaagaaggatacaactgcaatggcaatggattcgccgatgacccgggctcctatttattggcgccaagcaagctaagatctctctctctttctctctccttccatggcagcagctgatgctgctactgcggatagtaatcactttccaagccgtttggattgaccgagcccactttaatctcctggttgttggtgtgctccgttaactgctggtgattatccatttaatttaatcgtgatcagggattaattgattagtatctgtttggtttgtttggcgtgtcaaaaaagaggattatctgttggtccaatgagaggccgaagggagtaacaaaattgggattcaaagcccacctacccaccagtggcagagtcgacaatcaagtgaaactcttcacaaatgttttactggaggcacagttgatggaagaccgtcagaaagtatggctaatcgacaagcccgggaatcccctggcaaaattttcatcatgtcatattgaatgtttgacatatttatagagtattaaatataaacgaaaaaataactaattacataaattacgtgtaaattgtgagacgaaccttttaagcccaattgctccatgattaatttgacaatgtggtgctacagtaaacatttgctaatgacagattaattaggcttaataaatttgtctcacagtttacagtcggaatctgtaatttgttttattattagaccctgtttagatggggctaaaacttttaagtccctatcacatcggatgtttggacactaattataaatattaaacgtagactattaataaaacccatccataatcttggactaattcgcgagacgaatctattgagactaattaatccatgattagcctatgtgatgctacagtaaacattctctaattatggattaattaggcttaaaaaaattgtctcacaaattagctttcatttatgtaattagttttgtaagtagtctatatttaatactctaaattagtgtctaaatacagagactaaagttaagtccctggatccaaacaccaccttagtctacgtttaatactttaaatatgtgtccgtatatctgacgtaacacgctaaaactttacacacatcatgccatcatggatctaaacatccccatagtactgaatagttgagtaaattcccaaactatatataactttttttctataaaaatataaagaaaactattactcccccatccaagtataaggttttttctgatccaaattttataccatagtttaagaggattattgtaatgatttccatggttcccattattttcaatgatgcttggaaaggaaatatgaacaatataaaatttatgattaatatctgaagtgactaaaatggaatctctcgagctaaccttaatattggctaaacaacttataaatctttatatttttggaacagagagagtaaattattttcttttcaaaaaatacacatgtacacccacgacaatagatttgtgcctacattgcatgcatatattctttaatggataattttaccattcttgagaaggtaccgggaggtactatattttttatttctagtataaaatttggtacctctaggtagtaagtatcttgaggtaccaaaattttagtataaaatcttggtacctccaggtactttctcaataactataaaatttctctcctttaataatacagtacaccctttcaaagtaggctcaagaaacagaaggcaacgataaataatccatgaccaaaaactacaatattgtcagctatgcatgaaagtcatgacaaatagactcatcgattggggaagagtcctactgcgatgctcccccataaatgaaccattgatcacatttaatcaaaagattcagatctatttatactatcattctagttagcagcagtggaaacgtagaggggcatcattgtaaagaaaaagtgcgaatgaatataatcctcaattagcagtaactaaactttttttccttctttcttttttggctttttggtagaatatgagcgatgccaacacaatggatgaccacatatcgatctgggcagggaaaaacctaaatggcaaagttaccaatcatcattatactagtaaattaccgatatacccttaataacgaatggtaccggtagagagcaccggtgcatcactcatcgggaaaaacattagcgatgtaggggtggaatcgtgggtacatgactccaaccgctaggattcaaatcctagtacccacgaatattgtacatatgcaggtgtgcttttaacggaattttagtaaaatcatggatgtgctgatttcagtctctttgagagtgtgctaaaagacgcattcgtgggtgtgtgagtgtggatgttgcgtgtatagtggtgtttgtgcgtgtgcgtctgcagtgtaatcgaaaaaaaaaaactcatcgatcattcacactagtggagtgtaccagataaattttcgtcgatctccgacaattttttgccattctaattaattttcaagatgggattgaagagtgttgagatacccagaaggatatgatcgtacggcagaaaaagcatggccaatgaaaaaaaaaacgagcttttgtgttggacaaataatgcacggccatggctctgtgaatcctcttgtcgccaagttaaaagttgcaataaatcgtcgatcggcacattaactttcaacgtctcccagtaaatgcgagtgctttatggcgatccaacaaactggtatggccatgccttaattggtttagtttttatttttgaatcttgattggtctaatttaattgtgaaataaatagctcggctcctattacggtgaaataaatgccgtccgattgttaaatttaaatcatatattcacatgtatactatatactccctccgtactcgtaaaagtaaatcgtttaagaaaatgtttaagttaaactttgagaatataaatcataaataattctcaagttgttgagtttgaaaatgtaaaaattatatgaatagatttgtcttggaaaatactttcataaaagtatacatatatcactttttaataaatattttttatagaaataagaagtcaaagttgtgttttggagaccgtgtcgctgtacaaaacgacttcctctacgagtacggagggagtacatgagattttctggcatttctcataagtaaatcatacatggtatatactccctccatttaaaaacagagagattttagttttatcgtaaatcaaacttatctaacttcaaatataaaagcacaccaatacattaaacaccaaattagtttcattaaaataaatattgaaatatgtgccttgatagcttatttattggtatcacaattgttaatatatttttctataacctagttaaaattagagaaatttcacttacacaaaactaaaacctcctatagtttagaacgagtgaatactctttaactttgaggctgcattaatttgtaattatgcatttttgttcttagttttgacaatatttgtaattagaatccatgcattctaaaaaaactatttaattaagcgaattggtgtacttcaccttcacctagttaggtttcttgcggtggaatctatccatcctggctcatgtcctaaacttgagatggatacttatatgtacggttaattattctatagtagaagccaacaacaagatactcatcatgacttcatcggtcagaagatatagacgtgggtagggctgaaaaaactcgattagctacctcggtggctcggttcaaaattgctcgccatgatttgatctttttcttttaaaaaaatattcaattgtaaacgaaagttatttgcgctttggcttggctccttacttcattaacaagaataggcacaattgatagataaaaatataataaactagaaaaaaatgcccgtgtgttgcaatgggtgaagtctattttaatcttgttatatggtttagttaagatgaaattcactgtgggagtttgcttggatatatatatttttagaaaatcatgagctgtagttaggagtccgatcgtctcaagttagcatacgagtttttttaaaacatatttcttgtatgattccttctgtattaccaaaagtgaacgatcttaaaaaccgactcaaacacaaatgactaaccgcgaaaacatcttcaatttttataatcgactcaaacacggatgacggaccgcggatagaaacatctttaattattataatagtaatagatatatagatatagatatagatatagatatagatattgattataggaaaataactttgaagaatgctagataaaaagttgaccaaaagcttcttttgcaccggaagtgcgggtgtatgctttcatacaagtgagtgtatatcagtcggtactatgtttcgaaaaaaaaaaacaaagacacgagggtagcatgcatgcatccacggtgtgtactatattaagatgaattgtgcgcataattaagcacgtacgcgtacgtccacacataataagcattggtgcgaaatttcaaatttatgcttgcttcgaaaattaagattgattgaaatttggaagtttcgcaccaatgcttgctttcatttggaagtttcgcaccaatgcttgctttcatagttcacgctaaaattggaagtttgattgaaattggaacgatgcgatgaaaaagttagaagtttatgtatgtaggaaagttttgatgtgatagaaaagttggaagtttgaagaaaaaattgagaactaaactcggcctcattaaactataggatgtgtcacatccaactaaaatctcttattatgggacggagggtataaggttgtactatgttatttttcaaaagttaagggttaggtgagatgattttcttcactactaaattacaaatcgttaggcgctctaaataagttttcacaggcagatagattatcgttcggaactaaaggccactgagaatcgacaatgtttgtaggtttttccacacccacccatcaggctgacctatgaaagcctttttttttatgcaaaaaataaaataaaaatctaaaaaatctagtagtcgttgctccccgtatccatcatgagctccttgccagatccgtcgtcatcacctgagctcctagaattggagctgcatactagcccccatcccccctccccaatcgcaatcgccagatctggcaacctgttatacccaccaccacagtatgtggatgacccctcgcggtcatcgttgtacgtggttggggtcaccatcattctcgtagccttgcgatcaccgccgctggtaattattatggtcgaagtcatggatctagagcagctcatgagtcgccgccccgtaggatcggccaatggtggtcgatccggtgctcccaagcaccgccgttgcaagatctgcttcctctaaccgcatctgccttttgcctttttcccgttcgctttgagtgcagtcatatttcacccagagcgtcaggaccagatctaatacgttgaggaagactgaagcaacggcgataccactggtaggaaaggatgaaaggccgaggagggggtgttgggagagagagaagacgggagtggaggtgaggagaggccgaggagagggcagagatatcaaggaaatgagcgagagtggagacagaggaggtcacttgtatggtggaaatgagcgagagtggagacagaggaggtcacttgtatggtggtgttgtagatttttaatagggtatctatttattacgtggaaggtgccaaagttttgtagcggtgcttttcagtcatcttattggttaagttcaaatttgaactaattagtttattagaatattagatttccgtatattgaaactggttcgtagaaatgtttactccctcataaaaaaaacccaacctaggatatgatgtgacctaatccaagactatgaatctggactgattcatataatagatcacatcctatatatctaggttgatttttttaaggactgagggaatatattattatatatagattttaattagaaaaaattatagtattttaaacagagaaagtactgtgcaaagcaatagccgccgacgacgacggacggcatgcagcaacaaccgcagcaaatgcagcgggagtgtacaggtgcgaagctggctggagtcgcaaacaaaggcctctcatctcactggccgcccgtacgtgcttcattcagtaataatggcggctaagcttgcttgccaggacgagatcgagcagccagcctgcagggcgccattgccatcgccaaaatggagaaaatatagttagctgctggcgaggcaggcaacccgtgttgggaggaggccattgataagccgaaaaccttggtgcatgtatgcgtgtgtgttctcgcataattaatcagtaatgctcatcatattattaatgctgtacatgtactccctagctagagctagtacctagtagtatgcatattggatcatcagtatttgcgcgtggtcattaaatccttaaacctaacacttcaattgtcatccacgatctgggtccgttaatcacttgttattacgcacactacggagtggcttgaatcgtactagctagtacaggcttgttttttttttcttttgttttgttttcctttcgatcatcttcatgcagggaccttattgactactgtacttggatagttcgatccgactgctagccaatcgctctattcaatcgactagttcggtcgatcgccggtcggcactgccagccttgataaccaatagttaagggggctgtttggttcactccctcactttatcaaactttgctatactttttaagatatatgtttgtttcactttcaaactcgtggcatgccacagttttttaattcaaaggcccacatgtcatacaactattttttagccaaaccatgtctaaggcgtggccatcaatttataagtcacatatttggctagattacatatttggctaagtttggcaagaaggtttggtaatgtttgggagggaaccaaacaactccttaacctttactatagttctgttgttgggggacgacatcaggaggggatgaaatcaggcgctgacgtcagcgcccaatttacgtgcaaaattaatttaaattgatttttctcttaaattacttatccaaatcatgatccgattgcaccattaaattcgttgcaattaaatcttcaaaacaagaccacacatggatatattccgacgaaaattttttttagcttattattgaattatttttaaatgttgcacgatgttccaccaggtatatcggaattgtttcactaagtagatcaaaaatgtcactcgtttaaatcgggtgttgttttaccttatataaaaacaatgtttcagcaaatagcgaaagaatgtttcagttcactgcaatatttgatccatacatagtgaaacattacaagtacactaagtgaaacatttttcggtggaacaaaaaataaaatgaattcccttaataggaggtttccaaaatatgtggttttttttgttgcaatggaatatttcagttcactgcaatattagatctatatatagtgaaacattgtgagtacactaggtgaaacattttttatggaaaaaaaaataaaccgaatttccttaatagaggggttccaaaatatgtgggtttttttgttgcaatagagttgtttgtgtgtggacacgtggtgggccaggggagtgcagacatgcacgcgcacgcggggggcggggggagcgcatgatttttcctccccccgcccggtcgcccggtgcacagcattatccctattgttggtttggtttcacttactcactgctgaaaaagcgattttcacggatgaggtgcttatgttttttcaagcgaagatattttcttttagcagaaatccgcctgcaaaatgtgtgggtggggggtggtggggggggggggggttgatgatggcggtccacatgtgaagatcaaggaacatgactagtcatggccaaattttaaatttgtttttttctccaaaaaaatggtgatattattaattaaataaagtgattacaattccggaggcacaagattgatcataaatataaactaagaaggtagcccgtatattcacgcgtgcatatatcataggctgcatttgagatacttgtaagtaatagaccgattgtattagaatgtcgtatttgttatatagcaaactataggcatgtggatctaggcctgccactcggtattcattacccatccgatatccatacccacattatttatgtagggtataggtaaacaaatttacccatttaaaatttggatttgtggagtgtattacctattttacccactttgtacatacccattttctatgcgtaaaacttgcacctaaaatttttaaactctcattcacattacaaaatcttatcaaatttgactttaatttggagggatgatttctgaaagagcaattttgtacaaattttggtcaatttctacattaagacccacatatgtctcttctcttatccattggtgtacccatacccattgggtaatacccacttaatttaggtatgagtaattgctagtgttatagataaggcatactcaatagtcttggtttaggctcgatggagcccaccatataccaagtcttatacaaaatcatgctttattacagaaggtatttcgaataaggaaggagaaacagagttttacttctccctaattctattttccatagttctatttgaagaaggggatattcgagggcataaatacaagatccctagaaggaaggagaacatgcaacacgtctagatagatctagacatgccaaaacaaaagacatgcccaatccggaaaaaaaaaacaagagggatataacgctacctccaaggctatctcactgaatttatattcaaagacgaagacaacattagccgtcgactatgattagatgaggatgagtaaaattagatatggatattggtttccaaataccctccatgctcccattaaattaatttcagttatttgtgtccattatctattaaagaaactagtttactggtgaatcggctactgtatcacacatccttccgaccatgcatgtagcgatgtgatgtacgtaagccatcaattttcataagttttcctaattaacacgcaacaataaacaaggctgatcatgccggtcactgaatgaattatgattattagcactccactagctagctaattaacgagacctaattaacgtacgacgtacgtggatattaaggtagccaaacctggagaactatatagtacgtatatagtatatactactagctagcgcagcatacttcttcagatgttttgactgatcaaggaaaaagatcgacgtaggaccgactaattaatttgcatgtattaatttatactccctccccatcttagacaaaacatcatttttctcatataaaattatttttttgacgaaggaattaaccacgtatatgcaaactatatatactgtgtggttactggccttatcgcggggtacggtaatagaaaaaccacggtaacctcctcaaattcaaataaatttaaaaataatttaaatttttgataaattttgcacagtttcgtacggtttttcacgggttaccgcgcggtaaccgtgcttaccgtcggggcgcggtaaccctggccccggcggtttggaaaaccctggatctgacacatgcaatcaatagatgcatatgactagctagcttgctgcggattcatcagttcttcatgcttaattacgtgtaagtgagatcatgcacacgtttggacgtgccgtacacgacctggtagtagcattggttgacctggagtgaacacgaacacaacgatatactatatatacatacatatcaacccatgcatatatgtggtatttttttttgtttgaacattcatatatgtggttagacgaccaaatattcgagtcatgctttgtatctaagctatatagatagaccaaatatactacggcgcatgtgttaggagagatcgagggtagtctttacgcatgtagtgtgaatgtgtgatccgtacgtggccgagcgcaacaaaagcacgtcaatgcggcgtgcttacagtttttctttttctattttctcttctttccttccaactgatggtagggaataaaaatgcagggatcctaattagggcacacgtaccagggagagaattaagttgcgcgcagttttcgactgcatggcgacaaactaaggttaaggttagggtttcgggctgggggaagggagggtggtgctgggaggaggaagtgtggggaggatttagagggatggcctaggaggaaacagaccaacagtgagtagcggacaaggccagaaggcaaggtggcgatggcactgctggaggcgccgggtttgcagtggacaatgggctggtgatggtagcagggataaagtgaggcgaaggggaaggggagggtgaggaggccggccgggcagggcggcacgttccgccctttcggtgccagcaaggctggggcggcggcacggtgggggtggcggtggagctaacctgttaccagaggaaggaatatggagctatcattgtcgccccttcgctcgcatcattgtcgctcaactgcaacccctcttctccgtcatagcaaatcactagagtgaggaggaagaagctcaccgtgaggctgtcgcccgctccgctcacgtgcgttgagtggagaggggaagtgaggggaggggagtgcatgagaggggggaaatggggtgagatagggggcgtgcactcatgcagagggagaggaagtgtgcacgacttcccctcctagctcacgtgcacttgataggaggccccttaaacgtgcttacaaattttccttttctttttctttttggtattgctctatggcatgtgatatttttttaatcaatagtaattcattaaccgaaaagtaatgcaaatttaggaacagttgtatatcggtattcagaaagacttttacatattcagaatagttgtataccggtataaccgaaagatttttgcaatgtcataaaactatttaaaattccattaattttgcaatggaactttgttaatattttttatctattgtatgagatatgcatattgtcatttttagttatctttattcttttccagaattttactagatcattgatatgttgatacaatcaatttgaagaattttatataattccgttaggaattttctcaaattattgatgttatgagctaaaatttgagaaaatatgattaagtttcctacatggtatttttctatattagttcctatatttgacaaaagtatgattaagtttcctacatttgactacttataatttcaaaaatttgagaaaatattatttctttgttcctatggtattgtcaaatttgagaaaatatggtattgtcaaattctaacatggtatttctttgttgctggtttcacttcctttaatattatttttctatattagttcctatatttgacaaaaatatgattaagtttcctacatttgactacttataatttcaaaaattttagatataataacgaacgttatcccatcatgctgatgaaatgattcataattctgtacctctatcctttgaattgtttccttcaacttaaactttattagcttatatgttgcctaattgtactttataagcaattaattatgccttattcaatgctcttgcatggtgtttaattgtacttttctgagcatcaaattcatttaaatttctcatttgtctacttataatttcaaaattttcaacaacgaacattatctgatgaaatgaaatgaaaatgctgatgttgatgaaatgatttataattatgtataaatcattttattagtcaaatgagaaattttacaattatgtataaaattgtccgtaactacattaaaacgtactgctaccatattctccccttctttttaatgtataacgtcgttaactttttatcaacatttgaccatttatcttatttattttttatgtagatataaaaatatttaattcatgtttaaagataaaaatatttgttttacataaaaatattgtttatgtataaatcaaggtcgccatgagccaagggaaaaagcttccgatgaattttccatggtgatttccactttccaccctgcattatattaggtactggcgtgtgtatattctaattctcccccgtgtgagcgtcgtcgtcgttcggttttgttttctaaagtcatttagcatttttttttttgaaaaatagatgcaatagcttttgggatgtctattacaattttgatagaaaaacaccactaaaaataatggatattcttgatgttggatcgctttattaagatatgtgcgtctggtttgaggttcatactccaccttatttcttcctttccagctcgtggctgccgataaatgctgatgaaatgatttataattatgtacctctatcctttgaattgtttccttcgacttcaactttattagcttacatgttgcctaattgtactcttctaagctattaatcatgacttattcaatgctcttacatgttatctaattgtacttttctaagcatcaaattcatttgaatatctcatctcatttcttaacgaaacatgcaattgatcatgtaatgaatgtcaaccagtttggattattttttggtaactttttcaacgaataagtacaatttatctatattatttataattcataacctcaaaagtaatgcaaaattcagaaatatttgtatatatgcattctttgaactatttcatttcacttcagccatgttctagtctttgaatagttcatttcctacaattgccctgtatattcaaaatttgttgtatatttaatgaacatctaaaattataactataactatggagacactgggaattataaaatctaatgtctaacgcgagcatcacaaatatttggatgggtattatactatccaatgcccaacgcgagcatcacacatatttggatgagtgggatccaaaacatgtgcgatgctcgtgttggatattggaaaatataattaccggggtgcccacactaatatgaatggtttttagatactatttactaactagcatgcttattttttttattcgcattatcttatattaaaatcacagtgttttaattgtgcaattttatcacatatgcactgtaaattgttgaataatgatattatagttgtattatattcaagaaaaaaaattatgtagtattacctgtatttatagttacaatttatgttgtctagtagacatgaataaatcaaatgagttaatatgatcttgtaggagttgaaaaattgttccgttctattacccagttttatgagctaagcagaatgaaagtttgattgtgttctctttgcatctgaacttcccatgatgtagatttgatctcgtttcctagtagatccaccccatgctgtttacatacttgtcagctcaatttgagtgaggagatggagtacatgtcaaatcaagaaccaaaggatagagaaaactttccttttgatttcattagattgatgtgttcttccatatgtttttgttttcatcaacttagttaacttatatgttgcttaattgtactttcctgatcaattcatcatgacttcaatgctcttacatgttgcctaattgtacatttcttagcatcaaatttatttgaatttctcgtctcatttcttaacagatcatgcaatcgatcatataatgtatgccaaccaattcagatctttttataagtttctcaactaatcagtatatatattttctcataatcatttatgattcataaactaaaagtaatgccaaatttagaaatagatgtatacgtatatcctttgaactatttcattccacttcaagacactctctattatttgaatagttcatttcctgtagttcccgtttattttcaaaaaaaaaattataggactaaccaacaaaaacttttcataatgaaaataattgaacaagcatcttaaattataactataacatgaatgatgttcagatgctagcatgcttctttttcatttacattgtctttatattaaaaatacaatgttttcattatgtaattttataacatatgtgatgcatattgtttctactgctattataaagagaaaattccttctatacccctaaaagtttagcaaatcccttctacgccctgagttttgtccactcccttgtatgcccctgaattttggttttgatccctttcatacccattccgttagttgaccgttagttgaatgtttaattcctatgaaaatgaccattttgcccttacacatgaaggaaatctgaaaattgtagactagctatattgttggaagtgtataattttgttatataagactattatattcatgattttattgtacaaggtattattcatttcaaagtttatttttacataatgacataaaaaactaatatttatttacttattaaaagagtatatgtagcattttttatggtacttagatcaacattttttttcctgtcctatatattaggaatgttttccaaaactatgcttatcatttaaagaaaattctatacatactttttaatatttattaaaatgtctatgtacaacaaacttacgaatgttataatcacacaacaaatttctatactttcaacaatatagtctacaaatttctacatattcctcatgtattgaagggcaaaactgacttttctatacctattaaacggtcaattgacggcaagggtatgaaagggatccaaatcaaaattcagaggtataaagggagtgaagagaattcaggggcatagaagggatcggctaaaatttcaggggtatggaaggaattttctctattataaaaggtattacaaatatagtaattgcaatgaaaaattttgaatcaggtaactgtggagcaaagtagtttacttgttagtttttaatgatgtgattttgtagaaaaaaatattgatgatatctttctgttgtcctaaaaattgtcagcataaatatttaaaaagaaaatatagtcaattacataaaatttgcatatgaatctggtttaagaagattgttgaagtttttgatatgttatatgaatagtacatgtttttcttttaacagaatgcaatttacttgaatcaatggtagctatgaataaaactggtttaggaggatcgtagacctatgaaaaacatgtttgtgtttggttggctggtatcaacaaccatgtacttcgatattaggagttcgaccttcctcccccatccctcaactagcgcatgggtatacaatttgtttcccttctcacatgaatcttggggcaatccaatattattatcacaaatctaaaagttttaactactaaaaaacgatttttttatacgagagcccctataggttgcgcgcggaccataacagatcgtgtctacaaaaatcgaaccccccatcttcgcatatggctccttaagaggcacgtgtgcaaaaatctattttcgccggtgggtcacttaaggagccacatgcaaaaataagtctattttctcatgtagtcctcttaagggaccatatgaaaaaaaaatagattttcacatgtggacctcttaaatggaccacatgaaaaaaatacctccatcttctccggatatattctctcctcctctttcttttttctctcatcactaaaaaaaacttttgcctcctctcctatcctctcctctcctctgctctctctccttttctcctctcgccccctaaccgagtggcgagcaggagcaacgcgtgcatgacgagggccggtggtgacggctggcggtggacccggcgatgccgcccttggcagtggctccggcaacgatgacggcggggtttttcgaattttttttcaccgaatttatttttgcatgcggttggtatagttgaccgtatcagaaatctcattttcgtgtgcggttgcgttggccgtatgggataatccgatttttgtggaccttttggtgtaagtgggctactcatctgtacgtaaaaatcactttagcctcgcggaaaaaactactttttagtagtgtttgaggagaaaaacactggtggaagttttttagcaattaaataaattaacagagtataacactatgaaagtactactatatccttaacactacgataagataatcgaccatatacacgtcctagaccaaattaatctctctcacaggcctactacgacagaccatatacacttaatccattataaaccacagttgacgattagtagcaagttaacagaggactaaacgctactacgactacgacgtatactactgccagtagtgtactagttagtacacccggtcactggtcatcagttggctggtcgatcgacctctcttccgggaggaaaatgtgccgcacattacgctctaatcaaccaccacggtcttactgactgattcatccatcagtcttctctttgaattttccacttacatctgatcttcgtctggacacagccagggttgactccatccgtcattgctccaacaaacttcatgtcactctacgagctagagctagctagctaccggtaatttcgttatatgtaaccgttggatagtactccctccgttcctaaatatttgacgccgttgatttttttaaacatatttaatcgttcgtcttattaaaaatttaagcaattattaattctttttctatcatttgattcattgttaaatatactactaccactcaagtttttgaataatattcacaaaagtttttgaataagacgaacggtcaaacatgtttaaaaaagtcaacggcgtgggaatgagggagtacaagtgtagtactactagtgttcacacatcatccaagcttactgctcctgcagagtcgtgggcagatctacagtgttagcttagatgcaagacaacgtcaataatttttaattgaatttatggttaaactgtttattcataatactacgatttatatatatactaattaacatactatgacactacactagtacgtatgttattatgatacaggaggaccaaattgtatcagcctctgtgttcttttttggagggtctgaacctgatatttttttcgagcgattcttctatctgttttgttttgtaaccagtgtcgcaatcaactctttaattaatcggtgccatgataatcatagttaacaattaataatatcaaagtccctacatattaaattctccaggacaaaggaaaaataagcacactgatgagctagccccagcgtctagattgtatagcaagatatctgccatttggtccttccctaccgatgcaaaagacgattaaattcagacatgacgtgttgccgacatctctcagcactagcaaagatcgtctgcatggcttttcaccacaaccaaaaacttccagataaaatggagatgaacacagcacaggtcacacacatgcatcacaatgcacgtttcatatggtaaatttgtgttcttcctcctaacacacacacacacacaaaggcttataatatgcagggatatattcagctaatccttttttgacttgttctttctttgttccctgatggaatgttcaccatttggcagggaatttcttgtgtttacatgggctttttcaccccctactaattagggctaagcttctgggtgccggtgccaccagtttctagtcatgttgttgtcagtattagtgtgattgtgacattgcttaacctgccttttaccatctgaatgtgatcaaagttaaagtactccacacatttagttggagcatctgcaactgagatcaaattaacgacagccgttgccttttttttttctctcactggaatatagtagtatatatagtggagatgataattaaccgtgcagcttatgttgatcgatcgatcgatcttgactgctgcatgctcgtagactttaatttgttgtgcagatggttcttcacgcgtgctacgtaaaaagcaaagctaacgaaagcaattcaattcaagcactgcatgtgtagtttgttcaacacttagcaaagcagctttaatatttcatgtgctttttgtgacagttttatctgagctttaacacttgcctttcgtatgcacaggagaaagtgagaaacagagtagcagtacgtagttttcaacgagagacaaaactgcttaacagtatctgcttgtttatactgatcaaagtctcaagctagcaaaaaaagattaaaactgtctccctggaagacattaatctttcagtataaacaaagcactgcagttttaatctttcagtataaaaagattaaaactgtctccatgggcctccagggagacattacgtgtgtcaggtacagaaagcgtatccagatctgaaaaaatgctggtccattttgatgtagttccatcatgatgatttatgtactggatctcaactgccatctgattattgatacattgatgaagagcgatgaagcccctgactttactgatacacagcttcctatcaccaaccgtaaaacatgtgatcgcattgtcattggagatcaaattaaagcgacacagatagtattaatattcagtattcccttcgattataattattcgacacaattaagtatttgtattaatatttaaaaagtttgtataaatatatgagaatatacatacttaaaacatctttaaattaaaataaaataagtcacaataaaatattttatattttttaataagacgaatggtacttaattagccgagcaattttaccgtccttgaggaggtaagtggtacctcgtagtacctccttaaggacaataaaattactctaattagaccgttgtaattcatggatacgttactagctagtataaaaagggctacaaattaaattggcttctgttcatcgtccacactggcacgtgcgtatgcttcgagtctatcagcatcgcgtgggatcgatccgcttacatcgtcgcactcgcacgcgcgcaaccgatcgatcgagaggcccccaaccccaagtcgcagccgttactggctactgcgctgccatgcccgtgtccaactgatctagtagctagtgcgtgtgctcgatcgatcactcgatcagtagcacaaattaaccagcaaaactatcggttacacattgacacttatagtgtacattatatctattcacctatatatctgcaattctaaattatctggctgtgtacataaaaagacgtgaatatgagggaaggacataatatcaaataattagaaagagtaaggcttcaaactcagatcgtctagcccaccaccttgtgaagctagccggaagaccccaggtcgtctggctgtgtacatggccagacattgaccgtgtacacgacccgatattttggaattatatatataggcgaatagatatactatacgtatctatgtgtacatgattttgtcgattagtttgatcataaatatttaaacgattgattttggcgatgaagtttaaccattcgtcttattaaaaaaactataaaatattttagtgtgatttattttatttttaaagatgttttaagtatgtatattcttgtatatttatactttttttaaataatacaaataatcaaacttaattgtgtcaaatatttataataggaaggaatacaaagtagtatttctacgtacggtaccgtttgggaatattggcaaacagtaaaattcccaacttcgtgtatataggataagctggctaattaggtccctttgaatcaaaggaattatgaatgaattttataggattgaaattctataggaaattttcctatgtagccctttgattcaaaggattgaagttttccaaatcctacaaaattcctatggaatggcttattgcatatagattttggagaaaacttagcaagaggtctaacctcttgggaaaaatcctttgagtctatctctctcatccgatttctgtgtttttcctgtggtccaatcaaacaatcattcatgtgttttgcaatcatctgttttacacttgcatttctgtcagaatcctatgttttttctattcctctgtttttccattcctacgattcaaaggggttaagcattttagtcgcataaaggtggataaaatgtcaacttaaatttggtcatttttgttcacttatataccaagatttgacatgcatcgtgtgtgcatgcacactatcaagtcaagacgttctggaatttgacctaatcagtcacaattgaaaccaaccgaagctacaactatggtacacgtatctgtctgaccggtgcgaaactttgcgcgtactgaactttcttctataagatttaagtgagttatgtagctttgacaaaatttgttcatcttttcaacccctaattaacatgcatgttttcatggttatttttttttcacataatgaaaaactaaaattatctagaaatgggggcaaacgtgttgcctggagttgaataatcttagcactttggccggtacagttggacttgaataaaattgtcttgccccaagtgaaatcagggagttgaccgatcgaatgatcgatgcaaatgcaaaaatgcttaaggaaaatacatctttgtagcacaggggattttgccatgcaaaatttgaatcttagatttttctttcatgcaaaagttttatgaataataatagaaagagctcctattttatgccattcaatgttatctttgactagcgaaagggcctgtaacctatagtggttacaagagtctcagtagcatctgaggtcctgagttcgactccccatgagagcgaattttccaggatttaacggcgttgtgctttcagtggtagacgacgtacccatcgacagcgatgcgcctgtggtgactttgtcaatctccaggattggggtaggatagcatcataggggtaggatttgcgtgtgtgcgttcatagaggtgagtgcacgtacgttgtaagtgtctgcgttttactgtgtaattaaaaaaaagttatctttgactagttggaacagaagtagatcgaagaaaacattactaggtttcaacaacaaaaaaaagaaaaaaaaatactaccaagaaatcagcatttcggcccatgcccgtagcctgatttgtccttgtttgatgggcctccattctggccagccacgtaatcaggccaagatattaacgtaccgcattaggcctagaatttggacggaataagttcatctgagttcccttaacttcaacatgggcctccattctggccagccacgtaatcaggccaagatattaacgtaccgcattaggcctagaatttggacggaataagttcatctgagttcccttaacttcaaccgaaaaaccagatacaacgggtccctcaactgaaaaaaccagtgtagatgaggcccctctgcggttttgacggcagttttggctgacgtggtgcctacgtggcaaatttgacttggtctttatctgatgtggcatcgacgtggtgctaacgtggcaattcgatccagaaaataataaactttgtgggacccacatgccagcctcacacataaattaatataaaaatggtggggcccacatgtcagctacaaataaaataaagatggcggggcccatgtgggccccacaagtccctcttggctctccatcatcctcgcggcggagcgacggtgaggaagaggagcgggcgccggcaacagcaagccgcgggcggaacggaggggcgggtggagcaacagcagatgcatcctggcagcagacgccaggcggaggtggtcagaggaggaggttgctaacagagcggtggcaagccgcggacgcgcggaggtgaccagaggaggaagaggcagaggaggagatcgccgatgagcgcagtagctccactccgtcggccgctatgcccgcgatgcccagcagaacaacgctgccccttcttgctcggccgcgccgcgccacctccttccttgcccggccaccgcacaccgcctccctcctcgtccggttgctatcgctgacgtccttgatggtcacatccgggtcggagccctccctcctcacctggtcgccgtgcgccgcctccctccttgcccagccgccgcgcgccgccttcctcctagcccagctgtcgcgcgccgcctccctcctcgcccggccgccgtgagctacccctcctcgcccgggcgccgcgtgccgcctcggggacaggagagggaagagaggaggaagaagaggggaagagagttgaagaaagcgagatgatgagaatgacatgtggggcccacgtgggccccacaattttttattaatttatgtgtgaaactgacatgtgggtcctacggagtttattgcttttccagatcaaattgccatgtaagcaccacgttaatgccacatcagataaagaccaagtcaaatttaccacatagacgccacgtcaggtaaaaccgtcgttaaaactgccgagggacctcatctacactggttttgacagttgagtgacccgttgtatctgttgaacgaagaaaatcggattcattgacaagttaagggacctcatatgaacttattccaatttggactaatattttggcccacacacacgaatgggccacgattcacgcccacataaatgaggcccatatataataatgggccggaatttggaaccatgcagacgagttcttacagggccaacgtctcatcaacgccaagaaaccaaatcatcattactctaattaacatactcctaattatctttctaatcaattaattaaacgcaaaatcagtagttttctaataattttattattaaaactgtacttttagaatatttcaccttataattcgatagttttacaataaatttactgttataaatatacatttaacagttgagtgataatttaaccaaataattaacatattatttttaaataataaaaataggttatatcttccgactttgtccatggtcacacaaccaacaaatttcacaagaatttaaaatggatgcgatgggtcaaaccctcaactctcaccaataaaatgataaagtgaaataacgttttcaaaatcagagagattctggcacgaaataattatctttctaatcaactattagttaattaattacggagtagtgataatccccggagctcatctccatctcctcttccgcttcctactcctactccgtcgcaatccgccgcctccaaaaagcatccacctgtacccacaaacggaagcaaagattccaactttcgatcgagagcctcgccgtcgattcccccacctcggctgagcccggattccgaggcagcccccccatggcgggagccgagcgaccctactacccgccgcggcccacggacggcggctccggccagcccgccggctgcgactcgccgatgaggtgggacgacgacgacgaagaccacggtggcggcggcggcgatggcatgaccgccgttgcggtgagcaatcccccctctctctctctctctctctctctctctctctctctctctctctctctctccccttacgcggtttcgtcactgtgaagattggttgcgtgtacgcttagttcgtttggttgagttcgttgtgattttaaagcttgtggtttgggcgattggttgggtgattagggcttgctgtgtgattgtgagaatcatggaggaatatggaaaatagaatgctttaatgggtgattgggttaagcgcttaagcgagaagcaagaaaaagaaggtttgggtttttaggattgtatggctgctgctgctcatcgccgtcgccgctttggctgctgggaattatggggcttttctacgattatttcttttaaacatgaacgaatttccatattggtttctgttgtaattttattttccaaatttagggattcaacctgttcgaggaagaatcagatgaccctcctgccaaaaatggcgtggtcgacgatcctgatactaccactacaagtgattgcaacactgatatgagtgaggatcttgtaaagagggaagaagggatgaacttccattgtgatcccccgcttcacgaacatactggcatctgggtgcctgtttctgtcccgccaatgaccaaacgcgatcacgaggagtggcataagggctttggtcataatggtgactactttccagaagacgaatttaactgggagatagatgaagagaacaaggagatgacgatgtgggatgtattttctgagatggttgttgcggcaaaggataaggtaatatcagttgcatcgtatgatcttgggagacgtggtatgtctatgttgtccaagtttttcttccaagaagcttggaaggatatggcccaaacacttgcagatgccaatgctggcattgcgaatgagctcctagagactgaacgaacaatatggttacctgacagcgctgccagcgcctgcatgctctgtaacgtgcgttttcatccgataatgtgctctcgacatcattgtcgtttctgtggtggtgtgttttgtggtggttgttcaaagggtagaagcttgatgccaccgaaatttaatacttcagaacctcaaagggtttgtgatgtttgcggggtacgtctagagagtattcaaccttacttgataaatcggatcagtcgtgcttcacaacctccaactcatgatgtcactgatctgagtacattgaggtcgtggctgaacttcccttacgcacacacaatggaatatgagatctacaaggctgcaaattctttgaatagttactgtaaggtatgcctttttaccctaaattgtttactgttgaatttgtttatcagtgctgttgtaatttttttagacattttcttttgttcttctcttttactgtttgagaaatcatgtgcttatgctttagtcatagcctatcaagacttgtcacctaattctaaggtgctttatcatgtcttaattctcaacagtttatatatgatttactatggacatcactcattaagtaattgatatgttcctttcttgctaatacaataataatatctataagacttgtaacagagtatggtcttccatatttcttgcaaagtaattttcagtttccttaagtatgagttgaatagatgaaaaacctaacccggtgattggataagaattgcatagatatttgctctcagcttttgcacaattacacctgtgtaatctatagtggcatcatatggttgtccacaacatttcagtacgtttatggtcttccctctgttgtataatttgttaatgatatctattattttttaaagacatacctgtgttacattcatccattccccaatctttattataataactctagaccattcaagttacagtaaatgctgccaactaattaaaatgatatctacattagttgttttagtgatatattcaaattagagaatcattttgtctgtcgaatgctggttcgaagtattatacaaactaaaattgggtttccacatcattctagcttctgaaagtgctgattgttcagttagttcagttgttaggagaccaaccagtagcagtgcaatcattttttttttcttccatgtgccattcaggtgggaagactgaaaccagaaaaggctatcccctatactatccttaaacaagcaaaaggccttgctataattactgtagcaaaagtcggtatgatggttgcatataaagttggtactgggctggttattgctcgaagagccgatggttcatggtcacccccttcagcaatcgccacttgtggtattggatatggagctcaggtgacatcttcttttctagtgtcctttatgtgcaaattcttttatcatcacactagcacatcataacaaaatcagataatttccgacttacccatcaggctggaggtgagctagctgatttcattattgtgctgaggaacacagaagctgttaaaactttcagtggaaaggcacatttgtcagtcggtgctggtgtaagtgcttctgttggccatgttggacgagtagctgaggctgattttcgtgccggtgatggtggttatgctgcatgttacacatacagttgtagcaaaggtttgtttcaaatttactccatggcatgcgtcactttggcgtcttctttcatatgttcattttcacctcgctcaacatggaacacatgctttattatatgatacgactgtatattcgtgaataacttcttttggtggtgatggtgatggttgggagaatatgtgtaacaggacagttcatggttacacaaagagtcaaataaacatgtaattctgtcttagaatctcttaaaacaaaacaacagaattggattggggtccttgacccatagtttctcaatatattaaggtaatttaaagggttttgtttgtatccattgcaagttgattatttctcttggatttcaaatggcagacgagtaattctacaaagtttgggaatgtcctcttaaacccaattttagttctgcatactttttataccaacacaccaggacctgttttaaaaggcccatagcttagtaatttgacccttctattattagctttatctttgaatgactaaaatatgtcctagtatatcttatcactggataagtgcacaaattctcggccttcattggcttacatcacgaacttattttgttactgatgagtaggcattatagtaagcttagccattcctactgttttttctcacaaagaaataatgtttaccttgttttttctcacaaggtaaacatttatacgttgaggcaccctgagaacacttgggactctagtctgaacaattaacttgttgacagtcttttaatgtaatattaatatatatatgcacttgtggaattcatattcataggagtgcaaaccatgtcatatgcatattaatttattttcgaggaattgctttttgaatttgaactttttgactaaaataataatgccaactgtgaaccactctagactgctggatgcagttatagtgacaaacctaagtagtattacagtgacactttagttcattcgtgcaatatctgatgtcgaatttttcaattaagtgtagcaggatagtaccatttttcaagaaataaatgttcattgctaactgttaagtacttgtggctagatctggtcattcagaccattcagggttgtcttatgtaacaactgagtctgtatatctgtcttatgttgcaggtgcttttgtgggctgtgctctcaatggtagcttagtatcaacccgagacacagaaaatgcccgattttatggtggtccaataaaggcacccgatatccttatgggatccatggctagaccacccgcagccgctgcgctctacaaggttctgtcagaattgtttgacaatcctgagaagcaatcgctttaggtctctagtatgcgttgcgtcttctggtaaatacattctggaactctctgtcaagtaattggattgcggttttgcgatcttttcacttattcgttggttgcagtttacgcaattgtacagtctgccattcattgacacgccaaaggtttcacatcatggttaccacaaaaccaaatgtaaatacatgtacattggatcccttcttgcttcatcaagatataaaagaaaaaaaatatatactattttccattccccttgatgatctgcatgcatgttcttcagctgcattgatcagcactcctgctgtgaatgacctaggactgtttttttttttttggttgcatgcaacttttttctcagtgtacatgtgaatgtcctcccatcttttctatgatctttgaatttgtgcacctcctccaggggaaaagaggagggtcccccaacctctcttcttgatagaattcacaggcagtatagtcatttttgatggtcctaaagaggacactgaaaaagctggttgtactggctctgtcatcctgttgtgatgttgtgtgttgttgcattccctgggtaattattttgtcctggcaatgcaatagcaaactaaaatgtactactacttcattacattgtttcagctagcctgtaattctgatgcaagaaattcatgcagaattgcactagacctgagaaacaatacttctctagcaaaagataaaacagaaaatgacttcatcaaggtagtggtggtattttttttttgttcatatgatgccattgcacttgacatgatgagttgtgagaaaatactccctccgtcccaatatattaaaacctaggataggatgggatattttctagtactacgaatctggacagaattttctagtactacgaatctggacagattttaatatattgggacggaggtctgtccagattcgtagtactagaaaatgtctcatcatgtcctaggttttaatatattgggacggagggagtgcatgacactgcagctaatgactatgattactgaagcgtgccgcatgttgagcttgtctggcatgcccagagcacacactgcagatgaatggaatctctgtccctgtcactgcaaaatgtatattcctggtcttaacaaacaccaatgtccatccagccctgaagatacagtaatgcggcagtgtccaatcggtgtctgactgaatgtgccgtcctcgatactagtgcccttgaatcattgagatgcataattcacttcagttccagttcagttctaccatgatggaattaagctgaatatacttactagagatgagatgagcaagagaatgatacagtatcctggaaagtgagtagcaatggataaatggataatcaatcagcaacacacagaatacagagcataaaccagcattgatcatgagcaggaagcaaaatgtataaaattattctctgaattctactcccaactgtctgacaacccattaaccatgaacatcctaattcccttcccttgccatgttttccttttcattgtcttctaacaaccgaaaattataggatataagaaagcaaaaaaaaaaatcaaaaagaagctaaacttaaacgacggcctgcatgaatttaaacccagttcagagactcctcataagatgaacttcttctgaacccctctctgatgatgatttctccaattcttgatttcttcgtcttcttcttcttcttgatgagatgaggaagtaagcttagcgatcgccgcgagtcatggagctcccgagggtgagctcgagatcgtcggagccgcactcctcatggatgcgctccccttcccacgccttcaccagcccggtcatcttgccgccctcgccgccgaacgcgaactcgcggcgcgccgcgtcggccatctggacgtcgccgccggcgaccggcgagcacgctccgctcatcaccctcgaggaggaccccgcggcggcggcggcggcgccgaacgggttgggaggaggagccacgaggctgtacgtcggggacgacggcccggcggaggatatctggaacccggcaagccacgccgccgcgtcgttgccgccgccggcggcggcggcggctgcggcgaccttgcggcgcgggctcggcggggtggagtttggcagggacgacgaggccgcgtaggcgtagctcgcgccgacggtggcccacggcggcagcacgctgccggcgtggtggtggtggtactcctcccaggcggccgtcttgaggcgcggcgtgcgcggcggcgagcccgagggcggcgtcaccggcgcgctgatggagccgccgccgaagtaggagtagtgcgccgggaacttggacgacgagccgccgccgatgccgacgccggcggaggagagggtcttgagccacgggatgaggctgctgccctcgccgccgccgccgccgccgagcgtgatctgggaggaggagccggagctggggaaggaggacgtcccgcgcgggctcggctggtacgacgagcacgggctcgccgacggcgagcggccgagctgatcagcgagctctgacgccggcggcttgcatccctgaaacacacagacgaacggttcgacaaattaaaccaaattttttgaagcgaaaatttaaaccaaattggtgaatttgacaatagcaagttaatgacattttgcatagaagaataacaatcagaaaaatttatcatgtacagtttaacaagaattaaaaaaaaaattgtaacattttgcatagaagaataaaaaaaatcagaagatttgatcatgtacagtaaaatatgaatataaaatctgtgtcgttttttaagtaaaaaaaatgtgacattttgtatagaagaacaaaaatcagatgtacagaacaggaataagaaaatcacctcagaacacaatgtgaaaataaagttacaagaaacgtgaatgcaaattcttactgaaattcgctgcctcagaattaaaacttcacaaattatggccagaaatattaacattgctggcacaggagttttcatcaattcaaactataaccatgataataccaaatagtggcaatgcaaacttaactgaaaggtaattaaaatcctcagtgaaacgcacacaaaaaaaaaaacaactactgctctaaaaagccgattgcaataaaagaaagaagatacttgggtagaatttgtcattttgtaatgcaaagttgattttctgaaatcaaaggcttctgtgacagccttagctttctttgatgtaatattcggtcatgcccatatctatctgcctatgaccatgccactaacttttgtctccataattgcctctttcaccagtccttttttcacatgagcagcttcaattctgtccaggctccagtactacatatagatgcatccatagagataatgctaatcttaaaaagagaatttactcaaggtatctagaggcagagcttgcagccaacttagacttactttgacaaaacagggcagatggattctgtaaaggtactagctttgaccaaaaactaacaatctttgattcttgtattaatctacaccttaattcaaaagcgatttgtttggcagtctaaccatgcagttactaacgcgtgcaagccacatcctattttgcatttcttttcaattgaaaacaagtagcacttcagtttttttcggttttcacttgtcagccaacttgtcatccagaagacttcagaaaagaagagatgatctaatccttaatttttttttaaaagaagagcaggcatctaaaaagcaccatagataacaaaaagaaatgcttgaaaacagatagatttgatacattgtattctgcaaacaagatcctgatagcaatgttcagacttcagagctagtactacaaccaaaaagatgctagtactgctcttctgccaagacaaaaataaaataagaacaaaaaaaagaaagaaaacaaagtgatgagctttaagtacagcaccactactactacgacctcttttccctgcctaaaaagacactaaatcttgctaaaaagacccagcgccacagcatcatctctccaccccacagatgaagaagatgaaatcaacaacaatctaaaaccatttttgttcagataacggaagatctttttaataccaaaaacaacaaagaaacaaaaccaaaaaaaaaaaagagaaagaaaacgaacgctttttatccaggaaacggccacggaatgtcgcggcggcacgcgtaatcctgagctcctagtgcgtggcttgtcccacgcacgcaaagaaaagaggagatgagaggagagaatttcccccgccattatcggagtaaaaggaggaagacgaagcagaggagagaaaggagaggagaggagagagcacgcgcgccgcgttgcaggaacgaggaataaaaaaaaaaagccaaaaaggcaatcatggataacgagaaaaattcggtaccctcctctacagccgacgcaaattaagcaagaaatccattccatataagagcaaaagattaaatgaaattcgacgagaaatcgcttaattaatttgcaagaagaagaagaggaagaggaagagggaccttgcggtaggtggtgccgtcgggctcgacggtccagccggcctcgttgcagagcgccttgagcacctcgttgttgtcgcagtgcttcgggagcgtgtagtttccgtacgcccgcagccccgcgtagatcttcgccgcgatcgcccgccgccgccgctcccgccgccggttgttctcccgctccctccacgtcggcaccctccctccccctcctccgttcatcatccctctcacctcacctcaccgccgcgacctacgaggaagccaacggcggtgcgcgctcgccgtcgccgccgctgcaagctcgccgcgcgctctgcagtgtcagcctcgcaggcgcggcgtataaatacgccggagaagcagtaacggccggaggacgcgcaatgaccattctacccctgggtggtcttgcgcgggggagggtaaatgcggcatttcgcgcgggggtggccggtaatgattccgccgcagttaaggcgggggtggccgagaatggaatgcattcgcagtggcttaactagcctatcgccttagtgaacagtggccatttttagcagcagctagctaagctaagctaatccatgcaaaccaagcgtgagcggcgtgggtggtcaggtgacgcgtggtggggccagggtgtcagtgactgtggggggttggtgtgctactggaccagtggtggtcaaacgaccggccggcttgggttttggatatgttcttgggggtgcccttgatgacttgggttttggtatgatgtgtatgatttggtttgatgaggttgggggagaagatggatatagctagtgtggttgctgtcactgttcaatgtgtcaatgataactctacagtaatgattagttaaaagctagcacgagtctagttatggtttgtaacggttttggttttgtgtagcgcatggttatatagccgttaaattattataaatatgtgtatgtggaagtcaataacgagaattgttgtcattgattaactgcctatcgtagttactgtctgcacgattggatagtttaaacgtatctcgtgatatctcctttgacgatttacacgtgacattgattagacgaaggggacgatattaaatttgccacaataaccaccgtaacggttaatctggttgtgtaacggccatggaatgcaattttatcctcataatgactacatgtagtattggatagtttaaattaaacatgtgattccttctttgtcgatttacgcgtgacattgattagacaattagattatgttaatctttaccgtgacaacagtaatggtttgtctagtaacatagaacgtaaaattggacgtgctacgcattaatagagcattgttatctataataattgatctgcacagtcaaaacaaaagatttcaaacggttcaattgggtctagcacatggttacgtaaccatggaactacaactgtacatgcattcaaggtgtaaataaaacattaatatctctagtaatctatctacaacgtaacgcactagatagagctatggattgtaaagcgtccagttagttccatagcacgattgtataactctaggattaccatttacagtgcatataggagttgataaaaattgctataaaaataatcgttaatcaacataactgcagacacaattatatgtacaggtaacacatattatttgttactaattaatttatgtgtgatattgattagacaaacatggttgtgataagatgtaccgcattaatcaaatcggtttgactcggtcattaactatgaaagtgcaaccgtatgaaatcaatataacactataaatctaataactaccatttcctgagaggaactactgctaggcttacctagcctaaaagggctaggtgcagtcagttattaggggctgtttggttttcagggacttattctaagtccctgtcacatcggatgtttggatattaatttagagtattaaacatacactaattacaaaacccattccataagcttggactaattcgcgagacgaatcttttgagtctaattacgccatgattttgacaatgtgatgctacagtaaacttttgataattatggattaattaggcttaaaaaatccgtctcgcggattagctctcatttatgaaattagtttttttattattccatatttaatactctaaattagcgtccaaacatccgatgtgacatgggctaaaaagttttagccccatctaaacacccccttagtctctctggccatgttaaatttgacagggaatacgtatactaattagagtttaatttattatttttattataacttgtagaaattaaatttgaaattgtattttttttcaatgatataggagtattatatattaatatatcttatcaatatttttgaattttattcataattatttagtaacttggatcatggaagttcaccagagaatacaatccatctctatgcaagcaaggtaccgtaccaacagttgctggcagctggcacgtacgtgaagtggactagagatcagcagcaggagataggccgtgccgtgcagtggctcatgactcatgagatcagcatcatgcatgagctagctagcacacggcgtgagcgcggttaaccgcggttggatgtgtgggtttcagttagtacgaacccgggataccggccaactcatgaaccgctgcttactttgtggagaatttttttttcttagtgaataatttgtgtttgtccactgagatgcatgtctcacacaatcttcctcttgatgcttaatttagatggttaataatatggggctcacacaaattaagcactttttaggttatccatcgataagatcgatgccattttgagtcaagatgataaaagcacagttaatagatacctgcataagtatataggtttatctcatggttaaaagtaaaagatttactactcaatagatctccaaatctcagtcgagtattatcatttatttatatacacagctatattaatagcttaaaaaaatactctcacatttaactacgtcatcaaattgggtcagccattagattgaaatgtctaatacacattgaacattagaccgatcaatgtttcttcctaaaagaattcttatacccacgtatcaacacacgaaatatcaactagttcagtggcggatgcaagatttctaagataaagatacaacatcacttaagcatagttaaatactccaaaaaaaataaaaaaagacttgctataagtgaaagtcaagtgataattttgatcccaatgcaaattaatagagaccaattatacaggaaaatttacaaaacaacgtaactaagctagaaaatacgtttaatacccttagaaagaatgattttgggattaagtgtgcttgttttgacacaagtaatggtatatagacatattatacctataaaatcacttattttttacaaaaatttgggatagaaatgtacccatgtcccatgtcccattgtaggtccgctcgtaactagttgttatgacgtggacaatcacgtgcttgtaatggcctgataattgtctttaactaagctccagctagcacccatcaaacagcgatggataagcgatgaggatggcacaacattaaagtaatccaggccatattcaaaagtaaatgaaatttaaataaaaaagcaagatgatcgataaataatactactacatttgttttttaatatatgacgccgttaactttttacatcatgtttaatcattcgtcttattcaaaaattaaataaatatattttgttttgatgtggcttgatttatcactaataaactttaagcactacttatatttttaagatttgcataaaatttttaataagacaaatggccaaatattataacaaaagccaacaacgtcatatatattgaaaaaaaaatgaatcaatcgatatctcaaatatatcaccccgtctaaacggatatcaactagccgataccttaaaaaagtatcatcctgtccaaaagtataccatgttgtagcattttccttattaatttatccatcaattggcgtgtgaaagaattaccgcggaatatgatttcttctccaaacaaaccaaattaaaccaaagttcatgaccgacagaacgaaaatgccagagcaagcaaagcaagcatgcatgccgcattttcaagcagtggcagattgcatatcgtggaagaagggccaagcatgcagcatgacacgtcgttttcttgcctcatccaacggcaacgtacaggccggctgctggtccatatgcgcctctccctcctctcttctgctcatgcatgcacgtacatgcatgcatatgctccatcatcgtttcatactatatccgtgtttcaatgtacgaaactgttgattttttttataatcaatctttaactattaattttatttgaaaattttatacaaatataaaagtatttatgtcatgcttgaaaaatatttaatgataaatcaaaacacaataaaataaataataattacatatttttttaataaaataaatgatcaaaaaccaacgacatctagtattaaaaataggaggatatatctcttcctgtcaagcagggcccacaggtcaggatagctagctagtcctgtcgatcgccacgtcgtcgtcaggcacgcatgctgccggcggccagaaacactgcatatcgatctgcaggagtagcactgcagggcagctagctattcccaccgcttctaaattgtaataacatattcgttttatattataaattatttatatttttctctaaataaaaatttaaaattttattaagtttatagaaaaatttagcaacatttacaacgctaaattaatggacctgttcgactggtattttttacagctacatggctgccagctgcacagcaacaagcagcacggctgcagccacacaacacaaattaccgctgcagcctgcagcagcagcagcgctgctgaacggcagccgaacaggcccaattttgttaaatgtaatattgaatatattttaatattatatttgtttcaggttgaaaatgttattatatttttttttataaatttgattaaacttataaattttaactaatagaaaaatcaaagcgattcattaatacgaaacggagggagtattattctaaatctattaggatatatccttcatccaatttcataaatagaaatcagatatcttatttagtttcgtaaccgaaaatacgcttatatttttgaaagtgaaccgatattcgaaacgatcaatacaaatacgaatatcgatgcctaggatgagaaagaattgagatggcaaaagatagcatcacgaggaggatgatgccaaatacgtaggaaggggtgaccgggtgacctgggggaaagagaccaaagagggagcaatggctaagccagctatatgtggcgcatgcaatgccatttttgtcactttgctccttggatcaggggaaaaagaaaccttcttgtgtcactctgtcagtgcttgcatgccaaattgactattgcattatacaaggatttttacatatgcatcccaggtcggtgagcgtgcatcttttatataatctaaaaagaaactctgtaaaatttacttatttatctctaatcaaatttcacacgattgactgattatttggaagattgttactcatgctctaccagaaccgtgcagcccagtctatccgacaggcaaacacactgactgttgagaatataggcatataatgatttaatatattccataaataaatcatgacattacatatgtatactagcattaacgcatcattaaatctacacatgtaaattaaacagtaaaacatgaacagatcaaatacgcgcaacatgtcgaacacgtaccgaggtagcggaaagaccggttgctcggcaggaactactcgcggttgcgagcgtcgacgaaggcgcgcagcacgcgagcggataggaaggcgagccgtcgcgaacgaacaggaagcagtcgcgcgaagcgcttcccaaaaaccttattgccgccttctcccggtgcaggacgtcgaaggcagaggttccggtgacctgctctcctgatcgccggtgcacactggcgagcgggatggagtagtctacgagcgacggcgcaacacagaggaggaggcaaaccctagattgatttcgcgtgtgttgcgtgaaggcggcgacacggtttatatagagataggtggcttgatcaggacgcccgcacgatctccactctgcgtaaccgagccggataagtcacgcgtaacttatccggactctacgccattttcacgcaccggatttttcggaatgtttccaacaacaaaacaaatccgaattttcctgcaacaaaacaaaactgcaaaaagaggctgcatctgcgcaatggtgaggagccaattttacggaccattcgatgcgtacgtcgtgcacgcgcgccgcctgcccaggcaaggcgaggcgagcgagcgcgcgcgtgttccccctcttctctccaccacacatgcttcaagtggctaggagggcatcctcccttttaaggaggtctccctcttctagaataagcaaggtggtactaaactccacatgcatgccatcccatgaggtgggcttttgtgatttcccaaagaattaatcttcgaatgggccttagcccatctattaattccaacaatcccccaccaaatctcaaaatcccactgagatttgccttttccaatgtactgtttatataccagcggttcgatggagaccgattaaggttgaacatccacctagaactccaagctacactaactcacaacttgaacaatggactacgccttgaattgcaagtcttgtgcaagcaagtttcactcagagtcttatctggtactagaccgtctgtagactacccctcgggtggagcgtataagtcatactcctaggtttttagtaagcttcctagaagattcacccaaaatcttaatagactgcggccaacagtcaagcttacaaaggtgagttctttcaagaatgctctgcaggacaacatcttcgctaattaaagccaacagaactcattaaggcatagccaacctgccttgcagctcacgagagtacatgtatcttcacttagagagggtatagattggtactctcctctagtttactaatggtttgttcttcccaggttctaattcacgagatctccgatcacatagactggattaccaccatagtataactcacatgggtctcaaacccatctccttcgatgcattatctatcacatttcgtgatagtcccttcgtgaagggatctgccaggtttcaagctgtttggatgtaatccaacgttataactccggagtttctcaatttcctaacagacttcaatcgtcttttcacatgtctagacgatttcatattatccttagaactattcactttgacaattaccgtttgattgtcacagttcataaggatagccagcaccggtttttcaacaataggcagatccattaatagatcatgcagccattctgcctcaacagtagcagtatccagtgccgtcagttctgcttccatggttgacctcgtcaaaatagtctgtttgcaagacctccacgaaacagcaccaccacccaatgtgaagacatatccactagtggctttgatctcatccacatcagagatccacttagaatcactatatccctctagtaccgcaggatacccagaatagtgaagtcccaattccatagtacctttcagatagcgcattactcgctcaagcgcacgccagtgatcatctcccggattagaggtaaaccagctcaacttgctcacagcaaaggagatatcaggcctagttgcactagccaggtacatcggcgagccaatgatttgggagtattccagttgattcctagcaattctcttgttcttgcgaagcaacaagctaggattataaggtgttggagaaggcttactatcaatgtagccaaagcaattcaagatcttctccacataatgggactgcaaaagtgtaatctcattctcacctctaattagcttaatgtttaagataacatcaactactcccaaatccttcatatcagaatgatttaacctcatttatcacctcaaggtttgtcccaaatatcagtatgtcatcaacatacaagcacagaataactccctcacccccaccatggcgatagtacacacatttatctgcctcattgactgcaaagcctgcagatgtcaatgttttgtcaaatttctcatgtcattgcttaggagcttgtttcagaccatacaaagacttcaacaatttgcacactttgccttcttgaccttcaactacaaacccatcaggttgatccatatagatctcctcatctagctctccattaagaaaagctgtcttaacgtccatttgatgaacgagaagaccatatgaagctgctagggaaagtagcacacgaattgtggtcaatctagcaacaggtgagtaagtgtcaaagaaatcttcgccttcttttttagtatagcccttagcaacaagccgagccttgtacttttcaatagtaccatcaggcctgagcttcttcttgaacacccacttgcaccccacatgtttacacccataggccgctctgtcacctcccaagtcccgttagcgataatggaatccatttcactacggacaacctccttccagtagtctgcatcaggagatgcgtatgcttctgaaattgacttaggagtgtcatccacgaggtacacagtgaaatcgtcaccaaaagacttaaccgtcctttgtcttttgctccttcgaggagcttcactgtcatcctcctcagtgacatgttcatgtgtatgttcagtttgttctggtggtgtgattgaactgagaattatttcagagggttggctagaactactatgtgtatccttcattgggaaaaagctctcaaagaaggtagcatcacgagactccataattgtaccaacatgcatgtcaggtacctcagatttaactattaaaaatctataggcaatgctgtagtgagcatatcccagaaagacacagtccacagtcttaggtccaagtttgcgcttattcgttattgatacgttgactttcgccaagcacccccatgtgcgcaagtaagaaagtgatggttttctcccaatccatatctcatatggtgttttgtccttatttctgttaggaactctgtttaacacatgattcgaggtcaacaatgtctccccccaccatgccttaggtagtcctgcggtgtccaacatggcattcaccaagtcggtcagtgtgcggttcttcctttcagcaatcttattagactcaggagaatagggaggcgtcctctcatgtataatgccatgttcctcacagaataagtcaaactcgtttgagaaaaactctccaccacgatcagacctaagtctttttatctttctgtcaagttgattttcaacttttgccttataaattttaaaatagtctagagcctcgtctttcgttttcaacaagtacacatagcaaaatctagtagcatcatcaatcaacgtcatgaaatatcgttttccacccttcgtcaacaccccattcattttacagagatctgagtgtaagagttctagaggtgccaagtttctctctttagcagccttgtgaggcttgcgaggttgctttgattgcacacaactatggcacttagaacctttgacaatggaaaacttaggaattaaacacatgctggaaagccgagacatcaagccaaaattaatatgacataaacgtgagtgccatacattagcctcatcatccacactgccacaaatatggttcacagacttattgcagaaatcagaaaaggaaaagcagaacaggcctccgcactcataacctttaccaataaaatatctatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccctattaggacggtggaaccccatgcgacctgataagaagaaaacaatgagatgtcagcacaaacatgtacattggcccctgtatcaacccaccaattagtagactaattaactgaaaaaacagtaggtaaattaccatacccgcttccatctccagtgttgccaatggtcacattggcagacttagaggtctgccctgcaggtgccttcatccccttgcattgtggacacttcctggccagatggccaggttgaccacacacaaagcaagtcctcttatcctgattaggattgttgttgttgttcttcttcttgaagttggtggtctgctgagctttgtatttccccttgctcttgttctgggccttgtgcacaacattggcagtggactgcccaccatcgcccttagacgcgacatctttttcccgagctttctcctcaacatcaagagacgctatcaacccctcaacggagtattcctgtctcttgtgtttgagtgcagtaccgaaacctctccaagatggaggtagtttcgcaataatgcacccggccacaaatttgtcgggtaagacacacttaaggagttcgagttccttagccatggtttgtatctcatgagcctgttcgactacagaacggttgtcagccatcttgtagtcatgaaactgctccatgatatacagatcattgctagcatcagtagcaccgaatttagtattcagtgcatcccacaactccttagcgtcggtcatatgcatatacacctcgaccagacgatcgccaagcacgctaggaatgcatcccacaaagagagtagtggcctcatcgaattctttctgctgatcagcattaagaacgcccataggcttgccagtactcacctagaagcatttcatagctgtcaaccatagagtgaccctgatctgccatctcttaaagtgcacaccggtaaatttatccggcctcagtgcattggcaaaaccagccatagtaaactcacagtgcctatcataaggtttttggattgttgagaatataggcatataatgatttaatatattccataaataaatcatgacattacagatgtatactagcattaacgcatcattagatctacacatgtaaactaatcagtaaaacatgaacagatcaaatatgcgtaacatgtcgaacacgtaccgaggtggcggaaagaccggttgctcggcaggaattactcgcggttgcgagcatcaacgaaggcgcgcagcacgcgagcggagatgaaggcaagccgtcgcggacgaacaggaaggaagcagtcgtgcgaagcgcttcccaaaaaccttattgccgccttctcccgatgcaggacgtcgaaggcagaggttccgaagacctgctctcccaatcgccggtgcacgctggcgagtgggatggagtagtctacgagcgatggcgcaacacagaggaggaggcaaaccctagattgatttcgtgtgtgttgcgtgaaggtggcggcacagtttatatagagataggtcgcttgatcagggcgcccgcacgatctccactctgcataaccgagccggataagtcgcgcgtaacttatccggactccacgccgttttcacgcaccggatttttcggaatgtttccaacaataaaacaaatccgaattttcctgcagcaaaacaaaactgcaaaaaggaggctgcatctgcgcaagggtgaggagccaactttgcggaccattcgacgcgtacgtcgtgcgcgccgcctgccctgcccaggcgaggcgagcgagcgcgcgcgtgtgttccccctcttctctccaccacacatacttcaagtggctaggagggcatcctcccttttcaggaggcctccctcttctagaataagcaaggtggtactaaactccacatgcatgccatcccatgaggtgggcttttgtgatttcccaaagaattaatcttcgaatgggccttagcccatctattaattccaacactgacacatagcaccccctacacttttattctcacttcgagtaaaatgattaacttggaagtagtattgagcccatccaacaggtagacccacttatactttcattcgacagacatgttcacttacactttcatcatcatttcgtgtaaatggttaacccaaaagcgatatggttggatggacaacccatcctccagaaccgcaaaccaaccatccgtatagcacctcatttacactttcattctcgcttcgtataaaatggttaatccgaaaatggcatgatttccttaaaaaaaggaagtggtatggttggagggcttataagagattctactcttgctcatataaatcaagggcacacaacgctcatgggtaacataggccacatcctaattgaaccgagatatcactcatcacaaattaggctgtgtttggaaccctgggttcccaacccctcccaatcgtattccgcgcgcgtgcttttcaaactgctaaacggtactttttttgcaaaaaaaaatctataggaaagttgcttaaaaaatcaaattgcatgttgggaacaaattattccgaacacagccttaaaatagatcttatcatgaatttgtcatataatataagaaaatagggttaattacttctttcatataatcacatcttatttaattaattttcatccatccttatctccaaccaccttcactcgttacatattcctcatttaagtatttaacgagagatattatagtatattttttcttgtttacctaaacctcttcaaaaatcctaggacattttatattttgtgatacttattaatttgataagttatgtcaaataaggagattctcactcgtgacgaaaaggaattggaaaattttgctagagggtattgtgacttcgcgtttttagttgtagaacaccacacgaagtgatttttaggggaagacactttggaagcgtggaaattagctcatgggaaccgcaaccattagaatattaatttttgattgaataagagagaaatcatgtgaaaattatgaaattaccactgggcccacatgttaggtttgccatctctctatccctatctctctctcgcacatgaacccacatgctgcctgctgtggaaggagaggagctcttgcacgcctagttcattgcatcgccaagcacacaataacaagcctaccttcatcggcaactagttggaattggtgaaccattggatctgactatctgagtaggtgcagctccactttggtcccgttctgctcgtctaccaccacctgcgcctctggccggtcaccgccccaagctcctccttgcatggcgcctgtgggttgtggtaagagtcgtccttcgcacgcgatcttaggtctccaccacttgtggcgtccctgctttcaagacccattgtcgggagctggatcgtcaccctctgactatcttcatcacagtcgcacacccggggggaatggagcccatcctctccatgactctgcttactcccatgtcggtgcatggtttgggccccccctccctcgctgcttacatgctgcagcgtgaaccgtgtggatgcgccacacccataggagcgcgccgatgccgagtggactatgacagatgatgtcgagtaggagctcatctccttccacgatccaccattcccaaccagcatctagctcgcctcgccgtcgccggtcaccgagacactctctcacctttgcctcctgcgagagtgagaggaatagaggaagtagatggggaaaaagatagtagaggcttatatgcggattccatgtacgagagagagaaggatagagagatggcaagcctagcatgtgggcccatgggtaattcagaactttcacacggttttttctcctactcaaccaaaaattaatattctaatggtgtagtgtccacgagctaatttttatgtctatatggtgtcttccctcaaaattaactttgtctgatatcctacaggtaaaaccgtgaattcatgatgttgtctagcaaaatttgctaaatgaattactacctttttgctaaaccaatactactagaagataattcccctgtcaggataaccatcggtcatttatcatgtcattctaatcttgtggctattttgctattggttcctcgacatcggcagaaaattatctcacgttagtttaataattttgcttgcagaagatataactttttttgccccagtactatttttcggcttacggattatgaattatatcacaggcatattattttacttaaaaatcataggcatattttactttttaagctcctaaacaataatttctctaaaaaatttctccatcagccctccgaaagaacatttttatataaaattttcagctttccaatattttatttatttatttatttatttgcgcccttaaataattgttatagactagtttcatcccacacccatcgtgggtcgtgcatcaacactttaggatggcggagaatggaaggcatttgcagtggtcatcagctagtcaagatggtcatttaattcaaacaggtacatcaatgccataaaatttctttgttttggcatatctagaacacatggatttcacaaggcaaaattaaaaagattaagataaagggaatcttttgaattcaggcaaaacaagattgaaatatagttaatcttctcaactcaggccaaaaattctcaattcactggtttacctgctcatagcaatcgtggggaaagtaagaaggcattgagtatgtgagttctgatggatacccgtttgatgtgcttcaggattcgtgcagtcgtcacatgggagtgatgtatagaagctctgtttaacaccaaacttcatctgagaaaattattacttcctccttttcacaatgtaagtcattctagcattacccacattcatatagatgttaatgaatccaggcacacatatatatctagattcattaacatcaatatgaatatgaaaaatgctaaaatgacattgtgaaatggaggtagtacaaccaataagtgaaaatgttactttcaaaacaattattttagacaggagagactagccagacagaaatacagaacaatttgggtaataatcaatgagagaagcagcttattaaatggtttgcctggtgtggaaatagccaacaatagtcatcttacaacagacaccattatttatctatagacacatatggacatcagactagtgtaatactacaagaatttcatagaagactacatcaacatatgtacattttatagccgagaagtaatgtttacgcttcgcagcaaatttatctgcatacaacaacacggtagcagtttggagccttgggagttcattccacgtgtcattgtgagctcaatgaatcaataacattagtaagttgatacaagaagttgatagtgggaagggaactcagcttcccagtttgaaggcatccacaaaaaggcccagacatacgccggctttccagtagttcaccattgcaatcaatgactggaatcgtccaggaggtctactcatcggttttctgtacataagcatgccaattccctctatggcagccactacaacaccagccacaagaacatcccagtcaccagtctgccctaggattgttgccaatgcgttggcggtatagaagccaaacagcacaaggaatatcttcgtgggggagttgcttctggcagagttcagcttttcaagtagttccctcccagcagcttggatgagccttcccagccttgttctaccaagaaagccaccatcatcttcgaagtcttggctatcagcattagatggtccacctgtttccaaggcaaatactggcttccatctagaatttttcatctggtaactatagagtgcagatatcaagtcaactaccaaatcttctgcatagtagagatctgaagaaattgattgcatcaatcttttatcttttctcaatctctacaaaccttcagtcatgaagctaactagtaaataattccacaaaggatggacacatcagcaattcatctactcccatccccaaaagaatataaaattggtaacctgactagtcaaatcttcctaagtttgaccgccactacatagaaaacctatttatatttatcatgtgaaaaaagtataactaaactggctcaagaaatattttggcaccgcaatacatttacagttattttgccaacacatatgacattactatacaaattgatggtccaatttatgcacttgataccatatcatgtccgaagtgtcgtatatttttttaacagatggattacttttattgtttctatttttttattgaaaatagtttatgcatataataggtagataccatataaattgaaaaatgggtactatcagtaacaagattgactgtccacaagttcttattatataatgattacctgccaaattcttgtattttgtatgccttgcggcataataacatttctgtttgaagatgctaaacgagatctaggtaggctacattttgcatccatgtcaccttggagagcacaacttgaacccatgcatttcctaacaacgtgcggtgaaacctaattacacttcattgtctattccattcttttgtttgggtgagcccttattgaattccttttaaacagtcaataatccaacctatgtcaactgaaatgtatttcttcaagtgtccagcttatatcaacaaatatatgattcttcaatataatctgactgatagtcagcaaagatgcattgtataaatgattgaactcatcataaacataaaaagatgtactgaaagctagatctacttatcaatggtgccaccgagtagaaatgtgtatgcaaattaattgtagtagggggaaatgctgttcatagatttaaaactttcgtaaaccagctcctccaaaattcctgttgacagaaaactgacccaaagttctggacgagtccaatggaacccaattcccaattgatttttgggatttttttttttacagaaatactaggtagagaaattcaatacgctggagaagagaagagaagacagcgagcagcggcgtcgggggctaacctgagcgccgctccgcccgtcgtcgccggccacgagaggctgcaggtccggcggaggagcgcgcggccgcagagaccgccgggtgccggccgaagaggggcgcggggagggagggctccgcgccgcagcggcatgaccggcgggcagcggcgccacggggcctctgtcagtctcaaggcggagctaccgcgacggcgacggcggcggcggcggcggcggggtgaggcgatgcgatgcgaagtagcctgtggttgacagtttcgatggtctagaatcgcgccttctgttccgtacgtggatagttgggccgagaacttgttgggctggagcccaactctccagttgcaaaacgtacctgtgggtcagtggcgagtggcttctctccgtcgctaccccggggacgtcgcggcggtcaagcgccgcgaggcgggcctcgcgggcggcgtcggaggcggtgaggatgcggctcgggtgggcgagcggcgggaccgccagcccggcggcgtccctcagcgcgacgcagtggtgcgccgagctgtgcgtgtagtcggacggccggatcggcgccgacgacgacggacgagcactcgccaccgccgccgctttcttcttcccgtcgccgccgccatcatcctcgtacgcgtcaagccgcaccggccaactccaaatcgacgctcaagctcaagctccgccggccagggcggagagggagagggccccgctggcggcgcgaccggcgggggaggaggaggaggaggggaggggaggcgcgcgggcgggtggcggcggctgaggaggaggcgccagctcggagcgggaggcggcggcggcggcggtggcttggagcgggaggcggcggcgttgtcgagaacgggagcgagagacgcgttcggtcgcgagcgagaccgcgtcaaagggcagagaagatgacgattttgagggagaataagttcaccggagattttttaaagtatcttaaccaaaaaaaccaaatatttactcctaaactctcacaaaccgttcactggaggtccctcggtactatttttgtccggtttttctgacgtggcattctagttagcaaaaaaataagaataaatatgtggggaccacatgtaagtgacataaaaatgttaggtcaacaatcctagtcagcactgatattctaaatcgcttttttctttggcgcacagggggagcaacagcgacacgcatccgaaggcaggcggagcagggacgcggcggttcggcgggcgaggtggcggttcgcgagtgcgactgtgatgagcacggcagcgaagcggcggtggagcggtggtagcgggcgagcagcggcttcgggctcgggaggaacaggcggaggggcggcagcggtggcgcggcagcagctggtgccggccggagagggcggagatgaggccggcgggagagggggtggagcgccgcatcggcggtggtggttgagaggacgggcgcctcctccaccgctgcctccctcgcgggaaccgtccagcgcttgccctcggcgcgccagagcacgtggattccacggcagcgggcgccgcggcagggatcgccaccgctatggcggcgcatgtggtgtgaacacccgtcgacgtcatcagccagagcctcatggtgcaggggaacccgtgcccggcctcccactaccgcggcggcctcgacgtcttccgcaagatcgtggccgccgacggcctgtaccgcggcttcggcatgtccatcctaacctacgccccctccaatgtcgtgtggtaggcgacatactcattgtcgtagaagacgatttggaggaggcgcctatcccctcagcccctcctcctccatcgctgctcccccctcttccgccggcgtgacacgtggagaggatgggagagggagaggtggtcgacgggagatgactagatgggggaggggaaaggtggccggctgctgccgtgctcgtcctccgccgctctgcccaccactcgtagaccgttgccgcgctcgctcgccgccagcctcccacattcacgctcgccatcgtcactccgccctccgccggagagaagagagtaaagagaagagaaggtgaagaaaagagaagaaaaaaagatgtgcagctgacatgtgggtcccacttttttaattttattttctaactaagatgccacgtcagcaaaatcggacaaaaatactgccgagggacctccggtgaatggttttgagagtttagggggtccatatttctggttttgtgattaagggacctcaaaaaatctcgttgttaagtggagggacctccggtgaacttattccattttgagggcatgcacgtaatttcacgttggctggagagctcggctccgtgggcttcggtgacgcccactgtgggctgtctgagtagccaaatgtgtaatctggtttgaggccacattggattgtgtagcttgtggcttttgaagttctttaatctatttggagtaaattgaacccacagtacaacaacttggtaggtggatgcgatatagaacaagaacttaagatttgaacgttcgagtacagtaacttgacaattgggtgcgatctagtatataagaacctgatagttcgatattttggtgcatcaacttggctaagcatatgctagatgagttgtttcacgatgtcaatatgctattagacagtaatcctacagatattaccttaaatattgaatttaatctttaagaattatattacatatatagtttacatccaattatctttaagatttttttttgttttcttcatcttctcaaatattaactgaaatataataatttttacatccagtttaattgactttcagttatgggttattaggataaaaatataaatatgcttatacaaatccatgctagtatattgtcaaaataattacttaaaaatgaatctatataaaaaatttctccaaataattaagttgtcgcataatttcttagtttactgtatcaaaatcgtacctatcttaaaagtttttacatttatataatcatttataaagttcttatactaaattgcacctacctattaagttgttatactagaactctcatttctcaagtagttcttataccaaattacacccacctaccaagttgatgcaccgtggatgcaatttactcatctatttggcaccctagtctgaacagatatagtggcgcattggtgtggtaggtggagagtggtgtgtttctatttctttaatgcccttgcaaattccctaatggtcccaacaagtcaccgaaattcaacgcgcgcgaaatgccaaaaaatattggtgctctgtctcatttcttcgcacaccattacaattttattttacagaacctttcctatgaccccaaatttttacactaacgggtacgttcacgtcaggaaaactcatattactgacggtatctcatccacgtcaaggaaaattccaattgttccgacggttttaaaggatcgtcacacaaattattttttctctgacagggttttggactatttgccactctcccgaatggcgtgttctcaaatgccactctcccggatgacttcgctattttgccaccggagatagaagatttcttgcctgtgtgccatttttgagcctgcaaggcaccacgtcactcgatatgaggacaaaataattgtcttaccctttttcttcatttctcctcctgtcattgggctccggtgagctccccgcctcgcactcctccctccttcgctctgctccttaccttcccggcccctactccattccactgcggccaacaccggcccctgtcttttcttttgtggcctcatcggtgcctcaccccatcaccgtcgacttcgcattcctcctcacagctcttctacactctcccccgatgtcggcggctgcgccaggtccaccctcagggcttcccctaccttgtcattctccacccagcgccaggaggtcggttcggcggtggtggtggcggtgtcaccggctcacatacagggaggaaggttggagaagagagacccgagctagaggaagaagaagggcaagacagttattttgcctttggatcgggtgacgtggcgctttgtaggctcaaaaatggcacacgagcaagaaatcttctctctccgatggcaaaatagcgaggacatccgggagagtagcatttaagaacacgccatctgggagaatggcaaatagtctaaaaccccttctctgactggtggttgcatgcatgtcactgagtcagtaaaattagcgaccgtcaggggtattctaatttctgatagtgtaatagaattaaacattctgtgagtgtatgatttaaaaaataataatttaggagagaagagatgttaattaattgtcatgcatgtatttatgttttatattatgaaacacctttaaaaagcatgtgtcctatattttggaatggaggagtactactacatgcaagcgaagatcctacaattcaagcaaagcagtccactaaatcgccgctcgctgtaattgcgtaactaatgatgccgtcaaacaatacatgtacgcacttgattctacaagaactcagaagaaggctgcactacttgcagtttgcagccatctcccggctagagcgggcctggaagacgacggtgggctcgccgaggtcgtcgtcctgaagctccccatccacgtgtcatcgtcgtcgatcgtcgccgtctgtggcgtacgtcgagcaggttcaggggtttcctccgtggcggcgtcgatcaagtataacatgggacactttctcgtcagcccgagcttctgaatgggtcttggattattatttaaaaccaccatgtgtgacacctcatttgtgcttttttttaaaaaaaaaagaaaaaagaaaacagcatcgatgatataattaagtacagactttacaaataagtgcacaaataaagcgaaagggcatatagtatagtggttgcagttatctgagtagcaccccaacgttctaagttcaaatcattatatgagtgaattgtctcaatttaaaatgggaaaaagtacgaattaccccctgaactattgtggttgattgaattaccccctaaattcgaataccaaatatttctcaccctaaacttttaaaactggacgaattacctccctactccaaaccataacggttttggtcctacgtggcatccatgtggcgctaacgtggcaatctaattagaaaaaaattaaaaataacataggccccacatgtcatatggagtagtgcactagtgctaaattgctaatctctctctctctttcttccctctagggtcgcgggtgcgacgtgatggggcgaaaccagacgctgtggtggggacgacggggatggcaggagccgaggaggagctgtgctcgccggcggagaccaaggaggagctgcgtgccggcggatgcggatgaggaacaacgcgtgccggcggaatcgaggaggactcgtcgcggtagaccactcccacttcttccaatgccttcctcggcgccgctcgttgcccgccgcgcaatcctggtgatgccacagcccaccactatcctcgctgcctgtgatatcagagagatgagagagagagagagagatgttgtagccctccccgcgacgcaccacccgccgcctccagcgtcctcctcggcaccacccaccgcccaccgcctccactatcctcctcgacgcggcctaccggccactgctccttccccgttacgcgacaagcttcagcggcggcgtagtaggattttgcgcgaaggcggcaacgagcccgcctcggtctcgagctccctttgcgacagcgggacgtggagcgaggcggcggcggcggcgggatcctccttccctcggtcgcccgagcgacctccgcctccgccgctagcaactgcccccgccctcgcctgctgccattcttggtgtcgtcgtgtgctggtgagctggtgaggagaggagggagaagatagagtggggggaaagattgggatagagatagggtagagagacatagagaggagacgagaactgacaggtggggtccaccgattttttattaaacgaattgctgactggacttccacgtaggaccaaaaccatcgcagattgagctagggggttatttgtccagtttgcatagttgggggtgaaggatgtctgattttgcagttcggggagtaattcactcgaccgtgatagttcggggggtaattcgtactttttcctttaaaatggctgcatacattcagttacatgtgccggttttatttagcaagcacaaaatggatgacccgagtgcacggtgtaggggaaaacatcttctgagtgatcttaactaggggtgggcgttcggtctaaccaaaaatttcggtatcggtcttcggtttttcggtcatttcggtttttgaaaagtcaggaccgaatttcatccaaaaaaatcaggaccgataaatttggtctcggttttttcggtctcggtctcagtctgaccgaatttggaggagccgtgtaacatcctcaaattttaacctaaaatttgactgcatcatgctggcttttgattaaattagtgtgttttaaaaatctatttgattcttaattggttcaagtattacttctttagaaccctactaatttactctaattattccctttactccaaaccttagtgaatttgagcaaattctctcaaatttcaaactatagattattttcttagcttaccctaatattagtgaggatttgctacacttcaaaccctagtgaaaccctttcaaacttatagtttaaattcattctttcctagggaaatattcaaaaattcctaaatttcactgttcatcgcacacaaggtgctcgatgaaatgcccagcttagctagagcagcccaaccaccacccaatcttgtgcaaagtctagaattgatcctaggggaccacaccccactcaaaaaccgtggatttctttgcttcttcctccccttcacacgcgccgcgcgggcatccgacttagccgcgcgccgtgtcgccacgcgtcggcctcgggaccgcttgcgcgtgcccgaccgccttggcgcgccgtcgcccgtccgacgccctcagaccgccgccgccgcaccaatcttgacgacgacaaagccgggatgactaccgccgcaagaaatcgtcgctcgacgccgtgcgctccaatccaagccgctgtcgagtgcgatttcgcttctacccgggatgaatcgcgccaattctttccacacggttggattgaagatagacggtggtatcccctctcacaattcaaaccattcacccccgagtcggccgttttcaccctcgccgccaccgcgcgtcgtgcccggattggcgccaacacgtcgccagccgatttcacacgcggtcaagccaatccttcgctggtaagtattcaaacgtggcctcctgccactcaaagtgatcttggccgccctctcgcagcctctgctgccccagccatatccaatctttgagctcatccatggcgatgacggtgttcgagctcatccgctcctcctagccctataaataggaccccaatcccttccttgtccatcatcgatcatcaacaaccataaccccacaaccccgaagctctgcttcaccaatccatctcatcaaccaccatcgcccgtcggtcgaacaccttgtgcgcgatcgactccacacccctccatccatcctccgccctaaatacctcttagaacaccttatatcaactatgttctagtatattagaccctaaccgaagccctgcatcgagttttacctcgccgcaccaagccgagcaccgccgcccccgcgctgctctattcttcgccgccgagaagtttttccgaccgtaatccttcatctcggcatatctcggtgagttcttccgtttcaaccatctatgtactccctagattccattttagcaatccctttgcactaccatgccaccctctgggctgccgacgtgagcacggccaaggcctatggaggcgctcgtcggcaagtattctccgcgccttgccaaagattgacaagctatcagaatctatctaggtacctcgtagatgctctagaacccctcccctagccatgtctaactcatatcacctcgatcactattacggcctaactgtaccaccgccgccctagtcgctagcctatccatacatcaaattaacccctccgccgccgctcgccatcgccggagaaccccagctccctcccctccttggctgcaacccctttccccctccatcgccgccgtaatcgctaaccctagcgccgccggcccgatttggggaacggccggaggtagaagaagagaagagagagagactaacaggtgggacccgcacatagtaacatttcacttttagttgattttcaaactttagaagcccatatcttttaaaatatatatccaattccagtgaaacttggaccaatattcttctaaaatcattctctatcttttgagcccctttttgctatttttacattttattttattttctctatttttcttatttttggatttaatttgaatttcttttgaatttgaattttatatgtctaaccctaggtcttgaggattcttctgactcaatagataatatcaatcaatctcaggacaacgagcaagggaagttaccatataccttttgatcatttaagcctatattttacaaattatttatttatagccttatatccaatattctattttctatgcataaatcaatcatagaaacccagataatttagtattgcttactttgcttacaatctggttaaaataccttatacttagattgggagagtaagtaagatttggttgatttccgggtggctagtactgtctcgatcgatataagttttaccaggtacttatgtcgaacgaacgggtacgaccgcagtttctagaatagggacatacctagttattatgttaattagcaatatggcacctctgtatagtggttcttatttttaagtcctcacacaggaggcaactatagccgcgaagggcaactttaaccattaccatgtacaggtaaatggtttgtgatagtcgactataaactatatggtatatttctaaaccctgatcgagatgacgtggtgtcatatgatcagttccccttaaatacctcgggaatgccagaactcctcttgctgctgttaacaacacatttagagcatatgaggatatgagttcatggaacaggtgccacaattgttaatgacttaatattgggccatgactaaagccgatgattatcagcaagtcgtggactgcgggtaaagcgtacatctgctgcagtagaatatctttgaaactattcgaatagccgtactcatggagttgagtaccgggactcatatggtaccctggttagaaatctaaagtctatatgttttataaattctaactataactttcctagattgtttattactgctttttgcaaagaaccctactatatactaatgcataacatatttccatgataacttactgagtgttgcgaatactcatccttgctcttataacccctttttcagatctgggtcaagagaaggacccttatgactattactatgatgaccctgataacttagagaatccctaaaggtcatatctccctagtcagaatgtatagaaacttctgctgtgtattaattagttaggtgagtacctattattataaaacccttagtattgtaaaactttaacgtatgcaatgaagaaccagttatactgtatatatcaatatttactgatctagggattgatacattaattctagtcagatccaagtttttagtttcgggctccgacaagccaaggcagggccagctgtaggtggcacacgctgtcgacgccgatacggtggtggtcggtgggagtacggtcgtggtggaggcggaggatggatccggcggccggcgaggcagcgtggaggcggagggcggagacggcgccggcgatgtggaggcggaggtggcggcgcggcgcgatggatccggcagccgctggcccggtgcgaccggagaggcggcgcggaggcggagggtggagacggcaccggcgatgtggaggcggagggcggaggcggaggcggcggcggcggcgtgggatggatggggatgcggagggctgagggcggtggcagcggaagcgtggcgcgatggaggcggtggcggaggcggaggcggtgcggccgcgcgggatggaaacgagggcagcgcgatggggatgcggagccggagggtagcgcgatgggatggatggggatgcggcctgcgggtggcctctagggtttagtgatgtattgggcttattgggcctcctagacctattgggacacaattcggtttctcggttaattcggttaactgatcccaataaccgaattacccgaacaaatttcggtctttgacaggctgagaccgaattactaactgaatttctcggtctcggtcttattctgcccacccctaatcttaaccacctactctctccatccctaaatataagattttgattggatatgacatatcataatacaacgaatttggatatactccctccgtttcacaatgtaagtcattctagcatttcccatattcatattgatgttaatgaatttagacatatatatctatttagattggaaaatgctagaataacttaccttgtgaaacggagaaagtactaccgtccgtaaatataagggattttggttggatgtgacacattctagtacatgtgtcatatctaacatgtattaatctaacatgtattaaatctaaccaaaattctttatatttagggagagagagagtaatctttttatctctcaaacattctgtttgctctttccccagctctctcaaggcccagccggcggaaattcacgttgctcctggtgcattggacaactagttttagaactgtaccgcactaaaattttctccctcgaaaaaaaatatattcacgttgtttttctgtaccttctacacgactcacgaaacagatcggccggagaacaagccgatgcaagtaggggtgggcacaaaaataccgaaccgaaagaccgaactgaaaatatcgagaccaaaaccgaaaaaaccgataccgagaaattcggtcatcaattcggtcttaggtagtgaaagaccgaattttgttcggtcaattcggttagtctcctcgggtaaccgaatagaccgaattatcaaaaatgtctaaatgcaacctataatccagtatgtttaataggattaaactctaattttcacatccctacttcttcttggcatgcaacctaataggagtctttactcatgagtgcttacgaattttttttgtgatttttgtgttgaaaaattccattatttctttgcatatatgaaaacgttgttgaatttcggtcaggaccgagaccgagaccgaatttgttgatcctgacatttttcgctgaaattcggtcttcacttttcaaagaccgaaaagaccaaagaccgagatcgaaattttcgattggaccgaattcccacccctggatgcaacgaagcagtgctactcaaagtaaacagtccgatcgatcatcaatcatgccagaaatttaagaattcaacccagcgtttcaggccgaatataatccaaaattttcaaatcaaccatctactactccgtcataaaaaaatacaaactctagctacgaatctgaaaatacgtgtctaggttattaattaggattagactttttttttgagacggatagagtacatatgcaagcaaatactctctttgaccttaaatatttaacgccgttgatttttttaaatatgtttaaccgttcgtcttatttaaaaatttaagtaattattaattcttttcatatcatttaatgcattgttaaatatacttttatttatacatagagttttatatattttacaaaagtttttaataagacgaacggtcaaatctataactaatataaatattcggatttttccggtcgtcacctcatccatacggtgatttttcgtccctcccccccaaaaaaaaaaacctagccggaatttcatcatcacacaagtagaatcccacattgagcacaccttctctccaatctcaaatcatcacaatccaaatccaaatcaaaagctaaatcccagtccaaatataaatcgaaatcattagaaaacatcatattaacacgagatgactaggagagggaggggcgagccggaccggaggctgcagcgcgttgctgctcgccacctcgccgtcggccacggacccacccgccaacgccgccgacaccgccatcgccgccggatcaggggcaggagggaggcgaaaggggagaagggagccgccgccggccagcgaccgccaccacctccggatccaccggcggctaccacagccgctgccgccaccacctcgggatctgccgagagagtggtgcggcggccaccgctcaacgaggagagaaggagccggcggtggggagagggagcggcgccaccatcgccgcgccgccgcagccgtccgccgcgagggagtgtgccgccgctgccaccgctgctcgcaggagggcagggcgccgctgccgccgtcgtcgccgctgctcagtggggaaggccgccggcggtggggaggggggcaagaggcgtcgccggttggggaggagcgtagagaggtgcgccggtgggggtgtggtgcggccgccggcggggagagaggcggcctgcgtggaggggaggaagggaaagaatgaaattagggttaaggtttatttgggttaggggttttgatagatttggagtcgatctgagccgtccatcaaaacgaacggcttagatcgctcccgcgtcggaccggcctccatcatcgggctgcatcagtgatgggctgcacgcacttcatgggccgcacttaggtcggccgacccaacaaaaacttaaattagatttccaattaaataattgttaaataatgtttgtattattaaaattagcaattaagctctgaaaattccaataaaatttcaaagagcgaaactaatcatggagaatttaataaaattaaatttaaccatatcattttatttaattatatacatacctacttaaaaataccaaatattttagtgaatttatattttaattaattgcatattcttctgctgtacgcttcccgttgcaacgcacaggtgcttttgctaaaccaaacaacacttttggtcaatatacacactccgtaatcacccggtgcaacgcacgggcacttttgctagtatatttaaaaagattaacagtatcaactatttaggaacggagggagtatatattttacattcatcgagcaaagctactcgatcaatcagccattcagccatcgtgaggtcaatcgaataatcccattaaacaatctacatgcatgtatgtactcaagattcttcataaatttcagaaggtttcgtccgtgccgtcagtcatgtccacctgttcttgccgttgcagttgctcctcgtctacgtcgtcgccggcgagcacggcggcggcctcgtacgagtcctcctccggtggcacgtgctctcctccggagccctgcgccgccgcttcttgctcttcctggcgcgtgctgccgtctgcctcgccgaacaagcggtacaacacgcgctgatgctccggtgaaagctggttgccgtcgtggaagtccgctgccgccatgtcatcttgttggtgctcctcctcgtcgtatgcgccgccgtactcgccgtccatgtaatagtagctgtcgtagtacgtgtcatccgcagcaatctgctctccggagatctcttgcgccgccggcgtgtcgtcgtcgtgcgtgtagctctgatcatctgcatctgcctcgccggagaagtgccggggaaagagctccaacaaaaccggtcgtcctcgtccggcgccaccttcttccgccgccgcagagtccgcgtcgtccttgcctgcgtactcctcggtcgccatgagtatcgactctgcgtgctcctcccgtcctccgcgacatcgtcgtcgtagcatcgccccggcgcgccgcgagcgtcgccgacgtcgacgtcgtcctcttcggaagcacggaggcgcttccggcatcgcacctcgccggggtccaagaacatgaacaacgagtgatcttgctccagatcaccgtcgagttcgcggccgtcggcctcggggttcgatccagggaaggatgcctctgcatcgccatccagaccaccgtcgaggtcggcggcggcgttcggttctgggaagtagggtggctgaggcagaggctcgccgtggagatggacgatgtggtcgtcgtcttcggcggggggatcggcgttgaggtcgcgcaaggacggcggagctggatccagtggcgaagctagagagaaataagggggtgcactacatcatcacatataaatgacaatgtacagaattttcaagcaatattatactagttaatatatttttcaatagtctcattagcatagcataagtggcgatggtacaccgacaaaggaacactgacaaaaagaacgtaccataccgagatgaataaaaccactaatatttggaaatacaccacctgtcctcaatatcttgcaacaaaggataatataaacatattaagtttccattgtaaactatagaaaaaccatgtgaaaacaaacaaattaccttttcataaatcataaattatatttgggctctgtcatgttcataaaacgatgaaccacagcttcgttggtgactttcttcatttcttctttttctatatagcaaataaggctatgactcaagtagtcatcaccgatgcgattacgcaaagaacttttcacaatcttcatagctgaaaaacacctctcaaccgtcgcagtggcaacaggcaatactagaactagcttcaaaagtcaataaactaaaggatagcaaagatgtttccttgtctctaccaacttttgtgaaagctcaccaatagtttgtatgttggagaatctatcatcttctcgcacatcagcggtgtagagacaaagatgatgcctaagatctcttaattccccagaattaaaatcattaggataaagttttgctagtctcatcaagttctcaacattaaaatcatggaatgattctcttgggctaaaggcagctgagcaaagaagcaattcagatgatgtctcattgaaacgactatcaagctcttgaagtagccaatcaataacatcattaaaacaatccacttcataatggtgttggtttgtaattcctgtcttttgcctctgtttctttggattgacatatgcttctcccatctcaagcttgatgatatcatatttgtcacaaaaagcatacacatcaccaagtaaattttcccacccatctcttctcaaatcatccaaatggcacctagttgatttgacacacttaacagcattcacaatatcttgatctttcctttgcaacgctaatgacagggtgttagtgataattaatatagttgacataagatgcaaatagaagacaaactcaaaagattggaaatacactagaagaccatttgcttgatctctatttgttctatctttgtcatctttttccacaaattctagcactttgactattgttgggaacatgtcaagcaaacttttgagagttttgtagtgagaactccaacgagtatctcctggtctttgaaggcattgctcttgatttaacccagttccagtttgaagcatcccacaacctaatgccttgcatatttgttcataatttatttctctaatcatgtctcttctcttagatgatccacccaccacattcaacaaagtagatatcatagtaaagaaattactaatgcctttatgtttttctcacaatggctacaacaactaattgaagttggtgagcaaaacagtgaacataataagctgaactactttccctcatgatcaatgattttaatccattgaactcacctcgcatattgctagcaccgtcatatccttggcctctaacttgcttcaaactgagcttaaagcctgcaaatagagaatcaatcgcagccttgagataggaagaagttgtttccttcacatgaacaacctcaataaatctctctttcacaaatccacacttatcaacatatctcaacaccactgccatttgttccttgtaggacacatctctagactcatcaactagcaaacaaaacacatcatgcccaagttcttccatgatagaatgtaatatttccttcgcaaaacactcaacaatgtccttctgaatatcagaagatgtcataagactattccctgctccatatttacccactgccttccctaaagcatgatcatgctctaatagcatatcatgaaactccaagaagttccctttgttgtaggaatccttggactcatcatagcctcggaaaggtaatccttgcttcaataaccttctagcaacactaattgaaccatttaaacgagtaaaataagcctttttagcatcttcactttgaatctgaaaagcaacattaatatgttgagatgtttgtaacaaagcatcacaatttttcattgcttgattatgtaaactaccaactccaccgacatgctctttcagcctgctttttctatgccaaccattccaaccttctgtaacaaatgctttgtatccatcctccttcttattgcagtctctaaataagaaaaaaaagaacaatatgctttgtctttggcctcactatattcaagccagccaccaaactcatcaaaccattccgggataaagcttctatttctgtctgatatctttgtagttggaaaattgagtgtacgaggttggcaaggaccattctctaggtactttcttcttaccctatctctcaggttaggatgataagcatcaatcggtttcctcaatccaggatcatatttgatctcctctttccaattgagatcatttacttctggacaggaagtccttgcattgttgctgctatcaggcacttttcttttaaggtaattctccataataaagttcacctatcattcatagcactagaaattataatatataactttaattttactccaaatcaccaaatgaccaaaccctaaccatttaaccaatataatacgaagaatcgggcaatcagccaagtaatgaagtaacctgaacatatctttcaaatataaaagtttacttacagcaaatcaaattaatcttaaagaatttgagacttgagagcacagtggaggtagaggtcttaccttgcctattgttgcgttgccctattgtgagcaggggcttgattgcttgaattaatctccagatgtagtggcatgtggccggcgaggcggcggcggcggcgacgacgacggcaacggcaacggcctcgaccaccgtcgaggtcggcggcggcttcggttctgggaagtagggtggctgaggcagaggctcgccgtggagatggacgatgtggtcgtcgtcttcggcggggggatcggcgttgaggtcacgcaaggacggcggagctggatgcctggatccatggcgcggcgcgagttgttgatcgagcacctgcgcgcaggtggatgcaggggcgagaggttggaggaggtgggacgacagaaattcaaatatataggtgcgccatatgggcttcttcctcgtgtcggagtcggagtcggagtccgtattccatggggtcattgaactatttggcatttaactatttgccacccctatctcaatgacatgtgggtctacatgtatctatgacatgtgggtccaatggcaaatcgttaattaccacatctaaaagtgacaaatagttaaatatctcgtattaatatcatggcgagttgttgatcgattgagcatgagagggtgggtggggctaacgcgcgggtgatcgcatcgcatctccgtgtcccccgggccccggctatgtgggtagattgattttgaaaataaagttgggaatatatttttttaaaaaaaactacaaataagggaaaattaattctttctaaaaatatacattattcgtataaattttacccatataaaaaatatatatgcagaatcttctgatatagctccattctgaatatataacatttgaatccgaatcagaattcaaatttaaattgggcatataaatttttagagcataaacttttggtatataaatttaggagtactcttgacaggctataccgtcgagtatggggatagttggtggtaaggtatggacgagattgtggtaaaagagacgacggaagatcgtgatttttatacacgttcaagccctctaattacaggttttctgtctataaatgtcttaccaaatccatatttttggattatatttttctaaaactagaatgcccctttcatatttatgtgccaacttattgagaaacacagttctcatgtgaaaaattcattcataaaaaactaaatagaatcatttggaaaaaaataaaaactaaaattttaaaaaaatttcaaatcatttttttgaattcatacaacattttcaccaaaattcgagaacaggtaaaaataattttagttttaaaattctcagtgaaacttttgtatgaattttatcaatttttaaaatttgttaaaatatttttttcttttcaaatttgtggtcaaataatattttcctttgattttattataactaaaaatttcacattcagatatactccaccgtttcatattatataatgttttgacttttttatagcaaacttcattgagtttaaccatatttatagaaaacataataatatatataatatcaaattaatttttatacattgaatattatttctctaaaaataatgatatgttttttataagtttgaccaaaattaaagaagtttgacttataaaaagataaacatcttacattaatataaaacggatggggtgtattcttaagtaggtagcgcataagaaattcagaataggagaagaacaatatagttattttaaaattttgtagcagtcaacaactgatggaaagaaattcaaaggcatatagccaccggacaaaactttatttttaactaggaagatagcccgcgcattcgcgcgggcatgtgcattagtttgttccgaaaatagttctaaaaaataaaaaattaaagtaatgtattttctactgttaattgattatttattatatctctttttcgtgaagaaatctcgacaaactttcattggtttgaaatatatttttttaccattctgctagccctctctttaattgcttcatatacatgcaatttttatgcatgtgaatcaataaagatagaaaatttcttttaaaaaatatttattgtattttgaatttagtgattgagggattcttaattcgactttgtattcaaatcaaattactttattctaaattgtctttttagggattttaaattgcacttaatctcgtatcgtgggggcttttaactatttgccattcttacgagtggtgcttaacgatttgccattaggcccacatgtcatagacacatgagggcccacatgtcattgacagggtatggcaaatcgttaattgccatgtcacaagagtggcaaatagttaaatttccccgtatcgtgctgtatttgatctcttcttttaatacttattttattattccaaattttagatatttataacttatacttttatagtgactcttgatattttatattctacatggaatcttgttatatttttttatagttttagtgtttttttaatttttgtttgtgtattttaatcaaattgtttgttttatatttttgttctgaatttaattacaaactccttgtggtgatccgcctgtcaccatcagcctcgcggatcattgttgacctcctcatcagtgagcctctcttgatacattagacaggacgtggcggggctcggtggcaaagatgaagctattttctagtccttgtcgaagacatggaacgtctccctctgcccctcccccccccctcctcttagtccttgcccttcatctaatcatttagtgcgttattaggtccaggaacttgtagaagtcgatgatgccgctaccgtcagtatccacctcgctaataatgtcttgtagctccgccttcatcgggttcatgcccagagtttgcattctggttccaagcttcttggtggtgattgaacttggatttagacccacacatttgaattcattcatcattttcgaagtgctattttgctcaaatatttgtagtcagaatagcagcattatctaacttctatatagtaaatatgggcaatatggatcttgaatttaattataaataatacaaaaagtcaaataaactgtgaaaagtacatgtaacttgagagtcatgatcatttagctattattatttttctatatattatgtgttaggtagaaaataggataagttatattaaaaataggatatgagaattggatcctagagatgagtaggacggtggaggtacgtacgtacatgcatgctcacatacggtaggggtggaggtgggggtaccggatttatttttgtgagatgtagcagttataattattggatctacctatttaaaggaaaatcaatggtttgatttttttatcataatttctaggaacttttaatttatttgagcactatatggtgtcttatgagtggttttagaaaaccatgtgacagtttaagaggatctgtagggagtttaatgattttttagtatataatagatagttaatatagcattttttggttctttatgtactgaactgctcactagaaaatatggataagaaagtgagcaggagagataataggagatcatttacgatggcatgatatatgttactatttagttgcgataaaggggtttatgtcaaatgatatgtttcttatatatgtacataccaaaatatggtaaacatagttcaaattaaaatcgaatatattataagatattctaattatttagttgttgtgttttttatatataaaattttgctaccataaatggaatgaagaagagaggggcggggagacatacgtactttggatgtaggtacatgttaggagatgagggacctagggagaggtgtggacgtacgtgacatttgtttttttacatatatagatctaatggtgtgtaaagagaaaataaatggtacgatgttttctttttttttctggaatttcttagatttctctaatttatcagagcgtcacgtggcggctcagaagcgtttgtaggagccacatggtggcttaagagtgtttttaaaaagtttaatggacttactcgtacgatgtctatttgtagggatttttttcataaggatagaaaaagaagaaagaaacaaagataaaaaaaaaagaagggaagatagggagcgtacaatacgcatcctgcacggaggtagggacggcaggagtttttttttccgttaaagataatctaatgatccaaaataatgagcccatctatttaagtgaaaatcgatggtcagatttctctattttattagaatgccacgcggcgactcgggagtatttttaggatgccacgtggcggtttgagagtgtttgtaggaagtttaatggtcttttagtatataatagatagataccaacgagacaaaactcaaagatatgaataaaatagatagagtgaaactcatgaacatatgaccaatatatgacaaacattcctagtctcctagccaataacttgtcaacatcttttggtactgttcaacaggcatgtttcgttttcgtgtatggagaaatctagccgcgtcgtggcaccaaagctatctatcatgcatggttattgtgccatggttgccagcatgcaattgcatagacataacttgcctttgctcctcaacctccggctcaatgcttgctttccctttcttcttacctatcctaagttcgtcagcaaatctaatcttctttcactctaagcaactgaacagcgcttttactttttctgataaatatatttaattttgataacatttaatttctcttaatctagagacggtacagtacagaaacacacaacacatatatacgtgtatataaagtacatccacgcaaaagaagaaaagcaagaaaaaaaaaccacaaaatatatacatgtgagcacgtactccattgatctcttttttagatcttttacataaacacttgaatagtatacgtacttgacatcatgcaaccaaacgtatatttatacgagtacacgtacacaggacacacggatatatactgattaagacatgtaattaatcgattaattaattcttaattcataccaagcgtccattgcccattattgcaagcttaccctgctcacggaagatgaacagatgatgatgatctaggccagctacggcgcgccgccgcccaccgtcgccgtcttcttctccttctccggcgcgtccgcgtctacggcgacgtgcccccggctgctcggcccggacggcgggatgcgccatgaccgccagtcgaggtcgtcgtcgccgtcatccccgccgccgccgccgccgccgtgctccttcctccccggccgatggcgaagcacgcggcgccacggcacctccgccgccgccgacgccatggcatgccggcgctgatcatctgctgctccttcctctgcgctcgcctgcaggaaggctaggccggcggcggccatggccgccatggccagaatgagagctaagagcttcttcgagctcatcatcgcttgcatattggagtagtatatattaatataggcaataaatatattcacactactaaactatagctagttaactatatgaaatatgatcgatcttaagtttatatttgaccctagaggttttcaaatgtggcgatagattgcattgatcgagaaatgggggcatatatatatacacacacacactgacacacaaaagaagagagcaataaaaatgcaattaggagagagagagagatgtttaattggtacgtgaaggcagagctaatatgtgtgtgtgctggtagttagaaggtaataattaaattgctggtgaatcaagggaagaagaaattaaagagagaggagtggttacacgtggttccttgctttcggtcaataaagcgatgagtttcttgcaagttggcatgtacatacatataaaacatacgcatgcatgcatatatatgacatagatcgatccggccggtcgatcgatcatttcgtctctttcgcatcgtatcttggaattatgttagcttgtttaattccttctctatgtggaggaagccacttttgatttgatactgttctctagctagcgagaaaataattggaaaaaaattggaaatagagccgatttgtgcaccgcgcaattaagaaaaaagaaatagcgaatgactctttgttgatcttcatacaattggtatcaaaagaacaagttttttttaattacacgacagacttacacgcacacacgccactacacgtgcaacaccattttcacaccctcgcgaatgcgtcccctagcacatgctctaagcgatggaaaccagcggcacatactgatctcactaaagttctgttgaaaaccaacttgcatatgcgtaatttttgtgagcaccaggatttgaaccatagtgggtagagttacgcacccacgactctaccaccacaccactggtgcttccccagaagaacaagtaatttattcgtgagagtggtagcatttatttggcaatgaacaaattaaatgtgcaaaatatccaaaagaataaatttatctttccttgccatgcacgaatcttagcgtggatagcatggccagagtgaaccttagacaacatccgacgactaaaaaattgcacgattttagcaattgaatttctgtcaaggtaacaattctgtggatttagttgttgtcccagtggtacaaaggcatatgtttgttttccccgtgtgtgtgcatggggagaaattcgaacgagaccctttttccccctaaatggaaatagtgataattcgaacaaattaaccttgcttctctgctactgtaacatgtacaatattcaacgcacgtgaagagaagtaaattagtcggtgctctttaaactcgttgtgaagattatggataccccatacccacatgacatgtatatctgactgggtataggggtactatatgtagatagaatatctttaaaggacttggattaatttcctaacttgtgtatcaaggaaatatccgagaatcttagtcggttacgattgtaatttatctttatccgtctattccgttaggaatatgggatgtatcttgtaatacggactcctccccctatataaggaggggttcggatgcctcttggggcataactttttctcccagatcatacgatcaataatacactcggcggatcaatccccggacaggagtagggtattacttctcattgagaggccctgaacctgtataaatctcttgtcttcaaacccatccatttttcctgcttgatagccatccttttttattgccgaaatcttgtttcgacactcgtcatctacatacacagcctaatgctttgctgtaaagattgcaaaggtacaacatttgaagaaattaaagtccaattaagctagacattgccttttgcctccctgtaagaacgaaaacagcttgcttacgttaaaaccggccactaattcgggctagttgtcgtttgtgcgcttgaattgtaccatgagtccatgagcacggccatcactcatcaacatttgctttatctacgaataaagcaaggttaggagttgggaatgcatgggccggtcagcaaattaatttgggttatgacattatttaggcccattttgcaccaggcccactctatccttgccaactttatgttaagctcctagggcttgatcatacgtggtttaaatcatcaccgtgctgccaaaaacccaaaagaaaagtcggagattttattattgagtgaatacgcagacagcatccgtaagtaagggggtgtttagatcacatcccaaaattttacgccctgtcatatcgaacgtttaaacacctacatgaagtattaaatataggctaaaaaataaccaattgcacagattgcgactaatttgcgagacaattcttttaagcctaattgctccatgatttggcaatgtggtgctacagtaaacatttgctaataacggattaattaggcttaataaattcatctcgcagtttactggcggattttgtaatttgttgttattagactacgtttaatatttcaaatgtgtgtccatatatctgatgtgacacggcaaaaattttcacccctagatttaaacacagcctaatatagaatcaaattagatacgtttcacgtttcagtactatgaatttgaacatatcacatgctcatatcaaaatttataatattaaaatatgtctaatctgatgttaagtaattatattttacgacggaggaagaactagtagctaaataaaaagagagataacggtgtgtttagtttagaaatttagttcgaaagtttaaatttcttatttaaaaaaaaacacttgtaccaatgaatactgatgagtattttttttttctttttacaaaatgttactatagattagaatgtgtgacccgtgataatcccatgttcgattagctgaaaaagtagaacccaatctagcactctctctattttaggttagaagacgttttaattttagctaaagtcaaactgtttttttaagtttgaccaagcttttgaacaaaataataacatttttaatccaagttaaatttactatgaatatattcaattattgatttgatgaaactaattaaatattataagtgatactatgtttgtttatagatttagttaaacttaaaacaaatcaaaaactcatcctgacgcatctctgaacacaagatgacgcattgtgccaaaagacacgctcgtgtagcagcgcagcatcgatcagcagcgtccagtgccatcactgcctgctaccacctgctgcctgcatttaatcaccgaccttacaccagcagcagtccaccaccccgccgcttccccgcaaaaacaaaaaaaaaaagaaaaggagagaaaaaaactcctttccgccaccctccccttcccctctctctctctctctctctctcacgcagccgaatcgcgaggagagattccatttccccaccatggcctccctcctcctcctcctcctcctcgtgctctccctcgccgccgtccacaccgacgcggccgcgttcccgtcgccggcaggtgcccgcccaacccagccaccttcttctcccgccgcgccgcggtttgtttgggggtggcggcggcgtgcaatgggcggggatatattcgatcctgacattgtttttgtgggggggattttctgcagatagcatcgtgaggcagctgtcgtcggtggtgaaatggccgcgggttccttcgtcgtcgtcgtcgtcgtcgcacgggcacaagcagccctcgcacccgcagtacggtgagcgccatagctgccgacttggtttgctagttgctactgttccagggtttatttactagtagtagtagtcagcagcgcaagttcgattagttggcggagtggtgatttgacgatttattaggttatttttgcttgtttctggctttctgcagttcggacgacttaccttgtgattactgattagcaagtgtgttagtatcagtatgttgggtggtgtctcttgtgaggaagtgagtttaaccagagtattcttaagatgaccaagctcaccaaacatacccagtgttttgtattatattgtctatgcttgcatttttgtttacttgagttcaaatgccactctgtgcgtgtgacctaagcaaaacaatgtttactgcctatgttcaatttcatgcatcctcacatcactaaagtgaacttaggggcttccagatctagcagagtgcatcattttatttagtgaatgtgtttgtggacagcacgtgttttttcattatcattattttgtgtccttgtatgctgatggtgtttctctgatgcggcagatgggggtgtggctctgcagtttgagagcggctactttgtggagacgctcgtggaaggggacaagcttggcgtcacgccacacaccattagggtgtcccctgttgagggtggagagctccttgcagtggactcggcacatagcaacattgtgcgaataactccgccactgtccgagtgtatgttttcttcttgccatcctcagctcagcgcttccttggttattttaaatatgaatgtaatatatgacatggaacattttttggtgtgtcatccagcggactgtttttaggagtgatcagagtttgttccttctttccccaaaggcatgaaactttaaaattagctttgttaaacatatcagtggctaataagcatatatgcaaatatttttttttcattttcttcttatgtagctctaatgaatttatataccaatttttaaataattgatatttccatgaaaataatgtcatctatttcgaagatttaggaataccttctttttactgaatttaggaatccatgcataaaatcggttttcaggtagtgagagatggagagagaacttcacatttgtttgtgctcaggggaatatcatctagtactagtagtgtagatactagatactgggactgatattacaacctctgcagatagcagaggaagactggttgctggttctttccaggggcattctggccatatagatggcaaaccaagtgatgcacgattcaaacgccccacaggcgttgccgtggatgatacaggaaatgtctatgttgctgatacagcaaacttagcaattcggaagattggggaatcaggtgtgctacaatttaatgttacatctgttctcaaagcagctgtgacttttgacctaatacaaactcttacctctgtttgcaatatatatgtaaatacctacatgtacagtattattattgtactttgtatgcaaatatgaaagttcattttcattttacctaattaattatttaaatttattattggtcgatgtttgaactgtgaaagccaaatgtgacagctatttagaaacagaaggatgacatatgtattttatgcattatttctgtgttagtactaggcgaatgaagtgaatgaactttctgtgcaggagtgaccaccattgctggtggaaaatcaaacatcccaggttatagggatggtccaagtgaagatgcaaagttctctactgattttgatgtggtatatgtgaagaaaatgtgctctttgctggttattgaccgtggaaatgctgcacttaggaaaattgcccttccgcaagaagattgtacctaccaggatgcaactcttctatcgtcaggtccattctcctatttttactttttatgtttgtaatctttacatctagatgtttttgcttgttgtcctatccgtcatgttctttagaacattaagaaaatgttgtttatgttagagagagagagaggagttagctggctgaatatttgaggcagttttgaacaagaaaagggtttccgggccttattttaagttttgtgctaattctgtttggtggtgctatccttgaatttttatggatgattaattgatcaccacacagttttcttctttacatcaagtgtggctcactcgaccgctttggtcccaatacatgcgttctgatttttttattattattttaaagttgtgatgtgaaatgatatctgaattggaagttggtaaaattgctagatgttttttacttcatgtatccctgtatttataattctatggtagcatactgatttgtcaagttgaaccagaagtaatattattagtgccatatcagtaatgtagatctagcacgcgccataagaaaacatagtctgtagcagatcttttgaacatacggatcgctataaatgaatttgttgattgaatacaagtgtagtatagaccatgactttctcaaccatttataacgagatatgccatcctggaactggcataatagtatcaaataaattgtggatgggcatgctatggccagtgatttgcagctttcttagtgagccatctgtaattttatatcatattttgggcctcttcctctatttagacttttggagtttgcatgataaatcttgtttagaaagctgagttacttgagtaaatgactagttttttttcataatccctaagagactctttttttctagaggtaataatgcagttggtgttgtgtttgtgtttctggctgaatcatttatatttctacactaacttatcttaaattatgactgtatgacaccagagctgtagggatttacaattattttcatgttcatttacctgttgaacatgttagtttttatcattagttcacttcttgctgcagtttatgtaccatttttcaaaagaaaaagaacatgtctagacttgatcactgattttgtttattttcacagatatcatattggtcattggtgctgttgttgccggatatattttctctgttgtgcaacatggatttgggtcatcaactgctgaaaaggtagtgttttctgtttgttacattttgggattcggttgtctttttatatgctggattttggctttcagttggtccttttcacttgcattttgcagtatcagtattcttgaagctttgttatgaagaattcttagtcactttaaactattatcaggttcttgctttcagttacaatggactgaagcagagaatccccagtatttgtttcatgaatttgaacccactatttacatagtagtttgtgtggatgccattgcagatcgaagcacctgaagatgagcatcaggagagcagcaccgtgggaaagccacctttggttgtggagagcctgaaagaggagccaagtgctgggtggccttctcttgggactcttattggtgatctactgaaacttgttattgaaggggtggggaatcagcttctcaggctcgtcccatcacgcctgcaacatgggaagagaaaaacagacctcactccactcaaagacaggcttgtgatgcctgaagacacagaggagaccccagtagcccagaagttaagtagcactccaatgagacccgagacactccatggtcctaacccagtaaacgaaacagcaccgaaggcccagaagagtgtcaaatcatccaaatttagggattctacgctgtcaagcaagcacaggtcctccaagaggcaggaatacgcggagttctacggttcatccgaaacacctcaagtgagctcaaaggtcccaaaagatcggctacgccaccgccaccgggagaagagtggggaagctgtttatgggactagtcatccggagcccaagcctgcggaagtgaagcccgcagactacagtgacccaaagtatgatccctacaacatcagaagcaaatatggtgctgacagcggctacaggtactgatgccccgttcctgccatcgttcggcatctatctacccccagtgtactgatatcaacttccattagtcgttgtgcaaaagcacaaagctgctgccggtgcttatgggtcattttctcaccagttgtaaccacccataagatgagatgcggcagatggtcattctagttaggtggtgatcctatatcaatttggcatccggaatccctctatgcggttcaggggaaagccaaaatgtaatttcgcgcagaaagcaacccgtagcctggtagtaattttgatctgctcaatacctttcatgttgcatgcttgagctctggtcttgccatgttatgttacagcctgtggtgcatgggccatctgtcatgacaggcaagtccaatgtcaaaccagctgaaatgcagctcctatcctagttctccttgagctgtcaatgaaagtgaggtctcattcttctctctttacactgctggtcctaccctgcaaaaccaagatgctgactggacagtcctggaaggatttgcatctgtgtgcgtgttgtcaattctgaattattcagattttctgactccatgggcggcctaacttttgatgatatgtgatcctgccatgtgagggagaatacgaggcgtctccgcgtgacaaagtgtggtttcttttgaaggattctgacgtgtgagcagcagcaacagcagtcaacaggaagctggggtccaaacaaaaacaaaagctggccgtttttcggcgacatggccaatgcatcatctattagcagctaatctgaacaaactttcttcctgtaataatctaatcgttggagatataatcaaagagaagaaggaaaagataattgtatgggcctgaattgtatgtagctgtctgccactcttgggaagctagcagccgaagcggtggtggtcctggccatgaactggactgcatatgtaggactactactacgactgaacaagatctggatagattaagtgataacatggcagcaatccacattgttgggcggcacgtcttgtggtctccggcgcctctttttcggaagaaaattgaggagggaactgccattttgctttgcctgaaaggtgcaaaggcactcgcatgatgagatgagaaaataccttgggatttggggactcactcaccgtcctactactgtactgttgtctgttgacttcatcttcggagctcatggttgtgacccccccccccccccggggtcacatgtgaaatccaataatttaacaacctgatggatggacatttggatggatattgctcatcctttatctcagactatgacctgttcgttttcggttttgaacaaaatgtccaaatttagctatagtcgtttttgtagttgtgtgtgcgtgtgtccaacaggcggctaagctaattacttgactaacattactcgtctccggttttgaacaagttgagaaaaccgttgatgaacatccctatccaaaaccacagccgccttttcttctcgacacaacgggcaagtatttgtttttttttcctcctgctcgtaagagcatcactgacagtaccaattgagttttagactaggtaagccatagacttatctgtatatgactttgctttattcttgctctgaattttgttttatttctccataagttttaggatatcacaagaaataaaacaaagtaaaatttctaagaggctaggactctttcttattcccccccccccccccccacataaaattgagccagaggaatgtaatccatagttattttctttctttcctataaaccaaagggatttaggggggaaatgtcaaaataaaattgaatcgttctgaagttctttgccgatccttcgtacaaagggaacctaaggtcagcaacatagctagatctaagacaggatgtgtcatatcctaaaactactaatctagaaggtgcacatatattgggatggagggagtacatattaagcttcctctgaatgcagtaattttacaacatttccatgtaattagtttaacttcccagaaaatcatccgaacttatcaacttcaaataaatgacaaatgcatgtgacatgcatagtagcatggaaacttatcgtatgcacacttacttcggatacattacatcatgcacaataactaacaaatattacgatttcttttttggaaaatttacatgtactttcaatattatgatgttaaaatttattattatttagcctaaaagaataaaaaatgtcagttttaatagtatataaatatgctagaatttttctctcactccctctatgtatgatggatttaacaatgagtctttagagtagtatgcaatattattggaagttcatatacaaattcttttagaatatttgtgacaagttctcttgagccacttcatcggatcattgttgcggattatttgttctacgtatcttgaaaatatgttttttatcttgaaaatatgatttttcataaaaaaatacttctactgcattgctcatatcccttttctaagatatttgttaagtttattaacaaaatatttaatttacatctgtaatcatatggataattcagtacaatagtcttcgcaatttttctccaagagtacattaccaattattagctaggtttattcagaccaacgaaattaaatcatgtttatatgatagaggagcagattcgggatatcccacaattatcaaagcttgaaattatgtgttttaaactgaccctaccaggttatcagctggactctagaatctactgtgagctctctggtcttgggtgcttttattaggtcaataagtggttggtggtaactggtaattaagcttctaattaagcatgtgccagccatacctggatgcaccccaggattggggttagaccagactgggaaaggaaaacaatagcagaaatcagtctgatggtttcacaccacacatgatacatactccctccgtcccataaaaaactaattaatatgacatatcttagttatatgaatctggacatatctctatccagatttattgtactagaatatattacattcagttttagatttgtttttttgaatggaaagagtagacatactcctatatatcatcgtgtaacaaaacgatcagcaacaagttgcgtgtagaaatacggtagaatttagtggaagacgaagaagaatccagagaaagaattaacgactgctgttttggatccatcgaccgcatgcagctcactggagaacaaaattatggaattttatcgttgataaagtgtaagaactgttaaacattagagatcgcaggtaagaatgacctacacgtaggatatatggatctgaaacccactatttaattatgtttctgacgtaaaactcttcctattgtatttctacagtttttctatttttattctaaattctaatgattattgtgcatagaaatattttaataactgcttttttagtttggtcaatttggccttgcgcaatgatttatttataagtatcagttggctccatatttgatcgtcaggaggaccaatgtactgtggttattgaagcagcacacttacagttgatcatcatgagcttcttcatccattttgaacggtgaactattaataagctacgtgcttagcttgcgttttcatttttgcgcttaatctattttatacggaatttttgccacgctgttttttttctcatttatttggttacaggaactttggttgggtagccttgatgcagaggttgaggatggagtaattcatcttccttgcaaaattgaaaccgtttttttttctaaaaatagttttaattagctaggtttttttttctgtggtaagtaaattggttccccatggagtgtcgttttttgttagtttttttcttggttggtcaggatctataaattagctttgcagaatcgttcttgggtctttgacagatcatcgtccttggaattcgtgcaagcagcagctaaaatttctgttgacgatggcgaagtcagttccgtcgtagtttacaataattaattagacttcctgatgttgctttgatcacctaattaattattctagctctttctgatgggtaagttacatcttctcatagatatcaagttcttgtcatccactgttaaattttctgcgtgctctcctattctaatacagcagagtcgtaattcaatcaacacaatcaagtttgttagccctgcaacaaatcaaccgttgccaaaatttaaaatttgaacttaattttttaattgcagtgtattttcaacgtggtttttttatattggcttttcatacacatattattaagctgtttgggccaggctataaacaaacagaaaaaaatgtgtgtttagcaatttgcaaatactcgcgaatggatcataacttatctggaagtgtggagtcttaaagaacaaaaacacccaactttttagtattatttgttcatcgacatcagccaatcagtgtggctgctgatcgatgcagatgaaaactagccctctctacctcaactcacatcagtaatcagatcattggattcaagaaaccaaaccctcttatctgcagcctgcataattgaccatgaacagttcaaatcatagcgtcaaatcacacatcatttaattcaggtcgcctttgaacattacaaccacatacaaacgcaccacaccagttaatccctcaactgtacgtactcccccgtcttaaaagaaaaaaaaacacattctaatactacgaatttagacataaatcatagtattagaatgtatcatatttagtattatattggatttttaagaaacggggagtatgtcacctcgatcgacctgcaaaatctcgttcgaaaaattcaaccgctagctatgaatgtttggcaataatcactccggaaagcaattagtaattgaacacgtttgacaacggcaacaacgcaagttgattcagatgacaaaaactttctgcgtgctatatattgaaatgttttattaagccacgtaactaattaagtactggtagtatatatattctgaaatgtaatccgacgttttgtcaaagaaaatgacggcaggacacgtgtggacacgaattaagccaagaaattcagttaattctcatataattcgtacaaattttccgtattccaaacaggggcttagaataatagatggacagactcgtaaattacagtaagacattaatggtcgagtgagttgtgttttaaaaaaaatattggtgtaaattaggcaaagctgagggtaagagttaaagagaaagtttaatagtagagttaagtattatctataaacttataccatagttaacatgtactccctccgtcctaaattataacgcctatattttttctacacagtcttcaatgacatactttgaccattaatatattagtacatgttatatttccaacaaatatgaaattaacatcatatgaaatactttaaaacacaaatctagtgatataacatgtataatacttagcatatatatggttactatgattattagtcaaaagttatcgagtttgattttccttaaaaagagggtgccttatactccctccattccatattgatcaagaaagacttaactactactccgttctagaatataaagattttaagggttagacactggtattaaaaaagtaagcagaattaaaagtgagaaggttgtgattggttgagaagagaatgtaggtgagaaaatcgaatggtggattggttgagaagagaatgctgatgaagaagttgttatattttaggacaaaatttgaaggctaaaagttattatattttggaatgaagggagtatgtgttttatttaatgtgaatatgtgatggagaataaatcaagaagcatgtagacttaaactccctatatgcaaaagaaacaagcgcttagaccatccccaacccagaaactataaagtagtttccatatttgccatgtcatatagatactatgggtagaaactatgtatccaatggatggtgtcttcaaattaaattctcatccaatcacctctattctctctccttttatccacctatcaccttgttttcattcttagttcttgtgtagatatggtttcttgcatgagaaataatttcttcatctttttacctctctcctcattaactctcttgccacataggatttttgcttatgtggcaatgtatttaatgctatgaacactagatggcatggagggctggggatagccttaactaccctaaatgcatagatacaataatgcttcacgttaaacgaagggacaagagttatatgatgatcaatttgaaatttgtagtttttggttatatgatgatcaatatggaatgagagagtaggttagttataatgttctttatttttttctcctctctctcatttatctatttaatacatttatcttgtatcatttgtaaatgtggctcttgcataagagccaacactcctcatttttcttatatcactgttctccacataagcttatagttttaccccattattccatctaaacttatagttggcttatacctcgttattacctttgctctaatatgaaccatggctcaacatccgatggtgctgttttttttttgcaaatggtttttcgaaaactatatatagtgggaaaacataaaaatggaatccaagtacaacttcttttacatattgttgcttttttgggggatgggaggggggaggggggatgtgttcatattacaggagacattgatttacattcgtcgacaagtaagatcttgactatggtatttgaggatgtagggcatggatggtataagtatatatgcattgatacagtaatgagatacatacatggaattatatataggtttggacctccaatatgggtggtaggcctaattgtgttgtctgtattgattgaaagtatcacaacaaagtatagtacatgaggtggatccataatctggtctacacaagtaatctcggcgaaaatgtgaaggcagtgtagttggcgttagttatggctccttctgaaagttgaactagtgtgcagattgtggcttgcaaatgtccatggcttgagataagatttgatgtccttccctcctaggaaaccttgtatttgtatcaaatcttgcccctaagaggccctgtacttatatcagagtatgacctctcttctaagtaaaactcggcatccaataaggtaccggcagagtatgtattccttatcattcccgattccgactacatgtcccttcttaatagaagggattgctttattgtcctatctaaatatacatgtttgaagatatctttccatatatgattggctatgcatattcctagctaggtaagtacatatgtatagggtatcacatatatactaaattgatagtagtcttgaacctaatttaaaatgtaaaccacacaaagtcaagttatcaacacatataacctaagcaaatttttgtttaactaggaagaggttgatcaccttaatcctttcatccgggtggtgtatatgcatgattagattataaaatttggatagatttcaaatcactcaaccgtcaaactatgcatagtaaaatttatctggaatgtcacccactttccttgaaatacgaaccgctctagactgtaaaacaagatctacttggcatccaactcatttttagaaatgtctcattgttccttttctctgcccaaaaagatatccttgcacgccatgttcttcagcgtctaccataagtttgtcgcccttcttagagccaacaccttgggccacaaagtaggtggtaggaagccaaatcttgaacttgacatgttgttgttctttattcgttcatcttatgtggattcatgcctcctctttttgagatcttggctcaaaatatgtcaaggaaatgtttggtttggagacttatcaaactttggttattcttcaaagaatgaagattatttggtagggtagtgatggttggcacatgttttgtttgttgccttatcaaaattttgcatcaaaatttggtaatatgattttggcaataaatcaaataggccttaaattatacttatttatgttcacataattttcttagttgttggactataatgaaaaaaataataatatcaacaatttaaatgcttcaagggagttgaatgggggcacatgccctcttcacctaaaaatatatgaaatatttgaaatatttaatatgcactaagttgttgctatgtaatattttaaattaaattaactaacttttggtgtgtgtgctctttgagttcagattttcgatccacctatacccaccttgtatagtcactttggtaaaagaaattatgttctttcatttgtaaaagaaatgtcataattttataaagaattttgttatttgttagttgcttgattttatattatttgtaagtccactaagcttacacaatatatatactcacgtgggaacatgtcgatatgatgcaaagcatcgggagttggcgctttgattatcattaattagaccgttaccattgctacttggagggatattatgatatcagactaccttgcatgccttaaaaagatatcaattttatcatgactacagaatagctagttttgtcgactcatatttggagatgcggctgccaggttctagaactacttaccattttgcacacccctttttctcaagtaacaaagcattatcaaggaaggtagaatccaaaagattaaactctcataattttacaatgtgatataggtgatccaggccttagtgacaaggtctgttgacacataccttgaccgcccatcgagggtacatactaagccactatggtacctcacatgaaatgactcaattggtttggatacgttgtattacatcgaatacaccgaccatggagtcgggctaatatgagcggccgagtgaaatgtctagctaccatgggataatctacaactagctggaaagtttaccgtcgatggcaatatctagctcccaatgtctattcgtcgctagttagtaatactagtcattaacctgtattgcacttgcagggcatgtagcaataaactttagatttctctcctgtctcgagtgcaagctaaggaaaataatgttggaactagggcgcgataaatttttatcctttattaaataacagatgatggtacgagttgtgagagcatgtatactcggtttatcatcaaatcatacccctaaggatcgcattagcatagggcaaatgagttgcttgtttgagccctaggcaactttaaatactagaatttatttaagagtttttttatttttatttttatctttttcaatcttgtcttctagattgctagaagcacaagtactaaaatttcagtccaaaactattttttgttattttggtcacgtattttgaaacagtctaaaccatatcgagaaaatgttgtccaaacatacgtgtgctctatattgcgcatgcagggtactaccgatttatactagagatttttaaggaagtagataacatacaatagtaatactcagtcattactcctttcagtgatccggtactcctacgatacaagagagctttcgagtgaatgtgcacatgacttagaccttattcgattaatccctctctagagaattgagcggtatttggagctccccactttctatttttacatgaatctcttctctagtcctctctaatcctttttcataggaattaatcgaacaaactcttatagcaagtttaatactaggctataagccaactataaacttatgtaaaggtgagagaaaattagaaaaataaagaatgttagctctcataagagcaagtttaatagtatagcccactactggctccaaatcatttatagtcaattcatacaatagttacctataaatatataccacactattaatatctggtcccacctgtcatacacacattacatattggagtccgtgctgcagctggctacaaatctgtagcccgttactcttctctctcctcttttatctcctcaaaatttgtttatagctggcttgtagtctgctattgtatccactctaagagatagctctttacatactccaaagtaaatacgttaaatgcatatgtgagagaagagaagaaaattatagacaaccttataactaatactatattatacatgttagctctaatataaatttatagctactagcaaaatgctcaagcttcgctttgggtagaagaagaaaaatatataatatgtcatataaaaaatatattttgtatcaaatatcttatcattatatggtatttacttgtttgaatcaaacgttgggctatttcataatattagaaaatattataaagtaatttacaaaaactacaaaaacaataatgaagtgacagatttactgtcaccataactactccctctgtaaaaaaccaacctcgtattaggatgtgacaatgaatctagacttcgagaatatccaaattcgttgtactatgttatgtcatatcctaattaaacgaatctcatactaggattttttttagggagtagaagtttttaaaaagatataggtcttgtttagataaaaaaaattggcaaaaaatgtcacatcaaatgtttggacacatgcatggggcattaaatgtgggaaaaaaaccaattgcacaatttgcatgtaaattgcgagacgaatcttttaagcataattatgcaatgatttgacaatgtgatgctacagtaaatatttgctaatgatggattaattagggttaataaattcgtctcgcggtttataggcagaatttgtaatttattttgttattagtctgtttaataattcaaatgtgcattcgtatactttaaaaactctacacccaaataagtaaacacacccatagataataggcaaaatttgccacaggacacacaaaaaacgtgtaattggctgggagacaccgcaaacgagcaggcggccgctccgcgcagcagcgcgctagcagggactggacgcggaggcaagcaggcaacagccacgacgggagcacgtgacaaggagccgcctacggtggagcttcgagcagtcgctagatcatgctcctccacctctcgtccctccccaaccatgtcagcctccgcgccagctacctcgccggcagctacaaaacttctgtgatttcgggtgggggaagatgacgtcaagggcaatctcgtcattttaaaaacaatttcacctctttttgactcggaaataataaaataatgcgaccggtgtcctatagccaattatatattttttgtagtgtccattagccgtgtcacgtttttgtgatatcttccaaccaattacatatttttttagtgtcctgtatcaatttttgcctagataataaactctatctcttgcaaaatactcctacctccgtatctctacgagtttccactactgtgcatgccttggtatggtatcctattcctacccgcaggtaggtcgttttccacgtctgctgctgcctgcctcctgcccttgttgccagtctgctgcggtggcacagagaccgttgcgctgcacaagcgttgaccttggattttcatggcaggcatacgtcccaaccatagcacacctccccataccaatcaatactatactggacgtactagtacatcaatactacttctacagtagagtactttttgaacgccaattgccaagacctagcaacactggagtattcttaaaagtggatcactgatttggctaattcatgatttatataaaaagatggacttaattaacacagagtaccgtttaaacttgtaactttaggtaagctctccccacattttttttacatgaagctcttcccacttgaccttagagaagtggagtactatccccgtttcaaaatataataacttttggctataaatctgcacacacagttatctagattcatagctaaaaatgcttacattttaggatggagatagtaactagcagagaagagagaaaaaaagaaattagtcgatcaagctaactttacaagtgcttcaagatattatttttagataatgaagtgattcaagatatatgtattaattaaatacataagtgaaaaaaaaggaagaggagaaaaatttgaagataaacttatagccaattaggtttgaaactaataaagatgaagattaagttgatgcacgtaaaatgagaaagccattagcacataattaagttttaattattataaatttgacaatggatatatttaatattttaaatcaatttctatatagaaagttttagcatgaaacacattatttagtagtttagaaaacatgctaacggaaactaagataaaatcttaacatgtacttataattatacatgttagtcctaatattatggttagatggatttacatacagcagtagtagtagttaactctactgttatatcttgctactacctccgtcccaaaatatagtaacttttggttagtgtctagatttatagctaaaaatgcttatattttgggacggagggagtatttctttatttctaattacgatgcagattttaccttagtttttattagcatgtttttcaaattgctaaacggtacgtttgttttaaaattgtttctatatagaagtcacttaaaaatatcaaataaatttaatttttaagtttataataattaaaaatcaattaatcataaactaataattttctcgttttgccaacgctcactttatcttcatccatctcaaaaccacgttagagcgagacaggaaaaaaaaagaaaaaaaaaacaaaatgtctgaaccttgataaggtcggacagctctgtctgcagggtgggcccagcccaccagtgtcacacccctcccgaaagcaaagtttacccccccaccagtacgcgtagcgtttccccacactccgcggcgccgcaagccaacaaaaaccaaaaccaaaaccaaaaaaaaaaaaaaaacctggcaaaaccgcggatcccaacgcaacgagagatagagaaaggcgaagacgaaaccgaagcagcgaagccaaggttgacatgtcacccgctcctcctcctcccctcttccccttcctcctctagaacacgccgccctctcctcctcctcctcttcctcctccacccctcgccgcgcagggcaccgaccgtctccgcgccaccgctcgtctcggtctcacctccacctgacctgacctcacccaacgcccccctcacctaatccctccctcctccaatcgccctcgtcaaaggggtgcaagaatccaaggggggagtggttggggttgattggttcttggttgtggtggggcatggcggcggcggcgtcggcgtcgtcgccggtggagttcctgctgcggcggccggcgccgcggcggcggcggctgccgctggcgggggcgttcttcgcgcccacggggctcgcgggggccacgctgctccgggcggtggcgtcgctcgccgcctcgctggtcgcgggggccaggccgccgtcgcagcggcggaacgtcgacgcgctcgcccgccgcctcgcgctgctgtccgcgatcctcgagtccatcctcctcgacaccgcggcggcgggcgccttctccgacgcggccaacctctgcttccgggagctctacgtcgtgctcttccgcgccgagctgctcgtctcctacgtcgcctccgccggccgcgcgtgggcgctgctacggagcccgcacctcgccgcctccttccgcgacctcgacgccgagctcgccgtcgtcctcgacgtcctcccggcggcatcactccgcctctcgcacgacgccaccggcctgctcgacctcctccgcgcccactgccgctgccgcgcgcccgcgcaataccatgaccccgacgaggcggcgctccgggaacgcctcatggatgcgctccgccagttcgacctcggccagccacctgaccacccctcgctccaatcgctcctcgccgacatgggcatctccaccgcggcttcttgccgcgcagaaatcgattacctggaggagcaaatcttgagccaagaagaggacaccgacctgccgctcgtcggcagcgtcctcgccttgctccgctactgcctattcgccgtgttcgaccctagcaacgcgaaggcgctccgggattggccgttgtcgggcaacaggcagcggcttctctcgattggcggcggcgatgacacctccttctcggtgccaaaggagttctcatgcccaatttctctggatttgatgcgtgatcccgtggtggcgtccaccgggcagacgtatgaccggccgtcgatcatacagtggatcgaggagggccattccacctgccccaactccggccaaacccttgcagatcaccggcttgtgccgaaccgtgctctccgcagcttgatttcacagtggtgtggggtgtatggcttgcagtatgattcgcccgagagcaacgaggggatggcggaatgtgttgctgcatcttgcagtagtcgggctgcaatggaggcaaacaaggccacagctaggattttggtcaggatgctggaggacgggtcagaaaatgtaaaggcagtcgctgctaaggaaattcggttgctggcaaagaccgggaagcaaaaccgggctttcatcgccgacttgggtgcgattccgctgctttgcaggttgctcttgtcgaatgattggatggcacaagagaatgcagtgacagcgctgctcaatttgtcaatcttcgagccaaacaagggacggattatggaacaggaaggctgcttgcggcttatcgtcggtgttctacagaatggatggactacggaagcgaaggagaatgctgcggccactctgtttagtctatcagtggtccataatttcaaaaaactgatcatgaatgagcctggggctgttgaggagctggctagtatgctgaccaaggggacatcaagggggaagaaagatgcggtgatggcactcttcaacctctcaacacatccagaaagctcagctcggatgctcgagtcatgcgcagttgtagctttaattcagtcgctgaggaatgacaccgtgtcggaggaagctgctggtgctttggccctgctgatgaagcaaccatccatcgtgcatcttgttgggagctctgaaactgtgatcactagccttgttgggttaatgcggcggggaactccaaaaggtaaggaaaatgcagtctcagctttatatgagatttgtcgtcggggcggctctgctttggtgcagagagtagcaaagattccagggttgaacacagtaatacagaccatcaccctcaacggaacaaagcgcgccaagaagaaagcaagcctgattgtcaagatgtgccagagaagccaaatgccatcagcaatggcactagggagcacattgacagtcgttgatcgttcattggtagggaacaacacattaaggcgtgctgcgagctttggcagtggagaattgtcaaacccgatttcgatatcagtgcaggtgccctaggtgaaaggtttctaccctggattatatggatggttacatttggtgagttttgtccccaaaattctttcatttcatgctccaatgaaggtatacaaaatttaatccaaaggatttaatactcgaaatatatcagatgttcctatgtttgtgtgtgaaatgtggataactgtgcagacatatagatgtgcaattagagttccagcttgatgttcctccttggcaagctcggaaattgtccaatttttgttttatttttttataaaaaagcaccaaatatgtatgctgtatgctgtaaactgtttaaattaattagaagctttacactgaggcaacagtggaaagaaatggtatttcatttcaccaatgggattgcaatacaacatagactttcacatttactctacaaaagccagcttaaaattaattaagtatgtagtatatcttaaaaagtaactctagctattctagcataggaaatgaacaaaaaaaattgcactatcaacacagacccccccaatctgaactcttccagcatggaaattgttgggagagaatgagtggtgtagaaactgtgctactttaggacaatctctactttgttgaggagaagattgaaaggacaaagttgatcatgcaactgaagaggagggggaccatcaatccactgaaggccagaaaacactaccggtgagtaaagatgatgttctggaatacaacagctcaatggaaacagggtgcgccggcggcagtaacctgattggtatcagaaagttttatttcacaatggaacccagtttccactcaccgaggcaccgagctggtgtgttcttcgggagaagtcgtgtggaatatcacgctcctgatggaaatttccctgcttccatttgaacaaggagcacaagcctgcaacaaccataataaaaggtggatcaagtcaggatacctggactgatgaccttttgagaagaataaatcttaattggtgacttttgcagttgcatgacagttcttggcaaagttgccaaaccttcaaaattattactatatgtttatcacatatggtacagtaggatacgaacaaattatgtgtgaatcttttttagttaggttggctacaatctgaacgaagacaacaatcgaagtttgctaggtgtaggtggtgcagagaatctttctgttatatgggagtatggaactgactcctgtaccttctcaatcatctgaatttctttatcgtccgaattttcctaccatcatcagcccatcagtcttcatcacctctcttgacattttgtgcctgaaatatcttccctcatctgatgtctacctaacaaggttcctgtacaaattcacaccatgatcacgttttcgtacttaattatcctcaccgtttcgtcagcttccagggtcggtagccatgtatttcaaacgaaaacgtgtgtccagttctcgacttttcggcttgacgaagaagaccgtcgcccaaaatctgcacattttcacacttgggccattttcattttacatgccggtttttaccgtgatcagaaacttttcagaattcatacttaacagtaacagattaggcgaatttcggaagagttttggcgtaccttgcgtgcgaattggatcggaaatcatgtggatgatatgctggtctccaaggcctgtggctgatcgtttcagttgggctatgagctggacctgtgattctcatgaccgtgaggttgatgtgctgaagcagctcgatctggcaaccggagatacggtatcaggatggttctcggcgccggatttgtggttgccttgagctcaggtcggggtcgctaacatggatgtctcggcaaccaatcaaatcaaattcatctgtagaaaaatgagaggaaaaccacacatatcaatggcgtgagtagcgacttcagttgagtcgaaagatcaaactgggacatttcagtggttaccgctggccaacatgcttggaacgcagaaatttttatttactcatgtgagaattgaaatgtcttaaaccctgtaaaattatgcattgaaaatgggccttgaatggatcagaaacatagtaaacaaacccaacggaaaataaagataacgtctgtgcggatacaaaagggttaaaaaattgaaaagaaaaaaaaaagaaaagctgatactgcaatcaggcaaaactgaacgcagatgctgtctatacgttcatggatgcgtgaataaaaacacgtcagttaaaactctaatcggattgagatccggtgcagttataaactctaaccagcatcataggactgttatgtattttcagccgtttattttaatgatcaacagttcagattcactgctatagtactcgaacaacagtaaaataagcaatgttttatattacaacacttttgccacagtatcaaattaatctgtaccgtttaagtttgatccaacttagcagctacaactgctaaagttgcagtcaataatataattgcagctgattcggatcaaactccaatcagtcagtgtgtgcttcacattctgtaccaacaagtaacattaactatgatctgacgggacgctttggaagacgattaaaaagattaggcagaatactgtcaattacctgggtaacatcagatgcgtgtttactctttaccttcatacgcaaaagctgtggtactccctgccgaagtcttcatcaagtcataatgccacggctgatcttgattgtacgatttagaaagagtcgtgatgctagccaaccaaaactgcagcaacagacttgtatttttcagttgttcacgtcagagagtacacatgaaaaaaatcgtatcccagtcgaactaagcaagccagtcattacgagtatgagcttccaggtcaaagatgtacgaacaaggcttcttttttccatcaaacacgaaaataaaactcgaaaagtttcactaagtttccataaaataaattctagagtgaaaatcagagaaagaaaggaatgacggtcgaatagcattgcttctagtaagtagtcaccgacccagtttcttgttgaaatatacaagtacaaaatgtaagatttgcaaacaccagcatcgagattatcaaatatgtcaacgggaagaacgaccgtgcgtgcaaaattcatcaggttgctgatgtcggtgaagaagttgaacctgcacggttgcatgagtgcgctgcatgactacaattggctgctaataactagtgctctacatgactaccttccaacaatttgtttaagtctatactaacaaaccaaaggcccactgattcctgacccagtttgtgcagtaagtagtcagctgatcaaacggcaccttggtttgcagaaattacctgggttaatacactcctatcattttagcaaaaggaggcatgagaagctatatgattgactgcttcatgtagcacagaactacattgaaaggtggcagtggatatcaagtatcaacagccgtcagcagattgtttctcctgtgcaaattatattagcataatgggacttgagcaccactaactctccactcatccaattgtccaattgtttaacctgatacacgagcacctgccattgtacgatgttgcctcccaaaacaagctccatactcctagcctctcatctgaggctctgaaacctttcgtctcaaacaaaagatcacataatctgtccccatctcccatccaagaagaactcacataccaaccatgccttgggctgaaagcttgctgttcctcctcctcttgttctcgctgcccattcccttctcccattcttggtcctttgattatcccagccccattgccaacattaattctctttggacgaacaacaatgccaccatcccatacagtgcaacctacccagatggttcaacgatcagagcgattcttgttaggcagaatcctacatggtatagtccattcttcgcatgtggtttcatctgcaccgctccttgcaatgattttctctttgccatcttctcggtgtccgttggtgatccgagcaaccctgccttcaatacctcgtccatgccacggatcatgtggacagccaacaggtcccgtccagtgaaggataatgcgtcactccagttcaaggatggcaatctcatactgcgagacttcgatggttctctggtctggtcgacgaacacatcggacagccgtgttgtcggtctgaatcttgctgaaactgggaatatggttctcttcgacgcaatggggaagacggtgtgggaatcatttgagcacccaactgacacgctccttcttgggcagtcactgaggcaagggaagaggcttacttcagattccttggcaacaaactggactcaaggtcagttctatctcactgtacttgacaatggtttgtatgctttcatcgaagcagatccaccacagctctattatcaaagaagattcaatatcactgatgccatagttcagccaaatatgaacatatcctctgatggagcaaagaactacacgacttacatttccttcttaaaaggtagcctgtcagcatttgttagcttcaacaatactgatatcaatctattcgatatatcactgccgtcgccatcttcagcacagttcatgagcctcgagaatgatgggcacttgagagtttatagatgggatggtacttcgtggaaacctcaggctgatgttctgcatgtggatcttgatgattgtgcatatcccacagtatgtggagattatggtatctgttccgaaggacaatgcagttgcccgagtcggaattctggggatgaagatcaatttttccgccaattggacaaccggcaacctaacatgggctgctccctagcaattcctctgtcttgtgacttgacccaatatcaacagcttctccccctcccaaatgtcatgtacttcaatttaggacaaaattggaccaccgacgaatatagctgcaaggaggcttgcttgaaggcctgttcatgcaaagcagcctttttcaagtataacaatgtctctaatggttcttgctacctaatgccaaagcttttctcactcatgaattatcagcctgaagtagttggatacaatttatctgcatacatcaaggtgcaaatgttacctccaccaccaagaagcaaacaattaaatccattagtttaccatgttggtgctcctattatagttgcagttatctgcataattattctcatcatcagaagaataatgaaaaggaagatggatgatgacgacccatttaaaggactggctggcatgccaacacggttctcctacaaacagctgagagaggcgactaataactttagcaaaaagctgggacagggaggatttgggccagtgtatgagggaaaacttggaaatgttaaaattgccgtcaaatgcttgcgtgatattggccatggaaaagaagaattcatggccgaagtcatcaccattggaagcatccatcacatcaatcttgttagattgataggatactgttctgacaagtttcacaggctccttgtttacgagcatatgaccaatgggtctctagacaagtggatcttcagaaagaacccaagaggtacactcagttgggcaactcgatacaagattatactggatattgcaaaaggcttggcctatcttcatgaagaatgccgacagaagattgctcaccttgatatcaagcctggtaatatcctccttgatgacaagttcaatgcaaagatatctgatttcggtctagcaaagctgatcgatagggatgaaagccatgtcatgacaaaaatcagaggaacaaggggatacctagcaccagaatggttgtcatcaacaattaccgagaaggctgatatctacagttttggtgttgttgtgctggaaattgtgagcggaaggaaaaacctggataacaatcagcctgaagcgagcaacaacctaatcaatctacttcaagagaaaatcaaggtcggccaagttctagatatattggacaatcagaacgaagaaatccaattacacggggaagaaatgatagaagtgatcaagctagcagtctggtgcttgcagcgcgactgcagcaaacgaccagccatgtcacaggttgtgaaggtcctggaaggcgcgatcgacacggaaacatccgcaggctacgatgcagctagtaaagatgatattaattttgacgcttcatcccctctgtccccagcaccagtgtcagcacgatgaaactctttttaagtaggaacaccgatacttgttacagtttagttgcagtactgtgtgcagtgtgctagtgtgcatctcatgtaaatttgtcccttgtaatatgtaacatcctcatcaatgtgtgaatgaatgaaatattataacgattttattatcgagctatttcatggtttcccaagtaacaagacgaacagcaaaggtagcatgtgaagggctagggaaaaggtaacatccgaaccttgccatgctcggccacgcatttcgtcgaacacgcggagggccgacaccatctgtgcccccccgaccgccgacggggaggccacgccgagggacaccgcccccggactgtcggcgccgcgcgccgcgtgcacgctcgtgcacccaccccgtaggaatcactcgacgccgcagcccatcctcatccggcgcggcgcggcgggcgacgccggcgaggctggcatgactcacgagcgccagcgcgcggcgacgagggaagcgggagagagggaaagaattataaaataataaaataaaaatctaagcgcgactcgagcactgcacgaatctcgaggcgcacgtggcccgtgctgcggcggccacgtgggcgcccgaggactcggaagagttttgtgtggccgtggtatcctcttccctccactccactctccaacttctcccgcagcatcgccgccgtcgtcgtcgccgccgccgccgcgaggtgagggctcgtagcaccgtccgggagggcggaggaggaggagagatgagctgctgcgccgcctcgtcttcctctccggttctcgccaacccccgggtgagtacgcacgccctaccccgtcttcgccttgccggcccgccgccgccgtcctctccatcgacggcggcgtgaaattcctgcaggaatccgatgcgttccccttccgctagttcatttcagccgccatcattggtcttagcggacttagggcaagatcaatcccgccgcgaacaaacccgcgcgcttccgatttttctcacaaattcttcggttcgatgtgctcgtggaatcgaatcgtcggcgcgaattcgctagttcgttgggattccgaaagggagggaatgttccgaagagaatcgattttataatatgtctggatttatctttcaccaaggtcccatggtctagcggttaggacattggactctgaatccagtaacccgagttcaaatctcggtgggacctattttttctccattttttttctgactcgctgatccttgctaggatgtggctacatccaaaacaccatttgctgagtcgaggcgtcgagctgaatccatttgctgagtcgagctgaatttatatatgctccatgaaatctttgctacgaatttatgctttgttttcatttcaaggatgttgctgcatcaaaacaccatttgcttagttgagctaaatttataaatccccatgaaatctttgcaacgaatttatgctttgttttcattttttattttaaactttcaggggggattcgctgctagctgctcaacaagaaggaaccacagggtgatcttcctcggttcaaggcagttttctccgatcatatacagcccagcacgccgcgcgtcgtcacggctgtctcggagagaggtgatagcttttgcaggccagcaatcttgggatatcggcagatttgtcaggacgctgtatttcttcaacgggccaccgaatcctctcaaggtttactcactgtattgggattttttttcacctcttctcgttacagttatttcacatttggcattgtgctcatgttttgtctgttcaatctgtagattgtagagtccattcttagcagtttcactggctctgctcctggtgaggtgccaaagaaaatggaatcttctgatgtggtgctggtcactggagctaccggtggcgttggacgaagagtggttgatatcctgcggaataagggaatacccgttcgagtattggtacaatacttgtcaagcttatctacttttggcttctctgttttcattcattattacatggatagtccaacttctccctcttttgttggatctttgctgctcttaatgttgatctaacatttcaaatttcaattcaggctagaaatgaagagaaggcgaggagcatgctggggcccgatgtagacttggtaagccacttgtttagctggatttagattcatgttccatgtgcggtttagtttcaaccaactaggtctatttcaataccccatgtattccaatatgcattacccttacccaatacccaatgtattccagcaatatgattgcctgaggtaagtctcactgttacatttctgctaaccttctagttgtgaatgaaatgaaactagggaattttgttcttaaatgatagtgaaaatttctgtgtattttttatgacattttgtttgaagtgaccacgtatatgcaatgattcactacatataatgaaccttcctatctcattgctagtttgcatatggtttatgtggttattgaatcttccacacctgtaaagacggaagtattgaatatttatattattaaaatttctattttgtgtcagatcataggagatgtcacaaaggaaaattcacttgatcccaagtacttcaaagggattaagaaagtggtaaatgcagtgtcagttatagttgggccaaaggaaggcgatacaccagacaggcagaagtataaacaggtacgccaaatgccctatcatatgttaccaatatttcacgtactctactttacaccctacaaacttacatttaatctcatcttcatgcagggcatcaagttttttgaacctgaggtagctgcatcaatacattccttctcttgtagaatataagtaacaatggatgactgacatcctcattcccaacatacaacatggaaatattgcatcagtttgcacttttgctcgttcaaaagctagttcattatattattttgttatgcctatcagatcaagggaccttcacctgaaatggtagaataccttggaatgcaaaacttgattaatgctgtcaagaacagtgtgggtctgactgaagggaaactgctttttgggggcacaggtaaatctttcattccataccaaaatgttttttgaaagaaatatcggagatttaaatctacactcaactcaactcatattcattaggggacctccatagtacccaaaaactttggtgcaagatctgcgggaaatccagtttttagtaattatggtgatcataacagtgatttttttcaaaacaacaaaatagtgaattgcttgcaactgaatcatgtataaatttatttttccatccctacatgtgtatacatttgtatgttagttgtctttcaatatataagttttttttccttatcacaacatgttagttattttatttaggcaacttatccggaaagattgtttggggagcacttgatgatgttgtgatgggaggtgttagtgaaagcacattccaaatccaaccaacaggaagtgaaactgatggaccaaccggattgttcaaaggtattttgtttttttttaatgatccctcgactccttgtatatgcgatgtggcaattctttggaaaacctctagtctaagcaggtctgtgcaatgtattctaggtactgtctctacttcaaataacggtggcttcactagtataaggacaaaggtacctactgacatgtattttcccaaaaaaaaaaaaaacaaagttgctgccgttttgtgtgttgatttatattttatttccatgtcctaactattaggaataattaattatttgtcactcttacagatggtgataaataatttgccactggacccacatgtcatagacaaatgaggacccacatgtcataaacagcgagtggcaaataattaattgccacatcttaaaagtggtacaaagttaaatgtccctaactattattgtgatatgttactctgattgcagaattttacagtgcctgaggatctgtcagcatatgacggtattgaactacgtgttaagggtgacgggaggcggtataaacttattgtgcgcactagctttgaatgggatactgtcggctacattgcaagctttgacacgactaagggggaatggcaaagtgtatgttgtatttgttgatttattgaaaaaaatacgtccctttgtttcagcaacttacagctatgcttcttattgatggaacaggttaaattacctttctcttcactgaatcctgtattccgtgcccgcactatgcctgatgctgcaccctttgatgcaagcaatgttacttccttacaggtacaatgtgttcatgtgttggtataattttttaggaataactgaacctgaaattgctgtgataattctgtagctcatgtttagcaagtttgagtatgacggaaagctgaacccaacatttacagaaggttcatttgagctccccttttcaagtattagagcatacataaacgagccaatcactccaaggtttgttctttgtactagttttactatatgacatcatcagaataaatgagcactgtaatcgtccgattgtttggaagtcatcaagactcactagaataaatgacaattctacttgcaggtttgtccatgttagttctgcaggagttacaagacctgagagaccaggcctggatttaagtaaacaacctcctgctgttcgcatgaacaaagagctgggctccattctaacttacaagttgaaggtatgcgccatttttcctttattattgtgcatttgtgcttattgattcacatcatgtctaaatgcttatcgcatgtcctttcagggtgaggatttaatccgggaaagtggcattccatatactattgtgcggccatgtgctctaacagaggaaccagctggagctgacctcatatttgaccagggagataatatcacagtatgtagaggcagcatttgtttgttgccttcataagatgccacgccattcttcttcctccataagatcaaataaagcatcagtttcatataagtttcctgtattttttttttcagggaaagatatcaagggaagaaattgctttcatttgtgttgcagctctggcaagtccaaatgcagtagagaaaacctttgaggttaaaattctgcaactcatttgcaagacactacttgggacaacaaaacttcagaaggaaattgtggcattttatttcattttaagctaactcatgtacttttttttgttaggtcaagagcactgttccattcagtgaacctttcgtggttgatccttcaaatcctcctccagagaaagactatgatgtgtatttcaaagagctcaaagctggcataacaggtaaagaggcactagaaggaacacctgctcaggtctgaagaacatgttaaatgcagaacgcccaactgctttgacaaatcttgacatggtaattctccattgtatttaggtcttaaccacttaagatatatgagattataacgctgaatttcataaattaacttcatgataggtgcttcttgaacatgaacagaattacataaatatgcaagtctgattcataaaccaccaatagttgcagtacctgagcatatgtgccacacttaatctttgcagtcatgtggtttccaaaataccaaatgggaagtactttgtgaagtatgtgaaggaacagttgtttcttttttttatgtaaagtagtatatcctctggagtttgtgttatatttaatctgctgtatctgtatgagaagatatgcatacatcttcagaagacatatggatgtcgatcaagagctcaaaggttatggagcattggagctctttctgtagcagattctgtatattatgttgcttttattttcactgaattgtgtgctgtagatagcgtcattggaatctagatcgaccattttgtaaaatcaaatacattgtcatacagagagaagagaagtttacagttccagttttttttttcaaactttttatgtctctttttagtttgcccctctattggttactgcaacgcacccctcctttttttaatttaaaatatacgatgaagaaataggaagatgaaacccctcaaaagagagaatgaaccatgaatatgaaaacaaggtacatccatatcactagaaataaatgaacagttaaaacacaagcattcatatattttgcacagcatcaggttttctaccaaactgaaaatcagtgaacacaccactacaatccctactacacacaagtcatttgagtactaattttctacatgtttcctcgttacaaagccaaaattaaaaagaggaaggcaaggtgaaattactactccgtgaaacgcaattatacatccaatcaatattcccataattacatgaaaaactccctaaactgcagaatcatatccatgagtcctttgcctaatgatcaaagctccccatgcttcatgcatgtcagactgtcactcaccagcagcaaaacacctgcatcataagaaacaagaactgtcattagctaattaagctaggaattcagaagcagaaatttgtcaaacacatttctgcacaagtgagaagagcacatgacacaatagtgcagtgcaaaccacaaaccttcctcctccagctccggcgccggcgcttcccgccgccggcgagcacgagggcctccggccgcaccaccagcggcgaccagaggccgctcttctcgtactcgaagccgaactcgctggtgtcctggaacttgcccaggagctcctcgctgacgtccagcggcaccacctgcaccacgccggcgccggcgccaccgccgccgccgcccgccggagaagaaggtgggaggctcacgaggtccacgagcgatggtggtgaagaatggcaggtcgacatggcagcatgtcctggtcagggcagacagaatgcatgaggagaaggaagcaaaggagactgatggaatgatatggatagctgatgacgatgatgatgattcatgctgagggaaaaagattcagattggtgtgtagtttgtgtgtgtgtgtgagggacaatggcagggagcagcaagcagagaggcaagaggcaggtgagctgttgtgtttgcttggttgcagggcaagctagctgccaagatgaacaacatgcatgtgtgtgtgtttttgtggttgtggggctgggagtgagagagcagaaagaatctcatgctgccttttctgcagttggagattgtggttagaggggacttttaacggattaggattcacgtccacggtgacttaatcattgacatgtgagccaaggtttagagcaggtacaatagcagactataagctagctgcaaacatattttaagaagataaataaggagagaagggtagcgggctacagatttgtagccagctgtagcacggacttcaagacgcaatgtgtgtatgacatgtgagaccaggtattaatagagtagtatataactattgtatgaatgagctattagattggttatacatgaattggagctagtagttggctatactattaaacttgctcttatggggccaatatattagtgacaattaatgtcacctgactttgaaggttgaggatgctagtttctttaaaacatgcatgtagcatactatctctatccataaatataaatatttctagcgtttaaaatttttccttaaatataaacatttctacagtattatatcattgagtatgatgtttctcaaaatatcaagttttggggcgtatcaagcaatttcacaacaaccttaaatccttaattttcacgtaaaggcttatatttgtggacggatgaagtaactactgtctaaaatcatttaactttataactaatgtttcgagggtaacccaaatagaaacatgctcctataggattttctctttaccggtgttcagtgttgtgcatgcagggctgcatcattagtgcatgcattgtgctaggccaacttttcacatgcctgttaattttaattaactaaaagttgatgactctggttaactcctactagtacctttcagaacaggtaggcacaagatctgctggtgtgtttaattagccaggcatcagctataatggaactttgctttctttcttcctttcctttcctttccatatgcttcatgtgatgcatcgctgtgatgagatgagatgagatggagatggagtgagatatctgaatctggattggttcgtacgcatgatggcaaattttgcaacagggggatgggatcatggacggtgtccacccatgcaatggtgaccatacccatagggcattggaccataagatgcaaaaacggcctctagctagagcgattcacggttggcacgagccatgagatgcttccacgaggtaagaaggttgcgttctagaccgtccgatcgtgatccaacggtatgtaataattcgtttgaaaaatataaggtgttagatttttacagtctccaaccttacacttcgacatagtgtattatcaacaattataaaagtaacatcaaatgaaaatatcttcataaacgaatttaacgctaagtgacgtactagtcaaaattttcatatattgactttttgaaaaacaagaacgcattatattttcaaacggggagagtagcacacgataaccagagaaatgaaacccccttgccattatgcaattaactatatatggactgagactttcagtttatgggcctgagcttgattaggttagttaggaaaaagtacaagaaaagcaattggcattcatgagaataatatgatgttctactattctctgggcatcctgattcctgaagacatgaacagatgaactgccagtaggtacgtgaccctaccccaatcttttccgatccatatatataggtaggttattcagatcaacaatgctgacgagattacgagaaacgtcaaatccaaccaaactgatgtagaaaaaagttaggcgcagcgtgattaaactaatctctagttaaaatgactacatcaactccatcaagaaccttatcatatttgtatagcaagattggctcctttctaagtaatgatcatgagaagtaatgcgtgacatgtagtacattgtagccagttgatgttaacttctgagcagatatctccattccagatttttgaaagaatggacaaatggataaatagggacttgtttagttcctattttttttcccaaaaacatcacatcgaatctttagacacatgcataaagcattaaaatagataaaataaaaaattaattgcatagttttcatgaaaattgcaagacgaatcttatgagcctaattagtccatgattagctataaatgctacagtaacccacatgtactaatgacggattaattaggctttataaattcatctcgcgattttaagcgagttatgaaattagttttttcattcatgtccgaaaaacctttctgacatccagtcaaacatccgatgtgacacccaaaaaattttcttttcgcgatctacggggaatttttgaaatggtgccatgcattcaaacaactcactcaaagcctcccaatagagagcaataagggggaaatttccagaaaataagagtgaacatctcgcatgccccacatgaaacagcgtctacagtctacaacatcaagaaatctagcggtactggaaggtataaaataccccaagcttgtttcctaaacacagcaaatagtttttccatcttctgaaaaatgttagcattcacaagatacagaaataccggtactatgctagagaccagcgagagcattcaacgagatcaggcatcgcaatgtggctttgcccccacaaataaaacggaaatctaacaccaacttggtgccagattatatcagtgtgtgcatatgccttcaatcctgtgaaaataatacaaaagttgtaaggagaagcaattgatatcatgatggcatatgaaataaaagcaaaactatacagcaaatattatcattacctcttcaattggggtgctttcttcattttgcttcttctcatccgccccattttcttggttctgaccatctgtctccatcttttcagtttcctctgaagcatcagccatattagcatctggcttggggattgcaaattcagcaggaatttggccagtgctcagtgcctaatcatcacagtagtgaaaaagaaatgtgagcccatagttagctgttccaaactgtacaaagcgcaggagctaaacgaaaggacatgctaccttttcaagccttgcaacctcctcaagtgtctgagaattcacaatggcagcctgcagatggaataattgttaaaccttgaattttgcaggtagttgtactataccaccatacatagaagatattgacatcaacagagagccatacacatatctaggaatgccaaatgccacactaactacaaacagttagagtttagaattatcaaagttaaaaatcaagagcatactaacaagccagtagaagccatagccacaatcatttttttaatgcagtagctaaataatatagttatttgcacagcttgcaatagtaccttgatagctgtgatttgctcaggtgttggagcaactacttttggaccctgctcctccattgtggtatcttgagcatccaccacctgtccaggagtaaaagttttggctggcaccttctttgcctcttcctctgcctcctttgagtgaaacttctgtgctgctgcaattctctcctacaaaaacaaaagatctcacgcataacttcagaaattaacacaaatacatgcacactagataatattaaaaataacacgtaaactaaaaggcattcatgtatttaattcattgcgacacaaagttaaagagtcgctcttttgccctttttcctgccagcacttctgcagtccattccaaaatcattttggcagtcattccaaaggaaatgaatgaacaacctgtggggaataagtaaactaatcaagcagcaacgcagtttctgcatagatccacatatttcaaaatgcctttgtgaaaaaaatatatgtacaataatataaactatataggcttgcaatgctgtttaattttgaactcctttgaaataatcgtatgctacatacttgcataaataaaacatgcaaccttaatgagtgttatgtcaatacatgcaaaatatcacaatatgtattttatggctccattaaacatttaaaaataagaagcgattaacttatgaaacattgatataaagagagttcacagaagcaccattgcacatagagctaaacgaaaggtgtttactgtttagtgctagaaactaccattagagatcaaatggaagaaaatactgagaaatttaaataaaaataaaccattcaaaatagaagtttttacagaaacttcaagagaacaaaactaagactaaatgattaacaaatttcatacaaaaacatatttacatgaaaaagaacctcagcattgctaacctgttgtttcactttcttgaaatccagcaaccgcaaatgcttcaatttatggatcacatacaaccggtagtctggctgcttggttacagtattatcaagtaagctaagaaactgaagctttggaagagatgccaggggatcgatctccgcaagatttgtaagacgattgtttgtaagcaccaatgtatgtaactttggcaagaactctagaaacaggagcaactgaaggtaagttctggagcaaaattatgaaaatgataaacagatcataacaagataaaatatataatcttaccaccaagattgggattgatacgtgtgattctgttattgttaactaacagagtgccaagacgattcaagtacgggaagttctcaagcttgacaatctcattgtctgacaagtcaattgtgtcaaattggtcctatttgagagcaaagtaacaaaaagaagtgttaaacatgctggagaaagaagataataaaacaaaagctgggtcaaatactgaaatgagaatgagtattttttgggatatcaaatcagatcaaaatgaccatactagttatttaactatcaagtgattgacatgacaaaggaaaaccaagaaacatgtcattcataacaacagaaagtatgccgttaacatactaatgctttgaaattacatgggcacattgtacaactaaaagacagctctatcagcaaaaaacactaaaagacagctctatcagcaaaaaacaatgtgtgggacttatttcctctaaacttccatagaagaaaaacatgcagaacctcaaaaaattgccaaaaagaagagaagtgctaagctacctagcgtcagcatgtacagacaaattttaatgccccaaattttgtaaaattattatgcaaagcacttcaaatcgcagcgttgttaacacatactcaactgagaatatgagttttattccattccagagatcgaaaaagataaaattgaccatactgattatctaactataggtgattgacatgagaaaggaaaaccaagaaatgtgtcactcataacaacaaaaagtatgccgttagcatgctaacgattagaaattctatggacacattgtacatataagatagctctatcagcaaaagaaaaaaaaagttcttccagactcatgtgggacttatttcctctaaacatccatagaatagaaacatgcagagccgacagttatcaagtcctacaaaaagtgacgactggtgctacagttagtcctaaagtctttgagggaacacgacttgagggggcacgactccatgtgctggccgcagaagacgcaatggagttgagacttgagcgaatgcttgggaggcctggtgccttggcctatcaggccctgctgagtgaaagggagattgagagctcattgggtccatcaggcgcagcaagttactagtaacagactagaagtagaagcaatctatgtatgtaataacaacctgatagagtagtcaactcaacgactagtcctcaactatgctccgaccagtctactacccagtagacggtatctcaacccgactttacaacttaacaaccatggcagaacctcaacaaaatgccaaaaagaagagaagggcacactcatatgttagtaatctctcatacctatcgtcagcatgtagagacaaaatgcagtgccccgaattttgtaaaattattttgcaaaacacttcaattgcagctttattaacacaaaattgacgctacgaacttagtagcattatgtactacatttcttgcatcactacctagggcacacccatatctactaatctcccatacgctacatccaagagtaaagcatgttccaccaccaatccaagaacccatcataatacttcaaatgagacaacaatggagctaagggaagaaaaggcttgcggaagctggtggagctcacctcggtggcgcccagattctcgatgatggggatcttgttacctgccaaggaaaagaaacacaacagacaaattaaactaccgagacggagggaatgaaaaaagagggccaagaacactaaaccctagatctagcgagcagggaggaaagagcgcgcaaacctcggatgtcgagctcgcggtccttgacggcgttgaagaagtgcgggctcttccatatcaggtcggcggtgagcctcaccatggcgcggccgggagggcgggcggcggcaacagcttcgggtcagtcgggctacaaactcccccgcggcgcgaggtcgaaaccctagtgatgacgaggaggggaaggaacggcaaggcggccggagccctagcaaacgggaaggcggcgaggggaggaggtggaggagggcggccgcatgctcgctcgggatggcgaggcggcggcagcggcggcaaaggagatgtggaggcggggtgggagagggttcaagggtagggcttttgtggcggtgctttacgatgacaccctcgtagtttttattaattgaagaaagcgtggattttaagcaaaatctgctcgtttgtacggtgagaaacagctgattgttctagaaaaatagggttttcgcttatagtttattttttaattttataactatagcttctcaaaatctgaatgaaatgtagtactgtttatgagagcttctaattctcggagaaagtgcagctggcaaaagctccccaaacatggatcatatagctacgacaacctgacccaatggggacacaagtcaaaaaatgagcaaatgtcgaccacttatatgtgataaaattgtaatatctcgaaatttaactaggtgtatgaaaattcggagggatcatttgaacactaagaaaaaaaatcatttatgcaataatttaattgtattatgtggaaaaaaaataggactccatcggatggctgattgagctaggggcgtttcagccgaagcccatcagatggctgattcgattaagctcattcagccaaacgaagtgagcgcacaatggttgtgtatccaactctggcaacaaatcctatgatccttctagtgctcacagccccacacatggaaacacctaaaaagaaaaaaaaaacacgagcggttggaggtgactaggccaacggcggaggctacaactaaatagccacaaaagatcaccaacactatactggattatgtcaaagaattgcttttcatagagccgttaaaatctccgtatgccagagccgcccagtcaccactcttattagcgatctccaatgtactcttatataagaaaaccccaaagaacgatatactatcaaaagaaaatgagaagatccaaggaagaaggaagaatctgaggtctcaccaacccaattttaaaccatcataccagagtgcattacacaagacatacactcaggagagagtcatgaagcaatagaaacaaattatgctgaggaggtcttctaccatgctccaatcagctcgcaaaccaactttcagtggccgtgtttgttaatgatgcttgcatcaagcatagaaagtcaagctatatcaaattacacccagttcaattttctttgatatccattagagagttagccccgaagaacaaagagatacagaatttgcatataagaataaccaagtaaaaaaaagcataaaaccaagtgatggactgacgacacaagtaaaaccaataatggtgaaactttaaatgaaaagcaaacaacaatgtgagatcttaaaagaaaagccaaatccatcaaaacaatgatcgatgaagacaaaatgaataattaaaagggaaaacagaacaacgagagcaagcaaagaacacgaatgctatttgtcacctgccatcacatgcgtccggtgatgatgacaagaaaggatgagtggtgtggggatctactcccaccgtcccatagaaaacgaatatagaatcgaatatgacacattctagcactttgaatatagatagatatatgtttagattcgtagtactaggatatgtcaaattcggtaatagatttattttttatgggacggagggagtactattttgtggaattgtttgccccctgatgacctattatttatcgtaacaatgagataaactagtaaaatcataaaaaaaatgttccaaaaaaatttagataacatattattaggagtttaggaccacacgaaaaatttatcaacaaccaggactatctagtatttcctttttcatcagaaaaactgatttatatcaattcatatatttttagttttctgtgtggaacccagtgccttcttaaaaaaagtatcactactttttttttattttcaaaaggaccattatgcccctccgcatgcccggagcagttttcccattcagcctttctcccgtccacgcgccatatctctctccccctcaacggcgacggccgccgccctcggatcccggcgagagacaaccttctaccttcctgcccccttctctccccttcgagttccaccccttgcagcgccgctggcccgcccccttccggcctcagatctgtcaggcacggctatgattgacgcgcgggcgatacaaggtcgtgggcgcggcggcggcggcggtggccgcagcggcggcgactcgaagctgtctacgcgagcttgccggaggtcgagattatcttggtcgtgggggacccagcttcagcgcgtcgcggcctccacctaccttccctaagattccctctcgtcttctcctcctacttggtttcttgggaccaagagaaattgtacgccatgctgcaagaattcacctcaagtttgctttgatttcttaatctgattcgccgtccacacacacgatgcgatcagctaggctcggccaccgcccgttttgggattcttttccccttccccgttgtacatattgtgattaattgcccttagttcagagcagtttatttagtatcgatgttgatgcacacgctgtggttagagattgttctgctggcttatacacgagcaacggaggattgggtacgaccaattcagagaattcgttagcttatgtactttcctcttaaccgaaacagcaattgtgcttgtaaattggtggcacggtggtgttgcctagttttatggtcctagacttgtcgatccatcagttgaaaaaatgtagtggaatcttacaagttgctacttgccagaactttgctttattatcgtagacgattaaaggaccataaccttctttagtatacataagtggcggacgtaggattttataaatgggtgtacgataaactaatctacttataaaaaaaataaactatctatttgttatacaatattatctctaaataaatataaagcccaatatatcataaaagttggactagaaataaactaaatcttatttttatctttaaatctcattctaatacatagacatgtaactagtaagactttgtttgcaaatgggatagagataaatattgtccatccattcatcacacctcatttaatcctagccattcatccatttctctttcccaatccctactctcataactcatttgccaacactacaacaaaaacattttgtagaggctcttttgtagagacaattttcaaaatacctctaagttttgaagctctatagtctagagacactttttagaggcatttttaaaatcacctaaaatatttatttttactatagagacactttagagacatttttaagatactttgttaaatttatcttttagagacatcttttcgacactttaaaatttgcctcatacgtaaaggcactttcttaaggcatttaaaataatgtaaagacatttttccaaatattaatatatatcaagtaactagatataagtaacacaaatcacatatttacatttaattatatgaggttgagatggttagtacattgaagataaaaaatgatcaactcaagaggtcatgagttcaaggattggtaagggataatatttttctttctttttcatattgatttgctatatttgccgtaaattctttctttttcatattgatttgctatagtgccgtaaaattcaccaaatggcacttataaaacactcttcaaaatgtctctataacatggtaaaggcatttaaaaatgtctttatagtattaggaaggcattttaaaaatgcatgtaaaggcgttttaaaaagacactcttcaaaatgtctctataacactgtaaagacattttaaaactgtctttatagtattaggaaggcattttaaaaatgtctctatagtattagtaaaatctctctacaaggtatatttgttgtagtgcaaacacatcctaattagaatatcatcactcacttcttgaacaatcctatcttcctatataaagcaaagcatgaaagaagccacatcatggcatgtaagaagccacatcatcaataattctaattcgtagagacaattcaccaaatggcacttatgagacactcttcaaaatgtctctataacactgtaaaggcattttaaaaatgtctctatagtattaggaaaatgtctcaacaatgtatatttgttgtagtgcaaacacattctaattagaatatcatcactcacttcttaaacaatcatatcttcctatataaagcaagtcatgcaagaaaccacgtcatggcatgcaagaagccacatcatcaataattctaagccgttggatcgcattagtacatagttatcagccgttggatcaagaagctactcatctagtcaccttcttttagattataagtaggcgtgacattgttatccattctgtacataatattatgttttctcctcccaagcaatccaagataatgcaaacttatcttctttatttaatatgaaattattatataagatatgaattttgttttgttataaacaattggataacatagagtaattaggcattattaatccaaacttatttttgaaataagcttgagataaagtaaagatgtgcaaactactctaattatgacggcatgtatattgtgcatgaaaataacttacgtatatcataacaatacacaatgacgttttaaaataataaaacatgaattgtattgtaatagcagaggctatatatgaagccacattatcatttattttgtttatatacagagttacatctaattatttaaaacattgattttatttgatgataaaactagcaaatcccgtggcaaggcgcatggtgccaactagtatatatagagcattattatcattggattctcaacaagtgtcgatctctaattcatctataaaaaattatatgattatttatagcattctagattatgtttaataaaaatatctttccacttcttagaaaactagttaggtaccttatataattacaatattattaacaaatatactaattattatttactcatgtaaaaacatagataatatatattacagagcacacacatatgagttagctactagtattcatgtgcaagtactagtgctgattgtagcaatattattataaaaaataaataagaatgagaaagcgagaagaagatggaacaacagaagaatataagattaaaactttagttttacaccgtattaagacgaagaacaattttgttaatattagtatattattgattaatgtgagtatataccataccatgaatgtgagtaactttttcccacgtgtgtttgagctaatgactaaacctcctttttttttcttaccttctttcgaagttctcctaatgtgttcggtaaaaaaatgttttgttttgaataaaataaagaaacattttttgactagattattttttaagagaatccactatgtgccgcttactttgtccttgtactataatatggcactgagtttgttaagttatacaatatgccatcgtattttgcttaacctctataatatacgtcaccgtccatttagacttcgttagtactgtataattttgttctaatgaccgaaatatccccgggacagaaattccaaaatttggctgaatattctgaaatatcatattataaacaaggcagagaagatattcatctcaaactttggaagttttacaatctgatatttggaatttttcgtcccatggctatttcggtcattatgataaaattatataatactaacagatgctaagtagacaacgatggtatgttatagaagttaaacaaagtgcgatggcatattagaacttgacaaacctagtgacatattatagaataaggacaaaatcaataacacacgatggattctctatatattttaggaaaaattagaaccatgccattataattttgcaaaatctgatatatgtcatcctgacccacatgtcattgactcatgtgggtcctacatgtcattgagataccgatggcatatctcaaattttgaaaaattataatggcatggttccaaattaccctatattttatggttgtttagttcattacctatctactatcgtgcaacatttttataaaaagttaaatcttatgctataagttcatatcatacacattaaattacatacacttataatataattttcaaattatacaatgccatcttcacattttataggagaaatatgaaaaatgatttattatctatttaattatgagaaaaagtattagtccaaattaatgtatatgtagaaaaaaataatatgaaagaattacggaaatacctacaatcgtatatcatgcagtaagaaaaggagaccacaatcgaatcccttattgttgagcaaaattgatggcattaattttatctttttttagctaaatctatctgactataattaatcagcccgtgttagtagaagtctgcatcttcatgcatcaatatatcataactcataactcataagactattagtaatagccaagtacactgacccaacaatacttaatatatcacaagactatcgggtaatggacaactcatctttgattgtatatcacaggagtatcggataacagacaactcatctttaattgtgctaaagaaaaaaaagtaaattatagttcgtactatgtattcttaaatgttttcatattatgtcagcctttaaccattcttttcatttacagaacaactaactttacatttcaatttggaccaacctatttcatccatctccaagtccaatgactctataaccacacactaactctctctttctctccattttattttcccccgatagttggggaaccgctagatccagcaagaaggagcctggatctagcgtctccactcttcatcgggtcgactcctgcctccgtgagtcgctacaatagtatgcatgacaagagggagaggaaaaaaagatggctcatggagtgcaactagagggtgcagttgcgcatgcaaagacagagaggagaaacgatggtggctcataaagaaagagtggtggtggcggtgcgtggagtaatagttagtggttactggtagtatgaagagtttgttgtcgactcaaatcgctaactgagtttgttaatttttagaatgtggaccactagtcattataaagaaatagtcattataaagaaatagctagtcttataaagtagtaaaatattgagatatcataaaggtgagagtactcgtctagagcttttaactttttaccatttttaaaatatggtaattaagaatttactactcacaatctataatacgtggatccttatgtgtatatgacacgagaatgctccttctcggtcgcgcgaggggaggggaaaaaatcggtcgctccacccttcccccatcacgtgcgcaccagcaatctctttgggcccccaccacatgtcccctgtccccacctgccacttgtccacacacacaactctattgcaacaaatcacccacatattttgaaaaccctatattaagggaatttggtttactttttgttccaccaaaaaagtttcacgtagtgtactcataatgtttcactatgtatagatctaatgttgcagtgaactaaaatattccattgcaacaaaaaaacccacatattttggaaaccccctattaagggaatttgatttattctttgttccaccgaaaaatgtttcacctagtgtacttataatgtttcactatatatggatcaaaagttgcagtgaactgaaacattctttcactatttgctgaaacattgtttttatataaggtaaaacaacacccaattgaaacgagtgaaatattttcgatctacttagtaaaacaattccgatatacctggtggaacatcgtgcaacatttaaaaataattcaataataaggtaaattttttttcgtcgaaatatatgcctgtgtggccttgttttgaagatttaattgcagcgaatttaatgatgcaatcggattatgatatggataagtaatttaagagaaaaatcagtttaaaatagtttttcacgtaaagcgtccgatttttctccaaaccgatcagacgcacgatccgtagactcgtccgtccgtatatacatgtgggaccagcggtaaattcttaataattcccaatagtaagagtctgagcgtcttccccttccctttgtggcgtaaaagaaagaaaagaaaatctcccgtctctttgtctcctccgctccttgcgccgccgagacgagtcgcggctgaacaggggaggggcggcgatctccatcggggcgagcagagcaggggagaggattcatggtgagcatccgcatcctctttctgattcatctctctctctcccatcgggactacttttgtctggaatttgcttgcgttcgttcgttcgttcgttaaccctagcttctcttctagatctggaagaagctcttcccttaatttcagagccttaaccttaatacaagtaacagtttgtttattccccgagaagtttgaacccccatgtcccaagttggatccgctcctgtacataatattggcagcttgtggcactcttgaatggaggtcttggaagatactttagtacctgttctattagattggtgtgttataggccctgtgtggaatacaagaattttgctcggttttcacctttaattttccttgtatttccaccttgttttgttagatcgctgttgctcacttgcttgcaatgtaccgttatctgaacatcatatgctttttttctacttgtggacaggtttatcactctagctttgttgatgacaccgggattaccaaagcatgcggctgtcctttgcttccactaaaaactcatataaggggcccagcgccagcattcgatcaaggtatactgacacggtgacaacataaaatacattgtgatatacttccgtggtttcactctgacagaaccatgccaagctgctgatttatgtcgtgctattacagacaaggctgacattgttgatgaagcaattacattcttccgagcaaatgtcttcttcaaaaacttcaatgtgaaaagcccagcagacaagttactgatctatctgacattttacatcaatattgccctgaaaaggctggaaggttgccgaacactggctgttgggacaaaggcaatcattaatctgggtttggagaaagttcctgtgcctggggaaccagggtttcccttccctggtcttttcactctaccccaatctcaggaggaagcaggtatatgacttcatccgccactaccacatttgtgtgcttgtattctcttttactccctccgggttgataatacttgtcgttttggacaagagcacgctttccaaaaaacaactttggccattatttttaattataatatgtataaaggtgttaacaaatatatgattttattaaagtactttttaagactaatctatacatgtagtcaccatattttaaaaatgattcataatcaaagattctaaaatttgacctcacccttgtctaaaacgataagtattatcagtccgaagggagtagtttctcaactgtgtgaaatcattgttgctttttattcctagagaaaagcttgccttatttctcgaatagttagtttttcttcttttcccccaattgtttatccatgctgcttttcttctataccatactatttgtcctggctagggaaaaaacaaaagaatgaagcctattggaaatttagcttttgtgagattacaaggggacctttccaaactacagcaatttatgtcttagatacttttattttggatttaactaaatctgtagtgaactccttatttgatgtcctgtatatatgttttttttttgtcaatttctatggtctaaactataagtctgctctgggtatagaagcaataagttgcttactgactattgacaactgtttttaggaacatccaagttgtaattgcatcagttttttttttacttctagggactaaataaaacagtaactttccatctctcatggaatgtgatctcaattaagcatttctctgttggattcagaactattgaggaattatctgaagcagataagggaggaaacaagtggaaggttgcttaactgcgcatacagagctaatggtactccaaacaaatggtggttggcttttgcaaagaggaaattcatgaacattgtcattctttgaagtataggtattttccgcgacatgtttgagcaattgagcagcttgtaggaatggtaattgcacttgcgtacttatttctgcgaatactttagagaattaaaggaacgacaatgattctacacctcgattgatggagccaaaggttctaatgaaacaatggatagaatgtcaacaatttgtttattgcaatggatgaacacaaggacacctttcagctgttatgttgaatttctatttttcatttttattgtactccgtccgtgcccttaaattgggcatgtatttttcagatgatgtttgaatagcgaatgttccgtgtaggacatttgtacagatttaatcaggtgtaatgagaatgtgaatatatattttcctgatccctcttttttgtatcattcgtgttaatcctttatctgtttttttttcaatatgattataagatatggagaaacctggacgtgcgcttccctgatcttgccaaacgttgggagtaaactgctgcttataaacacctcaagtgtgaattggcatggttaatttcattattcgatgaagcattctttgatacaaggtgcttataaacgatttgaatgcaaagcccattgcatcactgagacctgaggtgatattcaagctctatggcttgtcagtcaccatgtcattcgacacaaaggatatctaatgccaggtgttcatacatagattcagaaaaacaaaatatcattcgacacaaaggatatctaatgccaggtattcatacataggttcagaaaagcattattgaccaccaacgcaacgcccaacagaactgttacattgtgtaaatcctcttcgacaaaaaaaaaagaaaaaagaaaaaaaaaggagagagagagagagagagagagagagagagagagagagagatctcaacctgatcacagagttaaatcccatgacataaggacatcagaagactaaaatgtcgtttttagcgtgtttttaccatctaaaagttccatcatcctggcatgagcaaatccaacgtgttgcttcagcaatcttcatcagagtataataaactggctaattcaacaaccatctccgggtcttcctttctacatgtttgcccagcatagtaaataatatgttggtgttcaaaaacagctaggtttggaaattagcccagttacaagctttccagatagcattgcacaaagattctcaccagtaaatagccagttagttatggttctgcaaataaggcagaaaagggggctttacatgtgacacaaaaaacaggttcagtccatgcatttcttaccatattacatatatgaagatagctggctaaaagtaagacgaagcatgatatggttgaaagcatcaaattacttccacaaacactacacaggataagaagaggaaacctctttattgtttttaaacccagaccaaattttgcagcacacctcagatgaacatgtttccaaacctcccaggcaccttctcaaatgtgtggtcctgagatatttagtattagcatgaaataggtaccgtaatttttgttgggaatccatgctataattttctaaagaatgatgattatataagctaataaaaaggaacttgctcaaaaaccaagtaactaacaagagatattacccattgaatggatgagataatcaatcaaagtatcaaactaacgatgttgcaaagagcatgtatgataaaattgtcaggccatcacagttggtatgtgtcacacaatctcattggttgaatttgatttgaaaagttaaatttgtttgaaatggtaggcttgtagagatatggccaaagatatccacagctttcaatggaagttatctttagtccccagtcctctacaacacatctatctaccaaggattgtacaatggagataactggcaataagaagggctaccactcagcatacagatattagtctaaatcatttggacaaaattccgctgctaaagcaaattcattggttctagcacaaggccaaggctatggcatacagcatgtgatggagttctgtcagatgctatcgcataccttcatgttcaagagccgagcaaagaaaacatatgtgcaaggaataaaacaccatagtgatctgttaagactttaagaacaaaaaggaaaagaagccagtgccagtaggtttgggaattagcaatttatgattttgagtcacatgcagtaaagtacccacatcctaagtgactaagacactggacgaaaattaactcagagtctatgtatagaaacagttgttgaccacgctacaacatgggtatgatgctatttgtctgattttccaaatttaaacttgtcagtttcctatgctgctatgaagtgattattgaatctccaaatccaaagttggtcttgtttataaggatgtagaaataattccagaggtttttgaagatccatggaagaaataccatgcgtgcattctactatatgacccaaaacggcagctacatactcaaagacattggaagatcaaagcagggtttattccaaatatctttgaagatcaaagcagggtttattccaaatagcagtgcagttcacgtctgccagggatagccatagcattgctggcagatcctcctagagccatcagcctccatgccagagaactcatgctgtgattctcacagagcaatatagtacatgctacataagaaaaatattccatttgttatttaccttatgtccacactcttctttggccacaatcttttccttgttttgttttctaacttaccaggcatttatacataattacctatagcagagtcatagacacagacaagatatgcatatatacttctaaatcagcaagtgctatttagacttcatttacctttctaaaaaaatgaaccatataaaaataatgctcactattatcatctgattaaaaaaggtctagcttttttccacatatattattccctttagttctattggtagtgcaagtttgtaaaaataaatatcaataacaacacaaaatgataagttttcaaatcgagtcaatgtacatgcaactaactggtggaccacatgaatcatattctttatcatgtgaaaatgtccatgtatattatgctttgctatatggaacatccttgtggatattcttcctcatttcatgccctttcaaaactctggagaaacctgatacacaacttattctttggagaagtaccaaaagatgtgcggatcaagcagctcttgggcatcgaaaagccgcataacacttacgagatcaaatcgttagtgcaacattgaccggaacatgcttaccaacaaagtcaaagatttcagtttgcacaaccactgaacttctttgtcttagtgttctctccttccagaaggtctcgcatggctttacagttcctaaagaaaagtagcataactgattaataagcagaactgtccataaaacaaccaaatataagttcatcactgtaattatgatcacaaacatcttaaaatatgcttcataagtatgtctagtagtgtttcagtgaagaataacactttgtagaaacatgactcacttttcatcttgggctcttagctaattcattactatcagcatccctcttctgcccatgattgattcatcaaccagaactgttttgacacggctcagagtgctcccttttcatccagtgctagtcacgtagtgccccatatgaacctggctcagttggtatgccagttttaattgggatcactattaatatacagaaccataaaggttttaagtcatgtacacttcacccacctgcatatgtttggagctaattctactcttgaaggtgtaagcatacatttaaagcagatggagaaggcagtgcaaagattttaaattaacttgctgtattctgaactgctgggttacaatttcctattgtacttgtatgacaaaaatggcactttaatttgtactctgactcatttcaaatctaaggtttgtttttccaaacacatcctaggtggcataaacaaaatataaagtggaaaacgtccataaaacgaataaaacacacacacacacacacacacacacacagagagagagagagagagagagagagagagatttcttagattttgaatcattgctcatggccaaaccacatcaaagattgattgtaaagtttggaccttcggtggtggggtgtgtgggtgtgtgtgtgtgggtgtgggtgtgtgttggggctatggggggatgtggaaaaaatgagccaatttttaatacacctaacaacggtatgatgtttttactactgttgaaaatacaagttatatttatgttccatttcataactaacaagttctctttcatgtcactgcttgataatatcataataacattgtttcagatttcggcagtgatttgatctgatcaaaaccatatggcgagctcctcaggctgcatgtacaaagtattactttataaaagttgtcctttgctgtgaaagaatcagatgcagtaacggattcttcatatacagcttcaagagcacccagggggaagatccataagaatgtcccagaacagagcataatatcaggctatcagcaggatccacgaaatggaaaagaatatgatccagacatggcccatcgaattcaagctcatgttcaagactggttcccttttgtattagcaacagaaaccagaagggtacgggggtcagtcagttataagatgcaaacgcaaaagtgacagtttattagctgctcaagcattgtcagcttaggtagcatattccaaggcatatccagattttactcagtgatctttgtgctatatatacctgagttcaacaattaaaatacagagcaaggaaaatattggaagcaaagaatgacgagaggagcagtaatgggcagattgaataaattgtcagggtgagaatcacagtgcagttctcctctggcatggagggcaagaggagctgaatagctaatggatgataaactgctagcctttccctgccaaaggagagctgccctgccattcagtgaccctgaattcagcatgcgagcttcaagctgtgtgttctgttttcagtagaatgttgtgaagcacactgcatgaggtatgtgatcatgactctgtttttcatattctttgagcatcatccatgggtgaggccataacaacctcctgttttaatagtttatagttcatgaaactaatagttaaagagttaaggccttgagggtgtactacaaatggaaagatctagcaacaactctaagcgacacattcacataacatatccacagttaaagaaggtatcatgagtgtcaaatgacaattaagagaaaaatcactatatttaataataaaaacccaaagaaaagtaacaaaaatacatggatttaataagatatgaagtacctagatagggatgtatccgaggatttgaactggggttgtcagaccaagttggtggcatgcagccttgcaacagcaacggctatattcataaaaaaaaacagaagatgatggtaacaaaggttgttctacttcttcaccacagcatgccaccttgaagagcatcctgtccaccatcgaacctgccactgtttatagttagaactcatttatagttccatagctaacccagtcgctaatccaaatcaagcaccatagatatttggcatgttctaattaaccttcctatccaaacagtgggagcaatcatttgaaaatgtgaaccatccagtttcttgccaatcctatttaagttagacagaaaccctcatatacttaccctcaatattaagagcttcactaatcggattctccattaccacagaaaattagaattttggtacctaaattttccaattaatgaaatcatttgaaaataaaaacttaatagtggtacagcatttagcatgaggtagagcaagatttaagacatggaccaagctgtcacaagcaacagcattgctcagaaaaatgctctagaaaatcaacaaagctatcatgcatcatgatttcctaaaggattgcaattttattacttatagcaatgctactcgaaaatacaagcttcgatctaaattctatatgttagatttaaaataactcagtcttaatatgctacattatgcccgtcccagtgacagtccttatttttcttttaaaaatgtgctattatttagaaaaattctattatttagatctaacatattttaaaataactccgagctgtggccgttcagtggctgcagtgcttatttttcttttttgttataactatatttgttcagctctaatcttgtttaatttagtctaataataggaccttcccctagtatcttagtctaataataaggatccctccctccctccctccccctctctctctctctcttgatttggaggtgaatgattaatgtttatgcatgatactaataattattgttttttgcctgctctgctttttcttcttttcttagcaaaggttctcctgcttgctagctaggtggtaatagtcatggccggggacagagtcaaggccagggggagtataaatgtgcatctgtggttccacctagttctgtgactactgcagctaaactcttctttcatgatgcacgtaagagggtcaaagaacttgattttgggaacctgctcaatataaagctggagaaactgacaagtagagagcttgctgcacggctaacagatcaagctgaaattcaaacaaatcaagaccaaactgaactcaacaacaagcctggagagtcgctatgcatcacggtagaagtagtgcatctaattcttaccatgcggcgtggctctgttcaggagctcacgtcactgcctacaaatgaggcatcaaaagcattcatctcgatatacagtgtgttgaaggtcagggatgacaagttctcaaaagtaaaacccattgggatgctccttttgatgattgacactaaggtacttggtgttgtcatgtgttgtagttaacatttgtttgttcatggaattggcgcaaagtatcaaaggtgttcaaaaagagaaatagaaagagtacactaagtaacatacctaacaactggaaagaaaacattaatgaggaaaatatataatcgatgcagcaaatacgaagtaaatgatacacattgttgaaaaaatgagtttgcaatatttgacactggcacgtaaggaacacagcagaacagaaaattatgaaaatagctttctattttctaatatatagagagaaatgaagatttgtgggacaaccaggtaaaagtctaatttatagagagatgaagatttgtgggccaagcaggtaaaagtctgaaaaataatgatttagatgattgatacataatggcaactaagtggcatagctactatgcaagactgcagtccacataactactatggccattcctatatgcataaatctcattacaaaatgatcatgaaagatctatttgattcctaactaaacatatacttgcacataaagttagggccttgggggagacaaatagcatttgaaaaactagttaactacagcgcgtgaaggcaatgactacctgacatcgtgaaatgacacaatagtaccacaagggacaactaagccaccagaaaagaggtagaaaaaataccacaaaaaatttagtcaagcagttaaagcctaaagatgttatttggctgtcaatacaaaaggggcaagaacaacaaaaagcatctacaaacccaaaatacatggagagtcatccaacttgtttagatgtgtcatataggtcactctactttcaaaatgcacatttgagccatctaactatccacgtgagcacaccttgtacacctagcgtgccacataggattaaaaaaattggctgggtatccgcagccgctgtctcctaggattgcgcctccatctctgtttaagcttgtcgttgctgccacctaggattttgcctccattgctatttacattcatagcttgtcgccgcagccgccgtcaccatgtttgatggcaagcaagataaaggactgagaactagaagaactcatcaaaacaagcataagtgaaatgatttggtttccctaatttcgtgtatctccaagtgctagggttgtgagaaaggaaaaaaaaatacacatgcggttttctgcacatgtccgagagcatttttttcaattataggtggcatgccatgtgtacaaggtatgctcatgtggatagttagatgggcaaatgacttgcttaattcacattagtgacctatatgtgtattttgaaagtgaagtgacctacatgacacacctaaacaagttaggtgaccctccatgcattttactcatatatctagtactacccaccaaagaaatactgttaggcatttgcataagttatttttcatgacagaagtgtaagaactagaatccctggtttattttccaccgtaaatgacaaaagaaatgccgacataaatacattgtcggtggagtctaggagcaatatgccgaataacaggtacagcaaaggaaatacggaaccgaccggcatccaacattctataggattcaaatggtcaatatatccatcagtaaattcagtgtatcaaatgatttcagaacaacctttgtcaactaggtatttgttttatgcatctgaaaaaaaaacagtattagagaatggataaatcataccccgatgattgtcactgagagccttcaacttcatgtccaaagctcccatcatcacaaaccaaaggaagccaggccatacatatacggtctcctgaaatctctcctgaaacagtctctcaagcttcatgttctccaggcaaagtgagaagaattaagtagggggcatggccatcaggggagacctccactgttgccaagtacacataaccagccctaactcacacaactctcatgcccttgtaactgagatatgggtgtcaaagagaatatcttctgtgatgcccatctcgcaattccgttcctgacgactctagggatccagatgaggatgaggaagtctattgcatacacaatgcaaagccctcaatccttagtctccccagccataaaactgcaacccctgtgtcattaattcccatggtaattccaccctggagaattccatggccacggtgttcagcgtcattcaccatcgtaaggccagtaaatcgagccatccactagcacgccagcattgcctcatgttgctgtctccagcaaactcaacccatggatggcgatatggatgatccaattccaatcccatgggtctcggaggacgaaaagaccgcaagcacaaagcctgaattcatccctgtaaaccggaacagcgcggaagctccatgctcttcctgttccagctcgatgccaccgagcaacagcggggatgaagtacacgtcccagatcaaaggggtttaggatggcgagcctcctgtgggttcagcaggaggaggtcgccacgccacggcatgccaaccgtgggaggcgtagtcctccagctcgtggctccacggagggcgacggcggcggcggccgaagtccggggtgccggggaggatggtgaggccgccgtggtcggtgaagagcccgagggggcagggtccgggtgggtggagcaggcggcggaaccccggcgaaaagccgggcggcgcgggagcccacgagctgcaggcgaggaccgcgcggacgagagggcatggagggacgggagggcgaggaggatgtcgtcgttgagggaggcttacggtggtgctggtgctggtgctggggttcggttcggctccacggaggcggcgccgcccattgctcgaatcggaatggattgcgggggtgtgagcgcctgaacgagtggatggacggttgttgggttgtgtacaacggtatccattctctgtattagaaaaaaaagaagaagaaggtcaatcctagtcaaggtttgtaaggaatgtgtttttatggaaactccgttcgtaggactaccttgcatgacgccgttaatttttgtgtttgacgtttgaccattcgtcttatgtaaaaaatttatataattatcatttattttaatgtgacttgattcattaaatgttctttaagcatggcataaatatttttatatttacacaaaaattttgaataaaacaaatggtcaaacgttagtcgaaaagtcaacggtgtcatacattaaaatacggatggagtattgtcgacatttgatgtcgcgattccggtatttgcatagtatggggatcgttggtactaagatatacgcgagactgaggtaaaagagatggagacgatgatttttatacaggttcgggcccctgaattatcaggtaataaccctacatcctattggccgaagccggtcattgatcttattcatcataatcacaccagtacaatatttggggtagcctatctaactgttgtcaacgtggcggtctaaagatctgactcgtagtcgacaacagggtagccttcctcctcaaatctgcatccggcgagatcagagatagcgctagattcctctctttggttcccgtaggtaccatatcgggttttcctaggcttatgtctgatgtcgatatctagcagcttgtcttggcctatgtaggcttgtattggcttgtggctttgtggcgtctatgttgtccgtgtctgttggttgtgtctcctcttctcctagggggccttgtatttatacccataggtgtccccttgtccaagtagaactagggaaaccagtatggatacaatccgagtagtccttgtcgtttccatgtagaactctagtcattcttccttatgcggaactcctcctatatccgaaggttgtttccgtataagacatggtatgtggtgggtcctgccgagatttagtcgactactattaggtatgtggtatccataacactgacagtagcccctgacttcaatgcaaatgaacaaattcatattctcaaccgcagaccctggagtaactgttatcgagttcacgtgaccgttctcggtgagttcagagataacgttagacttcccttatcagcctcgtgcgggcacctatagggtttgtctgagtcaatctccggcgtcaaccaagaaaatacagagcatacgactaagtctcccgtcttgctataatcgagaatttggatggaagtcaagaaattttatctcggcgggtacaccatgtacaccatttcttcattccgtattccttgtcgagatccaccaaccgttctcgagtggtcgagaaggcacagagcttgcgacgaagccttgtcaacatctgttgtactcgccttagtcgatcttagtgtagaaccatagagacatggagttttcaacaatgtcgaatagaatttccttaaatcaatactcagaaaaggatattagatagaaatagcccccgagcaaacgctcaaagggtgacatgttataatgtgcatggaaaactgaaaatgaattaaatttacagaccaatgttttgtgtatgagcgtcttctcttttaccgacttcgatcagtcagtttgttgagtcatacactctccctaacccccagccttttcatcggagaatcgttctcggaggataagtctcttggacccttgacctgccttggttgaaaaagcgctgaccctagcccccagtcgtgaagttggaaaactcaatttccgattacacggcttggttaatacgcacggcgagaactcttacatgaccagatcttacatggccgtttgtctctataggatccgacaaggccttatccgctctgggcgtccctagccaaagttcccttaggtttctcagaggccttgtcaggacggcgtaaagggacatgaggataggtttcaactctaggtgtcgtcgtggtaagggatctctgggtaaaacacttggcgatattgtgtacctgatatcaactttgttggagtagaggtagtgggagaatcgttatacctctggtcgaggaccaggtagtagtcgtaactcgaccacttgaagtagaaatagtgggagaatcgctacaccgctggtcgaggaccaggtagtagtcataacttgaccacttgaagtagaaatagtgggagaatcgctacactgctggttgaggaccaggtagtagtcgtaactcgaccactagaagtaaatgtacgagagatcgctacgattgactggttgagaaccagtgagtaggtgtctctcgaccatttggagttgtgatacgaggaccgctacgttgccggttgaagaccagtcgtagatgttcctcaaccatctgaagtcatctgaattcgtggtgcgaggaccgctacgctattaccgtagttgtacctcgaccatctaaagttaaagcgcgagagattgctacaatttactggttcaaaaagcagcgagtagaattatctctcgaacgccaacggaggttgtagtgcgagagattgctacggtttactggttcgagaaccagcgagcgagtagaattatctctcgaacaccaatggtagttgcggtgtgagagattgctacggtttactggttcgagaaccagcgagcgagtagaattatctctcgaacaccaatggaagttgcggtgcgagagattgctactgtttactggttcgagaaccagtgagcgagtaaaattatctctcgaacaccaatgggagttgcggtgcgagagattgctacggtttactggttcgagaaccagcgagcgagtagaattatctctcgaacaccaatggaggcgctagagttggtttattacatgtgcatctcatgtgggcagcatgactcacatacccaactcgtagcatatccggatgtccgcctgcgatcatttcgggtgatcaagccgacatcgtttgcgagcaattatccgttaacaacccttttctcaaatagcctagccaaagccggcgctatgagataggtcgtcggtcttcgttggtaggttgggtgcgacagctctgcatttgccgagaacgttctcgataatgtatgtgcttgaccacaacctactcgagtgctcacttattcctgaaaaatattttctagaaggcaagatatatagcagagaatatcgagtatatactcaaaaaactgcatggatcttctagtattatcagaatataacgagcagatgtaaacatcatgcattatgtaaaccataaagaagcatgatttatacagaagaaaatagagcgagcccccagcgttagactgtagtcagcctaacaccggaaacactcgcataatagatattgtataaaagacatgctctaggtaaacataataaattatagatctgacaatactgtatgatctgaataggtatgataaattacatataaaatattgcgtacctttgtagatacatgccggatgtatctatgaaattagtagattaatttaaaaaaccaatctaccaattaacttgtcgcgtactcgttcgacatcatatgatctgacgtcttttggtacgccgcttatcttgaggcctggtcgatctcgagagatcaagttgttgatgatgatggttccgatctcgtcgggagacatactccggtcgggttggatctccccacagcgaagtcgtcgagtagcttgttgtcggagaatctatctcttgaacccatctcgtcgaaatcctgaagcaccaaaatcaccctacctggcgcgccactatcgacgtttgatgtcgcgattctggtatttgcatagtatgaggattgttggtactaagatatacgtgagactgaggtaaaagagatagagacgaggatttttatacaggttcgggcccctgaattatcaggtaataaccctacatcctgttggccgaagccggtcgttgatcttattcatcataatcacaccagtacaatatttggggtagcctatctaactgttgtcgacgtggcggcctgaagatctgactcgtagtcgacaacagggtagccttcctcctcaaatccgcatccagcgagatcagagatagcgctagattcctctctttggttcccgtaggtaccatatcgggttttcctaggcttatctctgatgtcgatatctagcagcttgtcttggcctatgtaggcttgtattggcttgtggctttgtggcgtctatgttgtccgtgtctgttggttgtgtcccctcttcttctagggggccttgtatttatacctatagatgtccctttgtccaagtagaactagggaaaccagtatggatacaatccgagtagtccttgtcatttccatgtagaactctagtcattcttccttatgcggaactcctcctatatccgaaggttgtttccgtataagacatggtatgtggtgggtcctgccgagatttagtcgactactattaggtatgtggtattcataaccctgacaagtataatataagagattttgattttttttacttgcactatttgatcattcgtcttattcaaaaatttttggaattattatttattttatttgtgacttactccctccgtcccataatataagggattttaagtttttgcttgtaacgtttgatcactcgtcttattcaaatttttttaaaatt

SEQ ID NO: 80696 - DNA, 647 bp, Oryza sativa
tttttagtgtgaattgtgaaaccatgctcatatgtatcgatgttgaatagacattgaggtttatgaaaataaaatattactccctccgttttatattataagactttctagcattgtccacatttatatagatgttaatgaatttacacacacatatatgtcttgttttggttgatggtccactggagtcaaaccccggtcgcccagactgtcctttcccttttgaaagaatgggatttcatatccggggactctttatctttattttttaataaagtcttcagtcttaaaaaaagagagaaatgtgtgctatgcggttggtctactaatattgatacatgcaattttacattatgtactgtacattaactttttttactgcatgaagtactcatattggacagtaggggaggctgagcaaggagatggtacggaagcagaggctcggctggcgtggccacccgcaccgggtgctgcaccctgtacatcgtcctcacgcagccggtgatgagcgggtgggtacgaggggcgccaggccgggcgacggttatccttccccgaacctcagcgagagatggtcggctggggctgcctgcccgtcaaggcgccgcgcagcgtaccggagtggacagcgcgcgcgccgttgg

SEQ ID NO: 80697 - DNA, 2656 bp, Oryza sativa
tggaatagaaatgctaattgagaactttgcatgcaccacatagtacagcaactactcaagccaagttctatttactagtgaagccatttccaacttatatcaatccatttattagaaatatgcatgtacattgtgtgtttactgagtttttacttgtagaatgtaccatcctagtataattattttaaataaaactcccttagttgatctctgcaaattaggtggctagctgtccttgcagtgagttgtcgtagtacaaatttgaaacagtcttcgggcttcagattttccatctacattaattatgaaaatgtcacctacatacatctcaattctaatataagttaacatttgcaagtgggagccaattaaactgtacttcagcacttatcttctttttatttatttactagctatgatttgcgacctgtgggtgagcaatcaacttcttgctgaagtgtcagagaagggtacctgaaggaacagaagatcaacactaacttaaaggctcatacatcatgtaagctaaaatcagtttgttcccatagtttgtgagataaattgcaatccttgctgcttgtaaattgtaatgaaatctgtacgattgcaattatactgcttcaacataaatttctcataaaatggacctggtaatttaatattggtggattgtgagaatatcgaagctatgctacagattgaattaaatggaactacatcagttatgttattgacacttatcctgcacatttgacactgatcttcaattctgtattgaaatagtaggtgttgcatagattacttatcattgaatggagtattattataatctatatatctgacccttaatacttttgtctttctgataatctgattcaagtttttagatgctcaacttatcatggcggtcacaagatattttggagtggcatttctcttcaagggaaatgccttgcctgttgtagatttgccatcgttttgtctcattttgtagattgtataggagaatttctctttttgtacaactaacctatgtacatggcatttgtaattaaatggaattggtatattcagtactagtggaatgtggatgcatgagaactgttggtggtatattcaattctagatcagtaggatttgattccatgaactatattttttttaacccaatgcagggcacactaacagaatatctgtcagaaaaactgatatatgcaaactgcgtatctgtcagtaatccgttaactgtcggtaaaggaccatctgtcggtaacttccgtctgtcggtaattcatttgtaggactgtcgagttatctgtcagcaaacatttatctgttggaaaagacctttgccggcagcacttggcctgacagaccctatctgtcgggaaaagttatgctgacaaataatttgacagcatataggtcctttcctgacagatatgtagtaagcaaacttggggcatggtgtagtgtcggggaacatattttgctaaatttttctatattcaagagtaatagcctaatgggtgttgccatttgttcaatctctcaaatagtatttgggtccacatgtatgtgagataattcggtggcatgtgtgaataagaagatgaatgcaaaatacgatgcatgccacaagttattagtggtaaaaacattttttcccttgtctttcatttacatgtttaagtgttacatgcacaaggttttggggttgatacttgacacctatagcccgtttctttcttaattagtttgtttattctacttttggaatgaaagatgatatgctttgaataaattgggggaagctctaatcttcttgtgctagtaggaaaacataactatacttcttgtaaaaatattcttccatttaaataagagaaatttatagttggagttatgaattatagggacagaaataaatttaaaataatagtggtggtagtggtgaatctcctgccatgccaccacctctgctactattctttctacagaattctccctaagcatgcattttcatattatttataggtgttttacgccattcccttcttatttcgtttattagaaccacaatgtaacaagaaaaaaaatctaagatgttccaagtattgtgtatatgtggaattactctatggaaaaaagagcgaacaatagatttgatgcaaaactagatgcagcggctaaaagatatacatttggttattgatgaaaatataggcacttatattcttgagatcttgggcataatactaaaattatattgtttatacatgggaatatttcatcaacggctataaaaaaattgtgtcgcataattagatatttttgttggcattggtcacactacttcataaaaaaatataaatttttcattacttcaatgtttcttcaacatcgatacatatgaggacagtttcacaccaaagaaaagaaatcacataactcggaaatcaaactctaccaaaaattggctatatacatacccttgaggggtgagacagcacgacaacgccctcaggagggggaatgaaccatcgttgtcggtccggccaaggcccgactgagtttttacccgccgctcaccacctgcaaatccacggctgacgcaccaatgctctaccaccacacaagctctgccgacatgtgg

SEQ ID NO: 80698 - DNA, 3256 bp, Oryza sativa
catctcttgtgctgtctccttgtcatccattacaaatcttccaagccttccttccaataattcaatcttggcctcacgaacggcgggacatccctcatgagccaattgcaaagtatcccatatctccttggcctcctctagtcatcaaccttgttgaactcctccggattcaaggcggagagaattgcattggaagcttgagcattgcggtagatgagttgttcttgctccgaagtgagctccatgtcatcatggggtatacaatacctgtacaaacaattttccaaatacttggatgcaaagagattagatgcaacttcatcttgtgcttccaagcggcataatatgtcccatcaaattgaggagcacgcctagaaggcatggagacgaagttgtgagagggaatagtaagtttgctgtaatcaaaaggtatagtagctcccttgggtggtggagttcccttgctgcttgcttcatcttcatttccattttccccgttctttccccctaagtctgacatcgtggatcactcaaagcggtgaagcttgaatcaagagcaccttgctctgataccaattgaatgatcagagatgtagcctagagggggggtgaataggctttcctgaaattttctcaacaatcgtagcggttaaattgacagggcccggaacctcctggtgatgaacaccggaacttccgggcaggatgagtagcctggaacttccggagttcttgagccaggaacttccgggcagcagagataaattaaaacagagatgaaaaacaggtcctagcaagagaagtttaggcacacagaggaacaagatgaagattgcagaatatcagcagattcacacaaagatcatgcacaagagagacaaagacgattttttcccgaagttcggatcacatgaatcctactctctgttgaggtgctccaaagaagccgggtctcgattaaccccttgcctcacttatgcaaagatcccagaagaggtccacaaccttgaactcaacacttttaagtcattttctagaattgagtgaccaccaagatccaactcaaaatttcttctacaaaaaaccacaagtgcaagttgctctacctaagacaacctctgaaaactcagcacaagaatctttactcacttacacttgttacttgcggaggtgaggaaaaccttcacaaacttttccgggacatccacaagatctttagaagctcacgggcgacacctaaccgtctagaagaagatctccaagagtaataggcccaagtgacaacccacaaggtatccaaagtgctcaatcagacttaatcttcaagccatctccaaaacactcctactctctcatctaatctctcaatctcacaagataggctctagatttgagtggaggaaagtaaaggaagcttgggagtggctagaaaaccctagaacaagaatgaacagaagtggaatggccaaagggtgacctggggatgaaatccatatatataacgactaggtgacgtcatctagccgttactcacaagtttgacctgaaaacttgccaggaggttccgggcaaaagtgccaggaacttttgggcagtacttaggaaattttttgcaaataaacggcgcccggaagtttcggccagaacctccgggtagccctctctgtcccgaggagaaaatcatttttcaaaaatgattccaaaaatattttgactcaccgatattattttgactcactttgtataccctagaaccacacttgaaacccctcttaatagtacggtttttttctaaactcaatttcgaaagtgaaaaacctagtctaatcaccttcggtgttttttgcacttaggaacattcaaattggggggtctccttgcattcttagccatcacaactcgctttgggactaaactcctatgaataaacttgataaacatgttagtcctctttaaccaccttgtcattaatcaccaaaacccactagggggtttaagtgcatcttcaatctccccctttttggtgattgatgacaacatggttaaagcacacaaaaagataatagaatttaaattttgaatgatgagagaagtgtgaagctccccctaaagatatgcatataaagaacttgaaatgaaaacattatgcataagatgaaggaaagctcaaaagaaacttcacactgccctcatcaaataagagatgtagatgaaagtgcttgaatgatgagtgatgcaaaaagaaagactagatgacatggcaatcactcaaaaaagatgaaaagaacacaacatcacatcaaaatgcaacatccatatggtctaacttactgacataaaggataataaagcatctaacagacattacatccaaccaaaatagaatacgattacatgtccatatagagagagataatagagaggaaatctgcctggccggaacctccagatcataggacccggaacttccggtcaaatgaccagacaacagtcaaggcagcaaaaaggataaggatttaaatgacccccttcaattcacaatttctccccctttggcatcaaggcaccaaaaaggcgagaaactatgaagagaagaagatgatcactcatctccatcagagggaacaatctctgtatcgccggagagatgagactcatcggactgagcagcggtgtcaccctcatcaacatcagtgggagcatcctcagcagctgcctcggtgtcaccctcatcaccatcatcatcatcatcatcatcatcaacagaatgggaagattcttcattgaagaaggtggatggaccttcaacggcaacgttgctggctgcctcataagcttcaaatggatcaacatagacctcatcctcagaatcatctaacacttctttcccagcctctcttctatcttccttctgacgcctttctatctttttcactttcttggcagtcttagcacacatacagaaaaattgcctgaagtgccttcttgatgggagaagaactcgaggaacttggtggggcactagtagaaggaccagctgaagtagaaggaacagatcgagggaccactggagaaaaggaaggtggagcacgagggcgaaaagaattatggtgcccatctttgatgtagaataccccggtgactgtctcaatcatctttataataaaaggagcatagatgcacccccgctaaggctcaagaatggtgttggggatctcataccaaatcaatttcatcacactgaagggaggctgat

SEQ ID NO: 80699 - DNA, 9258 bp, Oryza sativa
  unsure (1)..(9258): unsure at all n locations
ttttaattgttggaggctttcacaaagattttacttattcttcgcatgattttgaggatgtattttagaggcgatttgggacgcgacagtttattagagtagaagcctttcttttccgttggtcgtgtagacgctgcagcttcggaagatccgctcttcgtggaagttgaagccgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgttattattattatttccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggtttgattattgtggaaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttatacacaaaagtacacggatggagatggacgaagtctggggtcgatagacatctctaggacaaatgaaggctacacaagctgcggcccggtagtcgagatgtcatggcacagggctggtgtcctgctgctaggggctcaatcctgcctgcctgtcccggaggttccggccgtaggcggggttgggtcggtactcttgtctatggctaggatgggttggaaactatgtcacatcttccgtctgtataccgtggtggtatgtggcacgtggttacacgtgaggaagatgtgtcttgtgggtaaagatgtacacctctgatcagagtataatctattcgaatagccgcgccctcggttatgggcaagcctagcaatgtacccaagttagtgttttaattcttaaaacctgcttaactactaaaatgtggaatggttggcctgggttggcttgggacgagctgggacccagggtcgggttgccagttcggtctaaatcatcgtaggccttggattaaggcatgttcgtgggggtttacggccttgattaatatcactgtgtagctctaggatcatctttataaaatggctttgggcaactaagtgacttttaaatgctgtttactgcaaaacttaacccctatattattaccccttgcacccccttgcattaatcatgcatctgccggtgtggcttgctgagtactgtggttgtactcattcttgctcaatctttcccccccttcagtaagagaagctttggagaagaagtcttaggtggagtcctggcttataccccagttgagcgcctgtgaagatggagccatagtcccgctagtccgctgctgtttatttttgattgtcaggccttaagtgcctttgtaataatgtaaatattatcgatataataaagatgtgtcttttgtatcatgtttgtgtggtgtaccccgacttttcctgggacggggattaatacactagcgttcgggaaaatgcatttttctcagtcgcgacagaagtaaagtgtattaattagagaatttttcttcgggatccccccattacatggccctatgagactatttatagctcctattacaggttcttactactagagttttggttatacaggggaatttacatggttacccttatgaaagggacatttacatgggtacatagggtaattgaggttcacaggcccctgatgggccgtcgggcgatcgtcagctcaatagcccctagacttgatgggcctgaaaggcttcttcggccctcgcgggggcgagcttgctttggcgaagtcgtctcccttcggcatatactcttcgccctgcatccttcgcccaagaggcctctggcttggcagagtacccgtgcgatccctcgcctctcgccgtccttgttccatagtcttcgtcatggggggacttcgccccgactaactttgacgtctcgggcttgaatccccactcttcgtatagctttcagcagattttggtcgaagggcctcatgccataccaccaacaatgatatccatcaaaactatccaaaatgcgagaggcagattaccatagtaactctcggtaagcacttggctgagtgagttgcaagtactgttcatgtacttaatgatacctaaggaattaatttatatacggagaaattaaacatagtgcagcctgttggtctgtggcgttgtgctcattttttcagaccaccaccctttcctcgatcttacttgggctagcgctcttcgctggtccagcgaaaaggagatagcagtcgagagtcgagatcgaaggcctaattatttttagagagcaatggaacgaacattgatgggtatagatcagtcatttaattaggtgttgttagctccagtttagtctcatgagtttaattatgcttgtactccatccgtttcataatgtagcattgtccacatttatgaaagtaatttttataagactaatgatgacaaaactatagaaatcttttatcaaacaatgatttatcataaaactatatatttatagcaccgaagttattatagaactacatatttgtggtgcagtactacagatttaataataaagttaccacaaaatcacatgttgagcatcaatttaatcagaaaacttggatgctaattattcaaacataacattattgctagggatttaaaccctaaattttgtagttttggaataattttattattattattaaatatgtagtcttaagatatttagcctttttactctttttaaaatttggttgccctcatgggtcggtcagtgaaacactgcaggatttaaacgacagctagagctataatttaccttatcagatcaagtaggtcctgtctgattcatggttcgatgcttgaactatcttaagttcttgacacacatgaacgttacaaaagattagtatttggtgtgtagaagggtcaacgccaagccggttaattagtgcaacaaactatgtgtttgcttgcggcacgattgcagagagcacaccatcgtcatggcatgaacacaaacagacccgtaggcttaatcatgtgtgttaggtgaaattaacttgatagatttgcagttcattatctgcaattgacacgataaattacatccttaaacctgctggcaattgtacttagataatggtagcgtatcctcacagatttagcacagctagcaaggcgggaaggaaacaagaaagcattgggatgccatcatctgtaaagtacacagcacagtactgaatcaatggcaatccatccgttgcctcccatgtatgcctattgtctactgtactaaccaagaagacatggaggacaagtccagcgcatgtacgcatggtgcccaagaggacagatggaggatcagatcatggggcaggcacatgcatccacatccctcaaaatcatgcccttgtctccagattcccgggcttggctgttaatgcgtgagttgtctgaagaagctcgcatccctccaaggcaggcggcatatatacagttcaggatcatccatttcttaatgctacttcatcattctgatctccaaaagggcctttctcatcaggacaccgctggtgatccccatccgtgtctcagatttatcatgctagctgattggagtccattgtcgcacgtggcgacgatcgggtttcttggaaagctgggggaacattgttggtgctgggtcactaataatttagtttgataagaaaagagatggagagaaaaattaagccggaaagggaaggtaggacatgcaaacatctaagtagaattattctgtagttcacatgcaataagtgcgcgtcatttttcaaatatcgaattaggtggattggaattagcatcactaattaatgtgaaacaccgtttatagtttaggttgataacaccaattaattactaacatacatctcccgtcagaaaaaaaaaacaaagaaagaaagagggggggggggtcatgttattcagttagagaagtgtgatacctgaaactgaatgtcatgttcagtttcagactttaagaggaggaacagatcatcaaattaacttgaagcttaagctctccaggacgactgcatttactcatggaagtcgacaagatccccagatccacaatggttataaacaatcttgggtggcaattattaatcagtcatgtcattcaactagattgagaaataaaagaaagaaaaaagggggtccgtactgttgtagtatattcctgagtgggggaggggaggtctgtgatgtcaacaagttaggagcgaggagcatgattccagggcaggcaggcatgcacacatgtgaagtgccttggttactttagctgttcctgtctcttggttcgggtgattctttcttcctttctggtgtagtgccttcctttaaatctatttctggatagatacaacacaagatggatgcacacatatttatagcaagtgggggttgctatgtctccctgcttttctagtctgcttgacattttgtggtgggggcatcatccctttcactctcaaatgcttcagatttcagtcaatccacactgtaatccccattgctagtatctctctctcgctctctctccgcctttaaaataggctcttgtggattgttgagaaagttaagtgcccctgttgcaaggttctttgaggcttcgatcccgataagcgttcgaactggtcggcctccacctattgtgagtaaaagccactcaattcctttctcatagtttccattttccttgcatccatctataaagatagctagggtgcaaaattttatatggttggtttgttactgccatggcagaaaaaaattgagcgtatgcatccatcgagagagagagagagagagagagcaatctgttgatctcgcactgtattttgcagctgtgatttggcttcaaagccagccaaaaaaggtctaattctccggccacaagaagatgtcaaggtacctgaagcagtacgagaaggaacacatgaagatggccatgttgaggcaggaggagacattcaagcagcaggtaagataagaacaccactccatactgaaacttccaaactcttgcttccttatccagtaccgaaccttcaagccctcaagcaaataacagcagctttgttcaggttcaggagctgcaccggctgtaccgagtacagaagctactgatggacgccggctctgcaatcacaatgcaaggcatcagttgcatacctgaagacgattatcatgcagaggagaacgaggcanggtcgagcaggccatggcacaccttccctgggagcgacaatgacaagccacaggctcacactagtgttcttgaagagagcgagctggacctgacgctagcgatcgggaggacgacgacgaccaagaaggaggcgccgtcgtctagcgtggactcgaggacgagcaactcgtcgtcgtcgacgagtccggcagcaccaactgcagggcggtgatgccgcaccggccatctcggttggggtcgtcgtcggcggtgaaggttgttgctggtggccccggtgttgggacgacgcagcagcatttggacctggagcagcaggacgcgctgaagcagcctccttggctccaccgttgtctcaatttggcacgataagaggatgtatagcacacaacttcttaatttcttgccgtgtcatccctttactattctcaatcatgcttgctgctcgccctcgcatttctcgatcgtttgtcctcactttacttcacttttttttttacttcttattttttttacttccccaccaccgtcatgattaagaagtcgcgctcagcaggggaaagaaaaaagagtcgtgcacccggagccgacccgcttgatgattccaagccttatcgttttccttatataaaatcagccgctataaaaatttaagtttcagacttacttttgctgttgataactagccggcggctacaagtcgtcggatagttattagcgagtactagttggttggcaagattagttagcttgctgcttgctccaccattataatttgtgagatataaattataaatttataattgaattagggctactacctatctcgggggtctgaatcaacacaaaaattcgttgtctttagattactttaccgcaatctcacgtatagcttagtcccaacgtccaccatactatatagataccgtagtcaggtataaactgttgatagtagcgtgccaagtagggggcttgatgaaaaaagtttcgacgagatgggtacaagagacggattttctaacaatggcctctataatcagcttggccagggcggtccaacccagctgatgttcactcttctgcatgttggatccgtcacattcccagtcttcgctgttacgtcgttgttagtatttcttacgatcacagacaaaatccgcaagcgcacggatataccgatgtagcacttctcctacggagtattccaagggtatcgaatccaagagaacatgtgtggtcagatcttcctccggttcatccaaggacaccaagcaaatgataagccaggatagagaggatttaatagtgagaaacattgttagggaaagcttaattttaatcctaatgcaatatttcaggcactggcaacccgcagttcccagatgtcgctctactacgtacccggacagggaggacttaagtgatctcgagggctgtcaccacctctacacccacctcaaacatactgtgggatacgcagcaattactggataataattacctaaacaccacgtctaagcaattactatctactttagtgtttataactcactaaagcaatcattatattttagttgattatagtgaacaataatcccgtatgctacttcggaactaaccaagagataattctcacaagataaatctaaattactcaagaagaatattatattgaattcacagtaataaacagaataaaagaaataggggaagattactgacaactccggaattcttccgactcctactctactcccttccttcctattttagtatacaatatagtacaatagagcctcttataattcagctcaagcttggaagtatgtgtgagagtgaataaagtgaggtctatttataggacaggtatgacggttgtgagaaggggaaatgtccgaactgccccgcaaccgtctttgggagagcatctggagcgtcgatgccaaaccctaggatcaacggcgatcagaggggttcgcccgaacctaggctgggccctcctggcctggccttcggtctatggactccctgggctcttctctatccatttctcagagttttgggttaattcactgatgttttgatgaagttcacaacccctccttgtatagatatataattctcctcactttagtctaggtttcctcccaacatcagggtatatcatctacatacaaatatacaccaacacttgtggaatatgtgagattaagcacctatcactatgttggatgttttattatccgaactttatgcagatgttggcggtatagaatcgacatttaacagccgccaacagtcgttgatctaccatccgacttccaccgagaacaaggagccgactgcgaagtctattgggtttactcccacatcggtaattgaggatgggggagcactttttaaaaggtggagggagtcctcacccatcagactagttttttgggttgtgtaggcctgagacctaaagttgtggctctggttgagcctgtggtggagcaggcccaatatgaccgggtggcccatggttggtggactgggctgcgcactctaacaagtaatatcagagtccaggtttagaacctggaacaatttccatgggtcacatgatgggggaggccaggtaacaagtcttcagggtcacatgggttaatgtgacataggagattgttgggcccgatgtgtgacgacggtggagattgttgagtttagtctcacatcggtaattgatgatgggagagcacgacttaaaaggtgggggcaatcctcacccatcaaactagtcttttgggttgtgtaggctcaagacctagagttgtggcttcggttgagcctgtggtggagcaaactcaatgtgacctgagtggcccatggttggtgggctaggttgcgcactctaacaaagtccaatcacaagattaggaagaagtggtgccccattaacaaaacgagttctcactctctagatgggtgcagtgttatgctgaaggacaaaactggatgcaacggttgcaaacttgatgatactcaacgcatctcctcatacaaattatgccccatcgacaagacctgagtggcccatggttggtgggctaggttgcgcactctaacaaagtccactcacaagattaggaagaagtggtgccccattaacaaaacgagttctcactctctatatgggtgcagtgttatgctgaaggacaaaactggatgcaacggttgcaaacttgatgatactcaacgcatctcgtcatacaaattatgccccatccacaagacaaaatgcgtactttgacagggtttaaggtattcatcaaagttgtcgaatccatgacctcgtctacgtcggccagttcttctcccaagcattgtctgatccactcccgatgacatcaatccatcaatttgggatcatacgatgatatgtcagatgacttagcttgtttggtcggctatctgggactagacccccatgaaccatctattctccatagtctggatccgctcgagtcctaggtctcaattcataccgtagggtgaacatcgttgagatcgtggacctagcgtcccgtgacgacattgttgacggtcgttatcgattagtttcgaccgtcaatattactaaaatagaggagaactagtggtgcttgcaatgcatatatttgttagaataataatattccattagtattaggtatactaaccttttgcagagaatgacaataaagtggaggagaatcgacatcaactcagacga

SEQ ID NO: 80700 - DNA, 11893 bp, Oryza sativa
gcacttgtgggtgtgtcttgttgagtacggtggttgtactcagtcttgctcaatttttcccaaccccagaagaggagttcctggaagatgaaggcttcggtgtctagctcgtgcctgccgtcaagtgtctgtggtcgtcgccctagtcttccgctgtttctcgtttgtctttgtgtgtgctgggccttcgctgcccatgtaataaattaactatttacgcttccgcttgttaaactctgatttgtatcaacttttggtgtaccttgcctcctgggacaaggattaatgcacgcacgtaaggaacgcccgttgggttatttccggtcgtgacaagttggtattagagcccccttgaccctaggacgagccgtagatcccaagccttagcaatattttcaaaaataaaaatcctttgctatttgtgaaaactgtctagtctctctctgtcttgctgcttcatttactgccaaaatctggcctttaaaatgttgcttttctttttgtttttgtttgtagatggccggcagcatcacccgtcgtggtttggacatgactggcttcgtcttggagctgcggggcatgtgcgtggtcctggggtatccacacggagtggactaccaggccaggccgcttccggagcaggagggtgacgatgcagagccccacgctgcttgggaagtcactgcagtgatcctcgctggttctcccgagcggacctcgctgacagtcaccgcgggtggagactctttccccgccgcttgccagaacgccgctctcctcgccatcggcactcttcaccagcgctacccggacgagttgcagcactcgccctaccgctaccaccctcgtcgcggaggagcccgcgaccacgccaccttccgggatgctagttcggaggatgacgctaccatcgtgcacttggcgcgcatggtggaggcatacgacgcggctcgtatcgacttccatcagatggtgcgccgtgggatggtcgagaacaacatgaagatcctggagctgcgtcaggagaacctgcagctcaagaaggacctagacgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctagcgtggacctgcttcgtcgagaccccccgtgccgagcccgcgcccgtggttccccaggagggggaagcctccggcattggtagcacggaggatgcgctgttgctcaccttccgtcctggcccgtcgcagcggtagacgagcagttagtaggcttgcgcgtgtgttctttcttgtttgtcttcttgttgggttgtgtggggcatggttatgtcggtgtgtggcataactgtgtcagagcctgccttattttatttgcctaagcaacttgaactttaatgaaccaatttaatagcagtaataaattcaagaattatggtagtcgtgggtggttagttttaattgtccgctctctctgtttgctggtcctgtgtggggttttcagatggtgacgaccaggagaaatgctgttaccggtgatggcaaccaacccgaaggcagcaaccacaaccaccaaggcaacccacctccacctcctcctcctcctccgccaccaccaccagacaccaacgccattctcacccaaatcctcgcccagcaagctaatatgatgactgctttcctccaccacctccaaaatccgccacaacttaatgctccaccaccacccccacaacactctagactcgccgagtttctccgcatctgcccacctaccttctctagctccaacaaccccgtggatgtgttggattggttgcatgccgtggggaaaaagctagacactgtgcagtgcagcgatgaggagaaagtcatcttcgccgcccaccagctgcagggacccgcatctctatggtgggaccatttccaggctacacagccagagggacagcctattacttgggcccgcttcaccgccgctttccggagaacccatgtgcccgccggagtcgtggcccttaagaaaagggaattccgagagttgaagcaaggcaaccgctccgtgatggagtatttgcacgagttcaacaatctagcccgttacgctccggaggatgtgcgggaagatgaggagaagcaagagaagttcctggcaggaatggaccctgagctgtccgtccgtctagtctccggggattatccggatttccaacgtctggtggacaagagcatccgcttggaagccaagcacaaggaactggagtcgcacaagcgccgcttggcgaatttccgcaaccaacagggtgctaaccaaagggtccgctacaccaatccctatccagggggatcctcctcgcagcagcagcaacctcgctccgcgcctcgaccttaattcgtggtgcgcgtcccacagccgcagcaacagcagagtcagcaagggactcgtgcgccccgtcctcctacgccagctgtgcagcctagtcaaggccgcagggacgctcaaggtccgcagcgtctgtgcttcaactgcttcgagcccgggcactttgcggataaatgcccgaagccaaggcgtcagcaaggccaagcgcctccccgccccaacaacggtggtaaggacgtcattcggggtcgtgtgaaccatgtgacggccgaggacgtgctaacgactccagacgtcatcgttggtacgttcctcatttattccatccctgctaccattttgttcgactctggggcttcccactcgtttatatctgtgccattcgtggggagaattcagttgggggtagaaaggcttagaaaccctctgctcatcaccacccctggaggggttatgacagcaaagtattatagccctgccgtccctatagaaattcaggggattccttttccctcggatctgattctgctagacaccaagaacttggatgtgatccttgggatgaattggttggctcaattccaaggagtagtggattgcgcgagacgcactgtcactctgtaccgagggccggaacaaccggttgttttctttgcacccccaacctcagtcagaagttcagaacttcatcagataggactgtcagaaattcccatcgtcagagagttcggagacgtgtttccggaagaactacctggtatgccgcctaagcgggagattgagttccggatagatcttgctccaggaaccgctcctctgtacaaacgaccctaccgtatggcagcaaatgaactggccgaagtcaagaaacagttggaagagttgaaagaaaaggggtatatacgtccgagcacttccccctggggtgctcctgtgatttttgtggagaagaaagacaagacgaagaggatgtgcgttgactacagagctctcaatgaagtcaccatcaaaaacaagtaccctcttccccgaatcgatgatctgttcgatcagcttaaaggtgccactatattctccaagatcgatcttcgttccggatatcatcagctacgtattcgtgaagaagatattccgaagaccgcattcaccacgcgatacggactgtatgaattcaccgtgatgtcgtttggtttaaccaatgcacctgcctttttcatgaacttaatgaacaaagtgttcatggaatacttggataagtttgttgtggttttcattgatgacattctggtatactcacaatcagaggaagaccatcagcaccatctctgcctggtattgggaaagttgcgggaacatcaattgtatgccaaacttagcaagtgtgagttctggttgtccgaagtcaaattcttaggtcacgtgatatctgctaaaggagttgctgtggaccctgaaacagtgaccgccgtcaccgattggaagcaacccaagacagtcactcaagttcgcagtttcttaggtttggcaggatactaccggaggttcatcgagaacttctccaaaatcgctcgacccatgacacagttgttgaagaaagaagagaaatttgtgtggagcccgcaatgcgagaaggcgtttcaaactctcaaagaaaagctggtttcctcgccagtgttaatcttgccggatactcgtaaggacttcatggtgtattgtgacgcttcgcgccaaggattggggtgcgtgctcatgcaggacggtcatgtggtggcctacgcctcacgtcagctacggcctcatgaaggcaactaccctacccatgatttggagttagccgcggtggttcatgctctaaaaatctggcggcactatctcatctggaatcgctgtgaaatatatactgatcataagagtttgaaatacatcttcacccagtcggatctgaatcttcggcaaaggagatggttagaactcatcaaggattatgatgtggggattcactatcatcctggtaaggccaacgtggttgccgacgctctaagtcggaaaagccactgcaacactcttaacgtccgtggcattccactcgaacttaatcaacagatggaagccctgaacctaagcatagttggtcgcggattcttggctacgttggaagccaagcccaccttgctcgatcaaatccgcgaggctcagaagaatgatccagacctgcatggactcctcaagaatatgaaacagggtaaagccgctggtttcacagaggatgaacacggaaccctctggaatggaaatcgggtatgcgttccagacgtcagggaacttaaacagttgatacttcaggaagctcacgaaagtccttattccatccaccctggcagtacgaagatgtacttagacttgaaggagaaatactggtgggttagtatgaagcgggaaattgcagagttcgtggccctttgtgatgtatgccagcgtgtcaaggcagagcaccaacgaccggccggacttctccaacctctccaagtacctgaatggaaatgggatgaaattgggatggatttcatcaccggacttccaaaaacccaaggtggatatgattctatatgggtagttgtggatcgattaaccaaggtagctcgattcattcctgtgaagaccacctatggagggaacaaactagccgagctctacttcgctaggatcgtaagtctccatggcgttcctaagaaaatcgtatctgataggggaagccaattcacctctcacttttggaagaagctccaagaagagctgggtacccgattaaacttcagcaccgcgtatcacccgcagacagatgggcagaccgagcgtctaaatcagatcctagaagatatgcttcgcgcatgtgtcctggatttcgggaagacctgggataagagtctcccctatgccgagttctcctacaataacagctaccaagccagcatacaaatggcaccttatgaagcgttgtatgggcgcaaatgccggacaccgctaatgtgggatcaagttggggaaagccaagtgttcgggactgatatcctgagagaagctgaagcgaaagtcagaaccattagggataatctaaaggtggcacagtcccggcagaaaagttacgcagataaccgtcgccgtgacctggaattcgcagtggatgattttgtgtaccttcgagtcacgccattgcggggtgtacacaggtttcagacgaaggggaagctcgcacctcggtatgtgggtcctttccgtatcgctgctcgacgcggagaagtcgcttaccagttggagctgcccgcctccttgggcaacgtgcatgatgtgttccatgtgtcgcaactcaagaaatgtcttcgagtgccatccgagtaggccgactcagagcaaattgaagttcgcgaagacttgacctacgtggagaggccagtgaagatcctggacaccatggagcgcaggaccaggaaccgggtaatccgtttttgcaaggtccaatggagcaaccacgccgaagaagaagctacttgggagcgtgaagacgagctgaaggcagcccatcccgacctcttcgccagttctttcgaatctcggggtcgagattccgtttaaggggggtaggtttgtcgcgtcccaaatcgcctctaaaatacatcctcaaaatcatgcgaagaataagtaaaatctttgtgaaagcctccaacaattaaaatgtgcaaatttaaaagtcaaataaggcttggaggatttttgtatatttcctaaaagcctaaaatgcgtaaataaattttagtggaattttcagagcacaaataataattaagaagaaataaacaaagttaaaagggttttataaaaagaaaaatcctaaaagtccttttcccccccttcctcccttgggccggctcggcccaactccctctctctctcctcttccccgcggcccatcggccttccccgcgcgcgcgccgctgacgggcgggcccgcccgccaccctcgctgacgggtggggcccacccgtcatcccctacctcacgccgctccctccgcccgcccgtgccctagcgccgccgccgccgccgaatccgccgcatcccgccgtccccacgcgccataaagagggggaaatcactccccgtgattccctccctctttcccccctcttttccctctctctctccctcggattcgcgcggaatcttctcccgaaatcttcgccggcgcatcaatggagcccgagatcgccgcgccgatttccttcccctccggccgccctctctccctcccaacgctataaaatcactccccgtgcctccctcctccgtttccgccgttcgccgctctctctcctcgtcggattcgagcccgcgccgtcgtcctctctctccgccgtcgccgccgagctccggtttgccaccatcgtcgccccggacctcctcccgcttcggcatcgcctccttcggcttcgccgcctcctcgtcgacctcgtccactcctccgtttcgcccgtcgaccgccggagcaccgccgtcctcgtcgacccgagccgcgccgccgcctctctccgcttcggtcgccgttcccgtcgtcgccgtcgacccggggtgagccgaggaccgccattttgtttcccccttccctcccctctctcgggcgccgctccgtcgcgccggaggtcgccgccggcgaccatcggggcgtgggcgcgccacctcccgtcggccgtgccggcgaggccgccttcgggcgcgccccgcggctgccaggtggggcccggccgtcagccgcccgcgccctcgggtgcggctgacgcgtgggacccacggcgccggccagcgcaagctgcgtgcgcccggtccaccgtggaccgtgaggctgccgcgtgggccccactcccgtggacccggtccgcgcgccctctctcccggctgacgcaataaatccggtttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagcccttttcttttctgttggtcgtgtagacgctgcagcttcggaagatctgctcttcgtggaagttgaagccggcgtttgggaaagcgagcaaggcaagtcacatcatctttgaacatattgaatcccagtttgtaaaattatgttgatttaaattattgcattatcgctttatttaaattgccgcgttatcactgttttatttagccatgcctatttacctttgttatgaccttattattgttattgttattattaccttgttcaccctagaataaacaaaaccccaactaggggacactctacttatggtaccactagtgtgattataggtagatgcttcgcttttaattaggcaacattaggcggttttacaactctagactttgggaatattcatatcacctggacactgtggaattgttggagtattgtggaattggattcacaccgccccctctattcaaaacccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagtcataaacaaaagtacacggattggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtataatctatttgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttggattaaggcaggttcgtgtgggttcacggccttgataaataatattgtatagtactagaatcgtgtttacaaaatagccctgagcaactaatgtctttaaatgctgtttactgcaaccctaaccctttacagtataattcctttgtactcccttgcatttgttctgcacttgtgggtgtgtcttgttgagtacggtggttgtactcagtcttgctcaatttttcccaaccccagaagaggagttcctggaagatgaaggcttcggtgtctagctcgtgcctgccgtcaagtgtctgtggtcgtcgccctagtcttccgctgtttctcgtttgtctttgtgtgtgctggaccttcgctgcccatgtaataaattaactatttacgcttccgcttgttaaactctgatttgtatcaacttttggtgtaccttgcctcctgggacaaggattaatgcacgcacgtaaggaacgcccgttgggttatttccggtcgtgacataaactccatataacaagtaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaattttaaaagggtttattgcgtcaaccgaggggagggggcgcgcggaccgggtccacgggagtggggcccatgcggcagcctcacggtccacggtggaccgggtgcactcgggctcgcaccggccggcgccgtgggtcccacgcgtcagccgcacccaagggcgcgggcggctgacggccgggccccacgcggcagccgctcagtgcgcccgaaggcgggccacgtcggcgcggccggcgggaggcggcgcgcccgcgctcctatggtcaccggcggcggccatgggcacatcggagcggcggccgagagaggggtgggaaagggggaaacgaggcggcggtccacggctcaccataggtcgacggtgacgacgaaaaggcagccggagcggaggaaggcggcggcgcggctcgggtcgacggggacggcggcgctccggcggtcgacgagcgaaacggaggggtggacgaggtcggcgaggatgcggcgaagccgaagcaggcggcgccgacgttggaagttgttttgggcagctacgccgcggtcgggagcctggccgacaccgccgaaaaaaagcattggccaagttcgatccgggcaagaagaaaggccgttaaaagtcgcaaccgaccgaagcagttccgggaagggtttaaatagggttgaaagggaagaaaacggctgccggggaaggaataggacgcggaaggtccgccccccatcaatggcgccggcgccatttgtgggggcaaatccgtttgtttgaacgcgagagagagagggaaaaatggggggaaagggagaggggatcacggggagtgatttccccctctttattgcgcgcggggacggcgggaggcggcgggattcgcggcggcggcggcgctagggcgcgggcgaggcggcgggagcgacgggagtaaggggatgacgggtgggccccacccgtcagcgagggtggcgggcgggcccgcccgtcagcggcgcgcgcgcggggtgaggccggatgggccgcggggagaggagagggagggggagggagatgggccgagccggcccaagagggagagggagggaaaggggactttttagagtttttctttttataaaatcattttaactttgtttatttcttaataattattatttgtgctctgaaaattccactaaaatttatttacgcattttaggattttaggaaatatacaaaaatcctccaagccttatttgacttttaactttgcacattttaattgttggaggctttcacacggattttaattattctaggcataatttagaggatgtattttagagtcgttttgggacgtgacaccgatacatgctagatctatctgatcggctatgctataagcgtttataatctttatgttaatatatactttgatctaagtgatttatactgtctcggcatggcgaccgatctatcccaatcacttggtttaaatgtacatcgacagaaagattatttagtgttaatatctacagccgatcgagtagatttagtcttatcttgcttatttataactgccgatcgattcacatatgacatcggctcgaaaataaatgatatatcatcggcgactggccaattggctatcgtttatggatttaaccgcggtttcttttgtttttctttcttgtttgcaggatcaaatcaactggcacgctcacgaacctaaaagcaagattttggacctgcactgaagttaagcagattttccaggccagtgtgtgtttttcgcatcaacatgcttttggcacgcctggtgggaccgacaagtgacaacgatgtcaacagaaaagtaatctccatcgtcggcaagcaagccgtcaattcctcttcaaaccaagcttccaaaacctccaggaactaatctaccatcaactagggttgagtccgaggtcaatgaggcaaacattgtcccaggcagtgcagacaagttatcaccagaacaaaagaaagagtttgaattaatgatgaagaatgctcaggagcaattcatgaaatcgttcgtggcaactcgacagggaaaagttgttcaaaaatacaaggtgaaagtggttgttgccgttgaagttggaacaagctcatctcaaggtagtaagagtgctgcagatggctcgggcgacaaaggtgacgggcttcaggacagtgtggtcgaagatctttacgaagatggtgctgaagtgcaagaagaacctgctaggtgcaccaatttccaagaccaagttgattatgctgtacaacatgctttgatcaaccattctggagtgcttgtcaatccattaccaaatatgatcaaatctgtgattgatggcacgatagctgagcatcaaaccacggggccagtctacttgccaggtagtgtctttccaaactataggaacttggtgacaggtaaccagcaaagtacttccaatgtaccaccagtgcagccgacggctgcagcttcgactcatgc

SEQ ID NO: 80701 - DNA, 1244 bp, Oryza sativa
tcataactcagccatttaaagaagacaatgtcagcttcggagttcaggattccttaccagcaagtaagaggggatatgctttccttacagtcattccagtatatagttcaccatttaaaccacttaagtaaaaggtcagttgattttgagtatatattgaaatattggactagtgcaattcattcaaagtaaaaaagtaaggtgaaggtttcattttgttgatagagtgaatttctgttatatgtttcattacagttatgatgttatttcaagacaatattttagcagtaggccagttacttcttcaggcataaagagtgaatctcattgaaggaacaaaatgaacatttcaatttttttcagcagtctcggtaatcaaagttatgaatataccattgctctatagcacctctctctggcaaaatattagcattttgtctcaagacctccttatgacactatattaaacactatgggcacacaatacctatcatgtaaaagttttttatttttgctaaactcaagtttcacaaggtcaattacatcactttactgtggcattagtgagtattcactccattttgttccatacttttgataggtatcatcttcacagactactgagaatgcaggccagttcaagatctgccgatgtggggaaggagacccaaatacaaacacatctgaaactggtgataaatcaccaactagttgtcctaattgccaggtttgtgagatttcttgcacttaaaacttgtgatatgtatttatctaaataacctggtgaacgacttattgtaagctacttgagcaagtgatacacgacttgacacatcactggtttgtagctaaattaccggattgtctatagatacataagcttccatttctatgcatatttgcagcttattcatacttgaaacttcacttttgatattgatatgtatcatttgtgctttggggagcatatgaaaggggggtttgttgaattcttatcgtaaaaccgcataattagttcagagctatgttcagtggaaaaagaagtagacatgattgcttttatgcttcatagtcgcatgcacaagtttccatgaccaattttaggtactcttctgatgcaggttcttaagagtggacatttactgctctcatctaaaggtacgatttgcagtaatatctgtaacggttgcatggattctgtttttagcattaatagatactccctccgtcccataatataaggg

SEQ ID NO: 80702 - DNA, 4349 bp, Oryza sativa
aatcattgtttgataaaagatttctatagttttgtcatcattagtcttataaaaattactttcataaatgtggacaatgctacattatgaaacggatggagtacaagcataattaaactcatgagactaaactgcagctaacaacacctaattaaatgactgatctatacccatcaatgttcgttccattgctctctaaaaataattaggccttcgatctcgactctcgactgctatctccttttcgctggaccagcgaagagcgctagcccaagtaagatcgaggaaagggtggtggtctgaaaaaatgagcacaacgccacagaccaacaggctgcactatgtttaatttctccgtatataaattaattccttaggtatcattaagtacatgaacagtacttgcaactcactcagccaagtgcttaccgagagttactatggtaatctgcctctcgcattttggatagttttgatggatatcattgttggtggtatggcatgaggcccttcgaccaaaatctgctgaaagctatacgaagagtggggattcaagcccgagacgtcaaagttagtcggggcgaagtccccccatgacgaagactatggaacaaggacggcgagaggcgagggatcgcacgggtactctgccaagccagaggcctcttgggcgaaggatgcagggcgaagagtatatgccgaagggagacgacttcgccaaagcaagctcgcccccgcgagggccgaagaagcctttcaggcccatcaagtctaggggctattgagctgacgatcgcccgacggcccatcaggggcctgtgaacctcaattaccctatgtacccatgtaaatgtccctttcataagggtaaccatgtaaattcccctgtataaccaaaactctagtagtaagaacctgtaataggagctataaatagtctcatagggccatgtaatggggggatcccgaagaaaaattctctaattaatacactttacttctgtcgcgactgagaaaaatgcattttcccgaacgctagtgtattaatccccgtcccaggaaaagtcggggtacaccacacaaacatgatacaaaagacacatctttattatatcgataatatttacattattacaaaggcacttaaggcctgacaatcaaaaataaacagcagcggactagcgggactatggctccatcttcacaggcgctcaactggggtataagccaggactccacctaagacttcttctccaaagcttctcttactgaagggggggaaagattgagcaagaatgagtacaaccacagtactcagcaagccacaccggcagatgcatgattaatgcaagggggtgcaaggggtaataatataggggttaagttttgcagtaaacagcatttaaaagtcacttagttgcccaaagccattttataaagatgatcctagagctacaaagtgttattaatcaaggccgtaaaccctcacgaacctgccttaattcaaggcctacgatgattcagaccgaactggcaacccgaccctgggtcccagctcatcccaagccaacccaggccaaccattccacattttagtagttaagcaggttttaagaattaaaacactaacttgggtacattgctaggcttgcccataaccgagggcgcggctattcgaatagattatactctgatcagaggtgtacatctttacccacaagacacatcatcctcacgtgtaaccacgtgccacataccaccacggcatacggacggaagacgtcacatagttcccaacccatcctagccataaacaaaagtaccgacccagccccatctacagccggaacctccgggacaggcaggcaggattgagctcctagcagcaggacaccagccctgtgccatgacatctcgactaccgggccgcagctcgtgtagcctttatttgtcctagagatgtccatcgacccccgacttcgtccatctccatccgtgtacctttgtttataaccagactgagccacaaactaagccttacccactagacatgtggaagtacggtagtgctttccaacagaggcccgagcttaatccttatagtacccgaggtacgactaacaaaacccaaccacggacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaattaattagcgaagcatctacctaaattcatactagtggaaccatgaatagggtacccactagttggggttttgtttatcctagggtgaacaaggtaataataacaataacaacaatgataaggtcataacaaagataaataggcatggctaaataaaacagtgataacgcgggaatttgaataaagcgataatgcaataatttaaatcaaaataattttataaactaggattcaatatgctcaaggatgatgtgacttgccttgctcagagataacggccttccgaaccttcggcgatgaccgcgaaccacgcttcgggaacctcaggaacgacagaagctacgcgaagcacacaagcaaagctacaagcctataaagaagcaataacaatagataaaaagaaagcacagggttctttaggttataacaaacattaggagacttgaacggatcgattcggagctcgtatgaccaatgcatggtcatccgaagtttaatgttgttatatggagatttgtggattattataattaggttttacaactataaaacatgtgtaagcgctagcctggaaaagacaggaaggctgcgccgttgacatgcggaccccacatgtcaacctaagggaccacggcagaccgggtacacagagatggtccacgggtcgacggaagcggaccccatgtgtcaaccgaggcgagtggccgacaaacggactccactagacaccacgcgggctgcacacgtggaaaccacgcggtaccgagcgggcacactaacacggtcaccacacgcacaagcgaacgactaccgacaccagtacacgggtaccggggtcgacaaccgcacaacgggcacgggcgacaccaaaaggacgaggacgagggcgacgagggagagagatccttaccaccacgtgacgaggcgagggaacgacaacgacgaacgggcgcggcggagacggccgggaacgatggagacgaaaggcgaggggacgactccggtggcgatccttggacaaaggcgagacgtggccggcgcaacgcttggcaacgcagaggcgaggacgaagacaatgacggggctgcggcacttgacgtagcgaggacgacgaacgagaacggcttgacggagggacgaacgccacgacgaccgggaacgacgggaggacgacgatgacgacgaccggggccggcgaggaggcgacgtgggcagccggcagtggctacacggcgacgaggatggcgtggaacacgccgctgtgaatccgaagacggaggcggcgccgcgagacgatgagccggcgaggacgaacgaccgaccggaggagtcgtcgacgaggacgaacggagacgacaatgacggacagcggaggggttcggatggagggaaggcgatgccgaggacgacgtcgctggctcgccgctgcgatgccggaggtggtggtggcacggccaacggcgcacgggcacggcggaaggggttgccgaaggaactccagcgagaccgagggagaggcgccgcgggcgacggttttccggcaaaaccgatggcaggccggggtggagggcgatgcgccgactccgagggaggatggcgatgacgacagccgctgcaccggcgaggcggcacaggcggctggaggcggtggagtggtggcgacaccactggtcgtcggcgaggacgtcgctccgataatttccccgcgaaacggaggcgacgccagggaagaagaggcagctgcgaggccgctgggggcgacggcacggccggcccacacctgagcggcacggcaggggcggctggattggccggcggcgtgggagagagaggagggctgcggggagaggtggtgaggccacgggagagcgcgggagggggttaaaacgatagacggagcgagcgtgttccattttatagggtaggagagggagccgggcacggaagacgtgggaacggcggcggaaaagccggccggcagccatggaaggtggccggggttggcgcgggcgttcccgacgattgggggcacgaatcaagggggatattagggggaattgat

SEQ ID NO: 80703 - DNA, 1523 bp, Oryza sativa
caattcctacgttgagtttaaacgggtggttacgtggcaatatggtcagccagataaataaaaaataatggaaaaaaaattgagctccatatgtcaatcagcaaaatagacccacgtgaccccacctctttctctctctcctcttgccctctcagcacactgctcgagccgacgacagcgctcctcaaagtctagctgccccagacgcgaccacatggtccttccttcacctgcgtggccttctctgccgggactgccgggagtatgtgtcgtaattataaatctgaaaagatgtgcacttttttaatcacgtttcgtaacaaatattaccagttttgctgtttgtcacttgatattttcacctgacttgtcttctttgctttgaatccttctgttttcctccattttcctctatcctttatcctttttctattcctgaataaatcgtggaatccaccgagtactttgaataaatcgtggaatccctaatttgtcatcgagtctgatcttcatcctcggtccaaaaaactggatagaacgtatctcctaacttacaaaaccatgcaaacgaggtccctcgatagtattgatctcgggtttagctgacgtggcgtttatatggatcgtttaactaagtcttcgttccacgtggcattgctgtgacgcttacatgtcaattcaatcttgagaaataatacaacccgtagggcccacatgttagttacacacaaaaaaaaatgatggggcccatgtggctcgcatgccatcctccctacccctcctctcaatctcctctctgtccctacaacgaaaacacaggagcgctcgggcggcggagtgggaagggcgacgggcggattggagtggcgacggccagctgagtggagcgagcgacgggcgtagcggagggcggcggctggagcaggccgccggcggaggaaaggggcaacagagggcaagctctcgcttccccacctgcttccctatcatagctgccgccgaagacaacaacaacgagttcgaggaggaggaggacgcgcacctcaccatcaccatcgcggccctcgccgccacattcgccatcctccgagctgctctctgaccttgacagcgtccttgccgtgggcgacaacgggtgagctcccgcttcccacctgcttccccgccattgtggccgttgaagatgacgaagacgatggcgatgggttcgagaaggaggaagaggaggacacaaacttccattgtggagatcggcgccgacagtggattgctgctgcttcgctcgccgccgccttgcttggccctttcggcttcgcgcgccgtagttgctccggctgcagtcaccccactatgcctgccgccgcccagtggacttcttgcaccaccgctcagcttgcttcccatgggacttccatggtgggagacaaggggataggatacagagggggaagaagtggggcccactgacatgtgggtcccattatttttcaatattaatatttgactgacatgtgggcacgcat

SEQ ID NO: 80704 - DNA, 2236 bp, Oryza sativa
cagtacactgcaaatgtgcgttccgttgaaacgttcaacggagtacgtacaaactacaggtccacaaacctgtacttctcaacctgggattcagaaaaccggttgctaaatacggagtaagtaagatctcaacatcactacagtttctgatgtgacacctgcaaattccaatcttgcttttgttgagctaacatatgttcaatgcaacgccatagttccttcgctgccacacatactctctctttgctttcctcctgttgcctgttggacgagatggcaggatcataggattttgttcatcaataccatatgttttagaaatattattttagtagatcatattattggtagaagttggggctttgttccatctcgtccattttatgcttttttctgttcacttctaaatttttttttagctgtgtacctacggacagaggctgaagatataatccatttccaatatataaaaaatgctataagtttagttcgacttaagaattaagctaaggtcgtaagatctatgttcatcaatcgtgaaaaattcattagtgtctcattaccttattgcaattagcttagtcaacttgttacttgcacggggatctgagccagacatcttcttttttgggctacacatggctacctacaattgcaatcaagatgctgacagctgatacaagatgaagaactatactacacacgaataatgaatccatctccttcgatcccaaaactattctgatggcctgatcaagtccaccgccggtaatcgacccaagttggggattgttaattacactaaacaaccagccttgtgcagctagctgagtatgaggcggcaatacgaggaaggaagtgcgtcgtctgagccgtgaggcagagatgagagatggcagaagggtgtggaaggcaaaggtggtgtggaaacactctttgggtggtcttatataaaaaatggcaccaataagatcatcggtaatccgtaatcaaacgcgaataaacaatagatctaaatttaatcacgacatctaaacacgatatttaaaaaggaggctcaaccgaagtgtatattacatatcaatgttatcaataatcctcaactagctaggccgatgggtgtgcctctatatttaagagtgtgtccagaatagaatccgacactaattttactttgcactatgcatattataagtttactgagacgccactcaataaagattattaattgattgagataatcagtagcacggaaaacacaatagtgattagcacatgattaattaaatattaacaaatataaacgtgaaaattgagatattcgattcttaaaagaaaacaacgtagaaagtgtttgaaaaaccgtaccatttaatagtttgaaaagcgtgtgcccacgataaacgagagaagctcccctcaacagcacaaacaaacgaaacctaaggctgtgtttagtttccttcaaacttccacaaattccgtcacatcaaatgtttggacatatgtatggagcaattaatatggacgaaaaaaaaccatttgcacagtttgcatgtaaagtgcgagatgaatcttttgagctaaattacgccatgatttgacaatgtggtgctacagtaaacatttgctaataacggattaattaggtttaataaattcgtctcgcagtttctaaacagaatctgtaatttgttttattattagtctacgtttaatactttaaatgtgcgtccgtatacatcaaaaaaagatttggaggaggaactaaacacggcctaagtcctactcccttcgtcccatttgagtgaagcctgcccaacttttatcttctgtcttatttgaattttttttgaaaaaattaaaaacataagtcacacataaagtactattcgcgttttatcatctcatagcaacaaaaatactaattataaaaattttcaaataaaacggacgacttaagttgggcatggaaactcatggttgtatttaaaatgggacggagggagtactttataactaactttgtatacatatatttgacaagaactctaatggatggagctagtccggtctagtttttccggactaccttatatataaattattgtttttaatattcgcacgtaatgttggttccacaatattaatacaagtgatatccgatggacgatagtttcttaacatgcatctgcccgttgacagtgggcgcggatagccaacctcatgtggatcc

SEQ ID NO: 80705 - DNA, 1734 bp, Oryza sativa
  unsure (1)..(1734): unsure at all n locations
ggggtgcctgcgtgttctggccaccaccggcccccgccggatccgggtgcaccaccgccggatccgcggcctccaccattgctaccccaacgccgtcgccattccggcngcatcaacccacaacaccacngggcgcaactcacctcaaccgccacngtcgccggtcnccgccgcaagcccatcccgcaagatcgggccggaacggcgcggatctggcggacaccgcngtcgccactccggcgggctccccaggccacccgagcgcgaggagacaaggagcgccccaccgccaccgtccttgcggccgcgcggcttcaccggcgcccgctcgggtgacggcaagncgnaaaagggggtgggggtggggaagaggnacgnccgggtccgcccctcgggagagcgacgcgagagggtttttctacaagcagtcgcttttgctccgtgtcgatcgatctagcaagccggctgacccgcctctgcaaatgcaaagcttccgtgagcagcccggagtgatttgccccgggatcgcgtggtttgtgtcgtgtctttgcatacggcgacatgctatgaatccccgctttacacctgtcagatggaccaaatcaccaaacgtgattggcggtccaactgcagagcagtagcaaagatttgaggaacaacaggcaagacatcggcacggcacctgcagactgcggatgaaggcgttcgccgtagaatttgagctttcgtttactgtaacagggctagttggttgtacttgtaccttacggttgaaagataatgacacctagtagatgatttgccggagaaatattataggacaggaacttaatactcattttcttcgaaaagtcatacggaataaatacatgtgctaaagtgttctcctttaagcaggaacatcagagctttcaattgagtagaacaatgcaggtacacattgccgggtttcaaaccgctgctatttttctcccttgggatcatggcaagcatttttcgtcaacaagactgttagctgcctgtttagcacgcgtcaccaacaaatgtacagagtatgtaaccaagatataatcgaagcaaaccgcctggggtagtgtttttttctctctttttgttcgtaatagcctttataagatgtagaattgtaattttttaactgatccattaatacgaaacatcgcactaactcgtagtggttgcttaaagaaaaaatcatagcaaacaaaacaacggccaattccatccttaccaatttatcttgatgtgttggcacggtaaaaagaccaaaatcggcccaacgtttttccatcgaatggacggagaccaaaacaagcaagcaacttggccttcaatcttcttctccttcgcgctctcgccacgcgccgctgctcgccacagagcaccaatccaagattccagagcgggcggtataagagaggggtaggaggctacacccccgccgcctccacactcaccacccgatcgaacaccgccgtcacagcgcgtcgcggcgggggcgatgggcctcttcggcggcaagagcgcctcttcgaagcagaccgccaagctcaagtccctgatcaagctcgctgccgcgcgcgtcgccgtcgcccgccggccccgcctcgggcgccgctccattgcccgcggcgatgtcgcgcagctcctctccatcggccacctcgaccgcgctctcctccgtgtatgtccatgccatgcttttgccttgcctga

SEQ ID NO: 80706 - DNA, 1123 bp, Oryza sativa
tttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggtac

SEQ ID NO: 80707 - DNA, 30983 bp, Oryza sativa
cccagatgaaaaagtacggccgcaagctctttatgggcggccaaaattgcaattagccccttgccaccctctgtatgggcggcaagggcctaatcgcaattttagccgacggcggcagacggcgcggtcgacccaccgtctgccacgtcagcttgccgcccaccattagggcggcaggggctatttctgcaatttttttggtcgatagattatttctgtaaatattaaaaaaaatctaaaaacgaaaaaaattcaggggaaaaggagggtggctggcccgggaggaaggagggggagttgggccgagcccaagagggaggagagggatttttatttggttttctttttatttaattgattagttgaattttgtgactttaagattacttcttgagctccgaacattcgcggaaaaatccggagagtattttagggcacaaagaatattacaaaatattctcggccaatgatttttaagggaaaattttaattcccccattaatttcacttgattgaattgatttaacttttatttaatttctagaaaatggattattaaatgatttttaatcccgaacgaaaatcggggcgttacacacatcgtattctaagggtatcagtaggcatattttgggtctaggcctaatatgtctgcagcccatattttcaggcgtggcctgtcacgttcttttagggacttagaaattttttggttaggcaaaagtgcgcgtgatcaagtgcccaatactttaaaaatccttttataccgctcttactcaactttttagtagttggtacaatgcattttaaaaggtaccaaacagtaaagctttatatagctgccttgctgacttttttatctaagtcagggcattgtttgggtttataaagcaattgattggatacaatatcgttgctttttgccacgtaagtgtgcattcttattgaccaatattatggcttaggttgactatatattttggtcgtttttcgggcgattagtaaatcctttatgagtttatttactcggattttacaccacatatgccatatatttctaggtatggtgaaaccatgtgtcttttagggacttaagcacatatgttaaagcagtgtgcgcatggtgtgtgcccaatactttagaaatttctttgttcacagcatactagcttttttatagttgttttgcaatgtgaattttcaatgatgtagtcaactttaggttgcacgcatcatattttataaagcagttggtatatcactcggatcatgttattcggggattcacaccgcatatgctatatattaatattaagtcacttggtttactacaattatcaaaaccactcggttggttggattatttactccttgactatatgttttgtttgttcaactaaccacatagtcgagggctatacctattaggtgcatctagtcgatgcacctacgtttataattaattaatttttagccctccacagtctttagatttggtaaaagtactcgggagaccatggcaaagatgattgatgcactcggctttggagtaatctggttcgagagaagattatcttttcgactgtgaaggtctcacgggctactgtggagattatgggtaccccatacccacacggcatggttatccgactggttataggggataacttatatctatgaaatatgtaaccgatcatgactttggtattacatttccttgtatattatagaacggcctaaagttctggtttgataatattgtaaagtatatttaggaaactgataccatattgattaaggtttctatcttgtaatcctgacccccccccccccaaatcctatataagatgggcaggaggccctctagggggcataattcacaaccagatcgtcagatctataatacacccggcggattcaaatccccaaaaaggagtagggtattacctctcatcgagagggcctgaacctgtctaaatccttgtctctgcatccatccacttttaggtctcatgcgctaccccttttattattgccgaattcttgtttcgacaccacctccccgggctgccaacatctaggtgaccgtgtcgtcaactgcatgcataagctgttgcggggatgccggggagatctatggtgacctgcaggcaggcggaggaggcaacgattcgacggcaggtagggcagggcgcgatggcgacggtcatcggcggcaagcgatgcagggtggagtgcgcggcggagtagtcccggggggcaagggttggtgaccacagcccgctggtggctgggcgactggcattggcgttaggcggagtgggtggcatagcggagaaaagggaggggggagttgtgtcgctatgggaggcgtcgctcgatgaaattgcggagagaagcgtatgtctgcctaattcgatttgatgatcgaatgatctacgtttcgtgtgtctgcctgcatcaggattcaagaccaccactatgtttttcttaagtagtacagattttatacccagaaataagagggtgggactaaactaagtctcgttcttttttccaacaaaagttgcatgaagattaagattttcgtggcacgctttttaaacaactaaacggtgcatttcgagcgaaaactttatatatgaaagttgctctaaaatatcatattaatatatttttcaagtttgaaataattaaaactcaatcaattatacgttaataccaccttaatcttacaccttaatcttataccatcttcatcttacaccatgtgtggaagaaatctttacaattttgtatgtcggtgtcacattttgttagtaaatgaagatttccaaccccttaggccttgttcggttggcccggaaatggcagggattgggccgcgatccctgtggatcactaagttcatctgaggtcccttaatttgtcaacgaatccgattttcgtccttcaacccgaaaaccagatacaacggtccctcaactatcaaaaccgtgcagatgaggtccctcggcggtttggatggtggttttggctgacgttgcgcttacgtggctaatttgactcggtcaccgtctgacatggcgcttacatggcaattcgaatcggaaaattaataaaccacgtggacccacatgttagtgtcacacccaaattaataaaaaattggtggggcccacgtgagccccgcatgtcattcccactcctcttcttcctcctctctccccatctcccctctcctctctccaggcacgacggagagtcagcggccggggggaatcagcaccaccaccaccacgcgatggcgagaagacagcggcgctggtattcccgtgcggctacgtcggcggcgatcccgacgagtagccagaccccggtcgacccgccgctgtcgtctgcagattgcacaagaccaaacaagaagcaaattggatcatcagcacggttttgatcagtggagacgaaggttagtacgtaccattgtggtagcggcctagcgggaggtcgttggcggccatggggatggacatgaacagctgtgtctcacgtccgagccccatccaggagcccttgctgctccttctcatgcggccactcgtcgaagaagtggccgagaggtttgaggtttctgcgtcgccgccgcatggtcgtggcccgccgaattctccagccggaggtcggcgcccaggaggaagcagtgctgctgctgccgcctctctttctcatcgtcattttctttggaaagatcaatggcgtacggcgacacagcggtgttgccataaccggcgcccgggaagagcggcgtggtgctctgcttgggctccatgccgagctgcttgaactgccactggccgtgtccggcggcggcgtggtggtgctccctctcggtgccgtcggagaagaaggcgtgctcaccgtgtgcacctccttggtggcgtgcccgtacgcgtactccttgtggtccatggagtagtaggacggcggcagccggcgggtgagggtgggtggtgtcgaggtggaggtggaacgggctcacctgcgcgtggtatgccgcggcggcggcgggggtgtgcgcggtggccacggcgtagggcccgccgtagagcgcctggtacggcgctgcgtcgtgtgccgccgggcggttgtaggacggcgccggggaggaggtggtggtggtggggacgacgaggacgacagcggcgggtcgtactgcacaccggggtccggctactcgtcgggatcgcggccgacgccgccacacaggaaaaccagcgccgccgctggctctccatcgtgcttggagagaggagaggggagatggggagagagcaggaggaagaagaagaggagtagaaatgacgtgggccccacctttttaaaattaatttggatgtgacactgacatatgggtctcatgtggattattattttcccacttcgtattgccatgtaagcgccacatcaatgctacgtcagatgaagacatagttaaattagccacgtaagcgacacgtcacgtcagttaaaaccgctatccaaaccgccgaggacctcatttgcattggttttgatagttgaggaacctattgtatctggtttttcggttgaaggaccaaattcggatttgttgacaagttaagggacctcagatgaacttattctccccggtgggtattaaatcccggcctacaagaaagtgtgcgttcggttaagcccagtttggattctgtcccggcccatcccggcctttccccctcaccccggtccgggaaaaaatcatcgacccaagaggcgtggaagaaaccctcgcgcacaggaggaaactatcaacgcataggggaaagcagcggcggtggcgcgggtgcggattgagagtcgacggcgcgacggcgacgcggcactctccccggaggcggcgctctcccctccgccgaccgtcccctccgctggccactttctcaccggtgagtctctcttccttcccctctcttctccctatccttcctagggtttggttcttggtccaaggttcttggttaaagatggtgtgcaattttgatgtagctagcggatctagaggactgatggttctcgttggaataagcctttcttaggttattaatcagtgtcttgattaaacctgattttctgcatattggatggactgagcagcatcacaatttaggttgctccttgctctgcactgcttgattttgtggaataaaatgaaattaatgtcaatttgaacatatcatatgctgacaaaatgcaaaaattaatgcaaatcaactatggtggctcacctttgctttcaaaactttctgactttcactgaaatactgattaggatgattgattccagtatcactgagacaccatgtgctgcctcgaaagtcatcgtgcaagctagctatgtatttcatatcttagatgattcaagcaaaccaagtttggaagaatgtttattaaaggtagaattgtgaggtgcagtacctggttactgctgtttgtcgagttttaagcagtcaccagttaacgtggcctcttttatctttatccaacaaattagattagtatgatggttagagtacataccatagatgcacaacatggtaagttcctgacagattcaacgtcttttgctccttattgtatatctcatctggttatacatttatgaatatgattagtataggacaaaacagaagtcaagatttgatttttgcacaagcattttgatctacataattgtacctatccatgtccaatatgaacataattgaaaattctcggtttgatctcaattgaaaattatttcaatttttattggtactagcacatatagggccttgcactttagaaatattttaattttactaatgtaaattgtgtctgctttgtagattgcatgtccaccaattagagttggagaagaccagcctcctccttcttgggaccctatacccttggcctggtagtactggattgattttaagaccaattttcagtactgggttgatttctgaactttatgtatagtcatttcctaaagctccattttctagatgataaagcttgtcttcctgattctttttggaattgatccaatgctgttcgattttttttcagagatgggaacactggagctgggtgactgaagcgcatggtggcattagtgctaagcttaaacacttgcattcaatttgtagtttagctcttagctggctacttctatttattctaagaaaaacaactgaattgtacccattttgattaatctgtgaccttttcatgtccttcaaatttcatcatcttctgcatttgttgatctaatacggcccagccacctgttttttttttcattcatagtctgcatgatcatcgcgcttcaccctgagtgggatcgatcctgatctgccaggtaggcctctgttctcgtcgtcatcatggtgctttgcccgtgagcatcgcttgtcgttctttgttgagtcatcgtcaagctgttaacaccaaaatttgatacggttgtttagaggattcagttaaggaaagaagtcaatcaaccgatcaggacttatatcttttcttttatctttaggaaacttgtatcttgtccgattaggactaatatcaacctaagggtataaatatgtacacccgtagactttgtaatctatttccacatatcaatacattactttcggtacattgccaacttttattccggcgagttcttagttttgagcaggtttgcatttgttaagttcgatctcccacgaggaagtaagtttcgtcaacttcccgcgaggaaataatctcctcttcctatactatttaactttggctacaactttctcgtttaagtccaatattttattcaggttgacgcaagcattgtctatctgatatattgattatatctttaactgcattgctatttagagtggtatcggcttagttaggactttctcacttaggtccgatattttgactaagttgatgtttttctaatcgtattgccgttttagatagatcgatgtatcaatcatgtttgtatatatatctattggctaaatatttttttcttgttatcgtcaatcttaaaatatcttagttaggctcgatctgttagattgctactaataagtctatttctactaagccgataggttttcatgcaacgtttcatcggactgttagccgatgagttgtctttattgtgggttagctatcagatataatgattacttagttgatatacactttaatttatttactgttggcggatggcatgaggcccttcgaccaaatctgccgaaacccgtggcaaagactatggagcaagaacggcgcgagacgaggggtcgtgcgagtaccttgtcgagccagaggcgtcccaggcgaagggtgcaaggcgaagagtatctgccgaaggaagacgatttcgccatggcaagttcgcccccgcgagggccgaagaagcctttccggcccatcaagcctaggggctatagggccggcggtcgcccgacggcccatcaggggcccatgaacctccataacattatgtaccccctgtaaatgtccctttcgtaagggtaaccatgtaaattcccctgtataacctaaaccctagtagtaagaacctataatggggctataaatagtcccctagggccatgtaataaggggatcccgaagtaaaaaattctaaaattaatacacttcgtttctttccaaccactgttgagtaaccacgtctttcgacgtatgcggttgtcgtttcgacaacatttacattggatcttcagccaatggatgttttaaccatcctatttacatcacattatattattagttttgaccgattggttcaaattatattatctcatggcatcttctgagttacatcggcttatactcaaacttgtataatcatagttaaatctatatttatcaacttaaatcttatattttttcggtttgatcttatctatcaatattgcttttgacaaagaatgtgtttacactcaaatttggcacctagaggcgaaataggaaaaattgccaagatttgggaatctaccggtttcctccagaagggccgatctaaccgccatgtatggaccactcagactgtggccagagggccggtctgaccagcagagtccaagtcagactccgtttttgtcgggtctcgagattccttgctcagggggctatgttttgggttctttttttgttttctacccctagttagacatggaggagggcctgtagagggcaagaccaacccctatttaatggataaggtcggttcaaacaatgtatcacacaacgatcaatcaatcgaatcgctttttcaatatcgctttctgcttttcacttagctctactttaattcgtccatctttattgatttacgccgtaaatcattcgccttcattgcgagagtgcgaaatcctttgtaggtttgtcccgtaaaccttctgtttgcccacgagacatgtagttattcaccgttttatctaaatcggctccgctatccggtttaatctatcaaaacccaacttgatctagattttgctggtttggggtggttggcgactctacaaatcaccgcaagacgtttaggtgttgcgatcatgcttatctacttgaccaaaaaagttgccaacagaaagcagacgggaagaagaaggacaagcgcgcgagaagatagaagaggcgagccgagaaaacaaggagaatttctttaatttgtacggggaaatctctactattataaaaattgaagatattttcgcggtccgtcatccgtttttgagtcggttataaaaattgaagatgtttctgctgttcgtcattcgtatttgagtcggttttaaatttatgttttggttttaacctatatctctgtctctgctatttaaaaaataaagatgtttttgtcgatatttttatatgtcatctgtgtatgagtcggtttttaagtttacttgctttttttgaaaataaatatccgtatttaagtcggtttttaagatcattcacatgcattttttttatagtaatagtattataagtataaacacagtagttaagacggagccaaacacagcagagccgtcccgatctaatcgaccgagcccaaaactaaccctaaattccccagctccccaccacgccgccgccgccgcctccatgggccgcaaagatacttcctcgtcgtcctccgccgccggcggcaagaaggacaagccgatgtcggtctccgccattctggcctccatggacgcgccggcgtccaaggccaagccatccaaggcggcgtccaagcccaagccctccaaggcgcccgcgtcgtcttacatgggcgacatcgacctgcccccctccgatgaggaggaggacgacgccgacctcgttgccatggccacgaagcccaaggcggcccgcgccaccgtcgacctcaacgccatcgcgccctcgcagaaggacgcgaagaagaaggacaagcgcgaggcgatggcggccgcgcaagccgaggcggccaagcaggaggcgctccgcgacgaccgcgacgcattctctgtcgttattggcgcgcgcgtcgctggatccgccggggcctccgagggtgactccgccgccgccgatgacaacatcaaggatattgtgctcgagaacttctctgtttctgcccgcgggaaggagctactcaagaacgcctcgctccggatctcgcacggccggcgctatggcctcgtcgggcccaacggcatgggcaagtccacccttctgaagctgctgtcatggcggcaggtcccggtgccccggagcattgatgtcctgcttgtggagcaggaaattattggagacaatcgttcagcgctcgaggctgttgttgctgctgatgaagagctcgcagcgcttcgtgccgagcaggcaaagctcgaggcctctaacgatgctgatgacaatgagcggcttgctgaggtttatgagaagctcaacctccgggattctgatgctgcccgggctcgtgcatccaagatccttgctgggctggggtttgatcaggctatgcaggccaggtccactaaatcgttcagtggtggctggaggatgcgcatctcgcttgctcgtgcgctgttcatgcagccaacattgttgctgcttgatgaaccgactaatcatcttgacctccgagctgttctttggttggagcaatacttgtgctcacagtggaagaaaacactgattgttgtgtcccatgatcgcgacttcctgaacacagtttgcaatgagatcattcatttgcatgataagaatctgcatgtttatcgtggaaattttgacgactttgagagtgggtatgaacagaagaggaaggagatgaataggaagtttgaggtgtttgaaaagcagatgaaggcagcaaagaagactgggagcaaggcagcgcaagacaaggtcaaaggtcaggcactatcaaaggctaataaggaggctgccaagagcaaggggaagggaaagaatgtagcaaatgatgacgacgacatgaagccagctgatcttccacagaaatggcttgactacaaggttgagttccacttcccagagccaactttgctcacaccaccgctccttcagctcattgaggtgggcttcagctaccctaataggccagatttcaagctgtctggtgttgatgttggcattgacatgggaacacgtgttgcaattgttggtcccaatggggcaggaaaatctacacttcttaatttacttgctggtgatcttaccccaaccaaaggagaggtaaggaggagtcagaagctgaggattgggcgatactcacagcattttgttgacttactgacaatggaggaaaatgcagttcagtatttgctcaggctccatcctgatcaggagggaatgagcaaagcagaggctgtacgtgcgaagctcggaaaatttggtttaccagggcacaaccatctcactccaatagttaaattatctggtggacagaaggcccgtgttgtgttcacttcaatatcaatgtcacatccccacattctcctgctggatgagccaacaaatcacctagacatgcaaagtatcgatgcattggcagatgcactggatgaattcactggtggtgtggtcttggttagccatgactcgagattgatctctagagtgtgtgacgatgagcagaggagtgagatatgggttgtagaagatggcactgtgaacaaatttgatggaacatttgaggactacaaggatgaacttttggaagaaatcaaaaaggaagttgaagagtaatgtgtttttatagttgcaggatactgcttattctttatagactgggctggtaaacttaatgtactagtacttattttctttggtttgcagagtatttgtatggttgagtccgaaacacctattcgagctgttcttgctttttgcatgatctaagaggttccaggatgagtctgataaatatgttttctatgattttgctgccaattactctgtactaagacttccatgatatacatccataataattcagtatgatttcatgttattggctcatataattaatattatattatgctcagcggtactttatgttggtcagattaatccaaattattatcaaattcttggtcaattagttcaatatatggttgaatgcctatatgcttatggatggaatgctcactgaacaatcatatggaactgcagcactgaattgaaagcacactaaatgtgcgtactgaaaccatggtaattgaaggacaatgttacactgctgattattgaaactctacatcctgcagcttgatcctgaaggactttatctggttattatcaccgtatgccttactgaaaacatgctatatctaactactgaaatgttcagctattgattgtgtcacaagttgtactgctaattaactaagctacatgctatgaatggcgatttaatgccataccgatacggattgctctggatggtttgttacaagacctatgatttctgcttaatggttcaactagaagatctgcacgcctgttggcgtgccacctaatttagcatgtaatatggctcatctgtaatatatatagaaaatttgcctacctctcattttatattatttgtaactctagcaaaatttcacatcaaacaaggagatgtggcaaattacactgatatgcttattaactacattataatcgttttcaaaagcaatattaactttgattgacagttatacatggcatttaaaaggtgaagatagaagaccacgatctaaaaataataatttgaaatgtgagaatgaccagtaatattaaacatgcagagtaatatattattacatgagtaagtttaactctgaaaaaaattctttcaaatggacatgttaatggaatttaattttatgtttgtcttagaattatgagaaaaaccaaagtaagattgtaattaatgatgatcaataatttggcaaatagctagactctattagaaaatttaaagttatgtttcctcaaaattgttgtgatttcattaaccaaaaagtcgtacatatagtatcaatgataaagtgcatatttgaagaaatggttcttagtttatatttgaacaaattctcatccaatctctttcactttatatttgatatttagtttttcccgattattatttattttatataaatacaggatatcaatattttatgttttgaagattttttttacaaaattatttatacttttctctaccttcctttttcctacttttgtttggtcctgtttgtgttattactaattaattagcccgagaaggtaaagtgcaacgtgcaaatgctgtagcaacaacgctagatgaccaggcctagtgcagtcatgcatgactgggctgtacagcccatgacaggcgggatggtaattttgccaatgggttcgggtatccacggatacccgatccaatgggcacgggtgtgggtgtgattttttacctgtgggcacgcctacccgagacccgcagacatcgtgagcaacagccgagtttcattttttatctgtgggtaacccatgcccgacccaattcatatgtattagctaatttcgacttatctcttaattcttatacccctttctcttgattcatttgtgatactaactactaataataagttgtgacgtaattcaaattattgttgatagctgataatttgataaattgttgattttatttctctttgttaaattatatatttttcgagttattattcatgtgagatccattgggtacccgctgggcatacccgtgcccgcatgggtacgggtacagagttttgcctgctaaccctagtgggtagggtttgggcgggcgacgacgggcatggggtcgggcatggttttgctctacccgtgcccaacccgacccgttgccatccattgacagccagtgaatgaaccaatggcttttcttttctttttctttttctttttcacggtccagtgtccggactaatcgagagggctggacgaatgaaacatgccacgtggaccaatgaaacgctagaagaatggctagctttagattaatagaagagatgagacaattgcacaatcgacgctctagctgaatctcacgggacacgtggctggttttcaaaggagcaaaccctaaaatcttagggagccacgtggcccaatcatatgcttgattttttaccttgaattcggtatattagataagatttgattcttttaatgggacatgctgctatgtggtctttcaggcttaaatctgaactactgatgccacttgaactgctgctaatttcctgaggttaatttatcaaggtcacaaactaattctaactaggtcataaactaatgataactattcctgtataaggttcatcctgtagggtcttcattagaatcttacatcatatatactagcttatgttgtcacacatttgcgcgactcttgttacgtgatacgtgagtgtcaatcaatctgttgtttttcttgttgctagtaaaatataatcaatctgttgtttttcttgttgctagtaaaatattgggtcaggatgagtcatagtattatgttggtaaagtagatggcttaatatttattgtaaattttaataggtatgagacatatgtatcaccctttattcttcacttattttctattagtgcgtacccttttgtgactcattgtcatatattttgtaggtttttaaggattagtttaatttctatttttaaatttgtgtgaaaaatcattaagcctatattcaggtgaccatgactcattattggaaggaatatgcatgtctcagtagcaattttttttctcaaatacattaacaacaaattgctagaaacaaaaataatcacatgaacatacattttgaatatgccctgaatagctcaatcttgactaatgaatatttagttaagggaatgagggtgccttttttcttccttcatttctttctttccacttctagtagcttcatctcctgaagtctcttgaatgtgttcttttgccatcatttaatccaatggtctaagattcattcactcttttttgtcttgtagtaagttcaatggctaatatttaccaaataatgtggctcattctcagtccactttggatgtcacttttcactagttaagatataaatagctgtgatgggctatgagataatgagatgtgagacggcgaatggaatatggagggtttgcatagggattggggataagatctgggcccttggattgtgaacctatgattcaagatttggaagattagagatccaatttattgtgaaatttatatcctctatgttcccaaatataagcaaattttaggattcaaattttatacacaaattgtttttataggactatgattccaatacatgaaaataaacattttcaaccaaatattccgtttgtccaaaaaaaaagaagtatgattggatgtgacgtaatctagtcctcgagccccgacatgatggtcagggtgggagacggggattgatagagaaaataacgtggagctgagacgggtggtggaggggggaggtgtgaagttgtttaaataaaaatgaaggggtcgagtgggctgaagttgtttgtagcgcatctgtcatctgtctcgctcacaatacgggatgtgggtgttgggtggtgccgttcgcttgtcaccaaatcatgccatcatgatcagtgagaaggtagctttaaaatagggagtttataggtagttttgtctgaaatgatattatagtgataaacacaccatttgagaataatattttgataaaaacctaatatatcaaaggctaagggtgaatgcgtttggtagaggggagattttaggagggatctcctcttgacctggataatggtgagttggaaaggatttcatcctctaccctatctaaataaatcttagcactatatttttatttaaaaatacatagtctaaactcaatattatttctaccttctaccaaaaatacaagattaagattgaaaaataaattttcgtaacaatcatacgatcaatttcctcataaaaaactcccaatcctcgtctcaatttaccaaacaagcccatgcatcaaagcctccaaggcaggcgccaaccccagcccgggaacatcttctccggttctccctcaccgctcactggctctcgtctctcgccgccgccgccgccgccgccgccgccgtcttgccctcaagcatccgggttcgccgatcgccccacttctcccttcctccctccgccagcgccacctccgcgctactgcctcctccctcctttctcgcgcccgcgcctcctgaaactgggatcccccaatggcaatggattcaagtattcaactctctctctctctctctctctctctctctctctctctctctctctctctcggtgaacattggggccgccatttgccaaagatataagcccgagaggttcagcttctcgtagaagctaaggctgtgatgcgactgggcggatggatgctccggccactgaaccgcggcctcctcctccccaccttgtcctgcccagttgccccacaccgccgtgggttcgcagcctatgcagcagcgctacagtggctggaggacgagctcacctcgctcgcgatcctcccctccgtccccggggtggactccttcgcgtgcgccaggcagttgcagggctgcatcgctcgtggcgacgcccgcggcggccgcgccgtgcacggccatgtagtgcgccgcggaggggtggggcgcctggacctcttctgcgccaacgtcctgctcaatatgtacgggaagctcgggccccttgccagcgcgcgcaggctgttcgaccgaatgcctgagcggaacatggtgtccttcgtcacgctcgtccaggcccacgctcagcgcggtgattttgaggctgccgcggctctgttcaggaggctgcggtgggaggggcacgaggtgaaccagttcgtgctcaccaccatgttgaagctagctattgccatggatgcggcagggcttgccgggggtgtgcactcatgtgcgtggaagctgggccatgatcacaacgcctttgttggttcagggctgattgatgcctactccttatgcagtcttgtcagtgatgcggaacatgtgtttaatgggattgtgcgtaaggatgctgttgtctggactgcgatggtttcttgctattctgaaaatgattgcccagagaatgcctttcgggtcttttccaagatgagggtgtcgggttgtaagcctaacccttttgcactaaccagtgtgctcaaagctgcagtttgcttgccatcagttgtgctaggcaagggcatccatggttgcgccataaaaacccttaatgacacggagcctcatgtcggtggtgctttgcttgatatgtatgccaaatgtggggatattaaggatgcacgtttggcttttgagatgattccctatgatgatgtgatacttctgagttttatgatatcccggtatgcacagagcaatcagaatgaacaagcctttgaactgttcctccgattgatgcgttcttctgtgctgcccaatgaatatagcctttctagtgttctgcaagcatgtactaacatggttcagttggatttcggaaagcaaattcataaccatgctataaaaataggccatgagtctgatctttttgttggaaatgcactaatggatttctatgccaagtgcaacgacatggatagctcacttaagatcttctcatcattgcgagatgccaatgaggtgagctggaacacaattgttgttggcttcagtcagtctggtttgggagaagaagcattgagtgtattctgtgagatgcaagctgctcagatgccttgcactcaagttacatactcgagtgtgctccgggcttgtgcaagcacagcatcaataagacatgctggtcagattcattgttcaattgagaagtccacatttaataatgacaccgtaattggcaattcacttattgatacatatgctaagtgcggatacattagggatgctctcaaggtatttcaacatttaatggaacgcgatataatttcatggaatgcaataatctcaggatatgcgcttcatggacaagcggcagatgctctagaactttttgacaggatgaataaaagcaacgtggaatccaatgatatcacttttgttgctctgctatccgtctgcagtagcacaggattagtaaatcatggattatctctgttcgattctatgaggattgatcatggcatcaaaccaagtatggagcattatacatgcattgttaggcttctaggacgagctggccgtctgaatgatgctctacaattcattggagatattccttcggcaccatctgctatggtttggcgtgcattgcttagctcttgtataatccataagaatgtggctctgggaagattttctgcagaaaaaatacttgagattgaaccacaagatgagacaacctatgtcttactatcaaatatgtatgctgcagctggaagtttggatcaagttgcccttttgaggaaatcaatgaggaatattggtgtaaggaaggtacctggtcttagttgggttgagatcaagggtgaaattcatgccttttcagtgggatcagtggaccatccagatatgcgggtgataaatgcaatgctggaatggctcaatcttaaaactagtagggaaggttatattcctgacattaatgtagtgttgcacgacgtagacaaggaacaaaagactcgaatgctgtgggtgcatagtgagaggctggctttagcatatggccttgtgatgacacctcctgggcatccaataaggatattgaagaatttgcgttcctgtttggattgtcatactgcatttacggtgatatctaaaatagttaaacgagaaatcatcgtgagggatataaatcgcttccatcattttgaggatggaaagtgctcatgcggtgactattggtgatcttctgttgttccttgatgtgttaaaggaatccatacaagttatatgtgatataatgtgtttggcaaatggcaatcttctaggaaaccaagttatcatgcatgctctattgttttgggtaacatggttttgaacttgaactcgtgcaatttcatgctattttcaaggcactggagaagagatatcatatcagactgggctaccattccgaaaaaaaaaacccattcatttttaatgtttagtgttacctaagcacattttcgttattgacttgaatactagtgaatgtcatctcattagcaatagaaaaccttatggctgaactgaattggctgatatttttcgttctctatgatttcatcaagttggtagatagccttttgtttaagtatgttctagtgactgcattggaaaattgacacttgcaccggccttcgtattgatagtaattagcatagttcatgctatgacacaaacattaggccatgcaagtggttttcatgaaagagctttccattttctaacgtttatcttacatagttttgttagaattgtaggggggttttagttataataaaattggcagcgaacctacaattaaagcatcggttgattttcttgagttatagttaaagcagcaaacctataattagttatatactttgagttgtttaaataaatatcgtttgattttcttgtgccattgccttgacatcattgtgccgcattatcagttcagtcacacttcacactgactaggtgatagcgactcttctagcactagctaatggggatattaagtgtaatgcaccctgactctgcttgctgtgggagaccaggagttgttttatttttctgatcttctcaagattgtggcaaagcttgctaaaggagaaggaaaaataatttcttttgcctatcttatatgatataaactgcttgcccttgttaaaataaactctgttctgcaggtgatagttgggcaaggcaaccataagggtaaaatgcagcctttggaagtgaaacgagcttgcctactggcttattcttaggctatataaccttctactacctccttatggaagctgagggattgtttgtgccggatcatcctgtaattgctcatcttgtagagatgaagagtattgtagaaaaggtttgttttcttttctacaacaaccttgtttctttaatttgtatattttctggaaggagttaatgcagtaccaatttcaattaatactatgattttttatcattgagttgattgcaaatatttgaataatatctgatattaaacgtatcattaaacaggccaatatatcttccaagacaacaaggagacattaatgactgttgtacgcctggtagcagtaccatggatgtgctagacaagataatttttttggacaaggacaatttactagtacgggataagataaaaataggatctgttcttctttactttactataaagtacaaacatgataattgaagtattctggtaactcatcatgataatttttattcagcgtgcggaagttgctgaattgacaaagaatgaccattctaataaggcttagaatgaaattgacaaaagaaaggacaaggttgaactgaaacaacacttttgatatattttagcattttgtttcgaaaataatgcagatgcacaaaagctgaacaaatattaaaattctaggatgagcatatcagctcacaaagccttgaaatgttggaagtatgagcaacccttgaagaaaaagggctctataatttcacgcagttgaagcctgagaaggtttcaaacaccaggacaactcctcataggtgagtcattagttgtgccatctctttctcttttaaacgacacatttaatatatttggatggttttagcttttaaatgcctttttgttaataattatgagatacctgcaaatgttggatgattttgatgatgatgttctcagaaatagacaagtaaccaaacctagcaaggtcctggtagcagtggtaaaatccaataaaaataaggtctgtatacatttttttaatttttttccacctttctttaataattttatatttggttggcttctttcttagtttctacaatttcttaaatcttgtgataacatgtaagcttgaaatgatttaaagtgtgccaatctaaccgaagccttctattgagatgatggaaatacagagctacctccaaaactgtagaaacaaaagtacttatgccatgcatttttttagagttactgtagaatattgatgtataggtagtttactgcaatagaggttcaaatatcatacttctatcaagttacccaatttgacaaacatttttttttaaatgtgacagtagattttggtccctggccagtggtctcagatgagaaaactgctatttcatccgtcacaaaatgtaagcattttttaggtgggcacgggtattaaagaagtacttcctccgtttcatattataagactttctagcattacccacattcatatatatgtctagattcattaacatatatatgaatgtgggtaatgctagaaagtcttataatttgaaacggagggagtaggtgagaatgattcgaggaatattgtgattgattgagaagagaaagtagatgaagaaatcaaatgaagaaaaatggttgtgattggttgagagtagggtaggtggaaaaatagctttcattttgggataaggtattgtgctagaaatagctacatttcgggacagaggtaacaaaataaaatctttgacatcagtttgttcagaatgatctgagaagaaaactgcgagaaaacgttgcttgagtttgcaattaatgttgtatttctgaggcagtgagatatctaggtatacattgccaaagtgtagtaggacttcacaaattgacagaagagaactgaaattttgtataagacctggtcataattcgtgtccattcttgtgaatatttgaagatatctcatccttgaggaagcgtaataggaatggactctgctgcatttggtgccttttgtccttgaaaacttggtttagctatgtactagctagatctaataattagctttctcaaatatgcagtaccaaaatatattggatattttcttcttgtattatttcaagtcattcctctaatggttgtctcgctgctatgctgttcttgcagagctgatgtgctaatctgtcatattaactcaataacatctgcgtgtgcataaattgtgttcaatattctttagaacaaaaaaaaatgtagttattcttgcctggttagagatagtctgaaatatgtaattgggttacagttttttaaattgctggtgaagtggtgataccgtgatatttcttcatcagtggtagtgtctggttatcactgccatgctcttgcatacaagataaactcttctttggtgtatgttatttgtggttgtgacagttgcagctgtcagatactcttttctgctctttattatctgtttatgtatctccagttcgggtatagtctttttctttggaataaaaaatgtaggcacccttttctggttagaggtatgtctgaatatattaagtatcttatagctttttggcaaaagttgcagttttgaattttatggtggtgttaagaaaagtatcaggtctttgtgtctgattcacaccaggccactactattctcttgcataggagtacctatttagcacatgcactttggagttctggatgtcaaatgcctacgttaattgtggttacgacttatgacagttgtagacttgcaccagctgcttacctctttcttttttttaacctgctatgttttcaagtttgtccctggtgatgatgagcttccaaagcgagataatattggtgaaagacagtgaaaatacgaactacatgttcttgccagagtagaagctagtacacttgaagaagatgacttgcccaatgaagatgcccatactgaagggaagcttaacattttcaatccaaaacaacaggaacagaaacatttccatactgaagtgaagaagatgacaatgatgatgacattggaccatcagagtacaaggacattaaaaagcatgactgaaaaactcgagcaaagaacagaaatactcaccgtaagttccattgataaaaacttatgaagattgattgtttccgatcaaggttcttttggcaaggggatggacacaaaaggaaatatagactagcaaggtgggacatcatatgtcgtcctaaagaccaaggggggttaggaattcaagatcttgaaattaagaacaaggctctccttagcaagtggttgcataaactactcactacagatggtgtgtggcaacaaatgctaaggaacaaatatttggggtcacagcctttgtctcaagctcagtggaaagcaagagactcacacttttgggctagtctaatgaaggccaagcttaattttcttaggtttggctccttcaacatcaaagatggctctcaagttcggttttgggaagataaatggttggggaatgcctgtttaagggaacaatatccttgtctctataacgttgttaggcataaacatacaactatttcagaaattttccaaaccagtcctctaagcttttcttggcgcagggaccttactggctttaagttagtggcatggaatcaccttctctcacgcatcgctaatattatattatctcacgaccaagatgagtttaaatggaatctaaccactgatggcagattctcggttaaatatctttatcttgcgttggtgcagaccgatgttcccaatataaacaaaagaatctggaaaatcaaagcccccctaaagattaagatcttcttatggtacttacgtcgtggagtagtcttaacaaaagataatcttattaaaaggaattagagaggaaacaagtcttgttctttctgccacaaagatgaaactattaatcatttgttctttgattgtcgttttgcctgcacagtttggtctataattcaattttgcttcgaatattagtttacctaatagtacaactcatatgtttgggcattggataagaagacaaccacgcaatttgagatctttggtcttattaggggcaactaccactatttggtctatttggctttgcagaaattatgtggtttttgaaagaaaaaacatatcttctcctttgcaggttatctttttgattacacattggctccgcttatgggctatccttcagaaggtcaatttgcggggtactatcattgcggcttgttaacaattggagctagtggccatggagttttctaccccggtgcatgggtggtgttctagactacggttagagggctcctgaagttctttttgtccctgctatttggatgatgagtttatcttttgtttctttcttgttggctgtgtgcactctttgggtgcagaagccggaggtgctcgcagaataattatatcacttgatagagttttactaagattaataaagcttccattatctaaaaaaaatacttattcgttgactgtattacagaaaccccattactcaaccgctggaggaagaagctgaaggaaattggcaagaggaagatctcataccaggttaatcctccactagtgtacggtacaacctttcacaatttttattttttttatatgtgtggctaattaaatctaaactcctccagatagagaagaaaggttaacctgcacaagaacaaaagcttaagaatccatggaagatagggtaagtaataacataatatatgagacagccgagctatgtgagcaagtcattcagatgcactcgcttgtgtgtatgatcgttcaagctaagcatcaaaccaagcttgtttagcggggaggtaagtgcgtggcgtcaaccgtggggtgaatgtccggcatcaatccaaatgttagccatagtgttaggtttaaaggttgatggatcctgcatgatgaattgattatggtctaacatgatatttctttgatggtacgtagttttcttgttaagaattttttgagagatcgcacacatgatatttggaggttcaacgtcatgcattaaaaaattgtgttatgtgctatggatgcttagttctcactggtggagaaacctcaattgtcccagtttacaaccccctatatcccgggttgcaaaccgggacccccaaattctagactaaagatggtatctttagttccggatcaaatttgatcaagtttatagacaaattagttttattaaatttataattgaatattttttcataatatatttgttttggattgaaaatgttaatatttttttctacaaacttggtagcagtttgactttgaccaaaggcaaaacgacttataatctaaaacggagagagtagtttatatgggtttctcattgttttgataccctaccgatggagtagtgcaagtgtagaaatttatggagttaccgaaatttggtagtggtaaggttgtgatagttgcaggagaaaattaacaaaatcgaaaagatacgtagtagataaactcaaaagataggttcgtattacacccattacacccatcaaaagataggttcttttttttttaaaaaaaaacaccttaactatggaactggacattttaaatctcaaccattcaaaccaaccaaattaccttcctaagaataaagtggcattcataattttggcatccaaatgtattagtttttctacttagatttaactactttttatatcttttctaactaagtgccatataagtacgaaaaatatactcgctctgttccaaaataaaataaatggattcctagaatcccaacaaaactttagtagggaggaaatgaccatgcacctggtggtaggtagcaagggataaagtttttttatttgcagatcgggggtatgtaagaaggtaaaaatcaatttattttgggacaaaatttttaaactttaggaactaatttattttcggcttgtttgataacttgagggaaagagattgggagtttacatgagggaattgatgatgagattaagatgggaatttgatttttaatcccaatattttgtttggtagaggtgatggaaattgatagggagtttagttggagattaggtcattaataaaaacggatggctgagatttgcttagacaaagtaaaggaggaattccctcccaattacctgcccctacccaggtattgaaaatgaggtattgaaaaggagggggttccttcctcaattccccatccccatcccaccaaaattcccatgtctcccaccaaataaaacacttaatagcctcatttttctatattcccaatccctcctaaaaactccctccaaccaaacggaccgtttgggatggagtcgaaaacggtcggaaacgatcggaatcggcagcatcttttcagaaacgatgctcgaccggccggtaattgaccatatttatcatttaaactactcagtattgacattaatacggtgtagaaagaattgtgaaaaaacaacatttaaaaatagccaaaaacggtatggtcagaaacggtacctcttatatggaaacgacgctcagtcgatcgggaatttccatgaccgttttcacccctagatagagtataatatttggatcttaaaaccatgaaaccgctgttaaaattgggttttgttgccatttgtgtgtgtgcgcgctcatactttcggaaaaaattttaaaaaataatttgttggctatattgttggtactatgaaacagaggatcgaaatcaaaggtacttgctatactatcaggttctctcatcaagtatcaattaggtttttttctatattttagtaataaaaagttaataaataacaagaagacctctcttttagaaactcaattatattatgtttcatgatttaataatcaatgatatgatattatttaaaaaaatgtaggctagttttttaaaaaaaacaaaattgtaaagtagtagtaaaatcttgagattggtctatattacacccttaaactactggttttgtttttaacaacgaaactagacattttacacccctcaaccaccaaaatcatccaaaataccctcccaaaagtaattttagttttgatagtgtttcttacaattttactaccgattcaacttttctactatatagccaagcccagccaaaagattattatacacacccatataaaatcatgagtaaattgcatattgggctcagtattattaccaaagttttactttgggcaagggtatagcctgcattttcactttggactagagtttctttcctttggttgcacgttgggccacctttctcgtcggccggccaggcactgcgtgcatcccaccattgctggcagtggcaggctccaagggcagccattattgttgctgctgcaaggtgtgaggatctcctgcacatgtgtaggaagaggagaagctccgggggacagccatcagggtggtgaggcagaggagctcgtgcacagcggctgggatggcagcaccggcgacgctcgagcttgtggtggagcaaacggagtttaactaaccttgagggcgagggacacgattccttttgcatcatccggtcaggtccattggggattggaggggattatcgcaatagatgtagaattaatcctctccaaatccccctcaatccacttgtgggagggggccttagagggaagcaacagcaggttgcattctcatgcatggaggagtaggagcaagggggcggaccgcagctagaatgatatggagatgaggagctcaagcaggaagccatgggaggctcgtgggagttttgagttccttggccatgaagcgcgagctcgagctagcccagtatctcttcttcgtatcaccaggggacacccggcttggcattctaccccttgtgcaatgctgagcagagcagtgatgtgctcaagcatcgtccctcacttcctccccaagcagtcattggatctagaccacgggcgaggagaacggcagggattggcggcggtggtgatgaattggaagcagagaatgcacggctggagagattgagacatggggtggcctaaattgcaacaaaggcgatatttcctagtataaagtgaaaacattggctcttctcttgtccaaagtgaaatcttggtaataataactggcccaagatgcaattcactctaaaatcattgtcataactaatactaggtgacacctcatgctttgctacaaaatgtatggataaatatgttaaatattatacaaatgatttatgttgaaataatatgaaaataatgtgagaaagatgatttgaaatattgtatgttgagttccataatattatattctagatgatgtgttatttttgcatgagatttaagatttctagtagaatagtaatagctagtggatgatgaagtgacatacttgcatgtaataattgctagtgagtaccaactatatatagaaggtatagatttgttgatgaacaattgaatttgcaaatgacttatttaatggaaattggtttgaaaatatttgtcgatattggtgtaagtatgtgtgattaacacaaatcggattgcgatatctataactagaaacaatttgtgtgcagatgattaaggatatttttggtcaattgcggtgatcgggactagcatggataaaatgtcatatgacaagattgaactaaagtcatgagacctcatggtcaatctcggttaacagcgggatgatgactacgctcagagaaaccgaggtttagatcagtcaaggatactaggtgataattttggacataagatgacatgagggtggacacatgcgggggaggagtctgacacagtacgggtcggtctagattttctatctatggctgcctttccggagagagggttttgaatttgggaaattgtaaaaattttggataccaagggattgagttatagtgtaaataggagttttcccttaaaagaagtgtaaataggagcttttgtgatggaattactagttatagatagacgagaggtttaactcaacacatggataagcatctagagttagagagaaaagttagggttaggattaaaaggggggcgattgcatttttgaccttgttttgaattcaaactactaatttgactctacttttttaagtttgctcatttgaccctcttttttgaaaatgaaaatcagatctgaccctcttttgtgaatgcaatgtaacggtgttaacttaggtaaaaaaagacgtttacgcccatgcttatttgaccatattttttctcaaagtttttgtttatttgacccagttttctactcattatatatgatgaatttgaactaggtatgacatatttggcttagttttcatttgtttgacttagatttgaaagcattttaagaaatttgacttagatttgatatatttttgacccatttgaattagtttgatatatttttgatagatttgacttagatttgaaaaaaaaagtgaacatacaaaaaaattgacagcatttatttatacgcatacatccgtcccgattaaatcatttctgtaatatttaacatatatttatccatacatttcgtagcaaagcatgaggtatcacctagcgacaatgattttatacgagtgtctataagcttttggctgggcttggctatagtagaaaagttgaatcggtagcgaaattgtaagaaacactatcaaaactaaaattacttttgggaggtattttggatggttttggtgattgaggggtgtgaaatgtctaatttcgttgttaaaaacaaaaccagtagtttaagggtgtaatatagaccaatctcaagattttactactactttacaattttgtttttttaagaaactagcctacatttttttaaacaatatcatatcatcgattattaaatcatgaaaaacattataattgagtttctaaaagagaggtcttcttgttatttattaaattttattactaaaatatagaaaaaacctaattgatacttgatgagacaacctgatagtatagcaagtacctttgatttcgatcctctgtttcatagtaccaaaaaattattttttaaaaaattttctgaaagtatgaatacacacacacaattggcatcaaaacccaactttaacagtggtttcatggtttttagatccaaatagtatactccatcccaaaataatgtagttcctaaagtttaaaaattttgtcccaaaataaattgatttctatcttattcctatccgctatcctattcctatcttgggccttcttttcatctgcctacgtctcaacactcaggccttcagtttcttttcttcttttttgccccatccctttttaaatgaacaaaaaatttaatgtttatattaaaacataatatagattaataatacgaatctttctaaatatttgtaaatattttgcaaaataaaaacgatttgaaaatgactagcacacgtcgctggttatttaaaaagacaggtgattcctcgcgctttgctgcgggaattactaagcaattctcaatatattttttcgacaatcaagttaggagtaaaaaggaaaaaataatgaaacatcagggcttatcagtacttattaaaaaaacaaatgatactcgtactttaatgtgaaacatattaataagtatacattaaatattataaatttattagaatattatgcaaatgatgtgagggatgattgttggatatgcttgcatgaggttaaatatgtaattattgctagtgggtgatgatgtggcatggttgtatcttgagttttagacttagtgggctataactttatataaagtatagatagggagtatttgttattatttattagttacccatacattagaacattaaatttaaaaggaattgtgcgacaattctaggttatgagtggtaatgctcgtttctagggcaagacaatctcaacgatccacttccgaaagtatgttttgctctccgttgatttttcggattttctgaagatggctctcaaaaattccgaaatcacaaaaattcaaaattcggtactgatgtgttttcagatatgttcaaaatgaaattttgtaatttctgaaattcattttagccctgtttttggagatttatatattttcaaaaatgatttttggaatttttgaaaaatggaatctttggttccaacgggtagatctaaggttgtggttataaatagtttcctccactctcaagttttggctactgctccattgaatatttcatgccattgacttacattgatttgagatccattttgagccttgttttctcactttccctctcctccgct

SEQ ID NO: 80708 - DNA, 506 bp, Oryza sativa
aaattgacaaaaaagcattgttttagctcgtctccgcgcttaggcgcctagcccattaggcattagcccaagcatctttctggattcaggagagctcttgtctactccgttctctagcgtacaaaaagcatccgcgaggaagcgcatccatggtagcggcggtggtggcaacaccgacgagatcggaggctctgacccttcctccgcatggcatggcagttatccaactacaacatccacgagtacacgcgctgccgtgtgcagcggatgccttctgcgagaaccgtgcccttggcgacggcgttcgcggacgggaagaagcagctggatgtggcaaaacggcatgcggtggtgtactctctgtacgccccaaaggccaagagcatcatggagatgaagctacagtgatcgacgagagaggtttcgtgcccttgcttgctctacaaatactagggatttctttctgcattgtttatatcatcatgtgataggttcgagggaaattg

SEQ ID NO: 80709 - DNA, 2064 bp, Oryza sativa
aaacacccggggcggggtcggttggagccaaaccgggttcctggtaatgcaagaacgagaagcttgttgaattaccgatcgaggtggttggagttggatttgtgaacgcctaaaatggcctatgtttatgtgaggatttgatccttctatgtggcatgaggtatccctgggtcggcttgggaaaggctttgtcgcgaacctctgacaccggccagtgtctggagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggatgacctgagtggtcagaaacgaatctgtgtgattcgggatgtctgtgggcatcatagactaggcttcccgagtgtaagcggattgttgtgctgccgggcagcaggactctgggagtccgagaaaatgaaaaaggctctgggagccgattaatcaagtggaatggctctgggagccgagaagtaatgatctgacccgggaggtcggtacattactgatcgagctgttgaaaaacatctcttaaagacgaatcgagacgcaagtctcttttcggcccaaacttaaaaagaaataaatcacttagtgatttcaaaatgtcttcaaataaaagatttgcaaaacaaccttgcctctcttccaagcttgcattaaacacctaagttcccgtgacttgctgagtacgaaagtactcacccttgctctatataaatatatatatatagttcctccgtcgtgaagagaagacaaagtgaagtgaagattagggtttcgtcctggttcccagccgtcgcctgtggtgttgggtgttagaccgttggttcccctgctgctgctattgttggtgttcgcctcgtccgtgtcgtcggttgcattctcgggctgtctgagctacaacctaagttaaggtaaataagtcctctatttattttaaggattgcaatgattcatatttgtcaccgtgggtaccagcgctatgtcctgggactggtattgagatcgcggtttcgtaggaagcggttcgcgccgtttttcctacgacacgctcctgtcaggtgccgttgtacggcagtgccggatcggggtgtgacatatttagatcgtctggtaaaattttacacgctatcacatcgaacgtttggacacatgcatgaagtatttaatacagacgaaaaaaataactaattacacagattgcgtgtaaattacgagacaaatcttttatgcgtaattgcgccatgatttgacaatgtgttgctacagtaaacatttactaatgttgggttaattaggcttaataaattcgtctcgcagtttacagacggattatataatttgttttgttattagactacgtttaatacttcaaatgtgtttccgtatatccgatgtgacacgccaaaactttacacccatgtatctaaacacaacctttatcccgtcgatagcgaggcgtctgtgatgacttcgtcaatctctaggatttgccgacccagtcttcgaagatgctcataggggtagggtttgcgtgcgtgtgttcacaggggtgagtgtgcgtgcgttgtgggtgtcttgtgttgtactgcgtaattcttaaaaaaaaatgaaacttttaaaagttttatgtcagcgggtttatttccaaattcataaagaactagtactcaaaatgttttgagatgaattatggggcaatggggcttctgaagaaaatctttattattaggggggttacactaggctgtgtttagttcctttaaaagttaaaagtttgatttgaaattgggacaatgtgactgaaaagttatgtgtatatgacaggttgatgtgatggaaaaagttggaagttgggatccaaagtttgatttaaacacagcctagcaaaagtgcagaactcccccgttttttcggtgccaaataaaaaaaaaaacccaccgt

SEQ ID NO: 80710 - DNA, 536 bp, Oryza sativa
ttctgcctcccgtgaactggtgatttacaattacaacggtgtaaacattaacctttactataatgacattggatccacattttatagatacagatggacccatttgtcattcactcagagtgtcaaaacagcgaagcctctatgtttgcaatcccaatattacaattttctccccattttctccccgtgaactgctactgctactagtattagtaatatcattatctggaaattctaaagcggcattatcacactactccgcttctgctacacggacgtttaacgatcaactaactgactgactcaaatgaatttgcaacgaaaaaaaaagaacagtacgacttcgagggcaggaaggacctcgtcaggttcgtgaaggccgtcgccgacgccggcctctacgtgcacctcaggatcgggccgtacgtctgcgccgagtggaactacgggttcgcattcacatctctctcatgctctcgcactggctatcgctgggcgaattgatcgatagattggtaagaaacgcaagtattact

SEQ ID NO: 80711 - DNA, 654 bp, Oryza sativa
caagagagattcttggccttccaccatagtattttagttcctgcagaagtgttggggacttggggtttagtgtcaggttgtagagaggacatgtatatcggcaccacactagtaaaggatggatggtttaattattccgcaccaattttatcattgatccagcttacatttgagtgcaagtttccactgtgttcagtgtgcaacctgttgaaaaatttctactactaattcattctattttacactgcagtaaatatagggaaaatgagtatctctggcatcaatctggacgaggacgacgaaccaagtggagacaactaaaagcagaggcacatttgtcatggtgtggtagcagtggctggctggcccttgttctcctccctccttagcttttgaaacctcgcttttgaaacctcgaagaagcgtgactgtgtggttaccatcaaacgccaaaattgcatccaaaaattacgtataccttggacagtcgtctgacattctcagtaatctgctaatgttaagtcaatgtggtttgtggaatcgcgggcaagatgtttcaagaattcaagtactcctaatcaagtgtttagcgtaatgtttgttgctgcatcccacaaaaaccctggagggattgtacacttcggtttggttctg

SEQ ID NO: 80712 - DNA, 542 bp, Oryza sativa
aggacattaaatccactggcttataaatcatataagtcaataagttgacttaaaaaatctaggccaataagtctaagcctaaacaaagaaggtctgactaactaactgacccagtgattttttttttataaaaaaaggagcaaactgacccagtgatgaatgatcaaagacattgtccactcgtgcgtgcagtcgttagtcggctcgatcaataacttcggcgaaacatcgtcctcccgttactgccccaagagcaaggggcaagggcacgctgctgctactaggccatcacgctcgtgcttggagagttggagactcgttcaagtcctggagcttgaagccgccgagggcatccaactaggaacacgttgagtttcaaaaaaaaaaagtaggaacacgtctaaatacacgaagaaaaatccagaggataatgttgtgcatagccaatgccatgtagatgaggattgaggagtgtgacccggattcgcgtcggatatacacccgggcaattgacttccttttttatgaagaataaccagaaa

SEQ ID NO: 80713 - DNA, 1977 bp, Oryza sativa
gtctatccccaagaaagttctcctaaagattcaaaaaaataaaggactgatgctcagtgcaacaaattctttacagggctgtctcacaagtttgaatgtacttgagtgctcataatataatatttagtaaccgagcttatataatgatacacgaataatacatcacacaagatccaacattctgtaaacaaattaactacagcatataccggtaccatcatcagatagtgttaccagttgggagagatgtacatgaactatgaaatctgaatggatgcttaatcaactaatgattcagcttccataccggcaagcactagatcacataacttctcaactaaagtctacaaggttcggccagccaaacggcagcaacctccttaacctcctcgtttgacgactcatttcacacaggattgtgttcccatttcaacaagcaacaccagcggagcgcaatttttcgtcagtacctcacccgttacgcaactatcaggcgattttgcagacctcaagaccccccaaatcaacgaattcggaagcttgaacaggcaaaggatgcgggggctcaccttcctcgaccttcttcttgacgtgattctccctggcctcctgcaggtaccccatggtgcagcgaccaggcgcacgccgtatcggatcgacgccggcgagggcggtggccggcgggggggatcgttcagtcggagttaaaccctaactccctccttggaaggggacgcggacattgacggggaaggtctcgctgtgttttcccctgttcgttggtgggcgagggagaggaagtggcaaatgggctaaacttggtcgccccaaaaaggcccaattcatttggcccaacaggccgtgtaccatcagcctatatgggttttctcccctctcctcttcaccaagcaagttttgctgaactgttgaaaatggccaaagttctcatgaagcagcatagatgagagttgagaccagtagacaggtacagagtcgctgccaggatcaccactgaatcagaaaagatgtttctctgaattgttcaggttagagataggagttttttggagtgaatgctcggcgtagttagacctacacagattaatataactcatatatctgacacgtagccattcatgaattatggtagtataatgattatgtacctcctgatgaaataaggaatgtttcttcgtgtcactgtagtggttttcggttcttcacatgggacctgatgattggagattctggaattgctcgtagcttcaccaaatcgcacgagatccttacagctcttttgtaaggcggataattccaattcgttcaccatcaacgaccaaaccaggacaaaatcaaactagtactactactaatcaagttggtaaggagaccaactgacgatagcatccagccaagctcgacgcttttggcaccaacctacccttgtaaaatgccggatggcatcgccgtaggaggccgcgtgtttccgtactacactcaatgtgtttggtgaaaaaagaaaagcgtttcttgatgcatggttatttgacttaacactaacttaccaaggttaaaagcagatactactgtctgctactaaaatgactgcaggtgcatgtgttttcttacggatcaaggttgcagcagagccaagtcagaggtgtccactgcactagacatcccgccgaattcgatatgatactgaacatcagttgcgtttgaacacgtacgcgcatcggattctgatggttttgcggtagctgacgcctggctggagctagcctgcacgtagtgccgagacgtcctgcctgatcatgtcaaaaacaggtcagaatcaggatagtttccacaagaaacgaacccaaatcccatcggcgacagaatcacggacacaagcacacaactcgagctgattgctcactccacgacgggataagatcataagaagaaactgcaaattaaaccctgtcccgatcg

SEQ ID NO: 80714 - DNA, 19697 bp, Oryza sativa
ccagatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtttgggtcgtagaaacattatatggacttaaacaaggagaattatataacatgaagaaatagtagtacaatttgaacatgatacgactatttgcattgcggttacatagatgatattagattcgaactaggagggaggtagcgcaatagttgaacacaacgacgatgtagtaatgggacaaggaagcatgacagtagaaatttcaatatgccaagttgtccgataatagctaacccctacgtgaggatccctctcctctctgaaaccgcgctttagtaaccctgtattgctctggtagttcaagctgcacaacacggctaggtggagttagaacccttatggtgtctatccattctctgtattgacatctccttggtggttcctgggaggaaagactagatgtaaagcaagcaaagttagtaaatgttgtgagaaaataaggattcatgtaatcaaaatatttttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccacttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtattacgaagaataaagcgattgcccatacagaatgaataagcatatgcagataataaaatacctcacggtcatagttagggcacctaaaaaagcgccttcctcgaatatcaggattcctcgaagccattagttggcatcgatcactgcataggcagagaggacgctggcaccaaggtggtagtaggtatacacaaggatcgctacgccagtttggatcctcaacaccccggcgtctagccattgacgaaagccggttggatttgtaatgaagcaagtggggaagagagtactgaatgtgactgagttctgaaagattgtgaggccttactcgttaaggcgacttatataggcgcaaaaaatcgagtgatacccctgacatgtgaacgtggtggggtatggtgggtacgcctgattggcgccgaaagatacatgcatgatcggcgctgaaagttacattggtcgtatgcgccaaatggcgggcaaatactcgtatcacacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaagagaagactgctctactggccctgccccgcgccgcgaccacgcttggtcctccgggcctgtgctcgcacgtggtcctgggagtaggtgaaatgatccggtggcacagcacgggtagcacgagtgtcccgcggaggagtggcctgcgcctggtcctgcgtctacaccggcggtgcgcctcccagttgtgaggggccaatgacgtcctctgtcgagcctgaagcgaagtcgaagtcagtgatgttgaagagcaaggtggaaggcagcaagcggtccgacgaggtcccagcatggtccagtggtggaccctgactcgacgtgccggctgcctgtgacgaagtcccggtgtactgccagaactgcgctgagtgcgaggtcgacacagctgcctgagacgctgaccctgcagcctgggagaagtgggcggcctgcgtaatagcgaactgggcgaaacctacacatcgacaacgggacccttgtaagctaagacataaaatgtatgtaaattgattgtcgaagtaatgttgtttttttaagtacctgtggggggcacaacagaaggcctgcagaggaaggcggggtgctgaacggtgcacgaaaccctgaagcaatcggcaggtgaaacggctcacttatatgtgcgaggcatgtacagaaatagtaataaaaatacttacctccgtgcggagggggagtcggcctaggaatgtgcgcagctggatggggaccagtcggtacgggtggccgctgtacagctgcgtctgcccgagcaacgtcgtctgcacgacaggtgagcactcggagaatcgagcgcatcgactccaccatccgcatgtacgtcgtcaggtgctcctctatgggtactggaatccccgcgcctaaacgttggatcgtcgttgaaccgtcaacgacgacctggttgatgtcgtcgacctacatggttaatttgttcgtaaatattcgtaaaatttgacgaagagagagacatgaaaacataaaggaatggtgcgatgcagggtactcacagcacgagcgaagtcctggtcgcggtgcctggcatagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccatgacctcctcggttgcgagcaaccagtactcaacaaaagtcgccaacttggcgggccaatcgccagctgagtgctgacccttgcgcgagtacctgcgaattaatgtgtaatattagtgtgaaacgacagatgttacaaattattgtgaacaggcagattttaatgcaacaacgaaaagcatagtgcaagatcttaccggtgaacaacagctgggacggtggtcggaaacggtactggaaagggctgacggaagccgaactgccgtatcacgcggaaaggggcgtgaggctcaacgcagatgtcgaagaccatcggaaccgtagtcatccagtacgcctggtccctggtgtagagtgtggacagacccaacggcgcacgagcctgggtagccgctgcactgtagggtcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcatggtacagagccgccaacaacgcggaaccccagctccactgaggcacctcgcctaccgcggcgtcggcgatgctcctggtgtagtgcacgagtcccttgtcgacggcgtgcccgtgaccgccacagaacatcacccagccaaaaagccagagcaagtacgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaacactcacggtgaactgaagcagccacctcttcgtaggtccggtgttgcggtagtgtgccaacggctcgagcgggaggtgcggtgcgcgctgtactagtgcgaaacgtgccgtcagatcgtcctgccaatccacagccgtggtcactggcccaacagcgtctcccgcgagcggtagccccaacaaatacgatacgtcctgtagggtaggggctacctcaccgcacggcaagtgaaaagtgtgcgtctctggcctccatcgatcgaccaaagttgctaggagggacctgtccacagaccatcgtctggccgggtccgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaagataacttgcaaaattatgaaatagtaataaaatcatgagattaattatgtacaacaagattacaggctatttaaatatagcaaacgttactaatggtacataacgatgacgtgcaatttaacatatatgtagagttcaataatataacataacattacgtgtcgaagtccgacatacatcggcatacctaaagacgttaggcgccttagtccgacgttacatcacgagacctaaagacatgacatgccgaagtctgacattacacgacgaaacataaacacattgataagttcgaaacgaattacaagcaaatccacatgctgacatagaacataagaactacaccacgtagccagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcagcagcaatgacatgggtggatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactacagctcgatgtttcatggcctttttacgcaactcctctagctttttctgcatgaaagctccaaacaaaatgctattgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcataattccatatctagcaccacctgtgtcatacgccttggcccatttctcttttggttcatgcagaatccactgagaaaatttccgaatctccaattcagtttttctaaccaatgttgcactatccgttgggagaggtccaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctctttgttcttgaattgcttgaagaaattagctcccatatgacgcatgcaccacctactctgtacatgttcccaaacaccggggtatcctcgttccatactcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcggagaacaggacgacagttcacgaatgccatcttgcatgcatgtagagctaagaacgccctttgcagcacactcttgctaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttgccatagctaatagtatacttgtatgtctcttcgatgtgtcggattattgaccttggttcatatgtgagattatcgatgacatgcgcatacatctcagatgcaacaaatgcacaagtaatgttcctgtggtatttctgaacaccaggtagaaaacatgtatgcttggtaacgactgacactgtccaataatccttccatttccccttatacgcgtgcactctccagggacaaccatctttttccttaacacaccgaacttcatattgcgaccggttcgacttggcaacccaaaactctctatgaagtgacactacaaaatgttttaccgcctccttcatatcttctgctctactataaatcactccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgccaactggagctactacgcccccgtcctctcgtgcgttgacctcctccacagaagtctcgtttacttcagcacttggtccctcgccatcatccatgttcatctgcacacctggatccttcgggtgaacaaacggaaccaaagctagaggccacccgcgttgcaatgcattttccaaataccatctccacactcgagaggtttgaactggcattagttcccaataaaaaccctcagttgcccgacttactataacattgattgttatgtcacttgtctgtgatctcaagcccttcattaaccatccttttatggaaggtacactcctctcagccggtctatcaattcccctttctgatacaataaaatctgacagatctacctcagttggcccgtaacggacgtttcctggtccatggtaaacttggaatatttgtttgttcgacatatctgtcaacgaaataactagatcatattactctttcatgcaataaacatctacaacgtaatatcttcttttgtaagccaatgcaacggtaatgtattgattccaaactagcagatctacgtagttaccgatatctacaatacgcacttctagattagtacaactaaaaccctaaaaatataatgcatttattcaaacaaaattttaaagaatacacactatttaactcaatagtcacatataggatctatgaatattacctgaaattggcgtctgaatccggtagggcttcgccccttcttctcttctcctcccctctcttcttttattttcactggaattgaggagagaagaatgagggctgggggctgggcagcaggccttttataggcagcgaggcctgccgcccggccagagggcggcaaggggccgcctgcaaaatagctggccccgactggcttttttgcattcgggccccttgccgccccaccagagggcggcaagggttttcctgcaaaaaaccctccctccgtcaccgcccgttcctcccccgtttgccacgtcagcttgccgcctcagaggtgggcggcagggtctatttttgtaatttttttggccgatagattatttctgtaaatatttttttaaaaaaatctaaaaccgaaaaaaaattccttttcccctcctcccttctctttgggccgttggcccggcttgccccctccttcgcgcaagtccgtttcgcctccctcctccttcctcctctccccgagccgccgacaggtgggccccacctgtcggggtcacccccaacctccagcccaggccggcaactgccatggccgcctgagccgcccacgttgccgcccctcccagcgcgcctcccggttcccgcgcgcgtgtgggcgcggtccaccgcacgtcctcccctttatccactttctcccccattttcccccaaaaatcagcgccgttcgagccccactcacccacgtcgccggaacttcatccgccggccgttgccgcccgccacggccacgatctccacctcccggacctataaaaagcatccccggggccccctctcccatttttccccaaatccccaagtcgtcgcgccctccctcgcgctccccgcgccgagcccaggtgccgccactctccggcgaactccagccgcgccgcgccaccgctcccgttcaccccgcactgcgccgtcgccttccccggtaccgcagccgccgtgcgcaccccgtccaccgctccatttcccctctccacctccgaagtgccacagccacgcgcaccacctctctccgccgccgccgccgactccagccacacctcgccgcagtcctagtcgtcggcgcaccacgagacgacctccaccggcttcgccgtctcgagggcaagcccgaccgctactccatttccctaacccctcaccgaaactccacccccactgttaacccgaggccgccgccgttttgccacctccggccgcctactgccgccatccctgtccacctcaggctgtgccaccgccatcactggcttcgcggttgcaagggcaagctcggccacttctccatcttcgcgaatcaccgaagaaactccctcccctctgctcaaggtgagctcggtttcctccgccggactccggccgtcttttgccgtcgtcccgcgccacctccctcactctagctcccttctataccttccccaggccctgtcgggcctcggccgcgccgcggtcttcgccgggagtcgccgaagccccgccgagctgtctatccgaggagcccgccgtcgccgttcctcgccgccggccgccttcccgtctccttctcgccatttgtgcgggcacggtgagaactgcctcctcctcctctcccttttgccgccctcctcgcgccgtcctatgccgccgctagtcaccggtggtcgcgccgccgcgcgccatcgctcggtcgactcggctttgcgccgcgctcgtgcactagccgcgccgcgccgccgttctctcgcgtgcgccgcctgccgcccatgtgcgccgccgctccccgcgccgcccgccggtcgccgtcaccagagaccgcgcgctgccgccgcaccatggccggctgggctggtcttggccataccgtgcccagccgtctctcccctcagccgtccgatcggcctcgggtcgatctgggccacccgtgtgtccgcacacgtggccgccacgtcggtgccccgtcaacgtcacgtgtgcgccacgtggtgcacccgtctcgtgcctccgtggacttggtccacggtggaccgcccctttgagtcaccgacaggtggggcccgcttgccggcaccacctatcccctcggtgacgtcataattgattttaattgcgcaataaattcgttaataattatagaaattcatttaaatggttcaaaacttctaaaattcatatctaattcattcgaacttcaaattgagccgttcaacttgcaaaattcatctaaaattgagctctacatgtttgtttactttttatgtactgtttccttggtttttattagagtttttcctcattttgtgtgccagcgagtagattccgtcatttcggaagtccgcgatcgcgaggaaaagagttcggaagattcttttgaagaagcaaggcaagtcacacattccccttgagcatttttatcctaatttacaaatgttttatcgtttgcaaataaaattgcatgttttgctaattacatgggatccgggtattacctatctgctcgcttgtgccatgtttacttgatatctgtcctttgtcaaccttgggtaataaatcaactagctcatgttacttatgtgacctagctagacctatatgcttagccatgcttaattaccactagctcagttgatgggataatgacagtattagacccttttagtatcagaataagctgcgtgctcgagacatctggccatgcttcatagtcgtaattatctaactaaaatgcgactgaatggtgggctgtgggtgcatggttttgctagtcgcacccatggcaattaaggaccggttcgagggatgccctggaagaacttgtcgtacttaccacaagccagcgtaggcaacggctgggcttgtagtgtagctttcctctagctgacgcatccaggcaagggtgggcgtgatggagtttggatgggccctgtgacggcctatgcggcttccggattcacctaggcatgagaggggactgcctgctgccttgcgaggagtgggggtaaaacctgaggtgtggtgcgcttggttagagggggttatgcgaagggtcctgtcgcggcctctatccggtatgtcgtggtggcatgtcggcgcacggaaatgtgtcgtggggctgtgtcttgtgggtacagttgtacacctctggccagagtaaaactattcgaatagccgtgcccgcggtgatgggcggtcgaccagattcaccgtgattagtctcacacttaataaatcgactcaatgcactgtagttcaggtgggttggttgggactgttcaacgtggtgtagcgttgatcagtggagatttaatgttactttaattactcaacagttttactattttgctcagtaaaatgttttacaaccgcctttatgtaaatagccacaaaccgtccttttgttccccttgcacgtctgcatcattggtgtggcttgctgagtacggtggttgtactcagccttgctattattcccccttttcagaagtgtagtgcttctgagctgaagacgaagttagaggatcaaggctcagaccccagttgagttttgcctgtggagtggagctgaagccccgctaggatcgcctttttccgctgctgctgcttttgtttcggtgtgaggacaaagtgcctcttctgtaagtattttacgctttatttacgtttggaactgtttattacttgtcgttttgtgtaccctggctggtcctggatagggatttaatacacaaaatagtctagaaatttgggctaaatttttgggcgtgacgtgtataacatgcctattaatatgctctcgagtgataaatttcccgggtgatgtaaatagaatgcatctcatctgagtagcttatgatctgagtagttatccctcatgggacgcaccaaagtagatgcgaagttgaatcccgactggcgcaagtactcggctgatagccctcatggagaataatgaatagtccagtcgttgagcataagaaatcgactcatgaccatgaattcatgttgcatgtatccagaacaagtccaaattgaaggtatgatacttgtgtttgagctggtaagcccctgagtatatagcttgtcattttgtcgtagtcgaaattatccattgacgatagcatatgcagtcggcatggaaacgagatgaccaacatggggatgacatctcccattagagatgatgaagatatattggtggtagtaaagacagtgacaccaatcaaagatgacgaagtcgcacagctacggaggcgaagaaaccagtcaacaacagtcaggtcagccaacagtgaagatgaaggcgcccagcaatagcgacagagttgtatagccatggcggcggaacaatcagtcggtgacgaggcagccggtgaagaagatgaagaggcctattagtggcaatggcgaaattcaccaatcatgaagatgaagaaaatagtcggcgacggcaaacgcaaccgatggtaatgacgattagcaacaacagagatgatcaactatgatgacgaagtttcccatcaatagcagtagaataggctatgttgaagaggcttgacaggatgttgatgaagatgacgatatcggtgatccagtcaatagcggtgtagcagccaatgataatggcaaagatgctcatcagtgtttgcgtagtaggtaaactgtgaaggtgaaataacaagtcggcaatgacggaagcaaccagaagcgaatatgtgatcacccattagcaacggcggagacgtcagggccgatgaagtagaggtgctggtgatgatgtcaatgacaataatccaccaaactgctgagaagatatcgaagctcgagtagtttccttgatgcgagcgtgtgtataacaaagattgatgcaacgccccttgatttataaagatggcagtagaacttggtgtcatagctgctgcagatgcttcatttggaggaaagtagatgctgttgtcaaactcgtcgaaactgagctgattggttgataaccctaaactctcaaacatgtagattatctctcaaacttgatacttgagaaatttgaagtagaccgtggcatcagctgagagccagaatagtcactcaaaatgttggagttgctgaagtagaaagcttgctctgaagtgatgatgaagataatgactcccggagttgactcgttggctaattaattgattgcttcatcttgatataacaccagtcgaattcgaattttaagggtcttgtatttgtgtagcccccgactctttggttagttgagaaataactaaacatagagtcgagaactgtagcttcttgttgtcgagtagccattgcttgagtgaagatatgtgttgaagatgtccgagtagaaatcttgaaaattggagcaccacttttgtagtataataacacggaatcatatttggtaacgcatgccgagatgttgaggctcttgtagacgtcatggttggtgaagtagaaaatcttgcgaagtagaggcaatagaatttgccggtgctgaagacaatgaagatgaagttgccccataatgatgatagagttacattgccgtgatgacgtagacacaagccggtggcaacaaaagcaaaccggtggcgaagaccagtcggcgacaaaagaagcagatggtgaaaatagagacatccatgagcagcagtataataggccagccatcaaggcggagacaccaatcagcaatggagaaggcaagctggtgatgacaatgatgccattcaatggtgacgaagacgtgcagccgtggaggcgaagaaaccagtcaacgccaaacaaggcggccagcaatgaagacgaatgcgcccagtagttatgacggagttgtgcatccatggcggcgagataatcagtcggcaacaaacgggagcagccggaagtgaagacatagacgcccattaacggtggtgtgacgaaccaaccgtgaaggcgaagacacaccagtcggcggtgacagaggcaagccagcggtgaagatatagatgcccaacaatggtggtgtgaccatccaaccgtgaaggcgagcaaaaccaatcggcagcgacggaggcaagccggtcggtgatgttctgactgatccattcctaaagcgtaggacataagcttaatgccatgaatccatattatgcatatctggatctggatcctgcaaaacaaacatataggatgagtagtatctgatgtaaatacaatacttgagaaaaattcaagtattttaaaatgtttataaatatgtatttctcctcttgtcaattttgatttccccaagcagatgactccttacgtttaaacactttgcccgactagtcatagcccccacgcatcgggaatgagctaaggcacttcctagacatgcatatgagtgacttgagttcgtcattaatggaacaaagtttcacggattagaatttactacgcgggtacttttgcaatggttgagagcagaaaataaattatcttatttctgtgcttttgatttcttccgagtaatacttagcatcttgcattactcggtccatccaacgagcccccggtaggaatcagcccaaaggcaactaaccatcgacaaaccaaacgggaagcatagaaagatagaactccataacttgataggcactttatatttttactcggtttatttcgcaagcaattaagatagatattatgaaaattttttgaaaaaatatgatataacatctgtagcccccaactcactactcaatagagaaccaattgatgtagtgaggtagagaaaagaaaaatatcataaaaaaattgatgacttagctttttggtcttcgccttggtgacggcagaggtggacgatgtggaaacaaattcgtccatcaatagcaatataaacaccagccgtgaaggcagctgaggcaactagcggtgaagatgaagacgcccatcaacggtggtgtgaccatccaaccataaagacgaaggatccaatcgacggcaatgaaggcagtcgtcagggaaagtgaagacgcccatcaacggcggtggaatccgccaaccgtataggtggaaacaccagtcgtcggtgatgacgacagccgacagtgaagacgttgatgcccaacaatggtgatgtgaccatcaaaccgtatagacgaggacaccagtcggctgcgatgaaagcaggccggcggtgaagatgtagatgcccaacaacggtggtgtgaccatccaaccgtataggcaaagataccagtcagcagcggacaaggcggccggtcggtgaagatgatgacgcacatcaacggtgatgtgaccatccaaccgtgtaggcgagggcaccagtcggcatcagcgaaggcgagccggtggtgaaaacgtagaccaaccagccatgtaggcgaggtcactagtcggcagtggtgaaggcaagccggcggtgaagacatcgacgcccaacaacgatggtgtgaccaaccaaccgtgtagtcagagacaccagtcggtggcggacaaggtggccggttgctgaagacatggacaccaacaacggtggtgtgaccaaccaaccgtgttggcggagacactagtcggcggcgacaaggacaggcaggcggtgaaagtgaagacgcccaccaaccaaccgtgtagtcagagacaccagtcggtggcggacaaggtggccggttgctgaagacatggacaccaacaacggtggtgtgaccaaccaaccgtgttggcggagacaccagtcggcggcgacaaggataggcaggcggtgaaagtgaagacgcccatcaacggtggcgatgtccgccaaccgtataggcgaaaacaccagtcggtggcgaccaaggtggttgacggtgaaagcgaagacgcccatcaatgacggcctaataggtcagccgtgaaagcgagggcaccagtcggctgcaatgacggcggccggcggtgaagacaacgtctccatcaaaaatgacggcggagtaaaccaaccgtggaggcaagggcaccagtcggctagtgctgcttttgactcatcgtggccgaggaggaattataccaaacaaatagtttgtgtaagccttggtttttgatcgggctcagccatcgatgatacatgcaaaagtagaaaaaaaaagatcacataaaggaagctttttactaatctcagatgactacatcaagttgatagaaccatactaagaaaacttccggcctttgcataactaggatgcacataggcaaaacacacacgagcccacaaaagactttgtaataagagagggaaagcactaaaatttagggagcaccaatcttcaggctagaccaagcttacaaagttaaattgaaaaggaaaacaccaaaaacttgccagaagctggattcgtggatgattccacgatttgagaggaaaataagtttctgttactagattaaagatcaaaaagatataaccaaataatagaaccggagaggatgtctgacgaggatgtgcatatatacttaattgccattaaacttgtactgcatacatatgcatgtcgccgacttctctgtatgcatgcacgccaatttcttgctagccaaatagatacgggacacaactggaaatatggtcctctcaacgggtgatgatcacgtgtatagcttggcgtcaatcaatcatgttcggcttggaattgcagattggacttgaaactcgccgccgagtggttgtcatcctccctagccgattagacccgaatctgagaggcgaagcttgttggcgactcctgtattttattccatcccctacctggcgcgccaactgtcaaaacaagaattcgtcaataataaaagggggtagcgcacgagacctaaatgtggatggatgcggagacaaggatttagacaggttcaggccctctcgatgagaggtaataccctactcctatttggggatttgaatccgccgggtgtattatagatccgacgatctggttgtgaattatgccccatagagggtctcctgcccaccttatataggacggggggcaggattacaagatagaaaccttaaccaatatagtatcagtttcctaaatctactttacaatattatcaaatcaaaactttaggctgttccataatatataagaaaatgtaatacccaagtcatgatccgttacatatttcatagatataagttatcccctataaccagtcggataaccatgccgtgtgggtatagagtacccataatctccacaggtggaggtgctggtgatcggtggtggctgtggtagagcggaggaggttggaagacgaggttgacgatgttgaccctgtgtgacacttcttcgtcacctgcaactgagccccctagctctgtcgatcccttccgcaccaaaaattggtatcgcactatgccggtgtgcccaatgccaatgcatgtacgccctcctccacagcatcagtaagtctctatccctattatctgttgatcttgtggtgccctcctccatggatttaaatcttgctttgctacagcgcataagtgcataacagagtgttccaatttttgctcctgaaattttttagtggtgattctctcccatgttcatctgattggatctggtggtggcagtacggcactactgatatatgttagacatggatccttatccagccccctcatatgcctaggttgtttcaagatccaatttgcaagaaactttcctagattgctatttaattcatatgctttctcgttatagggatttagctacaaatagctgcaaactgcaatgctcatatatatatatatatatatatatatatacatatatataaactattctacacccggggtatagaatagctattctacacccccctccctccaacccacctcatctccttctaagggctcaaaacccacctcctacctcagtcaaaggctagtccaaggtcccccacatcggtcaaatctcggtcaaacccgccaatgacttcccccaccaccccctctcttcttagctctcgtatcggaacaacgtagtaacgtcttgtttatcgtgcagtaacaccgtgttttacttgcagtaacaaaattaaaattcagtcataatatagtcatgatggatctacttttgataagcactttttttcgaacatcatggtgcaaacggtttttaaaagtagtacatgatatgagagatattgcccttcaaagatttgttcttaaaaacttaactctccacgagcagtaatagtatatcaaaaggtgttactagtgcatgttttgcgttactgcaatcacatcatgtcgttactacaagatgtagtaatgattataagtttcatagtaacatagtgtgttactgcaattacttgataacatcactacaagaatatggggaattggttcggtttactcgtttgttttaacccatatatttttttattcctggtttactacaatttcatcacgatgttactgccaaattaagatgcagtaacgctctatatgtactacagtaataaagtttttttactacagttcttggatagtgttattgcataaacatgcggtaatgtgtaactatcaagtggtaacgtgtatctgctgtgcagtaacacttttacttttgtgcagtaacaagtatatggttagcatctgagactttgaacccatatatttttgttccaattccaggtttacaacaattcaccacaatattactgtcaaaagtgcagtaacgtcatatacatgcacgcagaaacactatattggagggtggagaccggttttcttgagaagaaggaggaagaacgatttcttgaggaggggagtatgtagatgcattttgaagtttaactctccacatgcagttgcactatagcattatggtggaaacggttttaaaaaataatgcatatcttgtgagatattgcttttcaaatattggtattttgaactttaaccctccacatgcagtaacaaaatgtgtaatatgcagtaacaggggcatatacatgcagtaacatggtttgaccaaatgtataaaattgttcaaaatactcctacatcaatcagacctcgctcaaagccaactacagactttacctatggcccacctattcaatcttcatcttgtaaaaatgacataataaaactacaattattgtgcagtaacatagctacttggaagtggtaacatgcacctattatgcagtaacacttctacttttgtgcagtaacaactatatggttagcatgtgaggctttaacccatatatttttgtttcgattcttggtctactacaattttaccacgatgttactgccagaactgcaggaacgtcctatttgttctacagtaacgtggcgtgttactatacttttatgataatgttactactggagcatagtacatgttacgagtttcgtagtaacatatctttgttttttgttttacgatggtagagaaagatattagaattgataatcatactactttcccacaaaattcttgaaataaatagcatcattagatgaattggttagaagaatgtgctttgaactatgaggtcatgggttcaagtctttgaatttagcaatttattttttattttcctagaaaagagaaaaaagaatgttttaaggagaaaaaaaggatcgggaggggggaaggggaagcgagagagaagggatcgggagggagggaggggcggatcgggaggggggagggggaagcgagagagaaggggagagatcaggaggggaaggggggatcgcgagaggga

SEQ ID NO: 80715 - DNA, 85283 bp, Oryza sativa
  unsure (1)..(85283): unsure at all n locations
gtagattttgctgagattatgcgcagggaatttgagatgagcatgatgggtgagttatcgtactttttgggattgcaaattaagcaaacacctcaaggtacttttgtgcatcaaacgaagtatatgaaggatcttttgagacggttcaagatggagaactgcaagccaatttcaacaccaattggttctacagctgtgttggatcctgatgaagatggtgaagctgttgatcaaaaggaatatagaaatatgattggatctttgttgtatctaactgcttctaggtcagacatataatttgctgtgtgtttgtgtgcacgctttcaagcttctcctcgtgtttcacatcgtcaagcggtcaagcgaataatgaggtatttgaatcatacacatgagtttggaatttggtattctacttcatcttctatatgcttaagtggatattctgatactgattttggaggttgtagaattgataggaaaagtactagtggaacatgtcattttcttgttacatcattgattgcatggtcttctaggaaacaatctagtgttgctcagtcaactgctgaatctgaatatgttgctgctgctagttgttgttcacagattcttggcttttatctactttgaaagattatggtcttacttttgagaaagtacctctcttttgtgataatactagtgctatcaatattgctaagaatcctgttcaacactcacgcataaagcacattgatattcgttttcactttttgagggatcatgttgagaagggagatgttgaattgcagtttttggacacaaagttacaaattgctgatattttcactaaacctttggattctaatcgctttgcttttcttcgtggtgaattaggtataattcatccttttggtatggtttgagggggattttgtacctcatggttttatcgagcaataatatgacaatgagaaaaattgagaaaagagagctttgtttatacatatggtattttcttgtacatgctagcaatactttgaaggtttatttgtctctagcatagcatgtatgtatttttgtcttttcatgagatttagattttgtttttaagggagatgatgcatgacacttaaattctatacttgaattaagcaaatatgcaatgttgatgctagcatatggtttgatgtataaatgctatatatatatgctttattgactttttattcctcaaatagttttaattgctcattgtgaaaagataataaaaaatatgaaaaaaatgaataccgaatctttagaaacagtcttgacgattcgatgtgagcaaaataatgggtgccgaattcctggaaaaagtcttgacgacagggacgtacccggaataaaagagaaaaatatgagcaaaaaggctcaagaaaaataaaaagttaaaaaaattctcttggttgttttgtgctaaaggttacttgagaaagagtgataaatgtaataggtatatgtgtttagtgtttatttttcaacctatatgcttgttaagatgttgcattaaaaatcatatgaaatcatgaattttgactgttgattcaagcataattgtaaaatctttggttcatggttatactttaatgcatgattgttatattatagatgggtttatattctttttattgcaacacatgacttgatatgctatatgtatgctaaactcttgaacattaatgaacataattcctatgcttgatgaaatcattgtccaaagggggagaagtaatgtgaaaatttttggatttttggagaagcaagatgaatttttggagagttgttgagaagagcatgtttctggttcaattgggaatttcttactttttaaaaacggggagaagttttcttttggatttttgagcacgatgtgtacatttgtacgaagtgtgctttttaccacttttgtttttatttttccaaacaccaaaacattttttatgggtttgccaatgtgttcatcaaggtggagattgtaaaatcaaaggtgtttttgattattattctatgataaacaattgggcattagagattattggttttgttatttggaatttattcacgaagtggttttggagatgattggattcacaggtgatcgcaggattcattatttcatgtgaccggtcagaccgggctctggtagccggtcggaccggcggtatgcgcgcggtcagaccggccagcccgcggtctgaccggccgacactgtgtcgatttcggtttcgggttgtttgtttggatatccgtgattatttcatgattatgacttctagatggatactagatgtatataatactgttgtttgctactaatgagtcaagttggagatagcttggtttcggaatatggtttctttgtttgttccatgtgtaggtgactcgatgcctcgggagagtatttgcggtgatggaccgggagtcggcttggggataagacgacgtccgtggtggtcagagatcatgcgggatacttaggctagagttgatgcacgtggttgatggagattccatatggcatacgatggagttattgtgtgcgtatgggatgcggagtcaaatttggaaggagtccaaattttgtacgattggttatgtaaagtttctttcttgtactagagggtttcctaaggtgtttaggactcttagtatgagtttggttcgtggctttaggctgcctacctcatgtataaatagagggggagcgtgaggtttccctgtatcgctttggagagcaattgagttgagttttgagttagggtttcgagtttagttgaaatttttgtaaggagtgctgttggtgcactttgtaaacacagagagaatcaataaagtcatcatttactttaagagttcttcgatttgtgtttaccgggtttcggcggtcagaccggcgggagcacggcggtcagaccggcggcggcgacagcgagcagcagctgatctcggcggtcggaccgaagatataatcgcggtcagaccgatggcaaccaggcggtcagaccggcaggacaacttcggtcagaccgcgatccgtcgatttcgagggtaacttttatttccgctaaaagttttcggtttttgggtataccaaccattcacccccctttggttggcttagttcttgtgattcgattctacagaaatttgtggcattgaaggatttaccgaaggtgcgatgcccatttcggcctgtttatcgtgaaatggtgataaacggccgcagctataaggtttttaaggttgccgaatggcttcgggtgcaccccgggcgaaccttagaagactacgatctttgttcattcaagacgtttggaggatatggctcacttttggcgaaaccatcaaaagactgatcggcaggaggcgatctcccagcatcgttacagtctagtctgtgtttcaccctcttctcctcttagggttgtgtatgatattagtagtgatgacgaacctagttcgcctgattattcctaagagagagagaatgtgatcgcgggggcgaagatgtaatttatctgtaagctgggctgtaacgccattgctattttcttgtcacttgtatcattgtaatgggtttgtatttttcgatacatttttatttaaaatcaataaaggtgcgttttatttccttttcgctatttttgcattgtcacttcgcgtgcttttcgttgggtcggaacgtgtcggctcctttgcatatattagcgaaataggttttgacttttcagctttcggcttccgttttcgatccgttttgttctacgttgtaggaagcactcgtgctttccttttgatcgagtgtaacggtgttcggctagttgttctccgaaacaagctgttgcggtttcaatcgtttggcgagcgatgcttcgcctgattcgtttcgcccccctggcctttttcgctgatcaggcgtttgccttggggtttttccacaaattatcaatcgcacaaacaaataaaaagaaggcagaggacatagagattttatactggttcgggccttcgtggtggataatagccctacatctagttttttgtctttttttcattttcatcttttttttctcttttttttcttaccgaagggcttacataacgatatatacatttttacaagttggcgatatgggtgccatccgttctagacataaaaacgcttgagagaggcagcgttctaggaatggtcgaactcttcgccttccagtgtcgccagtcgaaaggaccccgtcctggacttgtgcttgatgaggtacggtccttcccacttcgattcaagcttgccaacggctatcgggttcgccttcttccttaagacaagatgaccaggcaacagctccgtcggtcgaacttttttgttgtaagttgccgaagtgcctatggcatacttgcgcatgtgctcgagtgcttcgactcttaccccctccaagagttcaagcgacacctcgcgcccctcttcgcccccagagaacgtcacccttggtgagttagtccttagctctgttggggtcattgcctcatcaccataaagaagcgtgaacgggctgaacttggttggtcttgtgggggtcgtccgaagggcccaaagaacagatagaattttctctggccatttgcccttcgctgccccctcaagccttttctttagtgcttttaggatcttaccatttgtatgtatggccgccccatttgactgcgggtgcatgaccgacgcgaacctgatttccaggttaagcccttcgcacatttctctgaacttgtcagagttgaactgcttgccgttgtcagtgataaactcttttggtactccaaaacggcaaacaatgtttttccatacaaacttctgtactgcggccgaagtgatatgagctagcaggctttgcatgtattgctttatctcgtcgaacgctgcttggcattcgggtgtccagttgaattttcccgtgccctggagggttttgaagaagagcaaacctctttcggctgcctttgagaggaatcgactgagtgccgcaattcggcctacgagcttttgtacttaacgtacgctcgacggaggcttcatttgctgaatggcatcgattttctcgggattcgcctcgatgcctctttcagaaacaaggaaacccaacaacttgcctgcgcgaacgccgaaaacacacttcccaggattcagtttcatacccgctgcacgcaagttgttgaaggtctcctgtaggtcggacgcgtggttgaaagccttccggctttttacggcgatgtcgtcgacataagcttccacgtttcgccccaatttcttgtaaaggaccttgtacaccagcctggcgaaggttgctctggcattcctcaggccgaaaggcatcctgaggtgacaaaaggtgccaaatggtgtgatgaaggctgtcttggggatgttggccgtgttcatgtggatctagtgatagccggaatatgcatctaggaagctcatgagttcgcagccaactatcaaatccacgagctagtcgatccgtggcaaggggaaatcgtccttcggacatgctttgtttaaatatgtgaaatcgacacacatgcgccatttgccgtttgacttccgcaccagcactggattctccagccactcaggatggtcaactcaggatggtcaatctcttgaatgaccccagccttgagcaatttttggacttcggcttttgctgcctcttggcgatcagcggacatcttgcgtagcttctgtttccttggcttggcatccggcttgactgctaggtgatgcatgatgagatctgtcgaaacacctcctacttcatcggggcctcaggcgaagatatcaatgttcttcttgagtacctctaggatgttctcagcttcttcttcgcccatgtcgccccccagcgatacgagctttgtggggtcggcatcatcaatctgtatcttgattatcttgtcgtgtggggcgggctttggcgcgtgcttcgcacggtcatgcggttcggcctcaacattgtgcactacttatggccagatcgccttttgaagcagccaaaggctgaagccccttgaccacgatcactcctgtcgggccgggcatcttgagcttgagataattgtggtgggaaatggcttcgaacttgttcaaggttgcacggccgaagatggcgttgtagttgtacgggatgtcgacaacgtcgaacaatacttgctcttcgcgtctgttttccgccatgctgaaggctaccatcaactgtgcttggccaagaacttgaactgcttctccgctatcagggcgggcatcttgagcttgagataattgtggtgggaaatggcttcgaacttgttcaaggttgcacggccgaagatggcgttgtagttgtacgggatgtcgacaacgtcgaacaatacttgctcttcgcgtctgttttccgccgtgcggaaggctaccatcaactgtgcttggccaagaacttgaactgcttctccgctgaaacgtcggagcgatgctggtgctggggtaagggcttgggtggctaaccccatcttggcatatgcttcggcgaagatgacatcggccgaagtccctccgtccaccaggattcgccggacctcgaaaccagctatctcggctgagatcaccagaggatcttgatgcgggaacattactccttcggcatctcctggcctaaaagaaatttgctggttcagatactgcggggccccttcgccagccaaagtgatattgtggaccgttcgtagctgcatcttcttttgtcgcttcgacagctggatcggcgggtcggcccttgtaatcacttggattactctgcgctgcgcgtcttggcactgttcggggggtgcttgttcttgagctgcttcacgaggtgcttcgacagctgctccctgctgcggccttggatcttgcccgctgacacgttgccgaatgtttcggcattgctctgtggtgtgtgaagagcgtctgagaaaggcgcagtagaggtcttttcggaccttcttgcggacaggctgctgatggttgcttgcttgctgggcgtcgaactccttgcggagggcttgcacttctttgacagccatcactgccttgcccgcacggtcggttctgaacttcctctagatcatgggggggggcttgaccttgccttggcggttgtccttggatggctggggctggcgaacagcgagaggaggtggttcggcaacttgaacttgtgcttgggcttgggctgcggcgacggaagccttatgatactcatcttgtattgcttgccatcgcttggaatcctcttcgccccttgcgtacccgtcaatgatgcaaagtaggtgctcaagcgtctgtggctccttattggcgatttttcttatgagttcaccctcgagtagaccggtcgaagcggcgtttatgacagatgcctcggttatgtcttgaacttggcaccgggcttgcgagaagcgacgcatgtactcccttatcgactcccccggcctctggcgaatgccgagcagatgttgctgcgtcttcggctcctcataggtgcctcgaaagttaaggacaaagatatcgcgtaattgctcccatgagtaaatgttattggctggtaaattgaaataccaagaacgggcaatgccgtctagagcgagatgtattacctttgccttggtattttcgtcgccatgagccgcttcgatcgcggactcataaatggagaggaattcctttgggtctgtttcacctgagtagcgtgggacgggtgggaacttgaactagggtgggattggacgggtcttgattcccccactcagcgatagccccttttcgctccctgccctgttcacggcaccttgctgcgggtatggcgtggcgaagggcgaaatcatggcttgcgcgtgaggttgggccatggcattcggctgcccggctccgattggtgatgcttgctgagctaccatggatgggtcaaaagttggctgtgaccgtgtcatggcgacctggtttggtgcctggtttgctccgaagcctgacgttggtgcttgcggccgaatggttggtgcctaagaagcattgatgaagttgaactacggtccttgactccacggcgaagctcccagacttggctgattcgacggcaaccaactcggtgcatcatgacttgtattcccctccgggtgtgctgaaggggctatacctgaaatgctatggggttggctgagctgctgaaggaaagcttggagctgcgcccgcagagccgaagccccttctgccattgtttgtggtgcttggccaggtggttgaggttgtacttgtgtaacaccctgcctccaaaatccgcattagtccactctacacgttgagcggacccactttcgcatggtatcgtgcttacactttcgtcctcgcttcgtgtaaaagggttaacctggggataccatggttggagcaccaaggcttataagtaggccttcacccacctaaacttccaaggtggtactaaaccaccactacacatccacttctgggccacatgggccaaactcacactactaacaggcttcaaacgggttggggtgttacattcacccccccttaagggctgacgccccggcagctcaccgtttacacggcagaggcctagaaccccctccggtgcagaccatggccttttaccccccttaagggctgacgccccggcagctcaccgtttacatggcagaggcctagaaccccctccggtgcagaccatggcccaaagcacatgcatcacacaacggaggtttatgctctgataccaactgtaacaccctgcctccaaaatccgcattagtccactctacacgttgagcggacccacgttcgcatggtatcccgcttacactttcgtcctcgcttcgtgtaaaagggttaacccggggataccatggttggagcaccaaggcttataagcaggctctcacccacctaaacttccaaggtggtactaaaccaccactacacatccacttctgggccacatgggccaaactcacactactaacaggcttcaaacgggctggggtgttacaacttgggcagcgaccggctgagcttgcagctgcacgtgaggggccggatgcgctgctgcggtcgatggctgcccgacgaagtacattggcgcttgcgcgacttgtggcggaaggggctgggtcggcacttgtggatagacttggggtgggacataacctgccgaatactggaggattggtgctgaagcgaccttggatcgtcttgccgtctcgtatgcttgctgttgttcttgcatttggcgaagcatgtcttggagtcgtgtcatgttctgtcgcatggcttccatgttggcttcggtttgtgtttcggggttagggttgacttgggcttgcacagcggtgagcgcagttggggccgctgccgactacgacggagcggcttggggcaccagcagttggcttgtcaaaaggatctccgccctggtctggagtgcccttgccgccgcagccgccttcgccataccagccatgttcggcacctgcacagaggtggcaggggccgaaggcggtagtgatggtgcaggtgcggaagctgatggcgctcctccatcttcggcaacgggcgccgaagtctctgctccctcttcggtggccatatccgccctgacgtcactttcctttcgccttgtaaccttctccttcacgaccttcttcggtggcattcgctctcaatggtttcgcttggaggtccccacgatcgacgccagctgctgtcgaaacgacaaccgcatacgtcgaaagacgtggtcactcaacagtggttgggaaagaagttgtcacgtcctgataaatttatcccgaaataaaaatcattctctaaaaggaataatagaattaattaaaaatcgaaaagaaattgacaaacactaaaatacgtacaagaaaaattcgaatatggtccagagaatttttgttaaattctccttggtctaaaaggagccctcaaattttacttgaattttcagagcaccggaaataattattaagcaacaaaaacaattaacaaagtttactaaaaagaaaaactaaaaataatccccctcctccctttgggccaagtctggcccaaagtcctccctctctctctctcggcctgcggccaaagtcctcacttcctccctctctttctctccctctcctcctctccctccttctcttgggcctcctctccttcccctcggcccagccccctcctcctccctctctcccccaggtcgcctctccctcctctcctcctgggccggccgcccggcccaaaccgcgccacccagccgcccctcccgcgcacgcgcgttgcacgcgcgctaactgcgcgcccgaccggtgggtcccacccacccggtcgtctccttcctcccgcccggcatcctttctctcttctctctcccgtgaaacctagcgtcgattcctcccctaaatccacgcgaatcaatgcccttccttccaaattgattggggggaattaatccccgttccttccacatcaattccccctaatttcccccttgattcgtgcccccaatcgtcgggaacgcccacgccaaccccggccaccttccaaggccgccggccggcttttccgccgttgttccctcctctcccgtccccggctccctctcctaccctataaaatggaacaccctcgctccgttctatcgttttagccccctcctgcgctctcccgtggcctcaccacctctccccgcagccctcctctctctcccacaccgccggccaactccagccgccactgccgcgccgctcaggtgcgggctggccgtgccgtcgccgccagcggcctcgcagccgcctcttcttccccggcgtcgcctccgtttcgcgggaaattatcggagcgacgtcctcgcagacgaccagtggtgtcgccaccactccaccgcctccagccgcctgtgccgcctcgccggtgcagcggctgtcgtcatcgccatcctccctcaacgtcgccgcgtcgccctccacccaggactgccctcggtttcgccggaacgccgtcgcccgtggcgcctctccctcggtctcgccggagttccttcggcaacccctttcgctgtgccagcgacgcatcacctccggcatcgcagcggcgagccagcgacgtcatcctcagcatcgccttccctccatctgaacccctccactgtccatcgtcgtcgtctccgttcgtcctcgtcgacgactcctccggtcggtcgttcgtcctcaccggctcatcgtctcgcggcgccgcctccgtcttcggattcacagcggcgtgttccatgccgtcctcgtcgccgtgcagccactgccggctgcccacgtcgcctcctcgccggccccggtcctcgtcatcgtcgtcctcccgtcgttcccggtcgtcgtggcgttcgtccctccgtcaagccgttctcgttcgtcgtcctcgctacgtcaagtgccgcagccccgtcattgtcttcgtcctcgcctctgcgtcgccaagcgttgcgccggccacgtctcgcctttgtccaaggatcgccaccggagtcgtcccctcgcctttcgtctccatcgttcccggccgtctccgccgcgcccgttcgtcgttgtcgttccctcgcctcgtcacgtggtggtaaggatctctctccctcgtcgccctcgtcctcgtccttttggtgtcgcccgtgcccgttgtgcggttgtcgaccccggtacccgtgtactggtgtcggtagtcgttcgcttgtgcgtgtggtgaccgtgttagtgtgcccgctcggtagccgcgtggtttccacgtgtgcagcccgcgtggtgtctagtggagtccgtttgtcggccactcgcctcggttgacacatggggtccgcttccgtcgacccgtggaccatctctgtgtacccggtctgccgtggtcccttaggttgacaagtggggtccgcatgtcaacggcgcagccttcctgtcttttccaggctagcgcttatacatgttttatagttgtaaaacctaattataataatccgcaaatctccatataacagcattaaacttcggatgaccatgcattggtcatacgagctccgaatcgatccgttcaagtctcctaatgtttgttataacctaaagaaccctgtgctttatttttatgtattgttattgcttctttataggcttgtagctttgcttgtgtgcttcgcgtagcttctgtcgttcctgagtttcccgaagcgtggttcgcggtcgtcgccgaaggttcggaaggccattatctttgagcaaggcaagtcacatcatccttgagcatattgaatcccagtttataaaattattttgatttaaattattgcattatcgctttattcaaattcccgcattatcactattttatttagccatgcctatttatctttgttatgaccttatcattgttgttattgttattattaccttgttcaccctaggataaacaaaactccaactagtgggtaccctattcatggttccactagtatgaatttaggtagatgcttcgctgactaattaggcaacattaggtggttttataactttagactttgggaattctcatatcatttggacactatggtatggttggcttatgttggaattggacacacacctccccctctattcaaaacccccaaaatggttttaggctgggctcgaggtccgtggttgggttttgttagtcgtacctcgggtactataaggattaagctcgggcctctgttggaaagcactaccgtacttccacatgtctagtgggtaaggcttagtttgtggctcagtctggttataaacaaaggtacacggatggagatggacgaagtcgggggtcgatggacatctctaggacaaataaaggctacacgagctgcggcccggtagtcgagatgtcatggcacagggctggtgtcctgctgctaggagctcaatcctgcctgcctgtcccggaggttccggctgtagatggggctgggtcggtacttttgtttatggctaggatgggttgggaactatgtgacgtcttccgtccgtatgccgtggtggtatgtggcacgtggttacacgtgaggatgatgtgtcttgtgggtaaagatgtacacctctgatcagagtataatctattcgaatagccgcgccctcggttatgggcaagcctagcaatgtacccaagttagtgttttaattcttaaaacctgcttaactactaaaatgtggaatggttggcctgggttggcttgggatgagctgggacccagggtcgggttgccagttcggtctgaatcatcgtaggccttgaattaaggcaggttcgtgggggtttacggccttgattaataacactttgtagctctaggatcatctttataaaatggctttgggcaactaagtgacttttaaatgctgtttactgcaaaacttaacccctatattattaccccttgcacccccttgcattaatcatgcatctgccggtgtggcttgctgagtactgtggttgtactcattcttgctcaatctttcccccccttcagtaagagaagctttggagaagaagtcttaggtggagtcctggcttataccccagttgagcgcctgtgaagatagagccatagtcccgctagtccgctgctgtttatttttgattgtcaggccttaagtgcctttgtaataatgtaaatattatcgatataataaagatgtgtcttttgtatcatgtttgtgtggtgtaccccgacttttcctgggacggggattaatacactagcgttcgggaaaatgcatttttctcagtcgcgacagaagtaaagtgtattaattagagaatttttcttcgggatccccccattacatggccctatgagactatttatagctcctattacaggttcttactactagagttttggttatacaggggaatttacatggttacccttatgaaagggacatttacatgggtacatagggtaattgaggttcacaggcccctgatgggccgtcgggcgatcgtcagctcaatagcccctagacttgatgggcctgaaaggcttcttcggccctcgcgggggcgagcttgctttggcgaagtcgtctcccttcggcatatactcttcgccctgcatccttcgcccaagaggcctctggcttggcagagtacccgtgcgatccctcgcctctcgccgtccttgttccatagtcttcgtcatggggggacttcgccccgactaactttgacgtctcgggcttgaatccccactcttcgtatagctttcagcagattttggtcgaagggcctcatgccataccaccaacaatgatatccatcaaaactatccaaaatgcgagaggcagattaccatagtaactctcggtaagcacttggctgagtgagttgcaagtactgttcatgtacttaatgatacctaaggaattaatttatatacggagaaattaaacatagtgcagcctgttggtctgtggcgttgtgctcattttttcagaccaccaccctttcctcgatcttacttgggctagcgctcttcgctggtccagcgaaaaggagatagcagtcgagagtcgagatcgaaggcctaattatttttagagagcaatggaacgaacattgatgggtatagatcagtcatttaattaggtgttgttagctgcagtttagtctcatgagtttaattatgcttgtactccatccgtttcataatgtagcattgtccacatttatgaaagtaatttttataagactaatgatgacaaaactatagaaatcttttatcaaacaatgatttatcataaaactatatatttatagcaccgaagttattatagaactacatatttgtggtgcagtactacagatttaataataaagttaccacaaaatcacatgttgagcatcaatttaatcagaaaacttggatgctaattattcaaacataacattattgctagggatttaaaccctaaattttgtagttttggaataattttattattattattaaatatgtagtcttaagatatttagcctttttactctttttaaaatttggttgccctcatgggtcggtcagtgaaacactgcaggatttaaacgacagctagagctataatttaccttatcagatcaagtaggtcctgtctgattcatggttcgatgcttgaactatcttaagttcttgacacacatgaacgttacaaaagattagtatttggtgtgtagaagggtcaacgccaagccggttaattagtgcaacaaactatgtgtttgcttgcggcacgattgcagagagcacaccatcgtcatggcatgaacacaaacagacccgtaggcttaatcatgtgtgttaggtgaaattaacttgatagatttgcagttcattatctgcaattgacacgataaattacatccttaaacctgctggcaattgtacttagataatggtagcgtatcctcacagatttagcacagctagcaaggcgggaaggaaacaagaaagcattgggatgccatcatctgtaaagtacacagcacagtactgaatcaatggcaatccatccgttgcctcccatgtatgcctattgtctactgtactaaccaagaagacatggaggacaagtccagcgcatgtacgcatggtgcccaagaggacagatggaggatcagatcatggggcaggcacatgcatccacatccctcaaaatcatgcccttgtctccagattcccgggcttggctgttaatgcgtgagttgtctgaagaagctcgcatccctccaaggcaggcggcatatatacagttcaggatcatccatttcttaatgctacttcatcattctgatctccaaaagggcctttctcatcaggacaccgctggtgatccccatccgtgtctcagatttatcatgctagctgattggagtccattgtcgcacgtggcgacgatcgggtttcttggaaagctgggggaacattgttggtgctgggtcactaataatttagtttgataagaaaagagatggagagaaaaattaagccggaaagggaaggtaggacatgcaaacatctaagtagaattattctgtagttcacatgcaataagtgcgcgtcatttttcaaatatcgaattaggtggattggaattagcatcactaattaatgtgaaacaccgtttatagtttaggttgataacaccaattaattactaacatacatctcccgtcagaaaaaaaaaacaaagaaagaaagagggggggggggtcatgttattcagttagagaagtgtgatacctgaaactgaatgtcatgttcagtttcagactttaagaggaggaacagatcatcaaattaacttgaagcttaagctctccaggacgactgcatttactcatggaagtcgacaagatccccagatccacaatggttataaacaatcttgggtggcaattattaatcagtcatgtcattcaactagattgagaaataaaagaaagaaaaaagggggtccgtactgttgtagtatattcctgagtgggggaggggaggtctgtgatgtcaacaagttaggagcgaggagcatgattccagggcaggcaggcatgcacacatgtgaagtgccttggttactttagctgttcctgtctcttggttcgggtgattctttcttcctttctggtgtagtgccttcctttaaatctatttctggatagatacaacacaagatggatgcacacatatttatagcaagtgggggttgctatgtctccctgcttttctagtctgcttgacattttgtggtgggggcatcatccctttcactctcaaatgcttcagatttcagtcaatccacactgtaatccccattgctagtatctctctctcgctctctctccgcctttaaaataggctcttgtggattgttgagaaagttaagtgcccctgttgcaaggttctttgaggcttcgatcccgataagcgttcgaactggtcggcctccacctattgtgagtaaaagccactcaattcctttctcatagtttccattttccttgcatccatctataaagatagctagggtgcaaaattttatatggttggtttgttactgccatggcagaaaaaaattgagcgtatgcatccatcgagagagagagagagagagagagcaatctgttgatctcgcactgtattttgcagctgtgatttggcttcaaagccagccaaaaaaggtctaattctccggccacaagaagatgtcaaggtacctgaagcagtacgagaaggaacacatgaagatggccatgttgaggcaggaggagacattcaagcagcaggtaagataagaacaccactccatactgaaacttccaaactcttgcttccttatccagtaccgaaccttcaggcctcaagcaaataacagcagctttgttcaggttcaggagctgcaccggctgtaccgagtacagaagctactgatggacgccggctctgcaatcacaatgcaaggcatcagttgcatacctgaagacgattatcatgcagaggagaacgaggcagggtcgagcaggccatggcacaccttccctgggagcgacaatgacaagccacaggctcacactagtgttcttgaagagagcgagctggacctgacgctagcgatcgggaggacgacgacgaccaagaaggaggcgccgtcgtctagcgtggactcgaggacgagcaactcgtcgtcgtcgacggagtccggcagcaccaactgcagggcggtgatgccgcaccggccatctcggttggggtcgtcgtcggcggtgaaggttgttgctggtggccccggtgttgggacgacgcagcagcatttggacctggagcagcaggacgcgctgaagcagcctccttggctccaccgttgtctcaatttggcacgataagaggatgtatagcacacaacttcttaatttcttgccgtgtcatccctttactattctcaatcatgcttgctgctcgccctcgcatttctcgatcgtttgtcctcactttacttcacttttttttttacttcttattttttttacttccccaccaccgtcatgattaagaagtcgcgctcagcaggggaaagaaaaaagagtcgtgcacccggagccgacccgcttgatgattccaagccttatcgttttccttatataaaatcagccgctataaaaatttaagtttcagacttacttttgctgttgataactagccggcggctacaagtcgtcggatagttattagcgagtactagttggttggcaagattagttagcttgctgcttgctccaccattataatttgtgagatataaattataaatttataattgaattagggctactacctatctcgggggtctgaatcaacacaaaaattcgttgtctttagattactttaccgcaatctcacgtatagcttagtcccaacgtccaccatactatatagataccgtagtcaggtataaactgttgatagtagcgtgccaagtagggggcttgatgaaaaaagtttcgacgagatgggtacaagagacggattttctaacaatggcctctataatcagcttggccagggcggtccaacccagctgatgttcactcttctgcatgttggatccgtcacattcccagtcttcgctgttacgtcgttgttagtatttcttacgatcacagacaaaatccgcaagcgcacggatataccgatgtagcacttctcctacggagtattccaagggtatcgaatccaagagaacatgtgtggtcagatcttcctccggttcatccaaggacaccaagcaaatgataagccaggatagagaggatttaatagtgagaaacattgttagggaaagcttaattttaatcctaatgcaatatttcaggcactggcaacccgcagttcccagatgtcgctctactacgtacccggacagggaggacttaagtgatctcgagggctgtcaccacctctacacccacctcaaacatactgtgggatacgcagcaattactggataataattacctaaacaccacgtctaagcaattactatctactttagtgtttataactcactaaagcaatcattatattttagttgattatagtgaacaataatcccgtatgctacttcggaactaaccaagagataattctcacaagataaatctaaattactcaagaagaatattatattgaattcacagtaataaacagaataaaagaaataggggaagattactgacaactccggaattcttccgactcctactctactcccttccttcctattctagtatacaatatagtacaatagagcctcttataattcagctcaagcttggaagtatgtgtgagagtgaataaagtgaggtctatttataggacaggtatgacggttgtgagaaggggaaatgtccgaactgccccgcaaccgtctttgggagagcatctggagcgtcgatgccaaaccctaggatcaacggcgatcagaggggttcgcccgaacctaggctgggccctcctggcctggccttcggtctatggactccctgggctcttctctatccatttctcagagttttgggttaattcactgatgttttgatgaagttcacaacccctccttgtatagatatataattctcctcactttagtctaggtttcctcccaacatcagggtatatcatctacatacaaatatacaccaacacttgtggaatatgtgagattaagcacctatcactatgttggatgttttattatccgaactttatgcagatgttggcggtatagaatcgacatttaacagccgccaacagtcgttgatctaccatccgacttccaccgagaacaaggagccgactgcgaagtctattgggtttactcccacatcggtaattgaggatgggggagcactttttaaaaggtggagggagtcctcacccatcagactagttttttgggttgtgtaggcctgagacctaaagttgtggctctggttgagcctgtggtggagcaggcccaatatgaccgggtggcccatggttggtggactgggctgcgcactctaacaagtaatatcagagtccaggtttagaacctggaacaatttccatgggtcacatgatgggggaggccaggtaacaagtcttcagggtcacatgggttaatgtgacataggagattgttgggcccgatgtgtgacgacggtggagattgttgagtttagtctcacatcggtaattgatgatgggagagcacgacttaaaaggtgggggcaatcctcacccatcaaactagtcttttgggttgtgtaggctcaagacctagagttgtggcttcggttgagcctgtggtggagcaaactcaatgtgacctgagtggcccatggttggtgggctaggttgcgcactctaacaaagtccaatcacaagattaggaagaagtggtgccccattaacaaaacgagttctcactctctagatgggtgcagtgttatgctgaaggacaaaactggatgcaacggttgcaaacttgatgatactcaacgcatctcctcatacaaattatgccccatcgacaagacctgagtggcccatggttggtgggctaggttgcgcactctaacaaagtccactcacaagattaggaagaagtggtgccccattaacaaaacgagttctcactctctatatgggtgcagtgttatgctgaaggacaaaactggatgcaacggttgcaaacttgatgatactcaacgcatctcgtcatacaaattatgccccatccacaagacaaaatgcgtactttgacagggtttaaggtattcatcaaagttgtcgaatccatgacctcgtctacgtcggccagttcttctcccaagcattgtctgatccactcccgatgacatcaatccatcaatttgggatcatacgatgatatgtcagatgacttagcttgtttggtcggctatctgggactagacccccatgaaccatctattctccatagtctggatccgctcgagtcctaggtctcaattcataccgtagggtgaacatcgttgagatcgtggacctagcgtcccgtgacgacattgttgacggtcgttatcgattagtttcgaccgtcaatattactaaaatagaggagaactagtggtgcttgcaatgcatatatttgttagaataataatattccattagtattaggtatactaaccttttgcagagaatgacaataaagtggaggagaatcgacatcaactcagacgataaatcaatcggacgatgtcgagaaccagacttatgtatgaatgggccaagaactcaaaaataacacgacacattgggccaaaattcacaagtctacggaggaggacaacaaaggaggccgccagccaaagatgggctgggttgggccagcccatggtgtttcgaccgaaccccccatagctccgtttgatccagggttctcctggacggctgagatggctccccaatgacggttagagggtattaccgacaattccaaccgtcacaaccgtcattgggaggctataaaaggagctctcatcctcacttcactcacacacctcaagcaatagctctctcatttctctcaagtttagtttagtagtatctagctggtggaataggaatagagtagaaatcaggagtccggaatccttaggaagagttcgggtatggctctagtagcttttctcttctcttttgtaagccttgtacttttactagaatactcttctaaatatatttatggtattgaaatactttccgagtatatgagtacctactttacattatgttcatgttatgctgaatatacggctagcttatctgggagatgctttggtgcgggtatagtgtttccttatgcaattactctatgtcatgacgatgatattagagtagtacgtggtagtttagacgtggtgtctagattacgggatatcattatttagggttatatattgcggatgagaggtgggccgctgatggtgacagctcagtacgggtattcctccgtgccggtatataatcctaagttaattccctgggagggtattcctccgtatttagccccggttgtatggtcatgacgggctgtcgtaaggaactcagcagtcaggggtggcttctcgaagtaccaggagggtatcggatagagggtattagctagtatatcggttaactagaatgtatgtatactatgtatattaaaagtataggaattgatttttgaagtataggaatagattttctctcttttctttccacttagcttagatgatatattatgagaatgagtagttaatgcttgtgtgtcactctacccttggattatcttaacccctacttagaatatgattatcacaagtaatatataaattattagtcaagttttctctacatgatcttcccacgggataaaataaatacgatacccttggaatactctcaggtgaaatgctacaatggtatatccgtccgcttgcggatgaactctgtaaccataatataccagaagtatttctgcgccattgttgggaattatatttctagtaatatcgttaagaaataccaacaagcatttctggtgccgttgccggggaagatttataatagtgattacttgaactaatactttatttttacctttgtataatcattttcctttgcaggataaaccttggttgtttttactttttgttctgaaaacaggttagtgcatgactggtttcaatttgccggaaaacttcaaagaaaatccagaaactttctttcggagcgttaggccgcgagtcgttgctccgcagaaaactctaccaatagagaaaccagccataccggcgccaccaaccttcaagactatggctaacaagactctccgcgagttcgctgctttctctgctgacaatttggccatttggcagctggtcaacataggggacgtggatttcgacttgaagtccagcctcatcacgatggcgccggctagctcattttgtggcaagcctaatgaggatgccaatgctcatttgcaatagttcctggagatctgtagcatgtacaccatcaagggtgtcagtcctgacgccgtcaggctaccactgttttcgttctcccttctcgggagagcgaagcaatggttctatgccaaccgtgctgctgtcaacacctgggataaatgctctataacattcctctcgaaattcttcctgatgggcaaaaccaatgcccttcgtggaaggatttcatgtttccagtaggcaagcgatgagtctattcctgaagcatgggaacgtctgtaggaattcgtggccgcttgtccttatcatgggatggacgactggctgatcccggttgacttcgtggtgctggacatggacacggggaaggagacaccgctcatcctgggacgcccattccttagcaccgcgggagccaacattgacgtgggaacggggagtatccgtttccacatcaacggcaaggaagagaagtttgagtttcaaccgaggatggaacaatgctccatggtcagaataaagtacgggctgaacccagagaatattcaagtggtcgaagtggagccacccaaaatggacagcctggtgaaattcatgcagaatttcctagagaaggaaacaacgatgcctaggaaccgttattggaagacgccggtaaaaccacccataccagccaagaagatagagcagccgactcagaagaagccgtcttccacaccaaagccaaggaatgtgtggaaggagaagccaaagacgcccgctccatcacctccggagacgggtggaaaatccacgaactgaactggatggaggtacagtcttgcacgtcggactttaaatgacacgaccttcaccaacaggtaaattggtatgtatccgcatatttgctttcaacaatttgaatttttgtatcatcacatgtttgaatttcaaagttgcatataggatttttgaattttgaggaaattcttcaaatgaatttttcagagcaaaccaaaataaaattttcagtgaaaattcgctgtgccacgaccacactgaccgttggaacccaacggccgaaagcggggacggttgggcccaccatgggttcggccaaacccattggttcggtcgaactagccaggccaacggttggctgcctccttcattgaggcaacggctagtgggcctcacaggtcggttttgaccgttgtgggtgcactacttaagccaaccggccgagagagggaattccaccccatttcaacacatcctgaacgacatcgacctcgaccttgtcagtgatcgggagagacaagcctactacatgctgagcgaccgggagtatgctcacacacgagaatactcaccggagctgctaaaaaagataggtatggatgttgaatttcgtactatttagaaagcggttggttggcagagatttgctgtggtagatgagcctggttcttgtttgcttactttgcaatttttgtgcactttgaaagaaatagaagatggaatttcctttcgctttttccataaggagtacacacttacatgaaaggcttaagtacacttcttggttttcacgattcctgtaaaatcgatctctagaaaggaatttctgggttcgagaaaaataggttttgggaaaatatttctggtgctccaatttgcaagaaacctagaacgaatgatatccataatcctacacttaggctcatgcacaaatggattgctatgactttgtttcctagaggtgatctaaggcccataggggagatgaattgattatcatgtttgccttggttagaaagatcaaaattgctcctgtgaattgtatgataaggcaattgttagaaagtataaagttctctgctcctgttgagtgcacttctctgattactcggatagcaaaagggctaagggtcgttagcgacgtgttgatgaaaaacacgaggcctaggagatctgcttaactccagtgtaggtccaaactcgccttcgggtatgctagcatgccagttgatttgatcctgcaatcaacaagaaataaaggcaaagaaaccatggttaaatctataaatgatacccgatcagctatgtgccgatgacatatcatttatccttgagccgatgtcatgtgtaaatcgatcggcagtcataaataaataagaaagaactatatccactcgatcggctgtagatattaacaatatatattccttatatcgatatatatttaaataaagtgattgggatagatcggtcgtcatgccgagacagtataaatcatttagatcgaaatatatattaataataggattatatatgttgatagcatagccgatcaaatggatctagcatgtatcggctaatactatgataccactctatactaagatattaagagaagtagaatatatcaaacaaaagtctaatatacttaaatgcaacaagatcataatataaagggtagatttaacatatcaatgaagcatatggagtaaatatagttaaatcaggtaagatcggctgaaactccgatactaccctaatcggcaaccagatggcaggctagagattgatattctaagcacgacttaatagatcaaactcaactgatgcagcattaagtatgaaaacaataacaatatctagacaatcaagcccatggaagtttcatagagtggtggatatcctatataatctaagtcaacatcgatgtttaacctaatcggctgccctctaccgacagatgttagccgaatgtaggttatatagcgatattgccagagattatgtaagatatatgataactcgacgaattacataaacaagatcagagtatcataaagatggaagcactaatcccgagaacgtaagccgtcataacaagttttacctcttgttgaagatcgaaaccgatgcagctcaacccgaaagcaagaactcgtcgaaataaaactaaagcaaaagggtggcgatgcgccgaaattgtattgaacgtgtgtgttaattgattacatggggttcggggtctatttatacccgaaaattacaaacaatgtccatatcggacacgactcttatctctaacaaactctaaaataccataagtctttacggcagacttttgcccaaacatatctctaaggaaattacataaaatatcctaattaatagatacaattgccttctcaggactctatccatgtgtggcaatcatcttgaagcatatcaactcaacccgatgtcatacaccaagtcgtattgtcggaatcggccgtatcacctaacccagtctgactcggacttagccgatcccaatcgtagccaatccggactccagccgattcttacactattctcgaatcgatcttcgtctttgactcagctttgacctaatcctcttttccgatgctgatatcaccaaattcggtcattaatacaagcccgccaagtccggaatatttggtaatgtttcggatttgctgtacgtcaactccaagcaagtttcgcactttgccgttttctgaccgttactcccatgctttaaatactaaccgtcaccctcgagagatctcgcaccgtcctcttccgtttttactgctgaaacagactttgccctctctctctccggcgactccgccgacgcaaaaggcgattccaaagcgattccatctcctgccggacctccgcctgcgatgatgtcgtcctccgccagcccgtctaccgcgccatcagccgagtacgccgaggtaagttctcatcggctagatcccttttcttcgtaagaattcgatttccccttccctcatcttgtttccttcttctcgaatcctttggatttgcagcacctctccaatttagttgcgattcccagcctgtcgcatgaaaaccattactttcttggtccaatcggcaacttagaccctactgatttcatcatcggcgaaaccaacagaatcccctttagattagccaaccctaacctaggtcactggaagaatacttttaagtcttggccatctcttgagaaaactactcctgagaatagttggaccacatggtacaagcgcctatcagctagcaagcgaacacattgggatgaaatcggaatcggccaagcgcttgcccttaccatagccaattcagctaaggatgaacctctgatggccgccgccacttatttctggtccaataccatcaatgcctttctgttcaaccaagggccgatgactcctactctgattatgatcaccggactagatgtaacctcatcggccaaccctatgagcatgaataccaagaatcaatttgattttagaaccaaaagcataggtggctggtctttctatgtggccgcatacatgggccaaggatctgttactcctcgagaacatgtggcctttctactcatgtggctggaaaagtttcttttctgtggatctagctgtggtcctacaaccaagtggcagtttgcagccgaagctcttgagtcaaaacgagaatttcctctaggcaaaatcctcctcggctacttataccaaatgctgaacaatgcatcggccaaaatagccatcggctcagtggttggagcaggtggaccatggtggctgctacaatcctagctcaacttaatggtcatgaaggttgtcaattggccatcagtaacagaagccgaattcccaaggctggagccgattgtagaagatgatggagaagaacgaacccatcgtaggtgcatgtcttatgtagattatgcatccacaccaaccgttgccggagcaaaactatcggttgagctgctcaaggattggttttgcagtgtcacgcctcgaactagtcccaaccggaactagcccgtgacgctccaaattaacctgttaatcaataccagtcccaggaaacagtgctggtatcacaggaagacagaatatcacagcaacagaggtctctttattatagagtaggagtacagtcatgttgggctgcggacagatcccgagctcacaactgcattactaaatggaagcggaagccaagacttggaccaaacatcacaggcgcgacttgggaactaggccgaaaccctaaaactcatcgtagccggcttgctcctggaagaactccatcttcttcagcaactgggggggggattatttatatagagcaagggtgagtacaggagtactcagcaagccatgggaaataagtgtttaatgcaggcttcaaagaaaggccgttgtttttgcgattgattttatttaaactcttttctgaaacaactaagggagtgcttctcaaacgacacggatgagacagtgcgtctcatccggtcggagtatgtgcaatgtttcagtcttttgaattgatcaagattggtacccggccaacagctttcaaacggccacccgggcctggctgatcccatcagccgtagattttccaaacatcaaacctattccacaacagcaaatttcacaaggcagtagtcaaacaaaactacgctaggaatcacctcacatccgcccatgaccatgggcacggctgttcgaacagttttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacattccccgatccgcagttttggaaattcatttagtttgcaagcaccgacccaggtgtcgggttttctaagtcttttgtaaaacccaagttttacccaagatgtttctcagattttaagtttgaaggcgaccgtcgatacccgtgcagagtgcacgattaccgaggcgcaactaggtgggtacaagcgaacatggtataacaattacaatggaagggtcaaatgcaacaaattaggtaggtccgccaatctgccttgcagacgggacaagcagattaagtgtgatcctatcaatgcataatatttttcaggcaacataattaagttcaaatataggctcaagatgttcaaaggtggcttgcctcgctcgagatcttgagcttcatcctcgaaatcatcgcactgcgggtcttcgggctccgaaactacacacgaaacgggacaactcagcaaacggcgaaaataaagccctattattgacctctaagcatgccattagatagatctcgagatttgaggaattttggaagttgaacggagtcaaacggacttacggttgggaagatattgaatttctaagattattggatttttggtctaaaggaaaaggatttatttaaatcctttttgaaaaagaaaagaaaagaaaagaaggagggagggaaattagactttcctcgggcggctagggcgcggcccaagagaatggggcggctcggccgagcttaatgggccggccggccaaagaaggcggcccaaggcgcgcgcgggcggggaggggagagagccggtgggccgggtccatcccgcgtggtcccgggtgggacccgcttgtcggcgactcggctcaccgtgagcgaggtgcacgcggggcgtgctagggtttggggagggaggcgcggcacatgcgcgcagttcgcggaggacgcggtgcggcgggcccacgcgcagcctcacggctcgcggtggaccgcgcgcgcgagggggcggagggaagcggcggaccggggtctgcttgtcgcggccgaggtggcgccaacgtggcgcctacgtggctgccacgcgggccggcgggaggtagacgacgacgccggccggaacggacggcggacgacaacggcgagcggcggagcgaaccatggcgatacaggcgaaggcgagcacaccgggatgttgcacaggacgaggggagacgagccaatggctcggattcaccgggggatgctcgacggcggcggattgcggcggcggcaaccgacggcgggagaagggggaaacggcgatgaggtcacgaggggccgattcccggcggtgagagcatctacgcggctacgggaatccattgctagtgtcgaattgggcggagctacgccgaacgaggccggtgacgagcgggcgctacggagcacgggcggcgacggtggtgagcacacatcgagcggcggcaacggtcggggcggcgccagctagctacgggaaggctacacatgctactaccgaaaactaaggggaggagatggatcgaggagggagaacgggggaatgcactaccgagatgaggcggggcgctgtgacgagaggccgacgacacgggagtgatctctccggcctcgggccgggggagaggaagaagtcgagcgcccggagtccccttccttgtcctcgctcgtgccggctcctccgacacgcacgatggcgaacggcgacagcgaacagagcacgggaggcggcgacaagaggcgaatgggagaggaaaggaaagggggggaagcttgggtttatatgggcgacaatgtcggtttgggagaggggaaccgagtttggacggtcaagccagcgagctggcgctccggctagcggccaaatcggcgacagggaggaggggaatgacgccggtggaggaagaaaaaggaaaaggaaggaagaaagggggcttgccccttgccactttgggaaaagaaggaggggatgggggcgacgcggcagagggaggaggggctctgcctccgtcccttggtggctagcgcacggagagaggcggggccgtgtcgatgacgacggcgatgacagcggggcggtttggagcggagcgatgacacgggcggcaggcgcgggcaggcgcggcaggcgctgacggcggcggcgactggccgatcggccaccacggcgcgcgcgcgcgggcggcacggcgatttgggcggcatcggcgggaacggcagcgggggcggagagggaggagggctcggcgcggctcacgggcagagcggggagagagagagagagagagagccggggagggagggggagatgggccgagagggattcggcccatcgaacccgagagaggctaaatagacttttgcggagggatttgatttgggaaggatttggattcgggattgaacttgacgatagatcggggattcgagatctgagatggcacggacacgacaacaagcaaagaaacggatttggcaaatagggtttttaagagatagttttcccgctaggcgccacgacggaacgggcgctacaattaggctcttgtttgatatattttacttgttttagtatcctgatatagagtagtatcggagtattagccgatacatgctagatctatctgaccggctatgctattaaaatatataaggctgttatcaatatatattttgatctaagtgattcatactgtctcggcatggcgatcgatccatctttggaagaactagtcccaggaatatccgcaaccacctttaccttatacttctgcaccatagttcccttacgggtttgcataaatgaactcaagaactggttgcgtgcttgctgcatcatcgcttcaaaatccttcttttgatcgggtgtcagcttgtctagagtgatgttcacgatgttgccttcattaacttcagataggcccaactgttgtatcttctcattaacaggaccggggctagccgaggacggcgatgctggcggcttgtcatccatgagaaaagacttctgacttcttatatgtcccaccaggcgtgccaaaagcgtgttaatgaaaaacacgaggcctgcgagatctgcttaactccagtgtaggtccaaaactcgccttcgggtatgctagcgtgccagttgatttgatcctgcaaccaacaaaaaataaaggcaaagaaaccgtggttaaatctataaatgatagccgatcggctaagtgccgatgacatgtcatttatccttgagccgatatcatgtgtaaatcgatcggtagtcataaataaataagaaagaactatatccactcgatcggctgtagatattaacaatatataatccttatatcgatatatatttaaatcaagtgattgggatagatcggtcgccatgccgagacagtataaatcatttagatcgaaatatatattaataataggattatatatgttcatagcatagccgatcaaatggatctagcatgtatcggctaatactccgataccactctatactaagatattaagacaagtagaatatatcaaataaaagtctaatatacttaaatgcaacaagatcttaatataaaggacagatttaacatatcaatgaagcatatagagtaaatatagttaaatcagataagatcgactgaaactccgatactaccctaatcggcaaccagaagacaggctagagattgatattctaagcacgacctaatagatcaaactcaactgatgcagcattaagtatgaaaagaagaacaatatctagacaatcaagcccctggaggtttcgtagagtggtggatatcctatataatctaagtcaacatcgatgtttaacctaatcggctgccctctaccgacagatgttagccgattgtaggttatatagcgatattgtcagagattatgtaagatatatgataactcaacgaattacataaacaagatcagagtatcataaagatggaagcactaatcccgagaacgcaagtcgtcataacaagttttacataaacaagatcgaaaccgatgcagctcaacccgaaagcaagaactcgtcgaaataaaactaaagcaaaagggtggcgatgcgccgaaattgtattgaacaagtgtgttaattgattacatggggttcggggtctatttatacccaaaaattacaaacaatgtccatatcgaacacgactcttatctctaacaaactctaaaataccataagtctttatggcagacttttgcccaaacatatctctaaggaaattacataaaatatcctaattaatagatacaattgccttctcaggactctatccatgtgtggcaatcatcttgaagcatatcaactcaacccgatgtcgtataccaagtcgtattgtcggaatcgaccgtatcacctaacctagtctgactcggacttagccgatcccaatcatagccgatccggactccagctgattcttactatgttctcgaatcgatcttcgcctttgactcagcttcggcctaatcctcttttccgatgctgatattaccaaatttggtcgttaacacgaccaaattgcttttatctcagccgctcgtctgtgtattgatgagacttatctagtgcaagggcatattctgaaacatggagtagatggatctttgatttactttttctctggttgtacaaatgaaatcccgttgccaaatgcggggtatcatttgtacaactgccgtgaactaaccattcccctgcagaccatagaagaatctcgtgcaggtggagcatacagggagacgcgcaacatgacaagaaatgaacgagaaagttcatcatcctcaacacctgtgcagatgtatgaggcaggttgggagccaattggggatgcacccggatggacccaagctccacgtcacagtatcggagtctcaacctgggcaagtgccagtgaggaccggtggcgtgcgcctcatgacatccaatggggggacaatcaaccttccagatcaagtggtgcgcctccatctccaagtgaatggcgctcaagttcctctcgttgggacttgggtgaaatcactaggaggatggacactcttgatatgcagacgtcagagatacagtacaacctcacggaacacatagcacaaacgcaaggatggcaacaatctgctgatgcgcagttcgccaacttcaggaacatgatgcagcaacaggacgatgaccttcaagagtacttccgctttcaggggttcaatccttatcaaggaccctgagcgaaaaccatgcttgggggggggacatctcttccccccactgaggtaacttgtatcacatcgcatattttccctttccaattgcatcttataaaacttgaaaacaacataaaaatttgcaaaatagaaaataccaaaaagataggatatgcttgagtcatgctaggtaagacaagctagttctctttgttgaaatgatgaatagttgctctgttttatatctcttatatatgggttcttggtaagtgctctctcaaaggtcaaatatgagtagccaacaattatctgggaacatgagataaatgagttgcacttgctgatctaagtctaagttattgtgagctatgatatagtaaataagagttactatgatcctgatcctagtttgacttgaattccggatgttttgtttttcaaaattataaaatggaaagttcctcatttgatataaattcctaccagagccaaaaatgtgctatcatgtttaaaccatatacattttggttacttgtcattccattgaactctgtcaaactcttgtgacttgtgtagaaacttctcatgctctatgatcaagatcatacatccacatatatgcagatgccaaactcctacactgggagctaagcaatattccattccatttccttattaccaccaaaataaattctccatgctttcatgtgctttctcctcctagaaagaaagaaaaaaaaagagaggagggaaaggcatgattatgaaaaaaaaaagttatgctccatcaagcatgagcatgatgttgaaaaaaaatgtaatcataccctctcctaatcaataaaagaaggatttttgggagaagaaagtaagcgcaaaggagaagctttttctttattttccttcatgtaccacttttatcatataccacacacattttgcacgatcttgatcttgagtatgtttagtcatctgctttagtctaagtttttgatttagtaataaatgtgaatacaagtatgccatgtttgatccctactgaggtctacatattaaaaccttagagtaggaatcaaaaaggcaacaattggtaaggaattcattttgatacacttggagagactgagtgaatcatttgaggaacttggctttcttttgcaaaatcatttgaaaacttccagaataagagttgaataaatattgggtgattgatgctctaattactgttctatctttcaatcgctcaaggcaaggaaaagcagtgtcttgtgggaatcaggggtaagggtaagccaccgtgccaaagattatttaatttgagagatatgcagcatagtagcaactcctgatcaacaaccaagtctttgtttcctttcgtccttcactcgggacgagcaaaggttcaagcttggggggttttgttgatagtcgttatcgatcagtttcgaccgtcaatattactaaaatagaggagaactagtgatgcttgcaatgcatatatttgttagaataataatattccactagtattagatatactaaccttttgcagagaatgacaataaagtggaggagaatcgacatcaactcagatgataaatcaatcggacgatgtcgagaactagacttatgtatgaatgggccaagaactcagaaataacacgacacattgggcccgaattcacaagtctacggaggaggacaacaaaggaggtcgctagccgaagataggcatatatgctacgggacagtagaggtgggccactgatggtgacagctcagtacgggtattcctctatgttagtatatattcctaagaaaaattcatagggagggtactcctccgtatttacccccggttggacggccatgataggttgtagtaaggaacttggcaacccggggtggactctcgaagtaccaggaggacactgttagggggtattggccacacgattgtatagtaacatatgtaaactagatattgagtgtatacttgaagtataggaattgagtgctttatgtttcttgttccacttagttaaaattaatttattatgaggatttgaacagctttgcttcttgtcactctacccctatattaaatataacccctacttagactttgataaatacaagtaatatatgtataaagtgtattagcaaagtccactcatatgatctttccttgggattaaaaatacgataccttggaatacttccgggtgaaatgctacaatggtatatctgtgcgcttgtggatttacttctgtaaccataaatatacgaggactatttctggcgccattgctgggaatgaatatttctagcaatgtccttaagaaataccaacaagcatttctggcgccgttgccgaggatgaatatttctagtaatgtcgttaagaaataccaacaagcatttctggcgccattgctgcggaagattaataatgagatgactataagctaaccttgattgttttcacttgtgtcgtgaaaatagggtagtgtatgactggtttcaacctaccggaaaactttaacgagaatccagaggccttcttctggagtgtcaaacctcgcgtcgtccctccgcagaagagactctccgaaaagaaaccagccatcccagtgtcaccaagtttcaggaacaaggccgagaagactcttcattaattcgttgccccgtctattgacaacgtgcctgctggcccagctgtcaacatcggagacaccgatttcgaccttaagaacaggctgctaactatagcataggcaagcccattctatggcaagcctaacgaggacgcaagcgctcatctgcagcacttacacggaaaagggtgtcagtccggacgccgttaggctatgtctgtttccttgctcactcctgggaaaggcaaagcagtggttctacgtgaaccgggcgacagtcaacacctgggacagatgctccaccgcgttcctctcaaaattcttcccgatgggatgatgccgcttattttctgcagtgatccatgtggaactaaatgaacagtagatagagcaaagggataagcacttgctggtagcaacttgcaatgatcaacaatattgttgaggcgcattttcacaaaacaataattttctagagtatggcatgaatcttggcacatctaaataagtgaaaagatagtcctttcttgcaaaactatgcatccacgccggtggcaaaatatagtccattggatatagacgatcagaaatttcaaccgttagatcatccacatcaaaattttataaagccccgattgagagacttctatttcagaagggtcctctgaccttcatgtcggtctctgttgtcgaaacgacaactgcatacgtcaaaagactggttacttaacagtggttggaaagaaagtagagtgtatataattgagaattttttcttgggatccccctgttacatggacctagaaggctatttatagcctcattacaggttcttactactagggtttaagttatacaggggaatttacatggttccccttatgaaaggggcatttacatgggtatacagtgtaattgaggtatatgggctcctaatgggccgtcaggcgatcgttggcccaaaggccactgggccttcgtgaggccgaacttgctatggcgaagttgtctcccttcgacatacactcttcgccttacatccttcgcccaagaggtctttggctctgcgaggcacccgagtgattctccgcccttcgccgtctttgatccatagtcttcgccatgtgggcttcgccccaactgatcttgacgtcttaggcttgaatccttactggtcgcatggtttcggcaggtttggtcgaagggcctcatgccaaaccgcgaactagcccctcatgggcaagggtgagataggagcttcgggcgagaccgtgcagaccatgtggtatggtatgtggcgccccctttcgaccgatgctcctgccgaaacctatcttattcctgcaaagaaagtgcgttgtgtcttttcggttggtattgttttgtagctttcacctcttgcggatggtggagttatttttttatttttcctgggccgaaaggaacagtaatgggctttcccttcgtgggcttattactgtgcggctcggttgatgggaatttaccgtttcgcctacccttgcgatacgtggcgctttattactggtgggtaggcgaaccgttgcctgggtgggctatatattctcaccctcttttcccttttcaccgccacacttgtcatttttgccatgcgcactctattccaccgttctttcctttcacggtgccccttgacccctcatatctttcgcccattccctttgtttgccactgcacacacccttcgccatggctcctcgaaagccaaaccccgcttcggcgaaagggcccgatcccggccggattgacaacgacaccacggcctttttggtgatttctctcatagatgatggcgagctggtgaagttggtcagctctggggcgttggttgaggggcaggctttcgccctgggaaggccgtggtaccaaagcccgtcgacaaccggacggtggtgttcatcgtcttttttgaggcggggcttcggttcccgtgcaacgtgttgttgccggagatccttcgccttttccaggtagagctcccacagttgagcccgtcggcgctagtccggatcgccatcttcgactgggcgtgccggacctccgggtttgaatctagcgctgaactctttggcgccatattttttccaccgtgaatttgaagacggtggtgaccccggccggaacaaagaagacgatgttcgggagcatgaacttcaacgttcgccccgagcactccgatctctggccggtgaatgctgccatgtcgaagtgggatcgccactggatggcgaggtggttctatcacaccatccccttcgaggctgggtccgagtcggcgaaggcccttcggtgtcggcgcagggcgattgcgccgaaccggaaacccaagatcgccgtggacggcgccatggaggaacggttcgccttgctgcgcaaggtctgctcccgcatcagctgccgcgacttggtggaggagttctgtatgcttctcattttcccctctcccattcgtggcaagtcgcggttgaccaagatgaagaggtcaacggtttgccgaagctggttcttcctgaggggacgaacggtgagattgcgctttcgctatgcgcttatgtgtttcgctatttttcctggctcgacgcttaatatggctacaccttttattttcacagtgttgactctcgatcaggccgatgccaaagcccggaggatgatcggcgatgtgtcggtcatcgagtacagccagctgctcacacgacaggccgctggtcgggtggaccgggtttacgacggcgaactgcctccccgggcgaacccccacaaggccgacgacgatacagggccttcgcgaaagcggacacacggacaagtgagactggcccctagaaagcaaagggtccatgcttccttcaattctgacgctgatgacgaggacgacgtcgaagagcgtgacggcgaggaggaaagggaggaagaagagggggcggacgctgcggccggaaaggctgcggacgaggcggtcgaaaaccacgccgagacccctggctacactcctactacaagtccagggcataatgacactggggtggagtcgaatagctcccccgttcattgaaagtatttgcagggggcaaaggcgctagttgcgttttcggcgggaaaggtggcgaaggggtgtccagttaagaaggccgccaagaagaaaggactcgtcgatgttgctcgtgtttttagcgacgacgagtcttctgacaaatccccgacttcacccaccggtcgtagcttagatctttcgaccgcccccgttcttccgatcgacgctagcggagcgggtggcagtgccgccgccagggcctcagcctccactgatcgtgtcgtgaaggctgcagctagggtttttggaagccctttgcgtcagccgattgtttcgctgctagtgaagccgaaggggaagggggcggccgtcgaaacatctgcccctgaatattctctcgcggcgccccacttcgcccctggcgatttcgagacccgggcggaacttattccctttgttgagggggtaagcaaccttgtctctcctgtcggcactctgagcctattcaccgagctgaatgagttcgacgaagggtattctgctattaaaagcttggcagttcgggtatgctgttcgctctctcttcttgtttgtctttattttcttcttacagatcccacaactaacatttgctctcttcgtccgttttaccttacatccagattcttgcggctcactgttcgatagagcgaaccgtgcgggcccgtcttgacagatttaggatacatcttcgagccaaggatgatgagattggccgcatgagtttggagatggaggccctcgccaacaccctcaaggaggtgaaggcgcaaaaacaagcgactccaagccgaactggagaaaggaagagaggccagagctgaggtcgatcgccttaaggccgaactggagaagggaagagaggctagagctgaggttgatcgcctcatggccgagcttaaaaaggagaaagcccattcggctgtgctgaccgactattacaatcttactgagccgaagatagaggctcttgacctggaggtcagcaaggctgaggcaagcgctgcggaggagtcgcagcggttttcgcgggagatggcaaaggccaccgagtccgcaaaaacggtgtgccaaatgctccgccttgccctcttcgacatgggtgtgagggtgcgaggagtccccgccgaagatgcctctgcctttgacttttcggagtggacacagcaggctgctggtgtagtttcggactgcgctactgcgtacggtgattgctgtgcacgtgtatcggcggccttcactatgggccttctgcaccagtttggctgtgagcacgtcgccgagttccctaactatgcgaagggggaatgggaggttagtgcgcaggacgtttcgcccgcgctccgcgcgtggtggagcagttctagcagaaggacggccgatccactgccaaggcgtgccttttggagcaaccggcggaggcagaggtggcagaccagggcgaaggtgaggatgcggcggttggatggggtggaggcgatgcctaggatcacccagaggtgtgaggccctccgccctttccttagatttttgtagtttttcttttttttcgtttgccgcaaaagacgaacaatgtatatttggccgatggccccttacccttcttaatgtagctgaaaatggccttttggatatttggaatgtatgactcagtcttagtcattttttatggtcgatgcctttggcgtatgtgcttgcgccattttcgtattacgtaatatttgctctttttcgcccattcttactatgcaatttgccttttgccctgtctgcactgtttagcagggtgttcgccgaaaattgtgcactgccccctctgggaattggcgaagcaaaaacgagaaattcgtggtgttgaagggtctgccaaaagtgcgatgcccgtttcggcctatttatcgcgagatggtaaaatacggccacagctataaggtttttaaggttgccggctggctgcaggcgcaccccgggagaaccttagaagattacgatcgtgttcatacaaaacgtttggaggatatggttcgcttttggcgaaatcatcagaagaccttagaagattgcggttttaacgtttggcgagcgatgcttcagccgattcgtttcgcccccctagcatttttgctgatcaggcgtttgccttagggcttttcccacaaattatcaatcacacaaatagtaaggcgaaaaacacaaagattttatactggttcgggcctccgggatggataatagccctacatccagttttttttgtcttttttcattttcctctttttttttgcattttcgtgccgaaaggcatacatagtgccgaaaggcttacataacaatatgtacatttttacaagttggcgattcgggtgccacccgttctacacatagaaacgcttgagagaggcagcgttccaggaacgattgaactcttcgccttctagtgtcgctaggcgaaaggaccccgtcctggacttgtgcttgatgaggtacggtccttcccacttcgattcaagcttgccgaccgccaccgagttcgctttcttccttaggacgaggtggccgggcaatagctccgtcggtcgaacttttttgttgtaagttgccgaagtgcctgcgacgtatttgcgcatctgttccagtgcttcgactctcaccccctccaggagttcgagcgacacctcgcgcccctcttcgccccaagagaacatcacccttggtgaattagcccctagctatgttggggtcattgcttcatcgccatagagaagcatgaacaggctgaacttggttggccttgtgggggtcgtccgaagggcccagagaacagatagcatttcatctcgccatttacccttcgctgccccctcaagccttttctttagtgcttctaagatcttaccatttgtgcgttcggccgccccgtttgactacgggtgtgcgatcgacgtgaacatgatttccatgtttagcccctcacgcatctctctgaacttgtcaatgtcgaattgcttgccgttgtcagtgatgaactcttttggcactccgaaacggcaaacaatgtttttccatacgaacttctaaactgctgccgaagtgatcgcgccaagtggttcggcctcgatccatcaggagaagtattcaatagccacaattgcgaacttgtacccgtttcgcgccaccgggaacggcccaatgatgtccagcccccatctggcgaaaggccaaattggtgcgataggctgcagctcttattggggcgcagtttagcttcggccatggcgctgacagctttcgcatttcttgacttgctcaacacagactttcagcacggtgggccagtacacaccttgtcgaaacactttggaggcaactgttcttgcggcctgctgtgtgcctctgtgaaacaaattttcggcaatatgcaaagggggtagcgcacgagacctaaaagtagatggatgcagagacaaaggatttagacaggttcaggccctcccgatgagaggtaataccctactcctgtttggggatttgaatccgccgggtgtatattgatctgacgatcaagttgtctcattctcatgccccctagagggcctcctgccccccttatataggatggggggcaagattacaagatagaaaccttaaccaatacggtatcggtttcctaaatctactttacaatcttatcaaaccaggactttaggccgttccacaatatacagggaaacgtaatacccaagtcatgatccgttacatatttcataaatataagtcatcccctatagctagtcggataaccatgccgtgtggatatggggtaccataatctccacagtagcccctgagaccttcacagtcaaaaagataatcttctctcgaactagattactccaaagctgagtgctttaatcatcttcgctatggtctccgaagtacttttaaatatgaagactgtggagggctgaaaaataaagtcaggtgcatcgactagatgcacctaataggtgtagccccccgactatgtggttagctaaacaaactaagcatatagtcaaggaataaataatccaaccaaccgagtggttttgataattgtaatcaaccaagtgacttgatatcaatatatagcatatgcggtgtgaatccctgaataacatgatccgagtgatatactgactgttttgtaaaatatgatgagtgtaacctaaagttggctacatcattgaaaattcacatagcaaaacagctataaagaagtttgtatgttgtgaataaagaaatttccaaagtattgggcatacaccatgcgcacacttctttaacagatgtgcttgagtccataaaagacacatggtttcaccacacctagaaatatatgccatatgtggtataaaatccgagtaaataaactcataaggatttatcaatcgtttggaaaatgaccaaaatatataatcagcctaagccataatattggtcaataaaaatgcacacttacgtggcaaaaagcaatgatattgtatctaatcaattgctttatgaacccaaacagcgccttgacttatataaaaaagtcagcggggagctatataaagcattattgtttggcaccttttaaaatgtattgtaccaactcctaaaaagttgagtaactgcggtataaaaggattttaaggtattgggcacataatcacgcgcacttttgcctaagcaaaaagatgcctaagtccctaaaaaaacgtgacaggccacacctgaaaatatgggctgcagacatattaggcctaggccaaaaaatatgccttcgacaccctttaaaggatcacgcatgtaacatgctcccgagtaataaatctttcgggtgatatagaccaagtgtagctcatatgaatagcttctgatctgagggattatcctttatgggatactccaaaatagatataacaattgaatttcgactggcgcaagtattcggttaataacccatacggggaataataaatagtccagtctttgagcatagaaaatagacccatgatcatcaaattcatgttgcatgtatccggaacaagtccaaattggagatataatcctcacgcttgagttgatgagcccctgagcatatagcttgtccttctgtcatagtcaccattgtccattgatggtagctgatgcagttggcatagagacaagacgaccaatatagagataatattgcccaccagaggtggcaaaaatattggtagtagtgaagatagtgataccaatcaaaagtgatgaagttgcatagccgtggaggcgaagaaaccagtcggcaaccgttaggtcagccagcaatgaatatgaaggcacccagcgataaagttgtgtagccataccagcgaaataattagtcggtgacagacgatgcagctggtgaagaagatgaagatgcccattagtggcgacataatgagccatccatgaaggcgaggataccggtcggtggtgacgaaagccagccgacggtgaagatgtaggcacgcatcaaaggcgatgacgaaatccaccaatcatgaagatgaagaaaatagtcggcgacgacaaacacaaccgacagtaatgatgataagcagcaatcatagatgatcaaatataatgacgaagttgcccatcaatagcagtagagtgggctatgttgaagaggcttgataggatgttgataaagatgacgatgtcggtgatccagtcaatagcagtgtagcagccgatgataatgacgatgactctcatcagcgtttgcatagtaggtcaaccgtgaagacgaaataacaagtcggtgatgagagttgatgatgataaaagtaaccgaaggcgaagacgtagtcgccccttagcaatggtgtaaatgtcagggccgatgaagtacacatgctggtgatgatgtcagtgacaataatccatcaaattggtgttatagctgttgcagatgcttcacttggaggaaagtagatgatgttgtccaactggtcgaaactgagctgattggttgataactctgctctaaagcaaagacgaagataatgactcctggaattgactcgttggctgattaattgattacttcagcttgtcgaattttaagagtcttgtatttgtgtagcccccgactctttggttagttgggaaacaactgaacatagagtcgagaactgtaacttcttgtcgtcgagtagtcattacttgagtgaagataaatattaaagattggaacaccacttgttgtaataaaataacacggcatcatatttggtgacgtatgccgaggtgtcgaaactcttgtagtcgtcatggttggtgaagtagaggcaatagagtttgccgatgccgaagataataaaaatgaagttgctccaccatggtgacaaaattgcatagccgtgatgaagtcaacacgactcggtggcaacagaagcaaaccggtagtaaagacgcgcatttgtgaagataaaagcaccagtcggcggcggcataaccagtcgatgacggaagacgatgatgtccatcagtagttgtagttgtgttgaagatgctgacgcctattagcggtgacggcgatgtagccagccgtgaagaagatagcatcagttggcgtcataacaggccagccgtgcaggcggtgacaccagttggcggcggatgaggcggccagtcggtgaagcggtcggttggtgaagacgtagacgcccaacaacaccagtcggcggcggaaacaccagtataataggccagccgtgcaggcggatgttctgactgatccattcctggagcgtaagagataagcttaaagccatgaatcccttttatgcatatctggatctggatcctacagaacaaacatataggatgagtagtatctgatataaatataatactcgagaaaaattcaagtattttaaaatatttataaatatatatttcttctcttgtcaattttgatttccccgagcagatgactcattacgtttaaacattctgcccgactagtcatagccaccaaacaccgggagtcggcctaagcactttccaaacatgcatatgagtgacatgagttcgtcattaatggaacaaagtttcacgggtcggagtttactactcgggtacttttgcaattattaagagcagaaaataaattatcttatctctatgcttttgatttattctgaataatacttagcaccttgcgttattcggtccatccaacaagcccccgggtgctaggaatcagcccaaaggcaactatccattggcaaaccaaacggaaagcataggaagatggaactccataactcgataggcacttttgtactcagaatatgtcgcaagcaatcaagataaatattatgaaaattgtttaaaaaaaatgatataacatctatagcccccgactcactagtcaacggcgaaccagttgatgtagtgaggcaaaggaaaaggcaaaatatcatataaagaataaaataaatgatgacttagctttattgtattccctcggtgacagcaaaagtagccgatgtgggaacgaagcagtctatcaatggtgacaaaaacaccagtcggcgccagtggaaccaagccagtggtgtagatgatgaagcccattaacggtggcgaagtccgccaaccatacaggcggaaacaccagtcggcagcggacgaggcggccggtcggtgaagacgtggatgcccatgaacggtggtgtgaccaaccaaccgtataggcgaggacactagtcggcggcgacagaggcaagccggcggtgaagttgttgttgctatcagcaatggcggtggcgaggacaagccggcggagtggactcgcggccgatcgaccggaaagctgagacgcctcgaatccatgaccagcatcaatcgcctcaatagtgccgcgtaattatatgcgaacaacaacaaaaaatagcaagagattaatctgacattaaaaatcaatatgataaataatgataaaactaggcgtccggcgctagacgagtagttagcatgagtagatataaaaaattgctcaatggaaaatatcacataaagaggaaaaataaaggcacttagcttttttctcagtgtcctccgtatatgtgttaatggatggacaggagatcatatcggcagcttgtgacagacatgcaatacatgcatgagtgctgcacttccttgcgcgaaaattgctcctattggttggctcacattccacgtcgactccaatttagattggtaattgaatatcaccaggagatttaacgtcatctaaaaaaaacgctggcggttgagaattgatccgttgcttggtgatccgggtagattgatatcgccgaacagattaaaccagatgatggacacggcatgtcatacgatcaagttgacgactgacgtcccatcggaattttcggtggtggcgatgcaagccaaactccagaagagaagaaccagtccgaagatgaaggtggtgctgacggcagccataggagattgaatctgaaacttgccgtggtagattgttgtaatccctcgattgagtttccccctgactaatttggatcaagtcagagaagaggagcttgaagaagttatcgacggaaaggaagtgaaaactcccgaagctaaaacgaagtcggcgactcatgaagttgattccatcgcgctcgttgataggaaactcgacgcagcccctacctggcgcgccaactgtcgaaacaaattttcggcaatatgaaaagggggtagcgcacgagacctaaaagtggatggatgcagagacaaaggatttagacaggttcaggccctctcgatgcgaggtaataccctactcctgtttggggatttgaatccgccgggtgtatattgatctgacgatcaggttgtctcatgccccctagagggcctcctgccccccttatataggatggggggcaaaattacaagatagaaaccttaaccaatacggtatcggtttcctaaatctactttacaatcttatcaaaccaggactttaggccgttccacaatatacagggaaacataatacccaagtcatgatccgttacatatttcataaatataagtcatcccctatagctagtcggataaccatgccgtgtgggtatggggtaccataatctccacagccacaaagcccctggtgtatttcctttgccatttcctcaacttcggcgaatgagatgcagcgaagcaaaggttggagcaccccagatcgatatagttggcccgagaccatcttgtactttgcggctctgagctgtaagctctttgcttctgcttcgtcctccggaagccagccgctcttgaggtaccttatgaacgggggtcgccagtcttctggatcttcgcccagttctacctggtcgattgccataatatccaggctctctatgggcacgcttggtgcgtgtaggacttaaaaaagatgccaggcgaatgcgggcccctacaagcaacagatttcgccaaggcgtctacttcctcgttctggtctctaggtaagtgttcgaccgttatgccggtaaagcatttttccatagaccgaacagcctccaaatacttcttcaatccttcttcttttgcctcaaaggacttatcaacatgacttgccaccaacttggagtcggttcggatgagcaagtgccgaacccccaatgctttcgcatttttcaggcccagaagaatggcttcgtattctgccgcgttgttggttgtgtcgaaatgcagccttgcggcataccgaatcggcacgccccctggcgaagtgagtactgccgtagcgcccgcccccttgtgcgaccacaagccgtcggagtacatcacccagggttgttcgacgggctcaggctcagggtcgaacgccggtgtccattcggccacgaagtcagctagaacttgtgacttgatagcagtgcgagcgacaaaatgcaagtcgaagggagatagctccgccacctatttgctgagccggccagtaacttccttgccccggagtaccacgcccaaagggtactgtgatggcactgtgactttgtgggcctggaagtagtgtttaagcttgcgcgaagccatcaccagtgcgtaagcaagcttttctatttcaatgtatcttatcttcactccttgcaaggcttaggagatgaaataaactggtttctggcctgactctgtctcttggacatgggcagcagtgactgccactagcgaagctgccaggtacagtagcagttcgcttcctggtgctgggcagatcaaatcgggtgggctttgcagatattgctttagctcgtcgaacgctgcttggtattcgggtgtccaggtgaattttcccacgccccggagggtcttgaagaagggcaaatttttttcggctgcctttgagaggaatcgactgagtgccgcaattcggcctgcgagcttctgtacttcacgtacgctcgacgggggcttcattccattttctcgtggttcgcctcgataccccatttagaaacaaggaaacccaacaacttgcccacgcaaacaccaaaaacacacttctcaggatttagtttcatacccgccgcgcgtaagttgtcgaaggtctcctacaggtcggacgcatggtcgaaagccttgcggctttttacgacgatatctggtggtagccggagtacgcatcaaagaagctcatgagttcgcagccagctgtcgaatccacgagttggtcgatccgtggcaagggaaatcgtccttcggacatgccttatttaggtctatgaaattgacacacatgcgccatttgccgtttgatttccacaccagcaccggattcgccagccagtcagggtggtccatctcttgaatgaccccagccttgagcaattgttggacttcggcttttgctgcttcttggcgatcagcggacatcttgcgtagcttctgtttccttggcttggcatccggcttaactgccaggtgatgcatgatgagatctatcgaaacacctcccacctcatcagggccccaggcgaagagatcaatgttttaattgagcacctctaggatgttctcaactttttcttcacccatgtcgccccccagcgatacaagctttgtgggatcggcatcatcaatctgtatcttgattaccttgccatgaggggcgggctttggcgcgtgcttcgcccgatcatgcggttcggcctcaacattatgcactgctctgttgattatggccagatcaccctttgaagcggccgaaggctaaagccccttgaccacgatcactcctgccgggccaggcatcttgagcttgagataattgtggtgggaaatggcttcaaacttgttcaaggtcgcacggccgaagatggcattgtagttgtacgggatgtcgacaatgtcgaacaatatttgctcttcgcgtctgtttttgcctatgccgaaagctactagcaattgcgcttggcctagaacttggactgcttctccgccgaaaccacaaagcgaggccggtgcttgggtaagggctagggaaggtaatcccatcttggcatatgctctggcgaagatgacatcggtcgaactccctccgtcgactaagattcaccggacctcgaagccagctatctcggccgagatcaccagagggtcttgatgcgggaacattactcctttggcgtcttccgacccgaacgagattttctggtttagatattgcggggccccttcgcccgccgaagtgatgttgtggaccattcagagctgcatcttcttttgtcgtttcgacagttgattcggcggatcggcccttgtaatcacttggattactctgcactgcacatcttggcgctgttcggccgggggtgcttgttcttgaatggcttcgcgaggtgcttcgacagctgctccctgttgcggccttggatcttgcgcgttgccacgctgccgaatatttcggcattgctcggtggtgtgcaaagagcgtccgtggaaggcgcagtaaatgtcttttcggaccttcttgcgagtaggctgctgatggttgcttgcttgctgggcatcgaactccttgcggagggcttgaacttcttcgacagccatcacagccttgcccgcacagtcggttctgaatttcctccaagtcatgggagcttggccttgccttggcggttgtccttggttcgccggctgaggctggcgaacagcgagaagaggtggttcggtgacctgagcttgtacttgggcttgggcagtggcgacggaggctttatcatactcagcctgaattgcttgccgtcgcttggaatcttcttcgccccttgcgtacccgttgatgatgcgaagcaggtgttcaagcatctgcggctctttgttggcaatttttcttgtgagtacgccctcgagcagccctgccaaaatggcgttgatgactgacgcctccgttatgtcttgtacttgacaccgggcttgcgagaagcgacgcatgtactcccttatcgattcccccggcctcaggcaaatgccaagtagatgctgctatgtcttcagctcctcgtaggtgcctcgaaagataaggacaaagacatcgcgcaattgctcccatgagtaaatgctgttggctggtaaattgaagtaccaagaacgggcgatgccatctagagtgagatgtattacctttcccttggtattttggtcgccatgagccgcttcgatcgcggactcgtagatggagaagaattcctttgggtcagtttcgcctgaatagcgtgggacgggtgggaacttgaactggggtgggatcggacggatcttaattcccccactcagtggtagccccttttcgccccctgccctattcacggcaccttgctgcggatatggtgtggcgaagggcgaggtcacggcctgcacgtgaggttgaaccacggtgttcagttgcctggctctgattggtgctgtttggtgagccgccatggatgggtcgaacgttggctggggccacaccatggcggcctggtttggtgcttggtttgccccgaagcctggtgttgtttcttgcggccgaaggtttggtgcctgagcagtgttgatgaagtcgaactgcggtccttgactccaaggcgaagcccccagacccggctgattccacggcaaccaactgggcgcaccttgacttgtgttccccttcggctaggctgaaggggttgtacctgaaatgttgtggggttggctgaattgttgaaggaaagcttgaacctacaccgaagccccttctgccatcgcttgtgacacttggccaagcggttgagagtgtgtttgggcagcgaccggctgagcttgcagctgcacgtgaggggccggatgtattgctgcggtcgaaggctgcctggtgaagtatactggcgcttgcgtggcttatgacggaaggggctggatcggtgcttgtggatagacttgggtgggatgtagccttccgaatactggaggattggggcctgaaagtgtatctaggcccctaatgattttgatgattgattacaatgcgattagagaggactaacacttttattcaaacaagtgtgaaggttgttatgtcctcgacatgttgtaatgagatgcataccccatgaatgcgacatcacgatgcaatgcggcaatgatcaaatggtatattgtatcttttaccttgcattatgtcgtactattaagagggataccacatgcatataattggtagaacactagtgctcaaaatgcttcatctttgtgtgagttgaaaaacctaagccaaaatttcaattccgagttgttcacttgtcacaacacttacaccaggtttctttgcaagtttttcaacatctcttgaaggttttggaccatgttttatgttggttttgatagcccacgaaactagctttccatagagtctaagatcttcgaaatcggagtttggagtaaaaagttattgcatttttactggagcaacatcagactatccgatttgaaatcagactatccaatgtatcggactatccgatttttcacaaaacttcactctctgtctttgtttgaaaaatactttcgagtgagtttttctatgtgtcggagtatccgatgttggatcagatagtccaatggtacagagactccgaaatttcatggaacttgagtctctgtttgaggacgaagtttttgcttctaaaatatcggacactctgatttaacatcagatagtccgatgtcttggaaagtccgaaatttcatcgaacttcgttctctgtttctcgttgtcttggaggtttaaaatatcggactatccgatcttgtatcggactatctgacgtgggatgaaagattcccctccaacggccacattttgggggggtctataaatatcccccacctaatctttttctagggtgacccaactcattcattcacattcactttgggttgagcttggtgctaaggtgctttcgatctttgagctctttctccctttctcaaatccctcctcattctttctgtggtggatcttggtggttgtggatttggtgtttgagggcctagtgtgtgtttcactcgatcttgaacactagggtttgaccaagagttgtgtggtgtttgttactcttggaggttgaggactcctagatggctaggtgtcactctcgagccaccgatcaacgtgtggttggccgggagaagtttgtgaaggccggatctcgcctccgcaaagaaagaggtaccccttagtggaaggaggagtgcttagtgcaacctcttgaggaaagggttagtagagacccggctcttagtgagctcctcaacggagagtagaatcccctcaaggatttgaactccgggaacaactccgggaacaacggagagtagaatcccctcaacttcatcgttggtgatatctcttcatcttctctttagctttgcttaattgtgccgctatagatctagctgttgtttgtgctatactcttgtttgtgcactagatctgcttgttgtgattctttagtggatcagacagtctgatccaacatcagactatctgatattttcggatagtttgactgtggatcagactttccaaccctaactcaggtttagcttccgcataaagttttaaattagcctattcaccccacctcctctaggcctaattgaccctttcaattggtatcagagcctaatctcctaattaggcttaaccgcttggagagatcatgtcggaccaaacggggaatggcaaggatggtgaaaagggagctacgttttattatgactatccatccacatcaacctcttatgtgagtacttatagcggcaaagctccgtacttcaacggcacggactatgccgcttggaaacataagatgaagatgcatttgaagtctattaacccatctatttggagaatagtcgaaaagggctatgttttgcagaaacccgaggatcccaccaatgaggatgacgagaacgagcattagaacgctcaagccgctaatgcaatacttagcgccttgagcggaagtgagtttaaccgcgtggacggcattgagagtgccaaagtgattcgggacacgcttcgaaattttcatgaaggcacggatagtgttcgcgagtccaaggtggagatcctcaaagggcaatttgagaggtttctgatgttggatggagagagcccaagctacatgtatgaccgtttgagcaagatcgtcaatgagatcaagggaattggctccaaggacatgaccgatgaggtagtggtcaagaagatggttcgagcaatcattccaaggaactctaccttggtaactatcattcgtgagcgtccggactacaagactctcacacctcatgatttgcttgggcgcatccttgcccatgacatgcttgtgcaagagtccaaggagttcatccaatacattaaccaaagctcaacgacaagcatcaagaaggaagacttggcattgaaggcaaagtaagaagaagaagagagtcgcaagagcaagagcaaggcggagatcgatgatgaagagatggcactcttcgtcaagaagttcggcaagttcatgaagcaaagtgtcttcttcaagggaagttcgtccaagtattcccctaacaagtcaagtggaagacacttcgcaagggtgtgctatgtgtgcaaagagtccgggcacttcattgtggattgaccccacatcaaggattgcccccacttcaaggaagacaagaagaagcttgagaagaaggagaagcacaagcatagctgaacgtgtagagatgtagcctagagagggggtgaataggctttcctgaaattttctcaacaatcacagcagttaaattaatagggctcggaacctcctggtgatgaacaccggaacatccgggcaggatgagtagcccggaacttccggagttcttgagctaggaacttccgagcagcagagataaattaaaactgagatgaaaaacaggtcctagcaagggaagtttaggcacacagaggaacaagatgaagattgcagaatatcagcagattcacacaaagatcatgcacaagagagacaaagacgattttttcccgaagttcggatcacatgaatcctactctccgttgaggtgctccaaagagccgggtctcgattaaccccttgcctcacttatgcaaagatctcagaggaggtccacagccttcaacttaacacttgttggcggatgacatgaggctcttcgaccagatctgccgaaacccgtggcgaaggctatggagcaagaacggcgtgaggtgaagagtcgcacgagggccttgccaggccaggggcgtctcgggcgatgggtgcaaggcgaagactatctgccgaaggaagacgacttcgccatggcaagttcgcccccgcaagggccgaggaagcctttccggcccatcaagcctaagggccggcaatcgctagatggcccatcaggggcccatgagaccctataacattatgtacccctgtaaatgtccctttcataagggtaatcatgtaaattcccctgtacaatctagatcctagtagtaagagcctgcaatagggctataaatagccccctagggccatgtaatgggggatcctaagtgaaattcaaaatttagtactcaacatccttcgacgtatgcagttgtcgtttcgacaacaacacttctaggtcattttctagaattgagtgaccaccaagatcaaactcaaaattccttctagaaaaggccacaagtgcaagttgctctacataggacaacctctgaaaactcagcacaagaatctttactcacttatctcgtttccttgtggaggtgaggaaaaccctcacaaactttcccgggacatccacaagatctttggaagctcacgggcgacacctaaccgtctaggagaagatctctgagagtatccaaagtgacagcccacaaggtatccaaagtgctcaattaaacgtaatcttcaagccatctccaaaacactcctacactctcatctaatctctcaatctcacaagatagactacagatttgagtggaggaagcaaaggaagcttgggagtggctagaaaaccctagaacatgacagaactgaagtggaatggccaaagggtgacctggggacgaaatccatatatataaatgctaggtgacgtcatctagccgttactcacaagtttgaactggaaacctgccaggaggttccgggcaaaagtgccaggaacttccgggcagaacttaggaatttttttgtaaataaacggcgcccggaagttccggccagaacctctgggtagccctctctgtcccggggtgaaaatcatttttcaaaaatgattccaaaaatcttttgactcatggatatgactaagagcactttgtataccctagaaccacacttgaaacccctcttaatagtacggtttttcctaaactcaatttcgaaagtgaaaaacctagtctaatcaccttcggtgtttttcgcacttaggaacattcaaattgggaggtctccttgcattcttagccatcaaaacttggtttgggactaaactcctatgaataaacttgataaacacgtttgtcacctttaaccaccttgtcattaatcaccaaaacccactagggggtttaagtgcatcttcaatctccccctttttggtgattgatgacaacatggttaaagcaaataaaaagacaatagaatttaaattttgaatgatgagagaagtgtgaagctccccctaaagatatgcatataaagaactagaaatgaaaacattatgcataagatgaaggaaagctcaaaagaaacctcacactacccttatcaaagaagagatgcagatgaaagtgcttgaatgattagtgatgcaaatagaaagactagatgacatggcaatcactcaaaaagatgaaaagaacacaatcatcacatcaaaatgcaacatccatatggtctaacttactgacaaaaagaataataaagcatctaatagtcattacatccaaccataatagaatacgattacatgtccataagagagggaaaatagaggggagatctgcttggccggaacctccggatcacaggacccggaacttccggccaaatgaccagacaacagtcaaggcagcaaaaaagatttaaatgacccccttcaattcacaatttctccccctttggcatcaaggcaccaaaaagcaagaaaccatgaagagaagaagaggatcactcatctccatctccatcggagggaacaatctcggtatcgtcggagagatgagattcatcggactgtgcaacggtgtcaccctcatcaacatcggtgggagcatcctctgcagctgcctcggcgtcaccctcatcaccatcatcatcatcatcatcagaatgggaagattcttcattgaagaaggtggatggaccttcaccggcaacgttgcgggctgcctcataagcctcaaatggatcaacatagacctcatcctcagaatcatctgacacttgcttcccagcctctcttctatcttccttctgacgcctttcgatcttcttcactttcttggcagtcttagcacacatacagaaaattgcctgaagagccttcttgatgggagaagaactcgaggaactcggtggggcactagtagaaggaccagctgaagtacaaggaacagatcgagggaccactggagaagaggaaggtggagcatgagggcgaaaaggattatggcgcccatctttgatgtagaacaccccagtgattgtctcaatcatcttcataatgaaaggagcatagatgcaactccgcttaggctcaagaatggtgttggcgatctcataccaaatcaacttcatcacactaaaaggaggctgattgtagcgcatgtgactgagaagatgagcatgcttggatggcaaagcagtagcatctccaacctttggaagcaaagaccaacaaaaatggagtacaacaccttgtagttgggatgcaatccatgagtagatcccatgcaagtcctaggtgcatcctttgcatacatgaacttggttttgatcatggggaggggtgcttcactatgaatgttgggcctattgagatcctcatcatctaaccccaacatctcagcaaactatgccatggaaatcttgtgcctaacaccctcagtcaaccacttcacataaggggttcccttccttgtagtaccaaagaatgttttcacattgaactgtgcaataacttcctcattccagtcatactccatggcgagaatatctccaagattcttgttgtggcacacttgcgtcacttggttgaacacttcattgtttttcttcctcatgtaagcccaatcaatccacttcatcccaaccactgaattctctctagccataatcactgagatataccaatccaattgagtgaatgtcctaaagcgaggatcctgtgactcctcaggctgtgactctggatcaatcaaacgatctcttctacacttggcaagttgatgaaggtagttggacttgggtcttccaatgtggtgcataggagtggtgtcaaaaacaagagtcttgtagagccgaataggattctcacgagatcctatagggaaatcatgagatgccctttcagccccagaactgcgaccaccacctctcccccgtcctcttgtattaggtgcatcacttccttgaccactgtcagcatccctaatctgaacaggacggttgctggattgccttgtaaacctgggagaagtacgagtgccactgccactgccgccctcaacaactttctctttacccaaacgaccacgaggaaactaaataggaggactctcatcaccggacacatcctgagaggctttctatattttctcacgagtcatagtgcttactgcaacaggaatcaacaaattggagtgcagtagttaggcaaaaattgagagaagcaagaatgacaggctggctggacaacgcccgaaggttccgggtgcaagaacaccggaacttccggccggcaaaaatgaagaacagaggtctcaaaaatagccagtgcatgtgaacaaatcctatagatcggtgatccacaagatagcagaaacaagactatccaagtggttttctccctaggttcacagatttagagatcgggataaaaatacaatgaactgagagagggaatcaaaaagtgctaccttgagagaagaaactgcgaatcgatcacaggaagaacctcccagccaccaatgtagatgaatccacggagaagaatcgaatttgattggagggaaaagaaaatcgccactcggggcactgtagcggcggctagggctggcgttggggagggagaagaatgaggagagagactagggtttctaactccccctgagtatatatactccccgacacccggaggttccggacagggaggcccggaacttctggcctgacagataaagggcagtcaggcccaaaaacaagaagaagatgagaatccaacaaggggaaataaagaactatggacatgtagagacttatgatgcatatgaccagccaacaatcaacattatataataatggtcaatatacaccacaagaaggggataaaaaccaaattttcaaaataaaaggtacacaaaggattttgcaaaaattttcacaaaaggggtttttggatgaaggcgaatgtttgagctttattcctggtatcaagatcatcttctaccaagaagtgatctcaagacacaaaagctcattttttttaatttacattttagtgatacatgtttgactataaattagctaaccacccatcacctaatgttgcgagaatctaagatattgagctcactcctaagctcacaaaatcttttctcatctaaaggcttggtgaaaatgtcggctaattggctttcggttctcacatgtgtaaggcatatgtctcctttggtcatgatctctcaaaaagtggtggcgaatatctatgtgtttggttcgagagtgttgaatgggattattggctattttgatggcactctcattgtcacataggagtgtgatcttggtgaagttgtagccaaagtcttttagagtttgtttcatccaaaggagttgggcacaaaaagaaccggcggcgacatattcggcttcggcggtggataatgcaatggaattttgcttcttggaggaccaagaaacaagggaccgcctgtcgaaacaagatttcgacaataataaagggggtggctatcaagctaggaaagtggatgggtttggagacaaggaattttatacaggttcaggccttcttattcaagaagtaatactctactcctgtccgaggatgattccgccgagtgtattattgattgtatgattgggagaaaaaagaatcgtcccgagaggaacccggacccctccttatataggggaagggatccgtattacaaagtacagtccatatcctaacggaatatgggattgtagataaaatacaatcgtaaccgactaggatcccgggtattttcttgacatacaagtttagaatctaacccgagtcctcataaagatattctatctatatttggtaccgtatatccagctggaatataaccgccatgtagatatggggtaaccataatctccacagtagcccccgagaccttcgcagttgaccaaaatagtcttctcgaaacaaaaaacaataatccgagtgcttcaattcaacttgcttcggcttgccgagtgctaaaagactgtgaagggcgaaaataaaacatggtgcatcgagtagatgcacctaattaggtgtacccccgactatgtgattagttgaaaaactaaacatatagtcaagaaacgagtgattttatatcgaagcatgcatggtactcaataaaatacccagccgactccttcttacttgaatatatcaaggacaaaaaatatgaaaagggccgaatgataaacactcaaaaggtccaaaaatagatatatttggtaggaatccgagtaagaaactcttaaaatgatccaccaaatatgataaagatcatggtaattaagaagttcattagcctaggctataacccttaccataatcaaaataagcatataacatgctaggagaatgactactaataaactagtcatctcaaattaacccaacaacttttgtagcctaaaaaagcttacaaaaatggtataacacctttctgtcgggcaccttttcatgtgcatcataatcattccaaagaattattgaatcgcgtaaaaaagcattttaacagcatcgggccacatcattgtgagcacatattgccaaagcaaaaagcgcctaagtccctagggatcacaacgggccacgctaaaaacataattgggctgaaatactgtacaggcccaggcccattagtactcccaataccctaaaaacaccgaagtccaaacattgtttcgtcttccccgctgagactctcgccattccccactccgtgctacagtacagaaccgcgccgacgaagctagggttcatcaatctgctccaacccaccctcaaaaacttcacgaaatttctccccacgtccaccactccgattccccattcctctccagccatatctcggaccaaattaaaacatccagttcacattcatggcggaagaaagagaaagcttcgagagtcagtgggcgccctccgatgtgacagaagataatctgaaggagatggtggcgcacggcgttctcccagcgaaggagattatcgggtggcgaccggcgttcggcgaagcattcccgacccccgacacacacgaaatcgtggtatttgctcatttcttctatggcggattttctcttctaacctcaagattcttccgggggattctgaacttctacgggattagcttgcatcacttgaatccaaactccatagtgcatattgccaaatttatccatgcctacgaagcttttctgggcattaggcctcatttcgccttgttccgccgcatcttcttcctcaagccccagccaaacaaaagcacaccgtgcgttgttgggggagctggtttccaactcagaggaaccttgagccaaaaatatttctccatgcctttcaaaacctcaaacaaaggctggcatgcaaactggttctatgttcagaatcctgagcgcgcactccccgagtactgctgtcttcctccagtttaccaggacacatggaactcattgcctatgggagatgaagctgctcaggcagtggaattgatggaacgcatgctaaaactgaagtaacaaggtttgcaaggagaacagatcactcggcacttcatcaaaagtcgattagctccaatcaaagaaagatctcgcacagccttcgaatttgacggcaagcatgacccaaaccgtgaagacccagattctcttgacttcaaggtcatgaaggaaatgatgtataagatcatttcaaacgccattgttgtcagctactcacacttgctgccagtcgtaccgttcaatgcattcaatcctcctccaccggtacgtattcatacacttcaacctttctcaaaatatgatcttgtcttcttgttgaatcagttaacaatgaaggatattacactcaggaatttgctttgatgaagtcggatctcccaatcgctcaacgccgatctccccgccaccaaactgggcaagggagtggaggaccaagaattcggtctgaaactcagccaagtgcttctgatccagtcggccagtcagattctcgaaagagcaagctggttctaagtgacgacgaagccgatgataccaccaggaggcctggagaccgagagacaaccaagaaactaccaaaacaggctactccaaggaagaaagcatccagtcgccctgcgccaaagatcaggaagtcttctaggtataactcatataacaatctctcttgcattgatgcgcatccattgcggcaataatactgataatcaaatttgcaggaaaccatctgatatagatccgtccgggaaagactctaacccgactaacgtggacgcaagttcttccaaagaaaccggaccaactgctgaggatcatccaagtgacaatcagccggcaaccgataatgtagaacccggtgatcaacccctgaccggaaaccagtcggacacaggggcaagcgaagagattccagaagtcaaaacccatgcagacaaccctcgtggacaagacgccagcaatgaccggagatctggatctcctttaaaagcatccgagtccactcattgtctgaaaccatgtcgacccaaataactctgaccaattgtctaacctttgttagtggatacattagggccaatgatcagtgatgaagaagaaattccccgcatacaagcagccgaaggttcgtgccctcccattctggtcaagtggtgggatgacaacttgcaacctcaaggaattgtaataaaccggcaaaaagaagatgaagaggtatgcctactgaaaaaggcactaaatcaagcgactcgcattgtaaatgtaagttccttaacgcctgacctcagccatcttgtttaccgtctggctcgagcgctgattaaactgctccgcaaaggattcatcttaggaacgaggcgaaaaccgcaaccctagagaaactagttccttatcttggaaccttcgaagccaccaggagtcaactgcacgaggccagagaacttctgtaacatcctgaaaattcaagacaatgaaaatcacgaaaatttcgaactttttaaaacttttgcatcatgctggttgttatgattgctattacttgccaaactgtaaatgatcaccaagaaagtaaagaaaagaactacatttaagcaatagatatgatttatgggaatatatttaatcctacaaataattatgcacaagatattaaaatcaaataaaagaaaagttattattaacctattttatcaaatattaaaatatttgaataatgtaggtgggtgccataatatgtgtacacatgaaatgatgatcattcaaataaactgagctctctgtatatataatagaattacgggagtatttaattcgatatgtagatcgattttgcaccaagttcctaattgcatttagggattgaaatttgatatattaaacccctccatataaaataaactaacatatagataaattgaggtaatgtgctattgtgttaataacggtctcattagaaaattatagaatctttaataaaccttaaatattggacaatattaaattttgggcaaattcacatttgaacacttaatacggtcacctaaatgcttgggagtaaatacaaatttaatttgcaacttttctcaatttataaatcaaccaaaaccctaaaagaagaaaaataggaaaactttgaaaaatatataataataataagaattaaccctaattaaaaattcaaataaattatataaataaaatatgagtaatattaatctagaataaatccattggttggaatgacacaaatattgggtaaacttcatttatacaaaatctaggatttataaaatcaaatttacacaaaaaaataggctaaaatggggattaaataggaaaagacactattcatcggccgccaggtgttcgacgaggtcccctaacccagcccctcctctttccccctctctctgtcacctgccaccgcgccgacgtcgccatcgccgtccttgccccgcgctgccgttgccgtcactgcctcgcgccgcgcgccgccgctgccacgccgccccgcgcccgcgccccacgccgcgccgcctgccgtcgcgttgccgtcactgcctcgcgccgcgcgccgccgctgtcatgtcgtcctgcgcccgcgcgtcgcgtccgtcgtgtcgccgtcatctcgagccccgcgccgccctgtcgccatcgccgcgcgccgagccccgtgccgcgccgcgccgtcccgtcgccgtcgtgtcgacgctccgccgtcgtcatcgcgtcgcccgtcgccctcaccgcgcgccgagccccgctacgccccgagccccgcgccgccgcgccgccgtcgcgtcaccccctcccttctcttccctcttccccttattccctctctcccctataagagccaccgttctcccctctcctcactccatgttccccctcctctccctcttccccctctccacgcaccgccgcgccgccgccttcgagccgccgcgccgccgccctcgtgctgtcgtgccgccgcattcgtgaccgccgcgccgccgcctcagtgtgccgcgccgtgcgccgtcgtcgccgccgccgtcgtcgccaccgccgccgtcggtgagccgctgccccccccccctatttgtcgccgtgccgccgggtagagagggagccgagaaagagagaggaagggagaagccgagggagagaaagaagagggaaggaggagagaaaccggaaaagaaaagagagagaaaggagaagaaaagaaaagagagagaaaggagaagaaaagaaaagagagagagaaaggagaggagaaattagagtgggccccacgtgtttagtgaatagtaatccccttcttaatcattattagttgagtctattacatgtgggtccgggtggttaaaaatctaattatagaagttttatggtctcgagtttatgacatgtgggccccacttgtcattagctcttcctatttccctttagaaaataattcagtaggaaaaaggaataaacccggggtcccacttgtcaatggatatgtcttggattaaaaataaatctattatgaacagtagcttttcgcaatttctcggattaattcaaagttgaatctttacactagcataacttattcattttaactcggatttgagtgaaacttgaacctaaattcatctaaattcataagctttccaatgatatataattcactattcaataaaatatatttataattataaattaatcaatatcaaatgattagataatagttaacctaaatagtgtgccaataaataaaaaaaaatggatattgtacagtagcataattatctttaatatgtcttgtcactgtagcaaccaaataaattagttataatcaatccttcaaattaatgggtgtaaaggaaaatattagtgccatttactagcctatgtccaaatataactaattccatgacttataaattatttacataaagtttagcctcatattactttatcctcatattttgtaactaaaatataaacacacatagatgagtctttaacttgtttaggagagtaatcacagagctagttgtatttggaccacttaaaaaaattagttgatacaatgtcatgtgaagtagaatatatatatatagtcggttgatatccattagttaaccaaatagagccatcttaaaatcaacatgtattgtatagcttacagtaaaaagaaactactcaaatatatgatccaataataagatattgttgcttacacatatactatacatcccattatagtggtacggtatagtattaatttgcgtattgcatatatgaaattaagagggagtgtatgacaaacatgtatattagataaatactagttataaatcttgacctcatataattataattatagttcaactgtaaattaggattattcattgtaaaattatgtgatgggataatctgtaaccataatatgattaacctaaacaattctaacatacaaagcaagggtaattgttaacctttataatttattttgacaagtaaaatatgtacataattaaaataaagcctccatcaataaaataataatacaaatgattcacagtaattatttgaccgatccaaatctatccggcaacaaaacctctagtgtataaccgttctatttagatagatgcatgaatagccatttgctagactaaaccacatagtagccagatacgtatctcattcatactacattggctagctcctaaatagaccaccatgataacagaccaccatgataacagaaagattaagaaactttagcccttagcatgttggaacccattagcaagcgcgaataatatgagcaaccttaggtttaacctcaacaaatatattttgtttgtgcatatttgattgttgcttgaatattggtttttctcgcgtattatagactttgtgtatcggttagtcgtgaggcaatgtcagcaacttccaggaggtgaagattgatcaagaattatatcaagaataaggactatcctgagcaaggcaagtcatcactattccttgaacatgttgatcctaattgcgaaattgttttgtttacaaataaaaattgcatgcaatgatgaacatcctacttgtgattatgccatgccttggttattgtttacccttaaatatttgcaaccatgtttacgtatgagtccctagtcaactatgacaattgcttagaaatgctattctagaatcatgcatactcatatttatcaaatgctatatgcttgggcaattaccttcgggaaggtaattgagatgcggcatgtggagacatgagcgccacattgccatgatgttgatgacatgatttgtgaaaggagaaataaaatcaaaacaactgtttaagactggggcggacggaggatttgggtggtatctggaaaaggctagtatcgtccccagtcaattaaggactgagccatgaagttaagcatgaaacgacccccgtacaaccgtactactcgaatgggtatagacctagcggattagatagccgagcggaggcagtatccctgcatagatggttcacccctgagtgaggcaggtgcgctacgatgggacagccgttgaggtagggccgagaggcgtgccctacatcggtgttgtcattggtaggactgccatgagtgtgtgtgagagagaacttaacttgaaccataatttaatatgtgtgtgagatttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggcgcatgtgttgggcagtcgcggagtgcgggtaaagtgtacatccattgtagtgtgagtaaaccaaatctattcgaatagccgtgctcgttgttattgagcaccgggacatgtattacacttggctagactctaaattctttaacttgtgtgggatgggatattgcatgatgatttttatgctgatggagccacttcctgagaggcgggaatgtggacgccctcagaaaaccataacgactcaatggcgggaagctatccttgggatcataatggatagtggacagaaccgtcgttgtttaatgtgaatattggtactaaaatttgatcagtctatgctaggtcttaggcttgtgaaaagaattgcaaaactagctttatgcaaaagaacctgaagccattccttgaaataccctctatcatatgcatcgttgctgtggtggcttgctgagtacggttggtactcacccttgctaattatatatcttttaggagagtgttgaagagaaacccttgtcggtacgcttgcgtatccaacaagatgatcggagtgcggtcttgttctaggtctcgttccccagtcgactgcctgtggcatgttaaccggacccttatattatttggtcttccgctgttgttctctgatagttgttggcctacctggccctaatgtaagtatttaactcttttagcctgaattcattcgtgatatgttgtgattcaactatgtatgtgtgtaccaactactgatccagggattggtacggataaacacagatgatttccgatttccaaaatcgggggtccacaacttgccaagaagaatgaacacgatctgagggatcggattgctgagctccaggagtccaatttcgaactgagtggctcatcaaaaggttcgcgcaaactctgcccaactaatttgttatctctgtaatcttgattaaccaaagttgatgtagtgcaagctgccaagatatcttaactagagaagcagatccatactctggaaaatgacaaggcagagctggcaaggcagagggattcggctataaaggaggttgaaggtaccaataatcaatacctcaaaagccattatcttatatatgctgattcattaatgtgaatctgttgatgcagaccgcaagatcaagtctcaagcacagtttgatgtcttagttgacaagatcaacaatcttgaaggagccagggataaagtcgctaatgccgctactcccctcatccaggccatgttcttcaataacgccggttcaagtacacttgatgctaccgaaatcttcgacaagctgagagtcactccagatacttatttcaagaacatcaaagaagctggaagtatgggagcaagtctggcgttggcgatgaccaaatccctttatccaagggttgatatggatgccatcgatggctttgcagacgggacgagcgaagaagctgctcttgacctcatcagtgatgcgcagaaagcnnnnnnnnnnnnnnnnnnnnnnntagttgagagattccaagatgtcgaccttcggccgacttggtctgataagtctgatgatgaaaaaactgatactgattgatataacaataattttgatgattaatgatgacggaggcacaatttgtacaatactgatgaatttatgctatgcttgatatcttaacttagttcctgatttcttaaaagtttttgtcaaaccttgttgatcctaaaacccacaaaagttgttaaaaaactttcagtcctcattgactaagccaagaaatcaaacagggcaatgatatatcaagtaagcaaattgaattgatataaatcacacaccattattattatagtagccccctgactgaaaacttcaaggaaaaacttgaagttagcagtcaaagaggaaagatacaaacgaaatgcctaagtgtaaaatcaacgaaggtgttcaatattccaagaattgttgatgagagtaccgtcttcgcgcttgagtcgataagaacccggccgagtgacttcagcaattatgaacggtccttcccataagggagataatttatgccgatcctgtgttgtttgaattttcctcagaaccaggtcaccgactaaaaaggctcgcgatcgaacattctgattatgataacggcgcaacccttgcaaatatcgagtcgactgaattaaagctgcttctcgggcttcttctagtcgattgatgtcatctactcggccttcttcatagccctcctcgttgaagttccgaaatcatagttattcaaattccacttcactcggcaacattgcttctgcgccataaaccaaaaagaacggcgactggccggtagcccgactaggagttgtgcgtaaagaccaaagtacggacgacagctgatctacccacttgccagcgtagggacgtagtcggtcaaaaactcgtgctttgatcccatgaagtatcttgccattagcgcgctcgacttgtccgttactcctagggtgtgccatggaggcataacaaattttaatgccgaagtcttcacaaaagtctttaaatgctccgccagtgaattgagtgccattattagtgatgtccgattaggcaccccaaaccgatgcacaatgttgatgaaaaaatctctagctttatctgctgtgatcgtgatgaccggtttagcctcaatccacttggagaatttatcgatagctacaaagagatgtgtgtaaccgccgactgcccttttaaataggccgaccatgtcaaggccccagaccgcgaacggccaagacaacgggttggtttgcaactcttgggctggcaaatgagtttgtctggcaaaaaattgacaaccttcgcatgtgcgcacaatcttgtccgcatcagacacagctgtaggccagaaaaaaccatgccggtaagctttgccgacaatggtccgtgcagcagcatgattaccacaaataccggaatgtatatccttcaacaactgtctcccttgttccacagacacacagcgctgcagtattcctgatggactttttttgtacagctcagtctcatgaataatgtaaagtctgctgcgcctggaaatccgctcggcttcgtttttgtcttgaggaagttcttctttgctcaaaaattttataaacggttctctctagtcagcttcgatcatgcttatgcctcgagtatccatggcttcgactgtctcttttctgggcacggtcggttcgtaaagatgttcgacgaacacatctgaaggagctgcttcccgttttgatccaaaattggccagtctgtcggctgcctcattgttatgtcggaggacatgggtgagctcgagtccatcgaatttattttccaacttgtgtacctcttgtcgataagcggtcatattatcatctggacatgaccactctttcatgacttgattaacaaccaactgcgagtctccacggacgattaaccggcgaatgcctaaacagattgcaatccttaatccatggagtagcgcctcgtattccgccacgttatgggacgcagaaaaatgtatccacaatacgtagctcaatctttctccagtcggggaaatcaagacaaccccagctccagtgcctgtgagcctcttcgacccatcaaaatgcatagtccaatattccatcttttcctctggcatgtcttcttggcactcggtccactcggcgaggaaatcagctaaagcttgtgacttgatcgaagttcgtggcttgaacgatatgtccaaagacatcaattctaaggcccacttcgcaatccgtccgttcgcttcgcggttatgaagtatatccctgagtggaaacgatgtgaccaccgtgaccgagtgactttgaaagtagtgagataatttcctgacggtaattaaggcaccatataataacttttgaacctgaggatattttgtcttggagtcggctaaaacctcgctaacgaagtaaattggtcgttggactttttgaatatggccttcctcttcacgctcgacaatcaggaccgtgctcacaacctgggaggtcgccgacacatataacagtagcggctcttgtggatgtggcgaggccaaaactggtggagtggtgagaagtttcttgaagtcttcgaaggctttttgtgctttgggtccccactagaaattgtcagtcttcttcagcagcttgaagaagggcatcccccgctcgccgagtcgtgagacgaatcggctgagcgccgccatgcaaccagtcagcttttggacgtctttttgggagcttggcggtttcatgttgaggatggcgttgattttctccgggttggcctgtatgcctctctgagataccataaatccgagcaacttccctgacggtactccgaagatgcacttttcaggattcttccaaatccgcaatcaggtcatccttctgcttggtcttgacgactacatcatcaacataagcttcgacattgcgaccgatctgagttgaaaagcatctttgaatcatgcgttgataggttgctcctgcgttcttcaatccaaagggcatggtgatgtagcagtaggccccaaagggcgtaataaacgaggtcttcaagcagtcggattcttttagtcggatctgatgatatcccgagtaacagtccaagaagctgagtaactcgcagccggccgttgagtcaaccacctggtcaatgcgaggtaacccaaaagggtctttgggacaagatttgttgaggtcggtataatcgacacacatgcgccattgccccgtctttttctgaaccagactgacttagccagccagtcaggatgaaggacttccttaatgaagcctgctgctaacagcttggttaattcctccttgatcgcatccttcctgtcctgtgcaaaacggcggagtcgttgcttgatgggtttggcgtcttccttaacatgtaaagagtgctcaatcacctctctggggataccaggcatattggatggtttccacgcaaaaatatctttattattctgaagaaaggtgatgagcatgctttcctatttacaatctaacacagcgcctattacagcagtctttatcaggattagagggatctaaggaaatctttttcgtcttggcatcattttcttcagtcttcgtcagcttggttgcaggcacttctccctcgcttgccgtggtcgcagccagtcggatctcttcgcgggcgagtagtctcgtgggtttgggccatctcgcaactttctttgtcgcatgtgacggcttgcttgatgtcgctccgtagtgatatgactcctcgaggaccaggcatcttcatcatcatgtaggtgtagtgtgggacggccataaatttagctaaagccggtcgtccaagtatagcatgatatgctgtctcgaaatcagcaacttcgaaacaaacattttctgtgcgaaaattctcccgagtgccgaaggtaactggaagagtgatctggccgagtggtgtagctgacaatcctgggataacaccgtggaagggtgcattactcggttttaattccgtgcgaggaatctgcatatcgtccagggtcttagcgaaaaggatgttgagtgcgctgccatcatcgatgagagtccgtcggagcttgacattgtgaaccactaggtctagtaccagggggtaccgccccgggtggaccatgatccgatcatgccacggggtagtccgtggagctaggatcgggcggagtccgctagggccacaggtagatagtttgccatggccttgctgtctcctcctgctgcgtggattgcgagtccgtagacggtgagccaagactccggattagtggtgccgtcatacttcttgattccagtcggcttagagccggctggccaatccactcgacaggtcattagtgaaggcagctactccatcaacgtcgtcgtcgtagcgatttggtgaatggcggtgacctcgtgctgcacggcgctggttgatcgtgtcgcgaaggtcgatgagacgctggtgaggtggagagcgaggccgttcgactcggcgctccctgtgacgttcgggaggcgagtgaacagatcgttcgtcgtgacccctgctcctgcgattagatcctatgccgatgatgctgaggcttggctgatgataatcatgagatcggaggtgagggactcggctaccggtcggggtgcgggtgcttgcggagttggctagaaccgaggcaacgatcatggtcttcgtatgttgacaacgtgattggcttggttgagtgcgtcttccttgagggggggtgtcgaggagagtgattgctgcaaccgcgttctgctggggtttgcgaagaccgctgttccatcgacgtcttgttgcccaatgagctctctccctcggcgcccagattccaaggcgcgttgccgtcgatcttcagcctcctttgcaatccgttcgcgatcttgttgctcacgctgtagtcattctcactcctgtcgctgtcgctcttcctccagtcggcgacgttcagcttcttgccgtacgcgatcttggtccgcttctcgggcttggcgctgttcctccgtttcgttgtcagccatgaatacgccgaagaagaggggcgtgtagttatcctcatagctgtcgtcgaagttgtcgaggtcgctgaggtagtagtggtagccgaaatcgtcgtagtcgaggatctcgattagtcaagaactgatgccgggggagctaaggtaaccatccaactcttccgtcgagactgtcccaagaggttggagtataacgccaacctctctggatctagattggatcggggccgaagccggagctcgcctagatcttcgagtgggagatgtcctggtagtgaagacagcggccaaatcatcaggaagtttcatcaggattgagggataggacccgtcgtcttcatctggtcgcggaagagtagattggatcttgtccgagtggtttgaagccgactcgggatagatgatcttggagtaggcctcggccgagttcggaataccgaatggcacggggacatggtccgagtcgaggagagagatcttgctaaggtcgttggtgatgaagttgaaactgccgaaccggaacgcctgcccgggagggaacgcgaagtcgtcgatgccagaaacgaaacccatcgcacttagtcggtgagaacttgacgctacccctacctggcgcaccaactgtcgaaacaagatttcgacaataataaagggggtggctatcaagctaggaaagtggatgggtttggagacaaggaattttatacaggttcaggccttcttattcaagaagtaataccctactcctgtccggggatgattccgccgagtgtattattgattgtatgattgggagaaaaaagaatcgtcccgagaggaacccggacccctccttatataggggaagggatccgtattacaaagtacagtccatatcctaacggaatatgggattacagataaaatacaatcgtaaccgactaggatcccgggtattttcttgacatacaagtttagaatctaacccgagtcctcataaagatattctatctatatttagtaccgtatatccagctgaaatataaccgccatgtagatatggggtaaccataatctccacagtagcccccgagaccttcgcagttgaccaaaatagtcttctcgaaacaaaaaacaataatccgagtgcttcaattcaacttgcttcggcttgccgagtgctaaaagactgtgaagggcgaaaataaaacatggtgcatcgagtagatgcacctaattaggtgtacccccgactatgtgattagttgaaaaactaaacatatagtcaagaaacgagtgattttatatcgaagcatgcatggtactcaataaaatacccagccgactccttcttacttgaatatatcaaggacaaaaaatatgaaaagggccgaatgataaacactcaaaaggtccaaaaatagatatatttggtaggaatccgagtaagaaactcttaaaatgatccaccaaatatgataaagatcatggtaattaagaagttcattagcctaggctataacccttaccataatcaaaataagcatataacatgctaggagaatgactactaataaactagtcatctcaaattaacccaacaacttttgtagcctaaaaaagcttacaaaaatggtataacacctttctgtcgggcaccttttcatgtgcatcataatcattccaaagaattattgaatcgcgtaaaaaagcattttaacagcatcgggccacatcattgtgagcacatattgccaaagcaaaaagcgcctaagtccctagggatcacaacgggccacgctaaaaacataattgggctgaaatactgtacaggcccaggcccattagtactcccaataccctaaaaacaccgaagtccaaacattgtttcgtcttccccgctgagactctcgccattccccactccgtgctacagtacagaaccgcgccgacgaagctagggttcatcaatctgctccaacccaccctcaaaaacttcacgaaatttctccccacgtccaccactccgattccccattcctctccagccatatctcggaccaaattaaaacatccagttcacattcatggcggaagaaagagaaagcttcgagagtcagtgggcgccctccgatgtgacagaagataatctgaaggagatggtggcgcacggcgttctcccagcgaaggagattatcgggtggcgaccggcgttcggcgaagcattcccgacccccgacacacacgaaatcgtggtatttgctcatttcttctatggcggattttctcttctaacctcaagattcttccgggggattctgaacttctacgggattagcttgcatcacttgaatccaaactccatagtgcatattgccaaatttatccatgcctacgaagcttttctgggcattaggcctcatttcgccttgttccgccgcatcttcttcctcaagccccagccaaacaaaagcacaccgtgcgttgttgggggagctggtttccaactcagaggaaccttgagccaaaaatatttctccatgcctttcaaaacctcaaacaaaggctggcatgcaaactggttctatgttcagaatcctgagcgcgcactccccgagtactgctgtcttcctccagtttaccaggacacatggaactcattgcctatgggagatgaagctgctcaggcagtggaattgatggaacgcatgctaaaactgaagtaacaaggtttgcaaggagaacagatcactcggcacttcatcaaaagtcgattagctccaatcaaagaaagatctcgcacagccttcgaatttgacggcaagcatgacccaaaccgtgaagacccagattctcttgacttcaaggtcatgaaggaaatgatgtataagatcatttcaaacgccattgttgtcagctactcacacttgctgccagtcgtaccgttcaatgcattcaatcctcctccaccggtacgtattcatacacttcaacctttctcaaaatatgatcttgtcttcttgttgaatcagttaacaatgaaggatattacactcaggaatttgctttgatgaagtcggatctcccaatcgctcaacgccgatctccccgccaccaaactgggcaagggagtggaggaccaagaattcggtctgaaactcagccaagtgcttctgatccagtcggccagtcagattctcgaaagagcaagctggttctaagtgacgacgaagccgatgataccaccaggaggcctggagaccgagagacaaccaagaaactaccaaaacaggctactccaaggaagaaagcatccagtcgccctgcgccaaagatcaggaagtcttctaggtataactcatataacaatctctcttgcattgatgcgcatccattgcggcaataatactgataatcaaatttgcaggaaaccatctgatatagatccgtccgggaaagactctaacccgactaacgtggacgcaagttcttccaaagaaaccggaccaactgctgaggatcatccaagtgacaatcagccggcaaccgataatgtagaacccggtgatcaacccctgaccggaaaccagtcggacacaggggcaagcgaagagattccagaagtcaaaacccatgcagacaaccctcgtggacaagacgccagcaatgaccggagatctggatctcctttaaaagcatccgagtccactcattgtctgaaaccatgtcgacccaaataactctgaccaattgtctaacctttgttagtggatacattagggccaatgatcagtgatgaagaagaaattccccgcatacaagcagccgaaggttcgtgccctcccattctggtcaagtggtgggatgacaacttgcaacctcaaggaattgtaataaaccggcaaaaagaagatgaagaggtatgcctactgaaaaaggcactaaatcaagcgactcgcattgtaaatgtaagttccttaacgcctgacctcagccatcttgtttaccgtctggctcgagcgctgattaaactgctccgcaaaggattcatcttaggaacgaggcgaaaaccgcaaccctagagaaactagttccttatcttggaaccttcgaagccaccaggagtcaactgcacgaggccagagaacttctgtaacatcctgaaaattcaagacaatgaaaatcacgaaaatttcgaactttttaaaacttttgcatcatgctggttgttatgattgctattacttgccaaactgtaaatgatcaccaagaaagtaaagaaaagaactacatttaagcaatagatatgatttatgggaatatatttaatcctacaaataattatgcacaagatattaaaatcaaataaaagaaaagttattattaacctattttatcaaatattaaaatatttgaataatgtaggtgggtgccataatatgtgtacacatgaaatgatgatcattcaaataaactgagctctctgtatatataatagaattacgggagtatttaattcgatatgtagatcgattttgcaccaagttcctaattgcatttagggattgaaatttgatatattaaacccctccatataaaataaactaacatatagataaattgaggtaatgtgctattgtgttaataacggtctcattagaaaattatagaatctttaataaaccttaaatattggacaatattaaattttgggcaaattcacatttgaacacttaatacggtcacctaaatgcttgggagtaaatacaaatttaatttgcaacttttctcaatttataaatcaaccaaaaccctaaaagaagaaaaataggaaaactttgaaaaatatataataataataagaattaaccctaattaaaaattcaaataaattatataaataaaatatgagtaatattaatctagaataaatccattggttggaatgacacaaatattgggtaaacttcatttatacaaaatctaggatttataaaatcaaatttacacaaaaaaataggctaaaatggggattaaataggaaaagacactattcatcggccgccaggtgttcgacgaggtcccctaacccagcccctcctctttccccctctctctgtcacctgccaccgcgccgacgtcgccatcgccgtccttgccccgcgctgccgttgccgtcactgcctcgcgccgcgcgccgccgctgccacgccgccccgcgcccgcgccccacgccgcgccgcctgccgtcgcgttgccgtcactgcctcgcgccgcgcgccgccgctgtcatgtcgtcctgcgcccgcgcgtcgcgtccgtcgtgtcgccgtcatctcgagccccgcgccgccctgtcgccatcgccgcgcgccgagccccgtgccgcgccgcgccgtcccgtcgccgtcgtgtcgacgctccgccgtcgtcatcgcgtcgcccgtcgccctcaccgcgcgccgagccccgctacgccccgagccccgcgccgccgcgccgccgtcgcgtcaccccctcccttctcttccctgttccccttattccctctctcccctataagagccaccgttctcccctctcctcactccatgttccccctcctctccctcttccccctctccacgcaccgccgcgccgccgccttcgagccgccgcgccgccgccctcgtgctgtcgtgccgccgcattcgtgaccgccgcgccgccgcctcagtgtgccgcgccgtgcgccgtcgtcgccgccgccgtcgtcgccaccgccgccgtcggtgagccgctgccccccccccctatttgtcgccgtgccgccgggtagagagggagccgagaaagagagaggaagggagaagccgagggagagaaagaagagggaaggaggagagaaaccggaaaagaaaagagagagaaaggagaagaaaagaaaagagagagaaaggagaagaaaagaaaagagagagagaaaggagaggagaaattagagtgggccccacgtgtttagtgaatagtaatccccttcttaatcattattagttgagtctattacatgtgggtccgggtggttaaaaatctaattatagaagttttatggtctcgagtttatgacatgtgggccccacttgtcattagctcttcctatttccctttagaaaataattcagtaggaaaaaggaataaacccggggtcccacttgtcaatggatatgtcttggattaaaaataaatctattatgaacagtagcttttcgcaatttctcggattaattcaaagttgaatctttacactagcataacttattcattttaactcggatttgagtgaaacttgaacctaaattcatctaaattcataagctttccaatgatatataattcactattcaataaaatatatttataattataaattaatcaatatcaaatgattagataatagttaacctaaatagtgtgccaataaataaaaaaaaatggatattgtacagtagcataattatctttaatatgtcttgtcactgtagcaaccaaataaattagttataatcaatccttcaaattaatgggtgtaaaggaaaatattagtgccatttactagcctatgtccaaatataactaattccatgacttataaattatttacataaagtttagcctcatattactttatcctcatattttgtaactaaaatataaacacacatagatgagtctttaacttgtttaggagagtaatcacagagctagttgtatttggaccacttaaaaaaattagttgatacaatgtcatgtgaagtagaatatatatatatagtcggttgatatccattagttaaccaaatagagccatcttaaaatcaacatgtattgtatagcttacagtaaaaagaaactactcaaatatatgatccaataataagatattgttgcttacacatatactatacatcccattatagtggtacggtatagtattaatttgcgtattgcatatatgaaattaagagggagtgtatgacaaacatgtatattagataaatactagttataaatcttgacctcatataattataattatagttcaactgtaaattaggattattcattgtaaaattatgtgatgggataatctgtaaccataatatgattaacctaaacaattctaacatacaaagcaagggtaattgttaacctttataatttattttgacaagtaaaatatgtacataattaaaataaagcctccatcaataaaataataatacaaatgattcacagtaattatttgaccgatccaaatctatccggcaacaaaacctctagtgtataaccgttctatttagatagatgcatgaatagccatttgctagactaaaccacatagtagccagatacgtatctcattcatactacattggctagctcctaaatagaccaccatgataacagaccaccatgataacagaaagattaagaaactttagcccttagcatgttggaacccattagcaagcgcgaataatatgagcaaccttaggtttaacctcaacaaatatattttgtttgtgcatatttgattgttgcttgaatattggtttttctcgcgtattatagactttgtgtatcggttagtcgtgaggcaatgtcagcaacttccaggaggtgaagattgatcaagaattatatcaagaataaggactatcctgagcaaggcaagtcatcactattccttgaacatgttgatcctaattgcgaaattgttttgtttacaaataaaaattgcatgcaatgatgaacatcctacttgtgattatgccatgccttggttattgtttacccttaaatatttgcaaccatgtttacgtatgagtccctagtcaactatgacaattgcttagaaatgctattctagaatcatgcatactcatatttatcaaatgctatatgcttgggcaattaccttcgggaaggtaattgagatgcggcatgtggagacatgagcgccacattgccatgatgttgatgacatgatttgtgaaaggagaaataaaatcaaaacaactgtttaagactggggcggacggaggatttgggtggtatctggaaaaggctagtatcgtccccagtcaattaaggactgagccatgaagttaagcatgaaacgacccccgtacaaccgtactactcgaatgggtatagacctagcggattagatagccgagcggaggcagtatccctgcatagatggttcacccctgagtgaggcaggtgcgctacgatgggacagccgttgaggtagggccgagaggcgtgccctacatcggtgttgtcattggtaggactgccatgagtgtgtgtgagagagaacttaacttgaaccataatttaatatgtgtgtgagatttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggcgcatgtgttgggcagtcgcggagtgcgggtaaagtgtacatccattgtagtgtgagtaaaccaaatctattcgaatagccgtgctcgttgttattgagcaccgggacatgtattacacttggctagactctaaattctttaacttgtgtgggatgggatattgcatgatgatttttatgctgatggagccacttcctgagaggcgggaatgtggacgccctcagaaaaccataccgactcaatggcgggaagctatccttgggatcataatggatagtggacagaaccgtcgttgtttaatgtgaa

SEQ ID NO: 80716 - DNA, 581 bp, Oryza sativa
tgggagagtgaaaaggattaggcaactctcactaagataagaggaggatgaggcacaaaagaagcaacgacaaaagaagcaattaaagcctacgctatggtcgactagcttcgtcgctgggcgggcaaaagaaaaaaatcctgatttgagtgtgtcgacctcgacctcccacttgcggcaattaacaattttggaaaatcattggcgccattgatgttgtccacgggagtcaccaaccctgcctgccgggcttgtcgcccgacgacgacgagaaccatctccctactcaactactctaccctatatgcctcccactgctcggcacttcggctagcccgtatcaaaatctccaaagaacatggagccaagcggcatgttaggttgtctttgccggctgtggagccgcattccccggcgagcgatacggattgagatcctctgacgtaacttcatactgacttggtgactgatatgtgggttcgagagtggtggggaactatatgccagtcacggtgaacagtaacgtcagatgatcctcttccatacggtagacatgggccatcagtggccagagtgtagac

SEQ ID NO: 80717 - DNA, 2533 bp, Oryza sativa
agcaaaagtgatattaggaattgtcaaaaaaaaacaagcgatttttccctaattattgcacacgaattggaccttcgtctgtgaaattcttaaaccgtgaaatgtggtcatataacatggctaaatgttttctccagacatatggacccaatttcaatataagatactgtgacattagttttctttctataaaagtgcatgtatacattatccacaaatattgtaacagcaaggcgaccctctttacaagtcctttattgaagtaaattatttgagttatcacaattagaatctataattcaagtgagacaagctgttagaatcctaaatccaatcttatgtaaatgctcaaaatttacagtatatatataatcactaccttgtggggctttgatttcagaaagcttcaatacttcagttctcacttctcagttgtcagcaatgagtaggaccgttgttttcattttctggctgcgcagaacaattctcagcttcagtttccaactctgatggtggatcagcctccaacttcatttcctcagagctctgatcatggcagttgtgttcaacactcgccatcagtggctcactgggggcattttcctcatcatcttcactagaagatgacatagaggcgacctcaggaattagaggtgtcaagctgcttgaaggcaattttgctattgtggctcctccagatctgatcttggactcaatagccttgatcagcgaggcagcctcctcaggaggcacgacacgagcaccacaagcaagagcagtagcatgcaccagcgagtttggaccttttcctcgtttgtacagtttaggtagaaaaccgggtagtgggccctgaattaggaaaacttccctgtggttgttggatgggttctgcaggacggtatgaaattggaactgcttcaataggagcggccaacaacctgtattggccatctgcattccaggaaaatgggaagatgtcaggagagcattctaacggcaggtagcaatcaatcaagatccactggtagatagttatcaagtagggaaatcgactaaatgatgaaaagctttatgatgatgagtaagcactcatgtgatcgctggggaattgaaaccaaataatactagtaaatgttttaacaagtacagtgcaaatgctttatgatagtaaatactcccagtgattcactagaaatgatataacctctttttgaaagctaccagcaatggtatgaattatacccatatttgcacaactatacaagctttattaagtatcctaaatgacttatgttcttggattgcaaaaaagaaaaaaagtacccagataaacacaatgctccaagccacctatcattccaaagaaacaaagaaatgccaaactgaagagtttcaagatctatcgaactaaattgtcaggcaaactactatagtaggcaaaacaattggtaaatttttgcagatgaggacaacagaccacacacgaatattcttgttccttcaaaagaaaatggtgtcaagaggcattactaaacatataattattgggtcatttctaaaattttagtgttgtaaacttactatcttatcttgccacatatgatgaagaaaacaattgacaggcataaatatctaatagatttctaaactgatgcatctgtaatttctatctagaattttaaatattacttttacacttatttcctgtaaacagcagaaggaaatggattacctgcagaatctccagttggattcttcattataggcatgtacagcgtgagaggtatcgcaggaatagcaaccgtagtttctttagaaagtacatgaaacctttcatcctttccctgtaaggcttgattacaagtggaatccgcggtcagaactacgcataagatctttctagtccaatacagaatacacaaatcgtctaggtatattagggcctgtttggtatagctccaactcctaaatttaactccaggagttgagtctggagtggagttgtggagctgcctaaacccagctccacaactctagttcattttgtgagagagctccactcagctccactcccagttttggtggagccgaaactgtttggctgagctccagctccagaaggggtgaagctggagctggagctgtgccaaacaggcccttagtaacagtatgacatataagcaagcaggtaatttgtaacctgggatttctgcgaagagtcttcctttctgttcgcagccaaacaagaactttctgatacatgcttgacttcccccgctgttgatacaaaagcaacagttacaaataaaacaattatcccaacatcattcggtgtggagaaagcactaacaaagcaatggattagcttatcattatcataacatagttaccatttatagttaaatcacatgagagtggaatattgtcagcacaattcgagcttgaatgagtcaaaaggttggttggtattagcacaagactgggactgggctcttgcaaaaacttgagctgtggtgtcattgttttctgtttg

SEQ ID NO: 80718 - DNA, 2067 bp, Oryza sativa
tcaagggtattacccaggtaattcaatttgatatatatcaaggttttctcaccattttatgtcttgggaagtaaaattttgtgcattccttctattttgtaacttctattttgtaataagttaatctaatacatgatacgatatatctcgagaatacttataattggccactcgattcacgggataagaatcggacgctctctggcagaacagacaacagctagctaatttatctccttcctttcttctctcttttaagaacttttttcttctaaattacttatccgatctataatccaatcgctctgttgtattcgtagaaattaaatctttaagatatcataaattatattctgataaaagaaaaacttgtgtttgaaaccattagaacttaatgttccatacgtgatagagacatggctcaacgtgtgttcactgtgttaaataatattcacgcagctaactgtatgtactctctccgctccatccatgcaagcgcttgcatgcatttagtgacattcaaaacgatttttctactaaactagttatctaatctacgatccgatcccaacattttattccttgcaattaaatttttacaacaagatatcgcatgtttatattctaatagaaaaatatgtttcaatatgttaacatggaatgtttcatacgcgatagcatcatatttcaacgtgtctgcattgtttttcacaaaaaagttaaatgttttagtggctgaaattttttcaccattataactccatgtttccatggtaaactgaaagtctgaaacgcttggctgtcaaattttttaagaatcaatcgggcgcccgatttgaattttttcgatatatctcagcactactaatctggataaggattctatagattcaactaatgcgtagaaaaacaattgaaacgaaaaaaaaacatagtcgtgttcacaggtatattttttttgttcatgtgcatgtcgaatttgacttttctttctgataaatatagtaaatttagattgtctaatttttattctattttttcatataagtattaggacgacattttcatacagtgcaccatttggcatatgccttgcgcaggaccttgtcactggtggtgcggacaccagtacggtgaccgtggaatgggccatgtcggaggtcctgaagaatccggcgatcctcgccaaggccaccgaggagctagacaccatcgtcggcgtcggccgcttggtgacggagggtgacataccacacctcccctacatccacgccatcatgaaggagacgatgcgtatgcacccggtggtgccgctgctggtaccccggatgtcccgtgaggatgcctccgtcgccggctacgacgtccccgccggcacgcgcgtgctcgtcaacacgtggaccatcagccgcgacccgtcgctgtgggactcgccggagagttccggccggagcggttcgtggaagcgagatcgacgtcaaggggcgagacttcgagcttctgccgttcggcacgggccggcggatgtgccccgggtacagcctcggtctcaaggtcatccagctcgccctcgccaacctgctgcacgccttctcctggaacctccccgacggcatcgctgccggcgagctgagcatggaagagatcttcgggctcaccatgccgcggaagatccctctcctcgccgttgtcaagcccaggctgccggaccatctctatgccgagccatgatgcatgacgcaccatgcgtcgatgcgtgcgtgcatgcatgcgcgtcttctgcattcgacgaagctataggctccagttcaaggatataaaactccctagtgcgtcgaataatagaactagggtggtttaaataatcgtacagtagctctgcaagatatgcaagctcaaaatgttatcacctgcactatagatgtatgatggtaagtcatttgttgagacggatatgtccagtccatcaatggctccatcctaaataaaggaattttatgtttgccacaagtcgatgatcaaatttatttttatgtttattttattctttatctttatctttacgga

SEQ ID NO: 80719 - DNA, 607 bp, Oryza sativa
atccgtcatccctccttttaactatcattacaattttatttagggttttgttaatagtttttagatgtgccatcaattattaccactctactctttttcaggcatgttgcttggaagtcccgtgaaatgctaccactataatcctctacaacccatccactgcctcatctctttattgtcatcaggaatttaaaaatcaaacataattatcatttggattcatcttttactttctagaagttccgccaaaccatcatcggctttgcaattgtacttctccatggctcgtccgctgcctcccctatttattgttattgagattttaaaattgaatgcgactatcatcggggataattttttaccttttggaagtcctgccaaccgatgagatcgtattgcttaacagtctgtccgtcgtccctccaattaatcgttattggaattctattagttattttgttaatagttttttgatatctcgtcatccatcaccactctactccttagaggtatgttgctacttccatatgtgttccaaatgaatattttttttccaaaattccatattttttattctgatatattttttttataaattatattccta

SEQ ID NO: 80720 - DNA, 1034 bp, Oryza sativa
ttcgaattgtataagttaaattttagcttgcatgtttgaaaaaagatactcatatattgatctatttaaaaataataattttttaaacgacatgcacaacaagagaacgtccccgaggaaaaaaatccacttcctatactccgtgacatcagttgctatattatattcctattcctagtcggagttgtagtagcgtttcagttcgtacgtagagtccgagtcagcttccacatcgctcatatatatgccgcgtgtttcgtaaccgtcagtgaaacccttcgcgcgaagcaaagcaaagcaaagcaaaaccttttttcccgccaagaaacctcaatggcggcggcgaagatggcggggctgacgccggggttcaagttcgagccgagcgacgagcagctcgtgcagttcttcctcctgccctacctgcgcgagctgccggtgcccctgggcggcctcgtcatccgggacgacccgaggagcgtgccgccatggaagctcttcgcgcgcaacggccggggcgacgaggaggacgcctacttcctcgcgccagccgacggcgagggccggcaggcgcgcacctgcgacggcggccgcggcaggtggatcacccagcggctggagcgcacgggcaacctgcggctcgccggcggcggcggcagcggagaggccgtcgtgttcgagaagcacaggctcaactaccacgccggcgaggggcggtgcggcagcacggggtgggtgatgcacgagtacgccgtcgtcaagcccgcggcgctcggcgcccgccacagggcgtgccacatcgccttcaccggccacggccagaagcggaagcgcgtgcccgacggctacgtcgacgtcgaggacgacggcagcaaggccagcaccaacgcggccgccgccgtccctccttcctcgacggcggcgatgtcggcgtgcccatcgaatgtcacctataaccaagggtgccatatctcgccggagcagagcatcgaacagcacttccccgcggagcataataatatccaaatccaaca

SEQ ID NO: 80721 - DNA, 1315 bp, Oryza sativa
  unsure (1)..(1315): unsure at all n locations
aaggcgttctcgcagcaaaatccttcgtgaggtctatctactgggcttgagtttgaggtctacaccgtaggtagggtcttctaaaaaccacatgaaccttcactcttctgtctgaggagggcaaatataggtataaagcctgggcgagtgtctttgtccagcgcgagaaagctcggaattgaatgctttgaatgcgcaaaatgaatgctttggaacagttggtactttcagatcaaactctccatgatatattaggttgtttcaccaatctgttgaattggaatagagctcacgaccgtgaaacccctcgttgtttgatggcacctatcttgttcccttcggggagaaatactactcttgtttttcttgttcttctttctcgaagagatgggtgcaccgccttggagaaggtagcgtgcctccaaggtaggtggtacatatatatacatacatgtacatatacatatatatacatacatgtatatatacatatatatatatacatacatgtatatatacatatatatatatacatacatgtatatatacctatatatatacatacatgtatatatacatatacatatacatacatgtatatatacatatacatacatgtatatatataatcaaccatgcagcaaacagggccatgtaaataaaaaaaaatggtgcaccgatctttagtcccggttggtaacacaanccgggactaaagatggtttggccggccacgtggctgaccgatctttagtcctggttggtaacacgaaccgggactaaagatcgatctttagtcccggttatttcactcgggactaaagatagctatctttagtcccggattcgtagtcccggttggacaaccgggactaaaggggttaccaaccgggactacaaacggtttctccactagtgtcggcacgccaccagaacgacacgtgacaagacaatgcacaccagcctcgcgataggctttcaccacccttgtgtggataagggtggactgtcaggcagtatgattgactgccatgccgcgagactggagccacaaccatctcgcagtttctcttatccgtggctgataggcgggcccacgggcgtcaaccgtgtttcaggcttctactctaagctttgctagcatgctcaggacacgcggcgggtcggcaaggtctccgttccatctaggcttgacgaccaggcccactcaccaagaagaaccacgaccaacatatacctaacccctatgttgaggcccatttgtaagaaaccgatcattgtgatatccccttgcaactataaaggaaagaccaaa

SEQ ID NO: 80722 - DNA, 1552 bp, Oryza sativa
gcgaatgaacgtgaacgaacgtgaacgtgaaatgcaatatatatatgttacttcgcgtttatcttaatacatctttttgtatcttgcagaaaagacgtgttgtcgaagtcgtccctcaagccggagtggaagagctagccctagaaggaattcgtgcaggcaagtgacgtaataatataaatgattgttatatttgtaatgcaattaagattattatatttgtaattagacttagcatataagattgtgtagtgttctaatattatttgagttttaatataagattattttatttgtaattagacttagtatataattattgactatgaattggtgcgactcctagcaattgactattttagtgttaattagacttagcatatacgacagttacacttagcatacatgactattttagtcttagcatgtaatattatttgagttttaatataagattattttatttgtagttagacttagtatataattattgactacggaattggcttgtgcgactcctagcaattgactattttagtcttaattagacttagcgatacgaaagttacactgagcatacatgactattttagtcttagcatgtaatattatttgagttttaatatagattattttatttgtaattagacttagtatataattattgactagctagggtcgtataatatacgtcacctagacttagcttatatcatgatttgtaattagacttagcagtaaggttgtgtagggttctaatgtacgacagttacacttagcatacatgacttagattgttaaaacataaatgtctcatgacttagcagatgtttcttgtatcaccagatggctgaccgcgatgagtaccagataaaatacggtacaatcgcgaaggtgaagcaggcaagtactagaaataagaagagttggaacgaggatccaacccagtacttgaatgaggaagggacgtgagaagggatgcggaggggaaccagcaggggcacgtggaaagggatgtggaggggaaccaggaggaggaggctagtggaagtcaaccctccgttgaccagaagagggcacgcgggcaacgaggtgcagcgaagaagcttgagggtcggcacatcataacgaaagtggaagaagatggacgtcctagtgccccggccgaagctgccaagaactatgtacgtcacagcggttgggttgtgcgggataacgtgcctatcagtacggtgtactggcgaagaacaagggcacgcggagatcatgagagctttgtcctagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatcctgaaggggcagacaccgaacttcgacacattcccaaagctaagggatcactgggacgagttcgttgtatataagacaggtgaacaagggcaggtgatgatggaaagaaacaaagaaaatgc

SEQ ID NO: 80723 - DNA, 27500 bp, Oryza sativa
ctcgggttcttggtctctgcccgaggtatcgaggccaaccccgagaagatacgagctatagagcggatgcgcccccccagcaagcttaaggatgtgcagtgcgtcaccggctgcatggccgccttaagtcggttcatatcgaggctgggagagaaggcgctacccctatttaagctcctcaaacgctccgggccgtttgcctggacggagaaggctgagagggccttcactcagttgaaggcgtacctcagttctcccccagtcctggtcgccccggagccagatgagccgttgctactctacctggcggcaaccccgcaggtggtcagcgcggcgttggttgtggagcgcgacgaggacaaccctcgctccgcgcgtccccgccctgtgtcgactcgacccaggagagagcagggaggagaggcccccgagccgaacggcggcccgaggcccccgacggccggagctggccctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctctgacgaagagcgccctggagatgcggcccctggcgaagaggatcggccccgccgaaaggtgcagcggcccgtctacttcgttagcgaggccctccgggacgccaagacccgataccctcaggcccagaagatgctttacgctattctgatggcttcgaggaagttgcgccattatttccaggcgcatcgggttacggtggttacgtcctaccccctcggccaaatcttgcataaccgagagggtactggacgggtggagaaatgggcaatcgaactctctgaattcgatttgcgctttgaaccacgccacgcgatcaagagccaggccctcgctgactttgtggcggagtggaccccagctcccgagccagtccccgcccccgaggccagctcgggcccctcgcagctgcctcacaccgcctactgggtgatgcagttcgacggctccctgtcccttcagggcgccggtgcgggggtcacgttgacctcgccgagcggagacgtcctcagatacctggtccgcctcgactttcgggcgaccaacaatatggcggagtacgagggactccttgcgggactcagagtggcggctggactggggatccgccgcctcctggtgttaggcgactcccagttggtcgttaaccaggtctgtaaggagtaccagtgctctgacccgcagatgaacgcttacgtgcgccaggtgcggcgtatggagcgccatttcgacgggatagagcttcggcacgtgcccagacgggataacgcggtcgccgacgaactctcaaggctcgcttcctcgcgagcccagaccccgccgggcgcctttgaagaaaggcttgcccagccgtcggcgcgacccgaccccctaggggagacggacgcgcctgaacggcccctgaggcccgtcggagtccaggcctcgggacccgaggggagcgctcccagctcccctagattgattgcttggatcaccgagatccaggcgtacctcgcagataagactctacccgaggaccgcgaagggagtgaacgcgtccggcgcatctccaagcgctacgtgctggtggaagggaccctcaatcggcgcgcggctaacggagtcctcctgaagtgcattcctcgggaacaaggcgtcgagcttctcgccgatatccatgaaggcgagtgcggagcccactccgcctcacgcaccttggttggcaaggcctttcgccagggtttctattggccgacggctctcaacgatgcggtcgacctggtccggcggtgcagggcgtgccagttccacgccaggcaaacccatcagccggcccaggccctgcagaccatacctctttttacatatgacatcggctcagagataaatgatatgacatcggcacttagccgatcggctatcatttatagatttaaccgcggtttctttgtctttatttcttattgattgcaggatcaaatcaactggcacgctagcacacccgaaggcgagttttggacctgcactggagttatcgtgttttacgtcaacagggtcccatatcttttttatctgttttggctgactagactgccacgtatgcgtccacgtaggaccaaaaccggcctagattgatttaggggggtaattcatccggtttgtaaagtttagggttaaaaataactggtattgaagtttagggtggtaaatcggacgaccacaattgttcaaggggtaattcgtacttttttcctttgttttatgggatgaactgatggaggaagtagattttaggcaaaatttgctacaggacaccgaaagattgcggcctttgctgtgagacattcgaagatcgtgaatcttttcgtggacactgtaaaaaagtagtaattagctgttggacactactcccatttttttattatttccagttaaaatggagagagaaagttgtgtaagtaccaaaatgcccctgctctctccttttcttttcccttcttcctcgtgcttgctactgagccgagcataggcgcgacgcgcgcggccagcccacggtggggcggtggtggcagtgcatcacccaggttcaccgccgacggcgacgccgtacctgaagctgccgagtaggtaggcctggagacatgttgatggcgagcacgatgtcgttgccatacctctttcgtggccgtttgctgtctgggggctcgatatcctgggtccgttcaggcgggccccgggcgggttcgagtatctgtatgtcgctgtcgacaagttcactaagtggcccaaggcttatccggtcatcaagatcgataagcactccgcgctttaattcatcaggggcatcactgctcgatttggggtgcctaaccgtatcattacggataacggcacccagttcactagtgagctcttcggtgactactacgaagacatgggcatcaagctctgcttcgcctcccccgcccaccccagaagcaatggccaagtggagcgcgccaacgcggaaatcctcaagggcctcaaaaccaagaccttcaacatcctcaagaagcacggcgactcgtggatcgaggagctgccagcggtgctctaggcgaaccgaaccacgccaagccgagcaaccggggaaacgcctttcttcctcgtctacggcgcggaggcggtcctcccatctgagctcaccctgaggtcccctcgggtcaccatgtattgcgaggctgatcaagatcagcttcgccgagacgacctcgactatttggaggagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctgaactgagcaagctctcaccaatgtgggagggtccgtatcgagtgatcggcgtcccccggccgggctccgttcggctggccacgggcgacggcaccgagctgcctaacccgtggaacatcgaacaccttcgtcgcttctacccctagtgggggtcgggtgtcatgtctcgggctccggccaaccccgcacccccccgggcgtgcaaggttggccgggggctaccacatgcatatacttatcttttttctcttccgtatttcaataaaagcattttcgatttcctgaggactgtgtctgtgccatcgtttccttttgaagaatcttggcttgaattagcacgctcgtgcccgaccctgccctcggtggcccgggccggctaaaatcgccaaacggggcccagaaccgagccgtgccccggggcgtggtgaactccgggggggaatcggcaaaggcccacaatcgggtcatccataaccctcggtcaccgcgctcccggcctagccagtctcgacacgtggatctccccaggcactagccccgacccgcgccgtttgaggctgggacctgggcacgagcccttgttcaagccaagacacagaaggaccgcggcacagaccatcctcgtctcatacacacaacaaacagaactgacacagaaatttcctctttacttgattgcagattaaatcagtctatacaagaagggggcccgaaggcctcggaagaagaaggaaaaattattaagattggcaggggcctaggggctcactccgacgcgcccgggtcgccggcctcgtcgtcgctgtcgtccgcaccgtcgtcaccgccctcctcgtcggagtcgagggcgaacgcgagccgaggggccgtaccctcgaagctgtggacgatgtggtcggcggcgtcccggacctgcgcgcgcgcgccgtcctcggttccgggagggaattcttccagcgctgcccacggggagaagtcagggtccctggcctggcaacttgccagtacgagctccaccttcgtgtcacgcctcttcgaggagttcatcgttttcacaccaaaagaaaattggcaccgcgttttgtgggaccttataagattgtcagtagaagaggagaggttgcttatcagttggagttacctcaatctttggcaggagttcataatgtgttccatgtttcgcaattgaaaaagtgtttaagggtacctaccgaagaagctaatcttaaacagatagaagtccaagaggatctgacctatgttgagaaaacaatccgtatcttggaaatagatgagagaagaaccagaaatcgagttatccgtttttgcaaagtccaatggagtaatcactcggaagaagaatcaacttgggaacgagaagatgaattgaagtcagctcatccgcatctgtttgccagttcttccgaatctcgaggacgagattctgtttaagggggtaggtttgtcacaccctaaaaatcctaaatatataaattgttgcttaaatggaattattagattttattttaaaagcctagaagagaagatcaaattttaattaataaattccaatataaaatgggccagataaaatttcattaaatactttgcttaattctataattcctagatttttctgggatttatttgagctaagaaagtatttttaataaatagaattgcatttaatgaataatttaaattgaaaaaggtttttaaaagtctcttttggctttgggccgaaagacggcccaaaaacctctctccctctctccctcggcccagtcggcccagtccagcaacagccgccgctcgcgcgcgcgtccgcccgctgacaggtggggcccacctgtcggagtcgtcgtcttcctcgcatcggccgccgcccgaaaccctagtgccgcgccgccgtcgccgtccgctgctcttccgccgcttctttggtcaccggtgagttcgccgcaacgttctctacgtcctggtgccctccgttcgtgccgaagcgccgtcgttcgccggcgagcttgcgcgcccgagccgccgagccgccgccggagatgacgtcaccgctgacgtcatcagggtctgtctgctgtgagccgccgtggaccgctcgatctcggccgtccgttttggatggatcgatctcggccgttcgttcccgtgaaccgctgccgtgcgcccggtccaccgcaaaccctagccgctgacgcaataaaccctttttccttttcaaaaataattcattattgcgtcataattcaattaaaatccatataagtgttttaaatcgatttaatctttgaaaattcataactaattcatcttagctcggatttagttggttcaagtctctaaatttttctaaaattgagatctacatgttaaaaatatccacatgtattgttcaagcttgtttatgtgctgtttgggtgtttttgctcttttctgtttagattccgacgtttccggagagtccgttttcgcaggagaagaatttgaagagttccaaggccagcaagacaagtcacacagatcccaaacaatcctttgagcatgttgatcccgtttaaagctattgtttctattcaactatcgcatttattttcgaatgtcattgggtggaattaacctattgtttgttatagcccttttgttcttgaatactttattccttgataccttgggttattataacttgactagttgggctatatatattggttcgactacatattagatgtgattgcttagccatgcttagaaacattagcacactattgagataacttatgactcactattatttaatgatggcttaatgatagttcacgatggtcaatcgtgattggttaattaattacttgccaattaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaaaggtgctctgtagtggattgtgttgtgcgaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacctctcatcatgataacagatgctataactggtaataatttgtttagctcctggtttggaatggtatattcctggtttggagatagatctgtacagccgggtatggttgtttagaaaggttgggcctatacaacagggtatgttgtatagcgttgaattaatattgtttaattattacttaactgttttattaaattctgaaatgtttattaaaggctgtttatgcaaatggaaccctattataccatcctttgttattctgtgcacttgcatatttgctgcgtgacttgctgagtatgtcatatactcaccttgcaatcattcatcagaggaagagttctacagtgaagctgatggtgtggaggattaggtgtagccctggtcaagctgcctgtggagtagagtcgtctgcgccgtttatcttatctttccgctgcttagatctttattgattgagaggaactatctacctctgtaatgacattttatacgcttattaattagagtaataattgtactctattatcaatttgtaattgtgtgcctcggctgattcctggacgagggttcacacacatgtaagcgtttggaattttggatagaaattccgggcgtgacagtaataccctccaaccgccatagggagtgaatctccaccgtttcctcaaaaccctgcatccatcggcttcacgggaggttcggccgaacctggggccggcccaaccagcccacattttggctggtggcctcctctgctgcttcacttcgtagacttgtgaattttggcctgatttgtcgtgtcaattctgagttcttggcccattcatacataagtctggtcttcgacatcgtccgattgatttatcgtttaagttgatgttgattctccttcattttattgtcattctctgcaaaaggttagtagacccaatactagtggaatattattattctaacatatttatgcattgcaagcatcactagttctctcctgttttagtaatattgacggtcgaaactgatcgataacgaccgtcaacagacacccattggaatgtccccatatcagatagtatacgggaagtcatgtcgactacccgtagaacttgagcacagagcatacttggccatcaggaattggaatatggattttgagggagcaggagaatggagaaaaatgaaattagctgaaattgaagaatggagagagaaggcttaccacaacgcgaagatatacaaagaaaggacgaagcgctggcacaacaaaagaattaaaatcaagaaattcaagccaggagacaaagtactgatgttcaactccagggttaagcttttcggccatgggaaactgcgcagtaaatgggaaggaccgttcgacgtcatcgacacctcttcgcacggggcaatcacactctgcagcgaatctggtaacatatttaaggtaaacggtcaacgcctaaagattttccttgagccaaatgaaactttagatcaagaagtggatgtcattgaactaatcgattatgaacctgttgacaaaaaaaatcgaacacaccagcctggtgttaacaaccaaatttggtaatatcggcatcgggaaagaagattagatcgaatccaagtcagaggcggagatcgagttcggaaacagacagaaatcggctggagtccagatcggctacgattaggatcggctgggtctgagtcgggctaggcaagccgatgcagccgattccgacaatgcgacttgatgtatgacatcgggttgaattgaagtgcttcaaggtgattggcgcacatggatagagtcctgagaaggcaattgtgtctattaattagggtgttttatgtaaagtctgccgcaaagacttgtggtatcttagagtttgttagagatagttgtcgtgtccgttacggtcatatcttgtaattttcgggtataaatagacccgagcgctatgtaactttaaaaaagcacacatgttcaatacaatctcggcgcatcgccacccttttttgctttagttttatttcgacgagttcttgctttcgggttgagctgcatcggtttcgatcttcaacaagaggtaaaacttgttatggcggcttgcattctcgggattagtgcttccatctttatgacactctaatcttgtttatgtaattcgtcgagttatcatatatcctacataatccttggcaatatcgatatccaacctacaatcggctaacatccgtcaatagaaggcagacgattaggttaaataccattgttgacttagattatataggatatctaccactctatgacacatccaacagcttgattgtctagatattgtccttcttttcatacttatagctgcatcagttaagtttgatcttatgagtcatgattagaatctcaatctctagcctacttcttggttgctgattagggtagtatcggagtttcagccgatcttacctgatttaactactttttatcctatatgcttgattaacatgttaaatctgccctttacgttaagatcttgctgcatttaagtatattaggcttttgtttagtatattctacttgctttaatatcttaatatagagtggtatcggagtattagccgatacatgctagatctatctgatcggctatgctatgaacgtatatagtctcattattaatatatatttcgatctaagtgatttatactgtctcggcatggcgaccgatctatcccaatcacttgatttaagtatatatcgatataaagattatatattggtaatacttgcagccgatcgagtagattcagtccttccttatttattaatgactgccgatcgatgcatatatgacatcagctcaaagataaatgatatgtcatcggcacctagccgatcggctatcatttatagatttaactatggtttctttgcttctatttcttgttgattacaggatcaaatcaactggcacgctcatacattcgaaggcgagcttcggacctacactggagttaagcagatctcctaggcctcgtgttttctgtcaacatgcttttggcacgcccagtgggacatttaagaagtcagccaacaattcttcctcatggccgagaaaccaccaccatccccagctagcccaggctctgttaaggaaaagatgctgaaattagggttgactgacgtcaatgaaggaaatgtcgtgctgatcgatccagaaaaattcacacctgagtagaggaaagagtttgaagcaatgttgcagcaagcacgggatcagttcttgaactcattcatgtagacccgcaaggggacacttgttcagaagtacaaaataaaagtggttgctgctgatccggggaccagttcttctaaggatggagatgggaaacaagctccagacggctcggctcagctgagtaaccaaagtgctaccgacagctctctaggaaatcaaggtgacaattctcaaggagtccatggagtgcaaggtgacggggtgcatggagttcatggagttcaaggtgatggtgcccaggggttgcaaggagaaaatcttaatcagaatagtgatacggcacaagattttttcagtaatttccaagatcgggttgactacgctgtgcatcatgctttcatcaatcaatctagggtgttagtcaataccttatcaaacatgatgaagtccatagccgatggttcaatagctgagcatcaggctgtaggcccggtttatttgcaaggtgtctttccaaattatcggtctttgattaccgatgttcagccatcaactcaagcggttccctctgttgcaccaacatctcagtcgacggcactggcgtcaactctcctacttgttccgcagcaatggcgtcaggccagccagtgaaccctcggttgttaatgagagagcagctacagcatggcgggcaggttgcaaatcagctgacctaagatcaggttgctgccacgtttctgccgcctcaatctattgttgatccaatacagcagcagtcgattcagcagacacccccaattcagcaggttgtgcaaccaattcagcaacaggtcatgcaaccagttcagcaaacaccaccaaggcaacagcctttgcagccgattcagcagacgctgttaagacagcaaatcattcagtcgatccagcaccaaggttcaataggtgcatcggccgggttggcaacgcctggtggtcagcctgtacaacattttttaaatcaagttgtcctagaacacttggttcaccacgtatagccggatggcacagtaatacctcaagttgttcctgagcatttggtacgtaatatccagccgaaccttcataattaccaagggggtaacttgaattaccaagatcagcctccttccccacaagctcaatatcagccaggtggattggctcaacctcagttggcgcctcaatatggtcagttcgagcccatgcagcaacagtcacaaggggtagctcagcaacgaccgtgggccgatgtgattgctgacgtaatgagggaacagtttgggcttaaaccaaaagagactggaagcttgtattggcagccttaccctgagtggtttgagagagttcctcttcccaatcggttcaaagttccagacttctccaaatttttgggacaagatggtgtgtcaacttatgagcacattagccgtttcttagctcagtgtggtgaagcatcggctgtagacgctctaaaggttaggttattccggttatctttgtttggatcggcttttacttggttttcctctttgccgtatgggtcgatcaatagctgggccgatttggagaagcaattccacagctatttctacagtggggttcatgagatgaaattatccgaattgacagcgattatgcggcggtatgatgaacctgtgcatgagtatattcagagattcagggagatgaggaacaaatgctttagcttgagtttaactgatgcccagttagtcgatctggcttttcagggtatgattgctccgattagggagaaattctcgtctgaggactttgatagcttgtcacatctgatacagaaagtaaccttgcatgagcataggtccgcggaagttaggaaaaactctaagaaggttaatcatgtttgtccgtacatgtatgggttggatgatgacgaggacgattctgaaatagctgtagccgagtgggtgaggagtaaaaaggtcataccatgccaatgggtaaaaagttctggaaaagaggagaagtatgactttgatattactaaagctgacaagatctttgatttgctactccgagagaagcaaattcaacttcctgctggtcatacaatcccatcggctaaggaattaggcaaaaagaggtattgcaaatggcataattctgggtcccattctactaacgattgcaaggtttttagacagcagattcaagtggccattgagggaggcaatattaggtttgatgattccaaaaagccgatgaatgtcgatggtaatccttttcctgtttatatggtgcatacagctggccaaacagccgatagggcccgtgcaaggggttttcgggtgaattcggctaagattatcaacaaatatcagaagaagtatgacaagcagcagaagaagcatcatgagaaatacgatgatggttttgatcctcattggggttgtgagttctttagattctgctggaatgaaggtatgaggttgccatctattgaaaactgccctgggtgcagtgatatcgtcaagaactcaagccgatcatataataggggcaatcggttaaggcagacaacagtttctgttcattaaagattgggcccagtaaatcaagatcatggccaagaggacgatgtaatcaggaagaatcaatggtgtccttatggtattttcacgaagaatcagaagagaagggttcagagattaaggaatagggagcaccttcaggaggttgaacaaaaaattaatcatcggctgaagaaagcaaagccaaggcaggagtggcatgttaagaatcaggttcctgtagccgatgatattgcagccgatgaggcaaagaggttggcaaaagggaagagtgttgtgacggcaccggttaacatggtctttaccctgccagccgaattcgggatcgaccaagccgatgtcgatgaggtggaagaggaatcggctaagttggttctgtcaccagaacaggcagtgatcgagaaacccgaggggacagagaatcggcatcttaaaccattgcatataaacggctacgtcaatgggaagccgatgtctaaaatgatggttgatggtggggccgcggtaaatttgatgccctatgctacgttcaggaagttgggtagaaatatcgaggatctcatcaagacaaacatggtgctcaaagattttggtggcaatccatcagaaaccaaaggtgttctaaatgtggagctgacagtcggcagtaagactgttcctaccacgttttttgtcatcgatgggaaaggttcttacagcttattgcttggaagggattggattcacgccaattgttgcattccttcaactatgtatcaatgtttgattcagtggcaaggcgacaaaatagagattgtgccagtcgacaggtcagttaatgttgccagtgctgatttagctctttgggagatggatggccttgattgtttatatggaaaagtctgggatggagattttctaaaagtgtccaattctgatatacagccaattgaagatggagaacccaatctattattttgagggcgtcgtggagggttcaagtgtctacactacggacatggtagatgatctcgatgacaagcaaggtcaaggtttcatgtcggccgatgatttggaagaagtggacataggtccaggcgatcggccaaggccgacatttattagtaggaacttatctccagagtttagaaccaagctgatagagctcttaaaagagtttagagattgcttcgcttgggagtattacgagatgcctggactcagccgattgattgttgaacatcggctacctatcaaaccaggggttaggccacatcaacaacctccgaggagatgcaaggccgacatgcttgaaccggtcaaggctgagattaaaagattatatgatgctggttttattcgtccttgccgatatgctgagtgtgtttctagtatagttcctgttatcaagaaaaacagcaaggtcagggtatgcattgatttccgaaatttgaataaggccaccctgaaagatgaatacccaataccagtagccgatcaactagttgatgcttcttcgggacttaagattttgagttttatggacggaaacgcaggatacaatcaaatttttatggccgaagaagacattcacaagacagcttttaggtgtcctggtgcaatcggtttatttgaatgggttgtcatgactttcggcttgaagagtgctggagctacatatcaaagagccatgaattatatatatcacgatctaatcggctggttggttgaagtctatattgatgatgtggttgttaagtctaaagagataaaggaccatatagttgatttgaggaaggttttcgagagaaccagaaaatatggcctgaagatgaatccgacaaagtgtgcttttggtgtatcggctggccagtttttgggatttcttgttcatgagagggggatcgaggtaactcaaaggagtgttaatgcgataaagaagattcagcctccggagaacaagacagaattacaagagatgatcggcaagataaattttgttagaaggattatttctaatttgtctggaaggttagaaccttttgcaccattgttgagattgaaagccgatcagcagtttacttgggaggcagagcagcaaaaggctttggataatattaaggaatatcttagttgtcctcctgttttgattcttccacagaaaggaataccgtttaggttatatttgtcggccggtgagaagtcaatcggctcggtcttgattcaggagttggaagggaaggaacgagttgtattctatctcagtcgtcggctcttggatgctaaaactagatattcccctgtggagaagttatgcttgtgtttgtatttttcatgtacaaggctgaggcattatctactgtccaacgagtgtattgttgtatgtaaggctgatgttgtcaagtacatgctatcggctccaatattgaaaggaagggttggaaagtggatattttccttaaccgagtttgatcttcggtatgagtcaccgaaggcgattaagggacaagctatagctgattttattgtggaacatcgtgatgattcaatcggctcggttgaaatagtgccatggactttattctttgatggatcggtgtgtactcatggttgtggtatctgcctagttataatttcccctaggggggcatgtttcgagtttgcttatactattaaaccgtatgtgactaataatcatgcctagttataatttcccctaggggggcatgtttcgagtttgcttatactattaaaccgtatgtgactaataatcaagctgagtatgaggcagtgctcaaagggttgcaattactcaaggaagttgaagccgataccattgaaatcatggggtaaaatagaggttgtgggaacaaattcttacacatatatgtgtgctgtgattttatttttattcctcaccaaaacaaatcttgtaatagatctaaagattcaaaattacatgaaacttatatacaagttatactatagttacgtgcaagttacagtgtaattacactatgattgtactataattatatctgtcaaatttttaggggaaaatttatcgataaatgtataggtggacatgtaaaacgttaccactggatgaatgatgcaagaacaatggtaaatgtcagattcaattcagggttctcgttcttgtggagtcactcacattcagatgatgcggctgcgacgagggcacatcacccagcttctgctgctgatacttgctcccgttcgcctcctgcaggagatcaccattgaagaggctgcgacaaccctagctcctcctcctcctcagaccatttcctccatgataggctccctccgtggccgcggccgccgcctcctcgccgccgcgtccgccctcgcgctcctcctcctcctcctcctgtcccgctcgccgcgtcgtcgtccccacgggtatggcgtcgtcatcgacgccggtagcacgaggagccgcgtccacgtcatcgcctaccgctcccccgccgcctccgcggccgcggccgcgctcccgtggatcgactgggcgcgcacggcgtcgatgaaggcggccccgggctgttgtccttcgcctccgatccgggcagcgtgggtcggtcgctggcgctgctcgtggagttcgctcatggtcggcggcggcgaggcccggcatggtcgggtgaggcaaggtgggaagtcacgcgggcggcgggtgaggctcatggtcggcggcggcggcgagggccggcatggtcgggtgaggcgaggtgggaagtcacgcgggcggcgggtgaggcgggcggcgtggctggtgtggcgggcggcggagataatcctctttggcgtgcgttctttttttcgttctttttggcgtgcagtttctttttccggagcgagacgcagtgttaatccggtgctaattgcaaccgcaggattaatccggcgctaattgcaatcgcggtgttaattacactaaacaactcgtgctttttatattagtctagatttggcgtgcagtttctttttccggagcgagacgcagtgttaatccggtgctaattgcaaccgcaggattaatccggcgctaattgcaatcgcggtgttaataacactaaacaacttcgtgctttttatattagtctagataacatagggatgagtagcaaattgttaaacgccatatctgtggagtgataaataatataaatgcccccggacgagatggggggaaaagcagcacaaatcagtaagcccagtgaatactcagagttgaagagctgacttttcccttgcaaaatgttactgctgggtgctggccatcccgtatacgctttccatatgctgatcaacatcctgatgctgcaaatcttttagtaccacagtgtttcatgtccataactgcacggagaagctattcacctgatgaatagatgataacaaatttggacctgcctaaattttacctggccatatagttaacgtttaaacttatcctcatggtaaccgttgagaatccaatgcggcaaatcccaatttgattggatatcaatttaccaacaaacatggaaatccatcacacagcgtgttctgacaaaaagatgtataaagtattacatagttcatctgacgtgacaattttcgcttctgttctttgagtcaccctccggcgcttgatacctgcagaggattcagaaaatatctttagagatgtatccaaatgaatggtcaagtctccggggatagtgctagcgagggtattggggcataattaaataatgagaagtacaaaattgcaaataattttctaggtgcagtttaataaaataaaattcacatcaactgctccacgttgatgggaagtgaacgttgacaaagatgcataagttacagttaaaaaattgtttattactggattccaccccaaaattgatacaggaaggagacatcttaatccaaaagcacaagaacacagttcaacttgacaattacaaaggtcaccaagaaaaattagcaggcatactgtacaagtgttaagatgaaaaaaacgaattgcattttgaagctccgtattgctttattatattcctaggtggcatctcttgttggctcatagcaacaatccagaacagagtaacatggtaccatgatgcaggacgtgagcaaagtaatggtagtttgtacatgttacaaacaacctctctttattatactatgttcagattatcaatgcatatcaaagatttcagcatagcatttcatttggaatagaactcaattccccaaatataacttcttaacctatcacacggtacacaaaaagggacatttaaggcctagactttcaagaattgagacagtacccccttagaacaatatactatcattagttctgtagatggttttgcaaccatgcaataaaagccataaaatttatgtaagccagcacctcattcaaaacaatacacaagctaattctccctagcagctgggcagagttgactagcagtagttatcggcacaacagtgcgtggtagtggaggaatggtgccttcttacaatactagcagagctattttctggtggtttcaccagttcctgaggtttgagacaaggaggcacacagcagggtctttctaactttgctgaatctgataatatctctgacccttcttgcttaccctgcaacctgcagttctcttctacttcctaagctgtataacaataacttcatctccattttagctgagccacaggtggctctagttcaacaatctctcagatccattagaaatattgacctaatttcttttttttatgagcactaaatttaactttgcgaacagaagtaaagtaatatcatcaatgtagtcttggtgagtttgtccacacacctcgaagtaattctacatttaatgagccgagctgaacatgcagctgtcaaacacacccaccatctaccatgcagtcgtgattagtgagtgctgctactcaactctgcatagctgctagggagaattagcttgtgcattgttttgaatgaggtgttggcttacataaattttatggctttatttattgcatggttgcaaaaccatctacagaactaatgatagtatattgttctaagggggtattgtcttcgtgagcggagacaaggaaaacactatgcagccactgaatatcaggagggtgaatgtgaaagatcaatgatcttgttctcttgcatgatagaacaagatcacaatgttacatgagataacaacggtgtcaattggtggatgctagtgacagtcgattgaggggtaaaactttaatatttgctcgctcactcatcatctggaaaaagaaaattaagaatagccacagcatctccacctaggctaacccttcttgtgaaataaccatggggttaaatttggttcaacaataataataattagggccttctttggaacacgtgattgtgagatgggttttatggtacttgaaatgccttgttcattctttgtacctgcatagttgcatacactcattctggtacataacatcgtaaggcaaagcacgtatcaaaacagtttaaaaatcaaactagtgtttatacatagcatctgttcttacccaagggagcatattccttcgagtaaatttcacaaaaccccaggttttggggcacccataacacaaccccaggtactacgatttgtttcaaagaaccctagattttggggcgaaatgtttcaggacaccttatgtttaagcttgtatcattggttttcctaatatagttatgcataataattgcaaaaaaaagagatattcctgagtatatatacatgttagcatcattttaacgagcatcagttattggtaatatgattgtttacatgtataactggttaatgtgtcattactagtcaggttgttgtgctttttcaatcgtgcaatgcaagagtaaggaggaagataaattgcatgtgagtgatgtattttgagcctactaatgtgaacacatactaacaatatgagtatttgacataaactttcttgaaacattttggcccaaaacctagggttccttgaaacaaattgtaatacctggttttttgcgttacaagtgtctcaaaaccagaacgattttatcagccattcatctgtcatgactcatcattcaaatcaattattgaaatgtttgttcgtatcaataattgaaatgatcatgtttatagtagtttcaaatttaccatgtccaagtaaacataaaatcagataatgcactcctagcttagctagctacataatttgcatggactgataaacatgattgaacaattcagttaagctcttgaattttaatgcagacaatcacggtcatcgacaaccatttttaacattcaactaaactctaggttacgctcccaccccaccaccagacaaagggaatctttcctcacctacatgatttcatgacaatgaaaatcttcacttctgcaacccataatgaacttaatcgtttcttaacattttatcggtaatttacgttaggctccccctcccaacaacagaccccagggatgcttcttagaacaggtataatgaaccttagttcacaataggataaatattgtgcagaagtctggatgataacttaaaaggggatggatcttaggagagatgaaaacatagagttggcgatgaacttttaggagagaaaacaaaaagactaattcattatacatgcttgcttggaaaatataacacctccttatttatctatttataaagaactgctaacagattagatctagagatacgtcaaattaaaccatccaaaaatatgttgcgctctaataaaaactacttatcttataacaaaacaattgatccactaagtatcaactaactaaagtgtttcaaaagccatgtgctacatgatgagccctgatgggcttcatgtcacataacagttgaagtcatttttcatatcattacctggagctgcttgcaaataacgtctactatgactgcacctagcaataaactgcagtttgaatagtaatagtgcacaaggactggatgttacaatactatgaatgatttatctgcatattaactagcctgcaacctactaacttacatcaataaagcccattcaacaaaaaatggatatggtatattggtgatgaattgaagtgagtgaccatgtgtctttaaggaaataaggggagtggactacatagtacatacttctatattcattcttcaattaatgaaaaggatggcaatacctccatgttaacaagggcatattaacagattatatatgtactatgatagaaatagctaaaggaagcccagaatacacgtaattgctatctataaaaccactagctagacatagtggatgctattggtggttatacaagtgaatgatagaccccaagttacaataccataccatgccacatgaatactcacatataaaataattttccaaatctgattggacagaacaacaaaaccttaattcaacatttcaggccgctaagctcacatagtttttttttttttacttccattaccaagcgattgaatcacaaaacatcacagatgatgtacagttagaattttaccacaggaaagttcagaacatttgaaaaagcaaacgattaaaatatgaaatataattcataaattttggaaagctagactgggtaagggaaaaaatcaccacaagaggacatggtgaagaaagcaattaaactcaccaatcactgtgaacaccgtcataaaaatgcatgccctaaacattaggcaaaagagattaccttaatttgcagcaggatacaatcatgcagaacaaagcaaaatacccccgacagaacaaaatacttctgctcttaagcattttcaggagatccatttctctgtactaattgaaaacgccaacagtcacaagtcaccaaacaagtcatcattatcatcagctgaatttgtatccatattcccactagacttcttttcatcagcagctttgactttttctgcctggtcatccgacctgtatgcccaagatgggcccaatagttgtggaacagtatccccataaagatcatcataaattccaccttttgctgtgcttttaactttggtaagaacctgttttagcttatctgttaccccactgggggatgcactttcctttggtgaaggttgctcctttccttttggaatgacagtaacctgtacaagggattcatatttcccaacaagactgccttccttcacccctactggacctggttcagtttcaacatctgcgccatctgaaatcccaaccacttgaataagttctcctccaacttgatctctaaatgatactcttagttttttacttctcttcaagggccttccagctggctcgttatcatcatttgcaccagaggcatctcccgaagaatcttttgatctggataagtctgatttactaataccatagcggttaagtattgtgttgtatgcgaccacagcatcttcatcattggggtctggtggagatggcagactgacatctgatggaagactatgagttgggaaaaaggcagcgctattctttcgtaggatataggttctggttgatgcagcaaagcgaagtgactgaccaacttcaagttcaacagggttgtctttagttagtctctcatttgcaacaaatgtgccatgaactgatcctaaatcaataacatatatgctgaaatacaaaaagaatggaaaaaatgtcagtgatgcaccaaagcagcagtgtcaataaaagtagaaatgttttccatttgaggcccagtggtttttctggccgacaaattctgagcaaggcatgccttaaggttcttcaaaaagaaaacacattgcaacatgacataggcaactgttctgaaactaaacttgaaatttaggtgcatccaagggattgatttttttattgataatatgaatggtgttgttgaaccacattgtttcatataggttgttgcttatgaattattaagctcaattccactgctagcatgcgtagcattcagtaacaaacagcggctaaaaaaactaccatcaaagacaaaatcaacaagtggaatcacaactgtgttaacattagcattatttttagtctaaccttccatttctgtgtggaacaacagcagcatgctgccgcgatacagactgatggtccaacacgaaatcacatgcaggtacctgcctcccaaatatatgcctcttcttctccagattgatccgatcaatgacatccccatccttcaacacctcaagatagtaaaccccagggcgcggctctatcgcccagtcaggtggctgccacgctgattgcccaccaccgacctgggtcccagcatgccccggcgccccggtctcttgcccggccaccctcaaactggcacctgcggactcaggtgactctggctggttccaacatgtgaaatctgtggcagtgtcaatggagccggcggtcctttagctgttctcgccgctgcaggtacattcttggccgccgaaccggattgaacggagaatggctccaaggcctgagccttcttgaagcggtcaagcccgccacggtacatatcccgaaagccacgctggtatcaccaccacttctggtctcttaataacacaacaaatcaagcaactgatggccctggcccctgcgcacctgcagcgtccaatgaaccctagtgaaatttcgctagattgccagcgcaagaatctccggcctaaaaaatcagtaacagcaacaaactcagcactggatttggatagcgaatggagtacactacagacaaaaaggattcgatcgatcgatcggtcggtcacgggctcagggcgcaaatcaggaaaaagcgaaatcgttaacagcttagggcttaccgagagccgagaagtgctagcccggattcatctaggctcggttggaagcttccgaggagatcgaggccgccggggtgcttcggttgcggcggcggcggaggggtggggatgatggggattggggtttgcctggtggcgtctgcggactgcggctgctcgggcgctggtccggatgtagcggtggtggtaacactccccgcctcggatccccgacttcctcgccccgccccgcccccgacttttctccccacggcgggcgacggaggagcgcggcgatgggagggagggagggagggatggcggcgcgggtgtgaggggagcacgcgagggaacacggggagcgggcggcgccgccggcgcggaggggagcgagcgatggggtcgatgcgatgcgactggcggcgtgcgtgcggggaaggatccggggatagggctggaggatttgagcgccgtgtttctttctgggctgggctgggcttggtcggtttctttggacatgggctgtcacctgaacttgagccgacccacgttgccatgcctccctgccaccctccgtccgactaggtctaatctgattcctatttctcaaccacaaaaccggagtaatttgattcactcagtggttttgagagcggttttcgctcacatgacacgtgaggcctacttgttagtcatctttctctttcttctccttcccttgccatgtctttctccccatatttcctcttgccggcgggataccgggcgacagcgggtggtagcaggatggtcctctaggtgctcgcccacgacgagcgagtccaccaccgaagcacacgtcgcccacccatagcagcatggccatctcgctacttgtcaatgtccatcttcctctgatcctcccgacaaccaatgagctagctcgagacaaagagaggagagaaagagaggggaaggggaaaggactgagggacggtggtgctcctctgcctagcgcgaccttccctgcaccgatctacgtggcagaagaaagaaggaggtggtcgataaaccccaccgagctgcaagaagcggccaaagggaacgagatctggaggtcaccacctctgcttgccctcttcaagttcccaggggtggataagccggcaccacccatctccctcgtcttgctgcagccccgcgcccaactggttctaccacctcccagctccctcgccttgttggctcccaccatcctactactgccaagccatcggatcaacatgtgccacaacagccaaatagtagcgatatagccggttttgcagagggatgccaatcagattcggccgaaaattgagggcctgaaatagacttccttttgacaaccgaacaaaatcattgacccatcataaaaaaaattgtgagtacatataaaattaagacaattctatatgtattcacaatttcttaatttctcctttggctttcctccaccgttgtggttgaggaattgtcgagtttgactatttatcagctggagcgtatacacatttttttcttaatttctcatttggctccactgttgtggtcgaggaatcgtcgtgtttgacaatttgtctgtcaaagcatatgcacaattaaaattgctttaacctgactggtgtaacgcactggcatttttactagtagagataaagatagcgatcatataccgccatatagaacgatcatcggatcaacatgcgccacattagccaaatagtggtgatatagccggttttgtggagggatgccaatcagattcggccgaaacttgagggaatgaaaatagacttcttttttgacaaacgaacaaggaataagtccactttgactcccttagaagtgacgcgaatctaatccataacactcaaccacaaaaccggataggacgactcatcgaactattgaaaccagtgcaatttgactcccttagcggttttggagggcggttttgctaatatggcgctgacgtgacaatgttgatatagtattcgtcctacgtggcacttacgtggcattagattttttaaaaaaaattctatgggacccatctgtgatttacacaaaaaatattgtgggccccactgacatgtggggccatatgtcatcctttctcttcttcctcctcctccctctctctctcccttctctctctttctctcccccttttctcttcaccttctctctcgtagagcaatcgacgggtaagggcagcgacagtgggcgggaaccggagaggcgacggcttgcgggagggttggcgagcatgtgctagagtgtgcggcgtggaagtggcctcctgtggcggtggggtgtgcgggaaaggcgtgcgacgaaggggaggaagccgcggtggcggagggcggggcggtgggctcgactaagcgagacttaagcttggtgagcgacaaccggcggtggagtagcgcagccgaggcatgaggcagcggcgggcgcgaggacaacacgtaggggcttgaggcggcgacggggttttgtggaggctttgcaacctccgacaacggcgttgtcagtgtcaacagcggcggcggcgcagttggagatcctccttgggccggcggtgctcccggacaacatcgccttcaacgccgacctcggcgtggtcggggaagtcggcggcgacagcggtgacgatgacaaatatgaggaggaggatgacaagaaggaggagatggagggggcatgcggcagccgaatggtccagcccaccgccgccgccacttcagcttccgctgccgctccagctcccgctggccgctgctccaacccgtgctctccgtggccggccgaaggggagaaaagagaaagagaaagaaagagagaagggaggaagaagaaagagagataggatgacatgtgaggcccacatgtcagtgggccccacaattttttatgtgtgtgaatgacaaacgggtcccacgcatacgtttttaattcaaatgccacctaagcaccatgtcaaccccacggactaggtcaacagcgccacaccagcgaaaccaccctccaaaaccaccaagggagtcaaattgcaccagtttcaatagttcgggggttgagatatccggttttgccgtttagggtgtggattagattcgggtcacgggagtgaaaatggacttattccaccgaacaaaatcatcgacccatcatagaatccatggcccaaaacccaatacccaaatcttttccttcccacaagtccacaacacaaatccctaaccctaaaatccattattccccccacccggctaccccgagcgtcagctagcccgcacgcgattcgctcgcctcgcctcgcctcgcctcgcgcgacggtgagagaggtgcgcgggcgggaggtatcggcggtggaggctggtcgtcggcggagcagcgctggtggctggctggtcaggggcggagcagggcggcgcttgaggtcgaccggcggcggagcagcggtgggagtcgaaggcgcgcccgacgaggttgcccaccgccggcgtcgggtcgtcgtatggttgtgaagaagcaggttcggctcagttcctttgttcttctcgctagctaaattgtgttggtttttcttagaattccaagtttcacaaaaactgagaaaaccgtagacctaatgcccaccccaccccacccctggatggctagatgggattgtcacatcaaattcggtttcgcctaagtaaattccacctcatgaaattcaattagtaattagctagccgtcgctgcctcttcactcagctgcatctcccacaaacggaacaaaactttgaaaacgctcgctggaaccggccagggaaccttaggggtaggggtggggcttggataggtactccaaaggcattggttatttcttgatcgcattcgctaattaatagtaatttttaactaattacatgtgcccattacataacttttgccta

SEQ ID NO: 80724 - DNA, 1930 bp, Oryza sativa
tggacttgattactattaccttccttcagcgtaggaagagagatttcattatatgccactcctaattggtttgtagggtgagagggggagaggtggcaatggtggctccaaaggagggcactttgcaggcgttggcgtacttcatagttcccagtgagctcccttccgggtaaggccataaaaaaatcctcatctccattattgttcaacaggaggagcaagaaactaggtcagaagcgatttagcaagcaaactaatggtcttcctctcatttttgtttttcctatatgataggatcgatcctgatgcggcgtttattgtgtgtgttcggtttggtcagtacacagctaagcttgatgatggtagtagtgttcatgtgccaagcaaatacgctgaatgggttgtagactatcgacaatgcacattagagagcttggaaaaggattttgcagccagggtaaaatggggtaggtgccaacaggttgtggtgtatggatatgacaagagaactggcaaggaaacaaagtttttggataatatggatctagcgcatgcattatttgattggaagagggagaggaggctgattttatttgtggatgtggaggataaatctggtcaattagttactagctcttctatttcagaggtaaatgagttagtcatgggtgaggttgtgacagccaagcaaggtgatgctctagactcaagcaatcaacatctcattgattgggatagtttcaagatatctccaattctagaggagcaaataggttcttcagtgcccatgatgaaggaagatgaaatgtcaattccacaagagcaagttcctcagcatgtcattgattgggatggattggagatagctccaattccagaggagcaaattggttcttcactacctgtaatggaggaagatgaaatgtatgattttcttggactcagaactgaggatgagagagcggatcaagctaggcttgaagctgaaaagcagagggattctgctcctggtccagctccacgtcttgcacagcgggacttgaaccttgatgaggcagagatagatgctaggtttgaagctgaaattttctatgatagggatgaccctccaatgatagttggaagctcatatggaagtatggttgagtttagatcagctgtgaggcaacacgctataaaggggcaatttgagcttgggacagagaagtctgatccagaaaggttcaggggctattgcaaagctgagggatgtccatgggctattgtggcaaggttgatgcctgatggaaaatctgtgaaggtactaacaactagctaagaattgtctcatatttcaaatttatgtttgttagtaagaactgtcttatgttactaactaatggatttatgtgttgtaggttactttgaacagatttgcacatgcttgtacatctattgagggagttaagacaaagatggtatcatataagtgggttgcagagaaggcaattccttttctaaagaaggatccaaatatgggtgcaaagaagctaaaagaggagttagagaccaaatacaatgtcacagtaggatactcaaaagtgtggcaaggtaggcagaaggctgtggagcagatatttgggtcatgggaagagagctatttgtttaacttcaaggctgaggttgagctgaaaatgcctggaagtgtggtggagatagatgtacaggaggatgatgatgggatttatttttgtagattcttttgtgcattcaaaccttgcattgatggtttcatgaatggatgccgaccatacttgagtatagactccacagcctttaatgggaaatggaatggtcatctaccttttgttacatccatagatgggcacaactggatgtttccagttgcatttggattctttcagagtgagaccactgacaattggacttg

SEQ ID NO: 80725 - DNA, 2186 bp, Oryza sativa
ctatcaggtcaaaaataatggatctattggcgaggagaaagaagataggtgagaagctagatggtgagatgctccctattatagttcgtcaactcaatgcaatgactagatccttgggccacttgagggtggttcaaggtgatagagaccaagcagaggtggctgagatcactcctgaacatgagattattaggcatagggtcaatcttgcaaaacatacatgcacctgtagagagtggcaagtttctggcaaaccatgcccacatgcattagctctcataatatcaactagaaaccccagaatggctgattatttggatccttgctattcagtgcaaaagtataagcttgcatatgcaggtgttattcatccactttcagataagtcccaatggccaaaagtcaatcttggtttcaatttgttgccacctctgactaagaaagacgtagagaagcaaaggaagaacatgatagttgggtgtcttgataaagaacaaggcaagcttaggaccaaaggcaagtggcaggttcagtgcaagagctgtcttggcatgggccatagggcaacatctccaaaatgtcctttaaattcccagaaaataatgtaagatcacacatttacttgttctagcatatttattgtccatttccttttgaaaatatatttacttgttttacattttcaggaagaatagtgacaaacaagggagaccactaggttcaactagttgtgcagcgggtgctagcacacccaaaagacaaaaagtttcaagaaatgattccagcaatgctagtcctggacctgtctctgaaaggtaagatctttctatttgaatggtattgttgatcctgccttatgttttaactaacactcaatttattcaaggcaattggcgttgaccaaggctgctggagaagacaatttttattgtgcttgatcagcatgctgctggaaattttttgtgtgtgatcagtatgctgctgaagctttttacttgtacatgatgctaaaagttctgtaagctccaagtccttgatcaatcctgcacaggtatggcacaaagcagtgaaaaacagagacgaaagacaccaaaatcatcttctttacattacatagtatttacattacatggcaaacgaaccaaaatgaaatcttccacatcaattgatctctcatagtctgatatgtccattttgcacgacatcaaataattcctgctactgctgcttgtaatttccatcaagtaattcctgctactgctactgctgctgctttgccaactccatcaaataatttgttctcttcatgctaacgctttgcctgcttctgctgtgccgtggggcctgccatcggggcggtagtggcgacccacggtggtggtggtggtggtggtggtggtggtggtggtgctgtgcagtggcagggtatggccatggttgtggcggcctgagtggtaatgggcccaacattttacactcgaaaattggagggctgggtttaaaaaggggctgggctcaatttttatacatttttggcttaaaaatatttgagggctagggttgtgaaagagcccatgggccttgacccattaccacccctacgtggcgatggtgaggcatggggacaggggtgctgggcctaccgatgcggtagtagtggcaatgaggcgatggagtgcgtcggcatcgagcgaatgagacgagccaccagggacttgctttgatcgattgattagattgatctatttggtcagcaggggcaaaagtgtccttaaccctaggagagaagaagaaaatggaaggaaaaagaaattggggaaaatgggagtctgttcagttcgtcggtttcaccgagtaaccgagaaaacccacctgtatgtgctacgatgccgagggctggagtcctgcgagcagcatggcaatatattgggctgcggtggtggtcagatgggtttgataggctacggcgataggggttgttaacagtgataggggttggtaacggcaataggggttggtaagaactgatggtattaatgggcttttccaccagtcggagggcctccacgatgtggtttcatgcaggaggatggggtcgtagagattgatcggttgtgtgggttcttcggttttccagagatgagaaaccgagagaaaagtcgaagatcgaagcaccgtagaaataa

SEQ ID NO: 80726 - DNA, 615 bp, Oryza sativa
gggcgaattcgagctcggtacccattttggtgattcgtaattaatattaaattattgagggatttattatcgtatttcggagtagtaagcatataagataagacaagtgccgcagtaacaaacatgtaatacataaccattaattcaattgtaatttacatacaaatatataatacaagtggcacagttttttcatcatatgtataagtagtgtacatgttattgcatatgttctttctcccactctctgagaggtttaaatttgtcgtccattgcgagctcactctggttgtcgtagaagagacctcttgcgttgcagacatcgcgacggatgaatcggcagaggtcagcggacacgttcaagatagtagtgtggttgaatcgttgtgcaatatatgggatttcggggatctgcacacagaaaggaaaataaaacggtactcagtgagaagtgtgtgcgagatgggtttctttgtagagaagagttcgatgacctactcggttactggttgttttgtacctaccatttactctgagcatgtcgcacacgtggtaagcacacaagttggttcctggtggttgtttgtagcactgcgatataattatggggaccga

SEQ ID NO: 80727 - DNA, 690 bp, Oryza sativa
tgaatagtctagagcctccgactgagcattaatgtggatacttatattttggttgttggccatgtttagcatgtttagagcctctatgcaaccaatgccgtgtttcgcccctttgatcctacagctcaggttgcggttgcggtttaacgcatccagcacggtattcaacgtgccagtgcaatcactcgacatgtgagggcgggctagttcatgatcttgccaagtttgcattgatgcgcgtgaactagaataagcatatggtaggtgcttcttttcaccatgttgatctgccgttgataatagtcctactttacattaccttgtaacactcaactcaatacctacactctgtactgacatatgagctacatacaattacctttctagactgatttgtgtttttcaccttagccaatgtctaacacttataatgatgtttacactgaatttacatgagttcgatttcccttttattatggtcacattttttatgtgcaccacctagttcagacgacggataacgttttgaatgatgatactctagacgcgccctccttacatgcaggcgtatttaatttatcacttatcctgaattgatagtaaatagcacgtacctggcatgttgctgcgctagattactcatttctcaagatcttgcaccatattacatccacctacctagtttatgca

SEQ ID NO: 80728 - DNA, 1595 bp, Oryza sativa
acccctctcctctctccttttccccttcctcttcctctttctgcgtcctcctcgctcccctcgctctcctttctctcggcccaagcgccgccgcccacctgctgcgtcgcaccggtttatgcctgaccgccgagctccggagctgccgcctcacctcctatccgcgacgccgccgaaaaccacttcggtcttaacgccgccgcctgtcctggagcaccgccgcgcacagggttcgacttcccactgtcgtcgcatccgggaccccgccggtaacgacccctcccagatttcagcttgaggaagatgcttgtcacgcccagaaatttagcccaaatttccagactattttgtgtattaaatccctgtccaggaccagccagggtacacaaaacgacaagtaataaacagttccgaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaaataatagcaaggctgagtacaacctccgtactcagcaagccacaccaacgatgcagacgtgcaaggggaacacaaggacggtttgtggctatttgcataaaggcgggtgtaaaacattttattgagcaaaacagtaaaaccgttgagtaattaaagtaacattaaatctccactgatcaacgctacaccacgttgaacaggcccaaccaacccacctaaactacagtgtattaggtcgatttattgaggtgggactaatcacggtgaatctggtcgaccgcccataaccgtgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatattgtaattatcccatcaactgagctagtggtaattaagcatggctaagcatatagttctagctaggtcacataagtaacatgagctagtcgattcattacccaaggttgacaaaggatagatatcaagtaaacatgggtaccgagctcgaattcgccctatag

SEQ ID NO: 80729 - DNA, 618 bp, Oryza sativa
ccatttggcttgtcctacggtcaaggtcggctctgataccaacttgtcacgcccagaaattcccgaatagaattccaagcagaatgtgcattaaaatccccgtccaggaccagccggggtacacaaacgacaatgttgacatacagatccacgtcttacaaacatcataaagtcttacataaatgcagcggaagaaaagaaagacaacaggagctaagccttgactaaactttgactaaactgcagcgggaacaccactccacaggcatcctcgacggcacggacgaagcctactcctcagagaaaccttcatctgacccgaactcgaactctggggttgggaaaagtagagcaagactgagtactacccactgtactcagcaagtcataccggaataggggtatgatgcagggaaatcatcaaagaagagctgaagtggttcatttgcataaagcgagcatttataaacagagattgaaagatttaaacagttgtaataattaattaatattaactatccactgtccaacgctaacccacgttgcgacaggcccaaccatccacctaaactatccaaattaaaggattacactaaggtgaaactaatcacggtgaat

SEQ ID NO: 80730 - DNA, 982 bp, Oryza sativa
  unsure (1)..(982): unsure at all n locations
cccttgttaactctcttgaggccagtggtggattgagttgaaaacttgagttacttgaggcatacccgctgacattctttcctttttctctgttaaacatctgttacagggattgaggtgagagtggaaacaagccaggaaagaatagaccagaactaaagacaggaccttaaaggaactaactcttctcgttgatgtgctgtttgttttacttattctgcaagttgattaagcaaacaacctagcatggttacatcacaacccaccgatgcaaaccacgcgctacacacacaagcaaaggagcacacgactaacgactctaccctagagggtggcttaggttctgcgacgggttcgctgtaacatgtgattttaatctgacctctgtaaactatcttcgaacatatcacttggttcataactgggaatagctcccatgaacaagcaactcggattcactttctttacattcagtttacttcccactattctcttcatgttgtcctcagtaagcattcaacgtatccttttacacctttgacttttatcaccttttcgacctttgtcaactaagtacttttcactcgaagagttgtgnatgcttttggtgacgatgtggtacttgagcctgcggcctttcaaaaaaaccttcaagtggttcgtcaaaagctagactggcggttgttgcctttgatccaaaaaagacacatctgaaactcttagtccaaacaaatgtctctttggttaatcgcttgattttcttttccatcatcaggttggttattaactcgaggttagaacatagttcctctgaaatgaggccctaggtctcctttgacagtaaacaattatacacataatcccatatcagcatcttccgaaataatcctcatagaacttgtttttattacacatgtctcccttattacatgaatacaaggccttgccttaaacaagaagggaaggtgcttaacatcggtac

SEQ ID NO: 80731 - DNA, 617 bp, Oryza sativa
catgatttttcgtgcccaactttgatcgtccggcttatttaaaaaaattttgaaaaaaattaaaaacatatgtcatgcataaagtattatttataatttatcatctcataacaataaaaatactaattataaaaaaaatgtaaataagataagcatttaaagttggacacggaaactcctggtttcatttaaaatgagacggatggggtagatgctaaaaatggagttgttttgtgatggagagagtaagtatttagggggataggaattaagttggggatggattttaatccctaaggggatgtcccctcgtatatatttttcttccaaattccaaccaaatactttaaagaaaaccatttgaaaaaaaaaatgacgtcgatgtataatgggaaagggggtacacgcttggtccatccgtccatggagacgtacgtagggggacacgaagctagggcatcaccatcactggccagctgccagctgccagctgcatgcggcacatcctgaccaacatggcttggccttatatatttcccttgtgttttcctcatgtacacagtacattactagtcattaagccgtgaaacagtactttccattatttggcgtactgg

SEQ ID NO: 80732 - DNA, 637 bp, Oryza sativa
gaggtattccataggctcgtcctgtggatgtaattaaccagtagcctcattgctaggcgtcgggaatcaacggacttcacgcaatctccagtcagcataccttttcattaagcattcctcgcgaaggcaaaaggcgaactcctgcgggagccctcatgtatttgtaaacattcatgttaatgaatcataattaataaaatacagggtttccctattttctgtgtgttcgttgttttgttttcatcaaacagttttattccaaaattcatacacatatagaaagacaagccatgcttaaatgataaaataactcacagtaaaacagttaatatctatatagctagtcttctcataaattttaggcaaaatttgatacaatacacttaaattttgtgtaatttgctggtagaaatcttaaaaatgtgccacggaaaaaagacactctaaaacctaataatttgctagatggcacttttgtctcaattggagagatcaattcttcaaaaatacgagaatgcccctagagtcaaaagattttgagctagggctgtggagtaaaaatgtaatatgatgtatatatgctaatgacgtaattggggtgatggaaaatttagagttacataatttctaaaatttt

SEQ ID NO: 80733 - DNA, 1036 bp, Oryza sativa
tttcattagccaaatttaactgatttcaaggggggcttagtccaatatcacattaactatataaaatcttcagatctccatgatgcaaagatggagtacactttgacaatatagtgcaaccaagaaaccagaatgcaatgccaacttgcaagacaataaacatgcaatctgatgtagaaaacagaacagagaacagaaggaagaagacataattatataaaaaagacattattagaaaaaaaaaaaggtgtcaacttaataggccaattagcactttattcaattcaactggactgtgttctgtcagtccatagtaaatggatgcaagatcatttatgaaatgacagctaaatttgtggtcttacaacaagtagagattagtattatgctttatatgccctcaaatagaatcagccagtactctagtccaacaaaaaggcactaaattcccaaggtttgaagtcacatcaaagcctgaatcatcattatgcacgaagacaagaaacagaaagaactccgatttcaccaacccaatgaactctgtttcatgcaagaagaccacatcaaatgctatgctttcatactcaaaacgttcaatagccttgtatgccaacaaaatagtcttaaaagtgtcaaaattttatggcgcacgaaacacaatttccttgcaagatctatacatcaagagtatgacagcaatctcacacagataagtacagcttcaagattcacgctgataatgtaagaaaataaagtgcatctaaacagtgagtagacagccatcttattccaaacatgcataacaagattttatcacctcagcacacttctttgatagaggtgatatagcattatcatatattgccatctgtcatgcaagctgcagcaaataatgttttttctggaccaccccagatgacaaaaggaagaaaagataacatttttcctcacagctatgtggctatgtgcatggctacatctcattgcagaaggccaacaaaatctttgcaaatgggatgcagcttcccatcctttc

SEQ ID NO: 80734 - DNA, 3373 bp, Oryza sativa
tagttaactattgtatgaatagctattatattggctataaatgttttggagcgctattgtccttgctctgatggaactgaccgtgcgcacgtgtacggcgtagtatgggattagaggattaattatcgtaaaatctaaacggagaggcctctccgtttagcgctatcgcgcgacgcgcgtgacagccgtcgatccgcgcttggtgatgtggcgtccatccggcgcgctccgcgcgtcccgaccggccgaccgagcgagctcacgcgtcgccttttccgaccgaacgagcgagggtttactgttcaaatgttttgggtggcgctcgacgagagagagagaggcagagagtgagagagagagagacggaggtggcgtgaatctccggcgaaatccgtggcaaaggggggtgcggggagttgctgctgtttcctcccgtcgcgtcggcgttagcggagtcggcggagccgacggtttcctctcatcgcgccggcagttgcggtgggaagcgtaggctgcggcggaggtggttttctctcctccaaatccggctgccatttttttcggtaagttgtggcggtttcgttgtggtttttttgagccgaggaggtggagtgatggggctgtttttccgtgcgttttttgtgccggggaggtggagagatttgggcagtttttcactgcgcaaattgcttctcaaacctcccgttttgttctcccctattccctcatttcccctctctctccctcattcatcaggtgctagttcatcctctcggcgagcgcaaggttgcggtggaattcgccccctcaagcgtcggcttgtggatctcgggttccatttgaaggtatttaaatttctctctctctctagcttatgtagatttttctggttgcaagttgattactagtgattactaacatccaaaatgaatttccaaaattattactaacattattagttgcaagttgattattagttgatcgatggttagttgcaagttgattactaacatccaaaatgaatttccaaaattattactaacattgttagttgcaagttgattattagttgatcgatggttagttgcaagttgattactaacatccaaaatgaatttccaaaatgattactaacattattagttgcaagttgattattagttgatcgatggttagttgcaagttgattactaacatccaaaatgtatttccaggaatgggaaaaagaaaaaccattgtacagaaaggcatgttaggcaaaccagagccaagtgaaaaaacaatgggggtttcacaacgtgctaagaaaagaagtattggagatgatcatgcagatgacatagagcaacctcctccaaaaaggagcagatcaaaggtattaagcatccaccttttttatgcattttttgccctcaagcagtgtttcgctttttccaatgcactacatttttcttatgatgcattaagttacttctcactgtggattaagttacttctcactgtgcattaagttacttcttttaaaattcctatgagatttctaacaccagtactcatggctatgtaactagggaatgcaaattcaagtttatttttggaagtaacttgcatgtttctaggaagtaactttttgagttttataacaagtaactttctgttcaaattgctctgagaggcaactagatggaatgtatcatgctgtgtaactagggaatgtaaattcaagtttatctggaagtaagttgcatgttcataggaagtaacttactgttttgttagaagtaacttcctgttaaaattactttgaaattttctgttaacaagtaagaagttacttctcgatgtgcctgaagttacttctctctttgcattaagttacttctctatgtgcattaagttacttctcaccgtgcctaaaatatttttgatgctgctgcttgagggcaagttattttctagaactaacttaatggcaagttacttcttggttcagttacccttttttcaactgttttatatatgtttttgaaaaaataaacaaatgctgatgttttttttatttttctttttgttgttttatacatttgcagtaagaaagtagcagggcttcacctatgaaacttataaagttgtatccccatatgagtggcgaacaaaagcgactaatagagggggctggcttccatggcctcgtagatctcaagtgctcgaagctcagacctgatttgtgcagctggttgatggagcatttcaatccagcaaccaattagcttgtattccctggacgtggagccatagatgcgaacgaggagtcagtgaagtctgtgcttggtatcccaatgggcgacaaagatgtctcataggagatggaatctgaagctacagaatttatgctgaatttgcttggaatcaacgatggtatctcaccatcactgacttctcttgggattcaattggagaagttgaagttagcagatgacaagcacctgcgtatgtggatcatctacgccatttcttctgttttagcaccaacgacagcaacaacagtcagcccaagatgctatccttctgttgttgatgctggaaatatcaagaatcttaattggtgcaagtttgtcatatctattttgcaaaaagctactaaagctgggaagactaccaactcagcatgtctcctgtatatgatggtaacaatgctcgcctttttttattcgatcactgtcccaatgtaacttttatgttttttagaagtaagttaagttgtccaggaagtaactaacatgttcctaggaagtaacttctttctgttaaattgttataaataattttctgtcaagtaaattctctctgtgcattaagttacttctcactgtgtattaagctacttcttactgtgcattaagttacttcttcatatatgccctgccacatctttttttccaatttatttttaaatttaaattacatctggaagttaacatattttgtaggttttaaatcaaacaagttatgtactttttttaattaatctaaatgctctaatttcttttgtagattctttatttggactcgctttcgtttaaaaatctcaatgttccagtggagggttatcgagctactgtttggacgaatgaattgataaatcaagcaatattagcagacacatcagcagacggctcctttggagctttaccagtgagtttttttatagttggcatacttgcatcatttttagttttttgtttgttcgtaacttatggattttataattgaaaatatagcttaggagcagttttcagcatgaagggaccaatttgtttgggagcaatgtagatttttcaaccttcataaattcaaatgtgcccaatagtat

SEQ ID NO: 80735 - DNA, 9047 bp, Oryza sativa
attagttgaaagaaaaccaggagctaattatacaaagcaccaggttattagcttctaataatctaattaagtgagagtacaccactggtgagttgtgacacgcaccttgatcgaaaccctcctccactacactcgccggatggttggtgcagacagcagcaacccaaccgctcgtctgatctgccttctgcttaccttccttccctctcacgcgacagagagcaatctaccatgtttgctactgcaaatttcagagaagacgacactgaccagatgctaagagctactaactcttttgttagtgtgccaacctctgcaatgtggtcatcaatcaaagcatgtatatgtgtgtaccatctttgcaaaaaggattccaaaatcaaaatgcctagcatgtaggtccaacgactatgtgcggttttgatgttttgggttagtgctggtgttcttggatttggactgttgatggttctttaattttgacagttcaggagaggacactgaagaacatccagttggatgttggcaagctaattaatcagaaggttcttgtaattgttcctccaccaaattgtctggtttgtggttatatgctttacacattgaattagagctttttttttgtaatggtgattgtattccattttagagttttacacatggatattcactaattattctacccaaatgttgcagtgtggttacaacttacaacttaatttggtcattgacttatattggagattggagttaatcaatatacatgactctacccgtcaggataaaatattaccgtcaatattaatttacgtacatatttttgaaagacttttaattgtcgcactaataaatttatgtctcaagtctgtttgagagtgtggtaatgaaaaaaaaaagaaaagaaaaagagtcagctagctatgtgtacatgactctcaatattataatctcttctccgttagcttaatgaacaagatttagccagtgatgctcatgtccttcagacacatctaatcatgtcgttatgacgtcacacgctcgctttaaaaagcaggcatgctgttccgttagatgacacatatctttccttgcttttatatttttcctcttcttattttccccctcattcctgatgatagtcactctccaaaatggtttgcgagccacttttcatgggacgtcatctccacaaagctacgcaaatttagtacagaagtatactgttttctcaccttacgattaatcacctaattcagaaaaagattttctcaacccctatagatttttgtttaagatagtagataatccgaccttacttcaaaagaagctatatccacttattacaaaattgttgaataaaccaaaagcgatcttttgtatgaagtaattatgtacttgcttaattttgccacgtatatatataggtctatatataaagtttgacaatgtctagctagctaattggtttgaaatatactctgttagaaaaaaaacactgtgtagacatggaaaattcaaaatatgactgtcacattgctcaaagtatcacatcaattcctactgccctaacaacctaacaagtggaacaattacccctaaccatgtaggattagtggaccaaatcaatcaatagagaatatttatcaaatcagcttattggcaacaagatatggtccacaatgcatcaaaggaccagcattttctccttgtccagatggaggaaccctacatttgcaactaaacaagctgcaggagggaataattcccccaaaaagatgatccctagctagttgaagccagtgcaatgaaaaagacacccttttctttggcattttttttctcaagccatggtaaagctaagctagatacctcattgtcaaaagggaatcaagaaagaaagtttggtaattatttggtatatatatatatatatatatatatatatatatatataactcactttaaagatatatctttgtcctctttatatggtgggaaatgaagaggaaaaaagccttgttcatactggtatttcaaaatcaaactacaagactagttctcactggaaaactagtttgtggcatatggctaggcacaaaattgtgcatatggtctacccagttcaagtcgtatactagacattgttgtacatatcaaccaattttagaagaacatatacgtatgcacatttaatgcgagtgcgtatgctgtatgcatacccacaatgagagagtgtaattacgttgtacttcccaactgtactttctaaaaaaataccggttcacattgatttagggcacaaattcaagagaatttaatggtgtattagcacaattgaaaagatccatacctgaaaacaaaaatggttaaactgcaatggaatttattaaatttcccaaataaactagtgtgcggttttccttttactcatttacttatgaaacaaaatttacagctatttctagaacaactgtcagatgccatccctgaatgttcagagctatcttgatcactcgagagaatcaggcggctaacattgacaaacaacctaattatatatatttgatttgccaacaccagaacctataaaactatttgagtcaaatcttcatgtacccaagatatatataaaaccaaagaaggattatcttcagaagtatatcatatcatccacaaaactattggagcaggcatacattttattttcttttgcagacttgtacataatctgtgacatttacactaaggccgagtttagttccaaattttttcttcaaacttccaacttttatatcacatcaaaattttcctacacataaactttcaacttttccgtcacatcgttgcaatttcaaccaaactttaaattttagcgttaactaaacccaccctaacgttggttacttgggcgtgcatgcgtggacggcatttagcctaggccctttttaaagggagtccaaagggaggtgcaacagagtcgttgcaccgactgttctgaattcaatgtaacccgaaatgggcagcctaacggccaaacaaattaagaatttttgttcatttcgccctttaggatagtactatacaatagtaacaatggcctccgatccttccgttctggagttccctttcctatgttgagcgcgctattccagcgaaatctactataagaactaattaaagccacgttctaaaatgtggtttaaaacaaatgattagtcgcacgtaaaatgtgaaaagcgataagtataggattgattgagtattacttattgaaaactataaaaatggatttgttttatttttaatgcaacttcatttctacataaaacacaacgtttattagttaaacgataagggtaacagtacttgtgtacacaaatgcaatactttctgaaacttggagaaaattttacccggaataaatcctccgtccacaaccgtggcagtctggctcgatgacttgatctctacctctccttttcctcgtgacacgcatatagcgcgaggaagccatgctggctaccggcttaggccctatttagttcctaatacaaaaattttcacacttacatcgaatgtttggatacatacattgagtattaaatgaagataaaaaaccaattacacagattacatgtaaattgcgatacggatcttttaagcctaattgtgccatgatttgataatgtggtgctacagtaaacatttgctaatgacggattaattaggcttaataaattcgtctcgcggtttcctggcggaatctgtaatttattttgttattagactacgtttaatattttaaatgtgtgttcgtatattcgatgtgatagccaaacccaaaaattttcccgagctaaactagccacatagtcgcgtcgacttttgatcccgtttaagaacttttctaaatggtcttagtttaggtaagtttttaagaaggttttgatataataagttaatttttttatacagaattgatttccctagctaactgtatatttaactaagttgtactatatgctggttataagagaaatcactagaaggctcatgtttcttctctctttatcccctctcttttttatcgaataaaatttaaatatatacttttatttttaacgttttgcatttatatacatgtatggagaagaattgcgaaaatatacctctatgacagaatggagatgcgggacggaggtagcgccgctagctctgcgcagcgtccgcgcggcaccgtcgctcccgcggaacgtccgcgcggaaccgcacggaatgcctcgctcccgtgcgccacatacgcgcgaccggcgtggcaaagcaagcagcacttgcagcgcatgcattcagcgaaagcaacgcatgcattccttcgctcgatcggtcccgcactgctcttctgcatgaccgccggttccgcggaatggtggtgcgggaccgagatggtttcgcgtatcccctatgcagtagatgtatatttgttcaaaatttcatcgcattggtatataaacgcaaaacgctaaaaattaagaatttttgttcatttcgccctttaggatagtactatacaacagtaacaatggcctccgatccttccgttctggagttccctttcctatgttgagcgcgctattccagcgaaatctactataagaactaattaaagccacgttctaaaatgtggtttaaaacaaatgattagtcgcacgtaaaatgtgaaaagcgataagtataggattgattgagtattacttattgaaaactataaaaatggatttgttttatttttaatgcaacttcatttctacataaaacacaacgtttattagtttaaaaagtatgctaacgaaaattgaggaaaaagccaagttaaaactgagtttagaatgctcatgatcgaaaccaatgagttctaatgtgcaaatatagttttggcatatatttttctcacggtcgagctctatcatgcattttagaaatttttatgatggtagtatagaatgatggtgacttttatgatattggagtagtacagaactatgctatgaaaatatttgtggcagttttaatagaattttagtgatattagaaatttattgttgacgttgtcactttgaccatgtgttaagatggatattcacgagtgtttgcgtatacgtcttctgtataattcatttccaacaaaatggcagaaagttggtcctgatcaaatcactattttttgttggcactatgcaaaagtatccctttcataagccgaccagcaagcttgtactcaaaataaatattgacctgtaaatttaattgcttttccatcattaagccatatagtattaatctgtcctgtttagatgggactaaaacttttaaaacttttaagtccctatcacatcgaatgtttagacactaattataaatataaacgtaaactattaataaaacccatccataatcttttactaattcgcgagatgaatctattgagtctaattaattcacgattagtctatgtggtttctcaaaaaaaaagtctatgtgatgctacagtaaacattctctaattatagattaattaggcttaaaaaatttgtctcgcaaattagctttcatttatgtaattagttttgtacgtagtctatatttaatactctaaattagtgtctaaatatagagactaaagttaagtccctggatccaaacaccaccttaactacacctaggagtgcttgtagttgtagttgtagtcatctactcgctccattataaaatataacaacctaacataccaaaattagacacaacttaggttgtgttcgatacatagggtttggaacacatctccttcgcacggaaaacagaacagtttattaacgtgtgattaattaagtattagctatttttttataaatggattaatttgaatttttaagcaactttcacatagaaattttttttgcaaaaaagtaccgtttagcagtttgaaaagcgtgcgcgtggaaaacgagagatagggattgggaacacactgaaacgaacgcagccttagtactataaatataaacaaaaatctatctatattggagtatattatgttgctataatctgacacgggaagtagtatttgtagcgtactgtactcgatcccgtacattctcccacttcaactcgtacgtgtattctttttctaaaagaaaatgtatggtatggataacctcctctctagtctctaccgctcaactgaatgtacgtagacggtccccgttccagattggctagcgcatagtactgacctactcctagcactactgatgagtgtcaaactagggtggggcccactgccaccgctggcgtcatgctgacgccagcacatcaagctccccgcgaacccgatcgaaacgcgctcgtacgtgtaaacagtttgacgatcgatcgatcaaataaaaataaaataaaaaaaaaaaaacaacccatgcatcgatctcgtggccgccgaccaccgtggccgtggggacgcagcgaacaacgtaccgtgtctcaccggcgccgcctccgccttttttttttcttttcttggtcacgaacaggacaaagctcactagtcactaccagggtttacgaatgcatgttttgttttacgtgctgcagaggagaggttcctaaccctggcctcctctccaacacaacctaagatgcagactctacgctgattttcattagctcgtttttcaaactgttcaacggtacttcctccgtttcataatgtgagattttctagcattgcccatattatatttctagattcattaacatctatataaatgtggataatgttagaaagtcttacattataaaacggataaatacgttttatatgagaactttcgatataaaagttgctttgcgttcgtttggagaacagagagtttgtttgtttcgttttccgcgcacacgctttccaaactactaaacggtgtgtttttttaaaaaaaaaatttctatatgaaatttgctttaaaaaaatatattaatctatttttaaagtttaaaatagataatactcaattaatcatacactaatggctcacctcgttttgtttatcttctcaatcccctctccctcaaacacagataaatcattttcttaaatctaaaataactaaaactcaattaatcatatgctaatagttttctcgtgtctatccatatttaatatttatcttaagtgaattcaaccgtgtcagtttaatgtggtccgcggaatgtggctgcctcgggagtcatgacacggcaactcggcgaacaagtgatgtgattcggttatgcatggtttgttggggcgagatggtgaccgtagtgtgtcttctagtatagtacagctactgtgtacttgtatagcatactacttggatactactcgtccatccatgaactgaatggaagactgatgtggattgtagtagcacatttatttgcttcgatcgcgctggttgttcttgtgataatacgctaacttggatgcatgttttgtatgcgagatttctcgatacaagagaaaggctgtgtttagatttatgggcgaaaatttctgccgtgtcacatcggatatatggacacacgtttgaagtattaaacgtagtctaataacaaaataaattacagaatccgcctataaactgtgagatgaatttattaagcctaattaattcatcattagcatatgtttactgtagcaccatattgttaaattatggagcaattaggcttaaaatattcgtctcaacaattagtcacaatttgtgcaattagttataattttatcctatatttaatacttcatgcaggtattcaagcgttagatgtgacatggtgaaaaattttagggtgggatataaacaggaccaaagagtagttccgatgaaggaaaaaaaagtcaaagatagatggttctccaaatgttttgtggtctgttcctatcataaattgtttcaaatgaacctttgccaagcccaaggaaacatagttggttggcatgaaatagatcaaattaaaggcatatggtatgttaaggcacctagcagattcgatacaatggaggaatgtcgataggatataccctgatttcatagatgacacgagaaacacgaggctttgtttgtgtacagatgacatgcatgaatcattttagagatatgagcaacaatcatagcatctggccagttcttatcgcaaactataacctaacaccatttttcaaattgtatttggattaataggttgtgatggctctcttttaaaagatgcatgggcgtggtttgataaattcttgatgcttgcaaaaactgatgttctattggatatgagaattgatggaaatatgtgaggcatactactatgagacttgcaaataattgataattaggattcatgtgattgtgaaatgtatgtgaatggatgtatgtatatataagtatgaggattcaggaaatatatctctgtttctgtcgatttacagcgagcatggctagctatttcctatggctaaccaataaaacaaatttgttatttttgttaaaatcttactgatggcggggttacaacatatcaccgccacgacgagtcatccgtgacgggctttactctactcgctctttgaaccatattggtggcgggttgttgttataacccgtttaagatgtcttacatcggtgatagcagttcgttcgacacagataagttttgcatatcactgattcatgactagaatatcagcaaacaaagataagggtaacagtacttgtgtacacaaatgcaatactttctgaaacttggagaaaattttacccggaataaatcctccgtccacaaccgtggcagtctggctcgatgacttgatctctacctctccttttcctcgtgacacgcatatagcgcgaggaagccatgctggctaccggcttaggccctatttagttcctaatacaaaaattttcacacttacatcgaatgtttggatacatgcattgagtattaaatgaagataaaaaatc

SEQ ID NO: 80736 - DNA, 4450 bp, Oryza sativa
cttacgggcctacggcgagacgatgatgcggcagaccggcagtggcggtgatacggcgatgcgacgacgccggcgaagaggaggcggctgttggccgacgcgacgacgccgacgaagaggcggcggctgtggcgaaggggcgaggcggcggcggcggcggcaaagaggtgaggtggcggaggcggcggcgaaggggtgaggacgcggcggcgaaggggtgaggcggcggcggcggccgccggccgggatgcgtgggggtcgggggaaatcggggaatgggagtagtcggctggctcggctgcctgttgcctgttggttgttgctagctagctaggatttgcataacacaatagtacagtacacacgtagttgggctgggttgggctctttgggctgattctgatgaatggttgatgaaggactccggatatccgggaaaaatttctggatagtttccgaccgttttccgtttccgtcgaatatcacccttactgtatttattttcgtatccgagaaaaaaatccgtattcgtttccgaatccgaaaatttccggatagttccgaccgaattttgccgtatccaaaaattggtccgaacggaaggaaactatccgaaccagtttcatccctaggcacaagtaaccacatctagctatgttctcaagggatcatcatctgaaaatttaacgtttgtgtaaatatatgtagcatatgacaatactccttattttgaaaatatgtaaatgcctaacaatacataaaacactaaattcaattaatggcattgtaaatttgccgtattagaaaaaggcaattactattcgtgaaaccttgtgggtgccactgaaactttctaagatttgaaccacggcattgccaccgagtttcctgtcatcttctcccccaaatcctgttccatctagatccagggaagaagccgtgaaaggcgaggaaagcggtgacgtgctcgccttcgccatgtcgaaccgctcgacgacgccggtgagctgttctctagtcaggaaacggtcggcgtggctcctctgttgacggcggagggcggcagcgacgtggacgagaaggtgtcgtgactgcctctcatgagggtggttggccgcccaggggcgcaacatctcacaatctcgctgctgatcttccaaactagcggcccttggacaccagcacacgaggcaagatgcagccgcgagctcctatagacttcatcgggacgtcatcgctcggcggcaacgcaactagctgatcacaggggtctgctgttgtccttcgccctgcggcatctgcgtggactgcttcctgtaggatcgaatcacaagaactaagccaaccagaagggggtgaatggttggtatacccaaaaaccgaaaacttttagtggaaataaaagttacccttaaagtcgatggagatcggtctgaccaaagttgtcttgccggtctgaccgctcggatgccgtcggtctgaccgcccgtatatcgccggtcttatcgccgcttgctgccggtctgaccgccggtagatcgccggttagaccgccaaaacccggtgaaacacaaatcgaagaactctaaaagtggatgacgactttattgattctctctgtgtttacaaagtgcaccaacagcactccttacaaaatattcgactaaactcgaaaccctaactcaaaactcaactcaattgctctctaaagcgataccgggaagcctcacgctccccctctatttatacatgaggtcggtagcctaatgccacgaaccaaactcatactaagagttctaaacaccttaggaaaccctctagtacaagaaaaaaaactttacataaccaatcgtaccaaattcggactccttccaaattcgactccgcatcccatacgcacacaatacctccatcgtatgccatatggaatctccatcaaccacgtgcatcaactctagccttagtatcccgcatgatctctgaccaccacggacgtcgtcttatccccaagctgattccaggtccatcactgcgaatactctcccgagacatcgagtcacctacacatgaaataaacaaagaaatcatattccgagaccaagctatctccaacttgattcattagtagcaaacaaccgtattacatacgtttagtatccatctagaagtcataataatgaaataatcacggatattgtaacggacccaaaatttcaggggaatttttttgcgaaatgttttaagtcatgctcttctcgattcttgcattggagtgatcttgcttctaatctttcctttgattttggacttaaactttatttgcaaagttaatagctcccttttaaattctataaaacatttccatttgttttctgtaatatctaactttggctctaaattatatttcctttgaatctattcccgaacacctccaacaaataccctttcaattcccgctcaaccatctctagagcacatgaaatatcaatctctctagagttaatacctttttatttagagtttaccacactaccaccaaatctagttttatcttccacacatatttcccctttgaaatatcgtttatctaaattatccattcgagatttcaaagtttattatttagcttgggccaatacttccccgattgacccgactctctgttatatcccattaaccatttttatctttggactaaaccagtataactccctttttgttggaatttattttggatcacacctctatctaaacctatccccaaaaacctttatttcctctacatcgatccaaaacattcaagggtcaagttcctattttgatcaagccgcctgtttgattcctatggcttgatttcctcctcggcacaagaactatactatcacaaataattgagtgattgctcttgtgctaagaaacttatttccaatcccttctattcaaagtccaacttcgtttagccacaaatatttcatcgagaatccataccccatattttggaggctaaaatcctagttatttacctccatctatttttgacgtcatccaaaatttatccaaagttagaagatcaattatttgtgttccttttcctcccatttgattatttcaatcttacatttttaaatattaaagaaaatcttttgtgacaacttttatatttggttcttattgaattctataaaattggagaatctttatttttatccttttcaaaatttatatcttaaaataaatatctttgattttattttaaaaatatttcaaactccttttgctttaaaacccttattcaaaagacccccaaatatttctcttttaaatctattaaaaccctccattcaaattttcccttagttttcatctcctttgaaattccatttcaaatccctccacacaaaattcctaaaacccctattcattttgggccgaattcccttcaattaacccaatcagcacaagtctacatgtctccttcccccctcttgggctgtcagccgagccgagccgagccggcccaaatcggcccatggccgagccgctccctcctcctctgggtgcacttggcgcacgcacagggcgccgccttcgccgccgtctcgccacttcccgatgccgcccgccgttttgcgccgccgccgtcgtcttgccttcgacgcgaaggatccgtcaccaacgtcagctgcgacatcacgccgccgacgtcagccgccgaatcgaaccgccgaatcaacgaatagagctggcgccgtgctccacttctccacgccgccgtcgccgggttctccttattttcttcctccgcaaccgccttacgccaccgcctctcgccgcctataaaaggatgacgaggtcccctcttccccctcacataaaccgagctcctcaagctctctttctctctttctctcccatgtccggccattagtaccaccggccgatctccctcaccggagcttcgcaagccaaaccctcgcgccaccaactccgcctcgtcgaggtgattccacttttccctttcccgatcactccaccttgagataaaccgccaccaccacgttctcttatcggccggtctgagatcttgctaccgccgttccggccatctccctctctccctccgccttccaccactttccccgggtgcgcgttgctcggaaacaccatctcccaccggcgttcctacctcccggccaccagagagccggcacctcgctcgctctcccttctatttcctctcggctgccagagagaagaaaagaagaggtagaagaaacatatgacaagcgggccccaccttttataaagtaattccattttcttttatccagttccaatctttgagcatccatatctctccaaccattgatccaattagaaaaattctttgacctaaattcatctattttcaaaccctttattttgataccaaatttcctattttaaaatt

SEQ ID NO: 80737 - DNA, 664 bp, Oryza sativa
taaccactccaatatttagccgtcgtgctaccctaccctagcaccgactagaaaccaatccaccaaataaaccccacctatccaaaattatcctttcttcgattttaatcaatttccgacctatagaaactatcatctctcttttatccttcaaattaaaattaagtttattctatacacattcttttctcctctcgcctcgctctaattttatttactccttggtttttatcgtttctttgtagcaatttgcttataggctttatttgctatctttttcgtattcgtatgttagaccgtacagcaagttctatcggcatccaaggagctgacgtggacccaaatggctacgctgaagccgtgggaaatcttaaggcacaaggcaagacacaattaaaatttttaccacatgaaataatcaacccccatatttactttatgcataagttaatcatatgaataacatcattgtggtggcttaaaatgatatttaatgcttttaagcattgttatatgagattatggaaagatatactgaacatcattttatgtggtttattattcaaacatctttacaaacttaggaatccggttaaaatgggtatttttgaatgttatacatgatgaagtttgttggtgtggggagttcggaaagttttgggtg

SEQ ID NO: 80738 - DNA, 6089 bp, Oryza sativa
atttaggtgacactataggatactcaagcttttaacattgttgctatttttatgtaagacttttcgattggatgaggcaaggtgagtcggcacctacccactggatggttcagatagaaaagaagaaaatgaaatgaaatttccgatacatgagttgattcaactctgaaatcacattataatctcaaacgagaataattttatttctgatacaggctcttggggcatgggttgatgagttcatgaacacatatgacatcgaccattggaagaagcagtgcgaaaggcaggcacatggcatcgagtggatttatctcggctgagactttctcaggaactccgtagctccggtgctcacggtggatgttgcttggttcatcgcgtagagacatgtgaccgtcaacgagatgcgtgcagacattaaaagtgtctcctgatctcgacccctatcaatatctcaccttgcatcaaagatttccggtgtcttccaagcccaatatatatggataaaggtcatcgagcattagcttgcatgtcactgacaaaccatccgtagtgcgtgttttgtgacatgaagctgtaggggcgccaaaattatgtactgttcatctctctgccgttgtataagcattcctgttgaaaaaaaaaaaagagtgaggaggttgcacactagcataattaatttcagtgtagatcaacgacaggcagctccatggatatatattgccatccttcttaagtttttggatgagaaatataaatgaatgttattagacatcgcaattcctttgaacaaaaatgtaagagattaaactcatttttttatcaatccacttgattgctcaatttaggctagaatcagcccatacagattcaatttgtttttatttctaatttaccaaaaaacattccatgctcatcagaatgtattctcgatttgcaaaatttcaatatatttattgtttcaaaatttcgctgaaacaacttaaacaacggaagatcagaagcaattaccagtctaattaagatattggtggtaacgggtcccaaccaactggttctttaatgttacaatccaactcaatccttttgctcaacaatctctacaaacttaagcctgccctttttacacaacccttaaattttaaattttgtatgctaagaagttaggccaataactcaaccacccaactttaattttgacagaagaaatgctaacatgcatcttgttgacagaaataaaggaaaatattttgtcttttttcgaccagtccacttcagcacacagtcaaacgaggtcaacatacgggatttagaactgacgacaagaaattcttttagacagctcttaacttttactgcccgactttttagagaaagataaaatccgaccacacagagaaacatcttcctatccagaaaataggcaaacaaactcacacccagagaaacatactttacatgcagaaaaataaaccctctagtttctagatcattaggtagaactaggaaggtagcccgcgtgaatacgcgggtatgcgtcgtacattatgtctgagacacttataagagcgaaacatctaccatgatttctccataaattgttttcgtcgatatttaattttataattttctaacctattagctttatattatactccctccgtcccattttaagtgcaatacatgagtttttgtgtccaacttttattgtccgtcttattttcatttttttataattagaatttttattgttaagagatgataaaacattaataatactttatgcgtgacttatgcttttaaatttttttaaaatttttcaaataagacagacgatcaaagttaggcacggaaaatcatgactgcatttaaattgggacagagggagtattatatttaagtaatatttataagaaattatttataatcttcttcatcatttgaaaagaatgtatacttattttttttagaaaacatgtcaacgaaaagtaagtgtaaagtaaaattaagatatttttctttttttaattgcatatatattatcatggtttattcgaggatgaattgggtgagatatgaagctccactaaatatatgggtttatatagcttaatatgattgatgtagtttgaatgtcggtccatctatgaacatttcatgtagagtggataagaggttccacgcaagctaacgttaatacgataacgacgaaatataattgcacaataatacttctgaaatgtgacataccatgaatacacgcttgtgttttcttttataagattaatctaacggttagaaataacagttctaccggtttaaaaggtataggtgtactccaagaatgtagcttaaaaattatggttgtttaaatatccaacattattatgaagtgaacgtagctcaaccggttaggttccttgtgatggaacttgcccgagtctagacatgacaaattcttccagtggtaggcgacgtacctgtcgatagcgaggtgtacgtggtgacttcgtcaatctcaaaatatatcagcctagtctctcagaagtactcataggggtatttgtatgtgtgtgttcaaagatatgggtgcgcgcgcatgtgtttgtactttgtttaaaaaaatttcaaacattatttctcttttattttagtagatacaacaatagggaggggacgacagtgttatatacatgtgagggtgagggggaggtgaagattatatttttctattttttctaaatgatttatgtgaaagccaatgacaaggtgtttcatttttttatatgaatttttaaggttttctccattttttataggacgtgacacactgtgacttaagatttttttttaaaaaaatagatttaatcgttaaaaataatggacaagtcaatttaattgttttttcttataatttaattacaatatctaatctaatggtttattatagatctagtttacatgcatatacttctgtatatattatgtagtattatattttatctttttctatattatacaaaatcctattttagaccatagttttttccacgggtactacgtacgcaatttttttttgggctttatcattttttatcatacatagatgtctatttttttttcttccagctaacagtaggaagctttatttgttattttaattgcccagccaccgtttgcatatctttttttaggaaaagttatcaccattttaataataaatctaatctaatggtataaataaacgggtacaccaatttaagtgaaaatcgatggtgagattagatagtgccacatggcggcctaagagtatttgtaggaacgccacgtggcggtttaggagcgtttataggaagtttaattattcctagttcactatcggcaccctcaaagacgattgcatcggtaattagtaagttgagtactattatcaattctggcctccattgggccagtctcgactcaaccatatgtgatgaggacatcactttatcggatatgttcataacttcacacgttccaatgataattcctagtccaagtccagttcggccttcggagacagcactgactttaaacggacctagcgccttcatgccaacttcgatttgggtgatcttggacttcatggaaagcttatctcgctacctttcaaacgcatccggtctcatgtccaaattcatctcgagatgatggaaatcgccaaaacaaaacagtgctgttgctgaaaccgaacttgggccttgggctttgtaatagattagacccatctcggaagtgtctccctccacctccacgaattagcacttaaccctagctttattttcctctataaatagctttgtacatcctcaaaaacaattgggttttgtttagttgaattttgccaagtgacattcaccttgtctctagtcctcgttcgattagtcggcgactttagattcagagccctcaatagttggtgtcttgatttgccgggtcgattagatctaccacttcaatcgcaactattccttgtgcttaatcacctattcacaatatttagattgcatcttatcttgttcttgtagtgttttctcgtttacattgcagggatcatcaaccccgcgtcacggttagtacgacatcgtttgtggtgtagcaattgcacggcgtcctggacttgttttggttggtagccacgtcgcaaacgtcgcactcgatcaaagctagagttatcccctcacccaaaagatcgggccacgagagagagcgtcatcagttggtatcacagcttcagttgcctggtgaggattttagttttatagatttattatttttcctacccatcacccacaaaattgccgcaccactttttccatctccaaacattagttttgagccttgcaattttcattcaattttgctttattgagttttggtccgctgtcgtgtcggagtgctcactggtggagaaaccatctttcgtcgtacggctgatttccacaatagtcccggatgcaataaaaaccggggctaaagatgatctttagtcccggttcaaaagggtaacgggcatatttgatctttagtcccgattcgaatgctatcagggcatgtcaggcccccccgggaaagatcgtaactttagtcccagttggtattaccaaccggggctaaagatcctggtgatctttagccccggttggtgctaccaaccgggactaaagtcccacccctatatatatgtcttcttcctcctccagctgcccgagcaagcttcaaaatttcttcaaaaaagaggagaggtcatgccaaaatttttattgaatttattttggtgattacatacaaatcggaggtgcctaaaaggtttgcaacttcatcgtccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcatataattattgtatgactgtcattattgtaagaataattatttgtgtatggttttttttgactcatgtagatgaatcggcaatggatgtacgctgaccagcggtccaaagagtttattgacggcgtgcactattttttgagggtggccgaagctaacaggcaaaggggttttatttgttgtccatgcaataagtgtaagaatcagaaggagtattctgcatccaggactattcatttccacttgtttgagtcggggttcatgccaagctataattgttgggcatcccacggagagcaaggtgttgaaatagaagaagatgaagtggaagacgacaatattccggactttgctcagtatgttggatttgaagaaaatcaaacgggcgaggaggaaatagctgctgatggtaacgatgttgcggatgatcttggtcagatgttgcatgacgccaaggaggactgcgaaagtgaaaaggaggcccataaattggacaagatgttggagggccacggaacttcgttgtacctaggttgcgagcaggggcacaaaaagttggataccactctggagttcttgcaatggaaggcaaaatatggggttagtgacaaggcatttggcgatttattgaaactcgtcaagaacattcttccggggggaaacaaattgcccgagacaacgtacgaggctaagaagatagtctacccgttaggactggaagttcataagattcacgcatgtccgaatgattgtatcctatatcgcggtgaggagtatgagaacctagaagcatgccctgtttgcaaagcactacgatacaagattagacgagacgatctaggagaagttgacgggcagctaacaaagaagagaattcctgctgatgagctacttgc

SEQ ID NO: 80739 - DNA, 13148 bp, Oryza sativa
tccgccgccctctacgccctcctctccaccgccacctcgacctctccaccgccgccctcgccgccgccaaatccgccgccctctccgccctctccgccaccctctacgccctcctctccaccgccgcctcgacctctccaccaccgcctcgacctctccaccgccgacctctctgccgctcaccctctccgccgaccttcccgacgccggcctgcaccaccgccgccgcactcactctctcgaccgccgccatccatttccaccgccatctccaccgtcgccgtctcgacctctccgccgccatctccgccgccctctctgccgccatctccaccctctacaccgccctctccaccgccgcctcgacctctccaccgccctcctcgccaccgccctctccaccgctgccgcctcactcactctctcgaccgccgccgggacctcctcttagttgccacgccaggaccgtcgtcgccgccaccgggatatcctctccgccgcctcctcctctcgaccgggacctccacggtgagcccacgcccccccgcctcccctcgtttactattggtcactgattaaccccctcttctcctcctcagcgctgccgtgccgagaagccgtgcgccgtgcgctggccaggactcgtcgtcgccgtgcgccgcctcctctgctcgtcgtctcctctccaggtacccctctctctctctcatgccgatgaatggaatggtgcagttaatggatgaatgaatgatgcaatggaatggatgaacgaatgatgaactttggatgaatgatgaattttggggataattgtgctctttttgaattgaaaatgcatatgtataattgtgctctttttttgtcattccgttcagatttgttgcaactgttatttaaaacttaaatgtgtagctagtttgaaacttgaatgtggatactgctttataattgaaaatgcatatgtataattgtgcagtgtatactgctttatatgttgttttgttcccttttgctagaactattgaattttggggataatgtttacatttagctgaaaaatgatggattaatagattggcaacagtgtagttagataggttgggtagctagctagaaatagtttgtctagctagctagttaggggtaatgttcccttttcctataaataaagcatatacagggtttgaaatttagttcaaatggatgaattgatagattggccgtagatttaatgtagttccgaggttatcaaaccatcacagaatacaaaatgcatggggaattttggtggattggtcagtgtagtccatggacggaaccgacctagacaccaaaattctccatgcattttgttttctgtcattctttgataattaaggaactttattaggtttagggtttgaaatttagttcaaatgaaagaattgatagattggccgcagattaccagcacttgttgatttatatacccttgttgtctatgaataggtgaattgcatgaattgttgtttatatacatgatttatatagccttgctgtctatgaataggtgaattgcatgaattgttgtttatatacatgatttatatacccttgctgctgctgccacataaattattgtgggctgttttattatctacacttgcccctgcttgataaattaattgtgggctgtgatgaatgctcaagaacagaaatacctctaaacttaatctttaacttaatctttttttaatgcataagaacagattgtctacacttgttctttttttctgcataagaacagattatctacacttgttgatttatatacccttgttgtctatgaataggtgaattgcataaattgttgtttatatacatgatttatatacccttgctgttgctgccacataaattattgtgggctgttttattatctacacttgcccctgcttgataaattaattgtgggctgtttaagaaattattgccatgtgtatgataatttttttgatgccttgctgtctatgtttgcccatgctgctgcctatggttgccttatgttaaatggcgagtgatgaatgctcaagaacaaaaatacctctaaacttgatctttttttttaatgcataagaacagattatctacacttgttcctttttttatgtacacttgttcttttttgatgaactgctacccctgcgccccttattcattttttctgcatagattatctacacttgttctttttttaatgcataagaacaaattatctacacttgttctttttttctgcataagaacagattatctacacttgttctttttttctgcataagaatagattatctacacttgttctttttttatgcataagaagtgcccctgattgcctgattttgttgaattttgatgattgttataaactgaattgccatgtgtatgataattttttttgatgccttgctgtctatgtttgcccatcctgctgcctatggttgtctatgttaaatggctagtgatgaatgctcaagaacagaaatacctctaaacttgttctttttttaatgcataagaacagattatctacacttgttcttttttttatgtacacttgttcttttttttggattgataagaggagactatatacacttggttcttttttacactttactttgggttgctttttcctcctagcagctgatttcctcttttttttcctttcatgcaaatgatggtaattgatacataatttagtacaatggtaggaagtttataagctttttcgcgaaaattagaccatgacaacgcccggcgcaaacccgccctccccaacacctgcgaggatccaggaagaagcaaacccagccacggagacagttgccgaaggtcatcccttgacaacggcagtcgaaaaacccgacattcatggtaatttataggacaaattttcaccacatgaccacataaattttagctagcaccccttagcaaatgttgccttctgtttgtgcagcagaattgccgcaggaacaacatacatcgatgtcgggcgggacaagtgcaagtaggtcgagtagaaatccctggtcacaaaatatatggccgaccacagtgctagttataagagaggttgacgcaagtggtaggcccacggcgcccaggactgtcattggaagatggtctaactgctgcgggctagcggcacgtgaaaacttcgggatcctccataaagatatcggcaacgtcacagaagccgagaaagagcaagcttggatggcaatggagaaatggttcacaattccggctgaagcaaaggataggctcaagcggaaggcattccagaagttgggtaaagcttggaagaattggaagtcgaagctcttcaccgagtttgtcaacccgcccggcaatcatacgccgttcgatgaatagcctcaaataaccgaggcggtgtgggaggatttctactctctcaagaacacccaagagtttagggaatcaagcgaggcacatcgcctactgcaacagcggaatgagcacccacatcggcaaggaggcaatatgggcccaagaagatgcagccgctgcagcagcgaatgtccctgccccgttttcagacatccctgaacaaagagctcgcaactgggcgcgggcaaggggtaaggtcaatccagacagctctgtcacatttgagaacaaaagtgatgccgtcgtctatcaggaactggtgagttcactacttaacctaactaatttccattcgtacaaagtagaagtttgtataaacgactcctttttttctagttgggcttggttgctgaacaagcttcacaaagcgaggttgattccgcgccgaagaggcacgaagatgacatcctcacaaaggcgctcggaaccaacgaacatcttggccggactaggggaattggtagcgatgtgcactggaagcatggactcccacagtacagctcccaatacagcaaacggaaagtctccaaggaagagagggacgctcgtttgaaggccgaacttaaggttgaggtcattcaagaactagaagctagcatgaacgctagggtggaagaaagggttaacaaggtcctcgccgacatgaatataccccgaggcacaacacctgctgtgcatccaactcctcgtgcacaacacgacgcgagtctgtcacagtataggagtagttgtgcatccacagaggtgccggcccctggtctcccggtcgcaccactagctgcagtggaccacatagaggtaattgatgttatccaatccatatctaataaaaaaacatttacacgttccaatattaaattcagactttcacatatgcagggcgtagcacagtgtgtcctactggcgagggtccacccaactttcgctcccgaagtcgctgagggcatggctttcaagccctcggttacagacaaggtccacggcgcagacctgctagctgggtatgccaaggtgtccatcgatacagtaaaggacacctggtcaggctatccgctgcccgtgccccccaatgatgaaatcatgactttgggcaatgcgcgcaagacatttatacaatggcccaaagaagacatagttgtgaagatgactcctcatctaagtcgaccgacggagcttacacctcccaagtctaagctatcaattgaggctccccgtggaccggcattgtcagtacctcattctcctggtggagctgatatggacttggcagatatagctcaaagcttggctctaataaagaccacaacaaaggacgatagctccccaccacttgtcaaaggccagaagcgtgaacgcggcaaggggaaggtcggggagttgccgccggagccaaaaaggggcaagactgcgacgtcgatgccggtgagcaaagcggggaaggtcgtgagggcgccagcccaatttgagctaggcatgccattggtggaggacaatgtgttagccgtgatgggtattgtttgccgagagctacataagcaatacatggagctaagcaatgccaagcggaaaatgagggagtcatccatagttggacatcacgaccaccagccgttcctatcatcgcctgcctatataactataggctttgatgacctcttcgaccttttcaggatccggaagttggacactggtcttctaaaatgctactccttgtaagtgcataccttctatacctgtgatatgattggactatatctcctaattaaattagttctaatacgtaaatgttttaaggttgtgttggatcgagagtcgtcgccttggtaaacaggttgggttccttgatccatccatggtgaacgaggttaatttacgacagagtttcactaaggtggttgactatgtcaaccagtgtttatgggcccatcaagacaaggagtacatcatgtgcgcacacaaccaagagtaagaggacaatacccttcgtgtatattatttttgaagttaagattcttaggactaacgctacataaccactacgcaggcgacattggattctcctagtcatcgtacctaagtggactagggttacctaccttaactccaataagtccaaagattatgatttcactgaaatcaccaaggccttaaatatggcttggggcccatatgtggaaaagggtggtaggcacaaggagggcaaggacgaactttaccatgacaccaagttcgcatgcgcacaacagatcggaaaccaatgtggtttacacgtgtgccacaacatgtcaacacttctaagagaggtgaaagatttcaaccctgaggttgttgctaatggcgaataagctcatttcaataccaacattgctattcaaaacgtgctaacatcttatttattaaacagaaaggtagagctggcctcaagatctcacccatcaaccccccgctatgagaggcgaagtgtgcgccttcattctggtagaaataatgaacaagaaaggacgttttcacgtcaaatagactcatgaacttggctagataatttattgtgatgtaaaaaagatgttttcataatttcttgtgatgtaaaaaaatatgtttttatggagtgcaatgtaatttactttcatatgtgcaatatttatggtagtttactaaattgtcatcaaatttgatcaactactatctacattgtactattcatctattttctcctttttttttccttattgacaggttgtggaggtcgaggacattatggctttaatccatttggtaagtatatgtgcggttatatgagcaacgaccaaaattgtgactttcaaggggtgtgaatttgctgtgcaaaattgtggcatttgaacttcatatgtgaatgatgtcaatttttgatatggatctgtgttgttggggatctctgatgtttgagatggatctgtgatgttatattggggggtgactggaatatatccgtgatgtatcggtgtttgagagggcatggctagcaaatcctgaggctagccaatattcagcatttattttttttttggaattaactcatcagtgacgggtcagaacaaaaatccgtcaaaggtaacatcacctgtgacggactagcaaataaaggcccgtcagaggtgacctacctgtgacgggcctttacttttagggccgtcacaggtagatcgcctgtgacagcttctaactacggagaccatcacctctgacggcctttatttaaagggccgtcagagatgagtcacctttgacgggtcccaactcgccctaggcaagcggagaccaacaccatgagaatatatgacgaaataaagccatgtagtagatgacaaaaaatagatggatcctatctgactcaagcgtccatcaatttagcttttttctaacaattttttgagagcgatttgttttttagtagatggtttttttttcttgcgcggatttttaaaaccattttttttagaaatggcacgttttttctgatagttttttcctcgcatatttttttaaaaaaatattttaccgaccatggaaatatttttttctcgcgcatttttttatttttttattgaagatggaaaacctttttagcgtgttttttttgctttttttctgactttttcctcacacgtttttttgaaccgttttattttctcgtgcatagttagattagattagagatagagaagagatatataccgattagaaatcggattttgtttcaccagggaatgggacgaacttttttagatgtcttttcagatttttttttcgcctttataggaatcggactttttttccgtttttaaaggaatcagatctagtgtttttttcaccactttttttttttgccttttatatgaatcagatttttttcccgtttggatctactgtttttttgccacataggggaaaaagacttttgttgttattgtttttctttattttcttttttgtgtggcttttctttttctttttatgtacctttgtgtctttgttctctcttttattatttttttaataaaaacgacctcaagtaccttattgtaagattatagggactcaaatataaatataaaaattacaaggactcaaatgcaaaactacaaaccaaaaattaaaatcaaatgctctcaacctgtaagttccgttttttaaacagatcttcaatccggcacatcaatttttttcaccaatctagagtcggacttttttttgtttcttacagggaatcggatatacgagtcggacttttttattttattttttgagctatttttttacggacgtaggaagcatctctttttttattttttatatttatataagtagcagagaagatagagatagagaatcggagaggtttttttttaatttcttttgccctttttttaccgcgttaacggagttggattcgtttttcttttcccttattttcgccctttttctggatcagatggatttgatttttcttttctttttctggttttttttgcccggttttttttcggacatatttggtttttttcgcccttttttttccgttcggacagctttgggtttttttgccctcgttttgtttcgcctggttttttttgacggacgatgaaaacacctcttattttcatattttcgaagtagtagagatagagatatcatacatatgtataatttttttctttaaacacatatgtatatttatcatcaaatttctcctcctaatatttgtcagatgtaattacagtacaatcgtagtgtaattacactgtaacttacatataattacacctgggaataaatcctttcacatatgtgtgtgctgtgatttttttctttctcactagaacaaatcttataatagatctaacgattcaaaattacgtgaaacttacatacaagttacactgtagttacatgcaagttacagtgtacttacatacaagttactgtacttacactacgattgtactataattacatctgtcaaatttttagtacaaaatttatcgacaaatgtataggtggtcccatctttaccataattgatattgcagcacgtacacttctccctcctctctcccttcccgagaatgctatccagcgaacagtggcacgccctcctccccgcgcggcgcgacatgtgtcgcgcgcatagagggggcggcggacggcactgcgcggaggaactttttttccttttttttcagtttcgcttcttttttttgttttgttttttttctgtttttcttctcgccttcggtttcatttttttctgtttttttctttccgtatatttttcggttttaatacgtatgtatgtaaactttctatatgtacaaatgcaaactttttatacacgtatataaaatttgtatatacgtatagaatgtttgtatatgcatatacaaattttgtatatgtgtattttttgggttcttatacgtacgcatatcaattttgtacaaatacaaactttgtatacgcttatacaatgtttctataagcgtatacaaattttgtatacgtgtattttttggggttttatacgtacgtacaccaattttgtatacacgtatacaaagtttgtatgcacatttataaagtttgtatacgcatattttgttatacttacatatacaaattttatatacacatattttcaggtttttatacatacgcacacaaactttatatacatgtgtatattttttatacattaaaagtgtatacatataaaaaattatatatatacacacgtatgtatatagtgtatatatatatatatatataaactttgtatacacgtatacaaaatttatatgtatgtatatatggtagtatatgtataggagtatatatatagtagtagtatagactagaggggggcagctgatcgcgcgcgcggagcgctgcgcgactagtcgcccctcctccccttcttctcttcctactacattacaccacaaattttttttttagaaaaataaaaagttagaaaaatttatggatagaagtactatatataaaaaatttgaattcaaatttaaatttgaattggctatgtaaacttttgacttataaactttggatctgtataaactttagatgtatagaaatactatacatagaaaatatttgaattcaaattcaaatttaaatcggatataattcaaattcaaatttgaaacgggtatataaacttttgacttataaactttgggtctataaactttaggtgtataaactttagatgtatataaatactatatataaaaaatatttgaatccaaatttaaatcggatataattaaaattcaaatttgaaacaggtatataaacttttggcttataaactttgggtctataaacattaggtgtataaactttagatgtatagaaatactatatataaaaaatatttgaattcaaattcaaatttgaattggatatataaacttttgacttataaactttagatgtgtaaacttgaggtgtataaactttaggtacataaatttactaaaataggaaaataatgcggtgccaaaaaagaaactaggtggagggaggggggcgctacccgatcgctaccccatcgtcagggcgatcgatcgcccattagaggtttcgctttctttgatcaaacagatacgtaggtgtttcggtcttctgggcattttttttccaattaatgaaccaaagctgccaaggtaagtttcggctatactggtatttcatggcggtactggccgtcctgtgcaaacactagtaaaaaaacccctataggtaccggttgggaaccggagataggtgtcggtttcccagccggcaccaatgacgtcatagaagcgacacctttgtgctctcccgagttaaaaaaaaagaagccggctccaagccgagcagatggacatcaataatccccattcaagcatgattttacagatcacaaatcaaatcaagcagatgaatgataataatcccaattcaagcaatccctaatccagtccatcaccaatcacatatatgaacaaaacatcaacaacaaacaacaataattcccaggccagcaatcacagatgaagaacacaagcaaatgcacaaactcgcttgtcaatccaccaagtcacctctgggtccatctccacgcaaggtcgccgccgaggtcctctccgcacaaggtcgccgctagccgccggagagcgcacgaggttgcctcctgctgctgggtcccctctccgcgtgaggtcgccgctggccgccggccaccgaccgccaggtccctcttcatgctgacgtcgccgcacccatccctctctgtgctgaggtcaccgccggtggggaggttgtcacgccctgaagtttttcccttcttctttccttaaaacttgttaaataaatcgtccggagaaatggttcaaattaacctagagctaattccctaactaatgaatgcaattaataatcggaaatagcgtggtggaatttttcttgagttccccatgccctaatgcattaacaagatttttagtggaattttcataggccgcaatatttaatcccaggaatcctttttcctttttcttctttttattttcccttttttcccacttcttgggccgtcggcccagtccaccccgtcgcccgcgcgcgcccctctccttcttgggccggcccgcgccccttctctcctctttgggacgctgataggtggggcccaactgttaggtcgtccccaacctccagccacccgcgccccgcagcaaccgccgcccacgccggcgccccacctccccacgccgctgtcgtgtcccgccttatccgcgcccccactccgcccgcacctcgcgcccacatcgccgccccactcctccacctctcccgctctcgcgtgcgcgctcgcaaggggcggattcaattttgaatcctctctctctctccactctcccacgtctccggccacataggggccatccccggccacgtccgcctctcccgtgcctataaaatccttcccccgagcctcctctccccctttccgctctcgccaccctctcccgtgcctcctaccgagcccgcgtcgctcgccgctagcgccgccgcttgccgccgcctccagccgcgcaccaccaccgctaaagccgccgccgccgctagcttcaccgccgcgtgggtcatctcggccactgcctcacgttgccgaaaacccaccggaaccccatctccctcgcgagccggtgagctcttccatttccccgtcttcggccggcatccctgctcaccgtggactctttctccccctctaacctctctcttttactctcttagggtgtcccggagctcggccgtcgcccgccgtcatcctccggacactcgccgtcgccgttcgttgtcgccttctcccgcgctagcgaaaccccggtgaggccccccgcctcctcttttcccctttcctctccttcctcccgctgccgccgcacagccgcatgggccgtgcgccgccgcttccgcgccggtcgccgctgcctccctcgccgccgcttgccgtcgccggcgaccgctcgctgccgcctctccccatggccagccaaccggctttgtgccgagccgagccgagccctgccgccaatcacggcgtccgatcggcctcgggccgatccggaccgtcggtcccgtggaccgacggtggaccacccgcgtggtcccggtccacggtggaccagccgcctcatgccgctgacatgcggggcccgcctgctggcgcccccgcatccactgacgtcagccctggtcaatattgcgcaataaattgattaaggacttttctttattagtaaaaacacagattatcttctaaaattcatatctaattcatccgagctccgtttaagtccattcaagtctcagtaaattcataaaaatccctagaatccattaaaaatggttttgtttcctgtttcagtagtcttatagcatgttttgcttgtgtgctttgtttgtcgcgtagatttcggccgtttcgtcgatccgcggtttctcgaagacgttgctgtggtgagagcaaggcaagtcatgcattacaatcgatcatattgtacccaatttacaaatatcccatatttctattaaatgttgcattcttttacaatgtcatgtgggatgggtcctattactcagccatttattgtttaccttatgccattgataacttgggtatcaaaatgactagatgttggtttaagaaatgcttagccatgcttagttcaactagtataaaaatggggatcacattattacagagactttgactattagcatagctttggattggtgccatcgcaatggtgttagtcaattaaaatacactgaatggtgggctgtgggtgcatggttttgctggtcgcactcatggcaattaaggagtgggtaccacaagcgggagtgggtacctgcttgatctgaagtatagctcgaccctttcctaggcaccagtggcgaggatgggcgtgatggagttgggtcgaccggggtgtccagttgtccaactgccagattcatcgtggcgcaagaggggaccgcccactgccttttgaggggtgggggtgaaaccttagcgtggtgtggatggttaggggaggcctatgcggagggtctggtcacgatttccccctttg

SEQ ID NO: 80740 - DNA, 6379 bp, Oryza sativa
  unsure (1)..(6379): unsure at all n locations
gcctgtggagtggagtcgccccgctgcagaagtcaaccttccgagtttagctcgcttttatcttttccgctgcatttgtaatcttttatatttttgtaagacatggatatgtatgtcaacaattgtcgtttatgtacactggctggtcctggataggggtttaatgcatatccagcttggaaattctggttcgtgaatttctgggcgtgacacgcccgttgcgggtgacgtagcttgccggcttggagagggggtggagggggagggggaggagagggtggcggatcggaggaggaggagagtggggagggggccagaccgncagaggggagggggaggggagggcacggcggaggagggggccgcaggggacggcgggggagggggaggggagggcgcggctgaggagtgcggcagaagggctgagggggccgaggccgcagaggggagggcgcagataaggttaaggataaggatggagcgtgtgcgcgtggatagaccaggtcgatcggctcgactcgcccgggtcggctcgacttggtataggtgccctttttttacagaaccgacacctataatatattataggtgttggttctcttaaataaccgatacctatagtattggtaccagttttaactaatgaaccggcacctatactactttgtaaaggtgtcggttctttatttttttcatcttgtggatgtgggaaaagtcctataggtgtcgtgttttacatgaaccggaacctataaggctgatacctataaaggtttttgtagtagtgaaattctgtctgtgaaattataacaagggatttggggcaacaaaccaacagtgaaaatcatttttgctagcagcccacttaagtaacttgcaacaaacatcggtttttgctcgtggtaaggagcactgactatgggatgaaattccctatgttaaaatctcgcaccgatcttatcttctcctactttcacgatcttatctcctcccactctcacttggactctccctgtccttccccacctctcctcttcccttcccctaccctgtgcccccacgttctccctcacctcttgtcttccctccccaaccctgtggccccacctcacccctctctgacttctcttcacgtcagtgaccacggtggaccggtgacggcggcgacaacggtggactacgaggggcgtgggccgtggatcctcggccaggaggggcgcaggcgtggtggattcggccgccacagggccacgggtggtaaatcctatcgtcagagggccacggtaacgttgccctccctcccctcactctctcagatctgatggccaccctgatttcccctctccttcctctctgtgatccgatggcggcgaccttgcctccccccaccccccaatgcgacggcggcttcctgcagtctcgaggttcactcgaagacagcggacgcagcagcgacggcgatggcgacgggtggcagatccggtggtgcgatggttgtataccggctataccctccctctcccatatttggccgtagggagatggcggtggcagtagccgaggggttggcagagaatggaggatcctcaaatctccaacctccattcttgtggcatcctcaatctactggaatatatatttcactgaaaggcaaagttctgtcatatcatactcaactgtctctccttttctggtcaaaattcacgatggagatttggtctatagcttctgttacaacacttcaatagggtgaaaatgaatgaaaatgtgtgcggcccggtgacaggtagctgtcgatgggcggcgctaggccttgtgaccagtgggtgagcagctagttcggggagggcgctgagactcagttgggcgtgattgaatgcgtgggtcgatcggcgacaacgttggccggagatgcgaggtggtcagtggcagtgagtgatggagtaaaacctgatgattgtgatggctggaggcggcacacggtgggatctcgccaaagctgcttgccaagggatgtcgaggaggtcaacaaccggaacaaaatgacctggtggcttgctgggaggttgggggaggatggcaatgacgcgcgagggatgatgacgatggcgtgccatcgagaatttccctcaccaataaaaacaagaggatggggcatgtaaggttgagcctccgggacttgtagtttggagaggtgatttaggggcttccccatattgagggctctagtagggaccctgctggacctgtacttttgatatcaaccgtaaaagaatatttggggactatatttgaggatcccgctggagatgctcttacgaccctgaacactattatgatccacaccttgaatcatactccaccttgtaggatcgaacaatatgaagcaaacgaatcagaggggtgtgaattgttgtagtacccaaaaaccaaaccttccagaggaataaaaaattagatagcgatcggtgaattcgctctggtctgactgcccaccatgtcgttgttgcctctcgccgctgccaatctgactgccatattcccactggtctgaccgcgccggtgtcgtcggtctgaccaccggtgttccataaatcgaaaatctcccaaattagattgaatctttattacttctctatgtgtttacaaagtggaacaacaacactcctcacggaaatctcgactaaacacgaaactctaacttttctcacaacgcaactctctcaaaatcgataccgggaggccataccctcactctctttatacccatggtaggcatcctaaatccacgaaccaaccttgtacaagatgtcctaatcccctaggaaaccttcacgtacaagaaacggacattacaaactccaattgtactaaatttggactactccaaatttgactccacctctcatacgcacacaatatctccatcgtataccatatagaatcttcaccaaccatatgcattgatgtcaaagcttgactacttcaacatctctggcccgagagacagtgtgtgaagacctgatggaccgttggtgcctacagggactatacatgtgagaccatcgttatacagtaaaggggcggggaacggttaacggacactaatgtgtgaatggagagattgttgaatcgtcccccacattgattttggatggtcaagagacctaataagtgggggagcaccataattcattggctatcttttaggtgggaaaagctttttatgattctatagaacccagctgtaccgaacaacgcaatcaattcttatatacgtggcattccttactctacttatatatgacaagacaggaagaacaggatgtgaaggagataaagaaattcgatagaacatcaatgggttcttgccgtggtagctaggatgcaaatcctctacagtactgctgatgcagtagcagtggttgacatgtgggtccgggcccacatgtcagtgtctgctactgcatcactgtggtagctagggttgggagtaaccgggaaccatcttattacacacaaccatcttcctacaaaattctcagctgattatttgtcaggttagtaggcttcagtatgcacatctacccgtcacggttcattgattatattgatctcagaaggacggtacagcatagattagtggaaatttcaaaataggcacaattgcatccataccctcactttgaactctaactactgttttaccccccacattttagggtttgcatttttccctctctttttgaatatgaaccaattgtttaccctcatttttaacgtctagtttaatagtgttagttttagaacaaaaggacatttatacccttagttgatgttgcttttttgccccaacttttatactgcctgcttctcgtgccggaagccccgttgccgtctgcctcgccgcgccggaagccccacggccgcacaggccatcgccacgccggaagctccacaaccgtcgcctgccattgccgcgcaagtgagatggaagcctgcgactgccgcctacctcaccgcacaagggagagggaagtgtagccgccgctacaccggagacctgtcgtcgactcgcgctcaactgctgccgcggccatcgccgcatgcacttcctgacagaactgccgcgcacgctggaatcgacaccatcgcggcggttcccgccctcgccgcgcatgtcggaaccgccaccgtcgccgagcacaccgaagccgttgccggtcgccgcctcaacacaactgagctcagcgaaggaatgggcttgggtccttatccattcactcaagggtacaatagtaaattaaatcctttttctgtttcaatttgtatttttttaacccaaagccatgggtgtcatctaacgggtgtcaagagtgagggcaaacggcgtgttcgttttcaaaaagaggtggcaaaaatgcaaaccctaaaaagtaggggtaaaatagcagttgacattcaaaatgagggcatggatgcaattgccccttaaaaatataagtaaaaacacttcaagcaaagtcaaagtactctgctacttgctaaccgaggactatgtcacggtaatgattcgccatacattccacttgctcatgctttgctccaagcttgtgtttcattatagaatttacttatcatctgctcctccatttgcttccctctactccactaactattcaatttctttgttatatgatgttgtttagttacatgaccaggtgaagtgttttggggatggactgataaaagaatagctactaccccaattttttgttgctctgtcagtaatgtgtatgaagttcagtacatgcattcattcatcccattaaacatcagaatcaaacaaggcgcccattgaactcggctatacaattcttgaatgactgaaatgtttattagacgataaatttcctctgtaccataccatctgatctcctatgctctataaaagagcagatgaagtgtagtagcaacctgtttttcttggctgatgttgagagatatgaacaacaggagctcattgtgtttagccagtctactcactgcttagcttgctacgtacggtaggcctgggtggcattgggacatctcacataagccagcggtaagctgttgactgaccactctgcagttccagtctcaagcaagttacagactcagagtacatcaatggacatgtttggtgttcaagcctgaaccatttgatgttagcaaccggtttctccacaccttgcagagttttccagggttgtttggtacttgcttctcgagtggatctggtcatctcaacgtcgagaaacccatctccggtctactcagttgtcttgcctaggggaacatgaaccttgtaaacttggaacaactgatttgggtgaggcggtggctgaataaggttactttgtgatcattcgcacgagcacggcggagcagagcaagacactttgactgaaacggagaaggcagggttgggtttccttcgcaaaattccagcagtcgccgtcatcctcgaaacctctcgccgatgacactgtgacgctctccacgaacacatacgcttgcaagctaggcgacgcagccacacagcacggcctgtgccagcaacgatgtgtgataattaataagattactgttggagatcgtctaggtagcctcttctatctgataaactggtacctagcatctctactgacaaaataaaactgtcacaaacagaaacatcagcacattaatttggtctcaatttctctttttgcttcagtactacctagctaatagagaataataacagcattagcagtttgttaagcgttcaactcagctgtacagaactactggagaaagcgctcaattttcagaaaggatcctgcccttcttgccatacttataaaagacaacaccaagtattataggccgagggggagcgatgaagaagagtcgatggagattgattactctagtgtcttgcctattgtaggcttgggtgcagtcctattaccgataaccagcttcataccaaattctttgctgatcatgtctcaaatcagaaggcacaagtagggatgaaaacggatcggatacggtcggaaactacctttatcatattcgttttcatattttttctcggaatcgaaaccggaatcggaaacccggatacgaaaacggaatcgaatattatcgaatacagatacggagcgaatacgaatcgaaacgaatacggtaacgaatattaatcggaacataaaaccccctcaaactgaccttcacaaatcaataaagaaatataacttcttgttttttctaatagagcatgttacatttgcaaagatcaacaattaataatactataacgagaaacatccacaaacttgctgcaatg

SEQ ID NO: 80741 - DNA, 1858 bp, Oryza sativa
aaattagtacacgatagccacgagtatgtgtggggtaactaagaaacaatctatcggtagaacgtgcctcaaacttatccaaatttttagatttcaagataaagcacttgcaacaaaaacacgcaaatgtgaaactttgggttgatgtcaaaatcgatgttcataagaagtttttccaagtttagatctcaagaaaacccgatttgaaatataacaagcagtattaattgcctcagcccaaaattttctaggagttttatattcatccaacatcgttctagccatctcaaccaaaacacggtttttcctttcaacaacaccgttttgttgcggaacacgaggagaagaaaattcatgttcaagacctctttcgttgcaaaattgttcaaaaaaagcatttttaaactcaccaccattatcacttcgaattcttttcaaagaaccaggaaattcaagatccaatcgaagaaacaaaccacgaaagtgttgaaaagcttcgtccttagttgccataaagaaaacccaagaatatcgagaaaaatcgtcaacaataaccaacacatacccctttcctccaaccaaatggacttttacttgggccaccttggcccttgtgtataacctttcccgggccttcccgccttcacagaaacaataggagcatgtgaagaaacaaccatcacaggtgaaaccagattttcaaaatcagctttaaacactcttccatagcaagaaatattcaacactgaatcaccacaagaatcaaaaactttacttccagttttcttaaagtgaaactcaaaattttcatcaacaatttgtgaaaccgaaaacaaattgtactttaagtcttcacccaaagctacattcttcaattcaaatttctcatttaccttaaccaaacctgtagcgagaacggcacttgtagaaccatcaccaaagataatcgattcagtctttgatgccttcttgagtgaggagaaccaatttttatcaccggtcatgtgccgcgaacaaccggaatccacgattcacacgttctccttccttgccaccaaagcctacacacaagcagaagtcgaagcctcagtactggggttagatgataataaaaatttaggaatccagtactgagacacacgaccagaaatccaatacgcatatatccacgtgcaaaatcaattttagaattttcagaaaaattcctccgaggccgtctgaccgaggtacagtggccggtctgaccgggggccggtctgaccgccgctgtaccgccggtctgaccgatgcccggtctaaccgacactcagtagccggtctgaccgcgggacccactgcggtctgaccggtttcctcgagggaaaaccagatttttgccactttgattttgcaaaagcaatctctctctcctttttctgtttatgagttaatctgaaacaaaaaccaataatatgtccatcttttccaaaaaagaacaagtatatttttcacgatgattagacacattggtagtattagaagatttagcaacacaagcaacaacaggagattttgcatgcacaacattggattttgaagaagatgcactcaaggtagacatgataccagcagatttaaacacagttttgttagtatcaggtttaaccaaaatctcaccacttctagcaccaacacctaacacaacaagaggatgtctagaattatgagcataagggttaaaacctaaaccacgattatgtgtgctaacctttgattgatccaaaattatgttgaggttcttcttaccatcagaaaatcttagcaaagaatttttcaaataagacacctctttttccaaattagcacaattttcacaatc

SEQ ID NO: 80742 - DNA, 24585 bp, Oryza sativa
tcacaaagtacatgtgtgcaaaacaaaactataagcaagagaagatctatttttcaaatcatgtgcagcattaacatctctaatttttgaaatcttattcatgaaaacctcacaattttcgcaatcatcatcattaggaataagagattttaatctagcaatttcagatttaaaagattcaatgataaattcctgttttctatacatcttctcacacttctttttttttttcactcaagatattaatagcttcctcaaaagcacttacctcattatcttcatactctgtgtcagattcaccacacgccatgatgcaaacatcggagatgttctttcccttatcatcatctcgactttcaccatctacatcacttagtggctcgaaggtggcgcaaacttgttgaaaagccttcctgagattctccagcttcctcccttgggatgaacccttcggcttgttgttgttggtcttctcaccatctttgtcttctcttttgcctctcccaagcttaggacaatgcgaacgaagatgatcaattgaaccacattcaaagcaacgatttggaccacctcttttcctgttgctggcattattcatagctcgagcaattctgttagcaaccaaagccaaatccttctcctcgatctgttcgagttgatcatcggatgtggcaataaaaatagcaagaaaagaaggcttagatgaagaagcatcaacatccaaagaagaagaaaaagaaaccaaagcacttgacttagaatcaacttttcgagaaagaacattcatctcatgtgttttcaattttgtgtaaagcgaatccaaagtcaaagtagacatgttaacagactcctgaatagatgtaactttcatctcccaaatagacatatcaagaccattcaaaaagtgacgagaaatctcagattgtggataattagcatcataagaagaatcaacagatctaagatcaatcaaaattttattaaacctagaaagatagtcatccaaagcttctccaggtttcatctcaaatttaatgtactcctttttgaaaatatcacgatgaagttctttaatgttatttgttccttaatgaaaattactcaaagcattccaaatctcatgagcagttcgaaagtgcgcaacacgatcataatccgaacgataaataccactcaaaagaatgttgcgagctttacaattttgttcaaaagcagttttttcagcagcagtattaatagcttcaggaatcacataatgatgagaaacttttctccaaatattataatcttcagccataatgtaagattgcatcctactacaccaatgagaaaaatccattccatcgaaaacatgaggcttagttgaaaacctagcgggagtagccatggcaaaaactctagatcgataaaaatccaaagaagaaaacaaggctctgatatcacttgtaggatcgaatcacaagaactaagccaaccagaggggggggtgaatggttggtatacccaaaaaccgaaaacttttagcagaaataaaagttaccctcgaagtcgacggagatcggtctgaccgaagttgtcttaccgatctgaccgctcggatgccgtcggtccgaccgcccgtatgccgccggtctgaccgccgcttgctgccggtctgaccgtcgcttgctaccggtctaaccgctggtagatcgccggttagaccgccgaaacccggtgaaacacaaattgaaaaactctaaaagtggatgacgactttattgattctctctgtgtttacaaagtggaccaacagcactccttacaaaaattttgactaaactcgaaaccctaactcaaaactcaactcaattgctctctaaagcgataccgggaagcctcacgctccccctctatttatacatgagatagctagcctaaagccatgaaccaaactcatactaagagtcctaatcaccttaggaaaccctctagtacaataaagaaactttacataaccaatcgtaccaaatttagactccttccaaattcgactccgcatcccatacgcacacaatacctccatcgtatgccatatggaatctccatcaaccacgtgcatcaactctagccttagtatcccgcataatctctgaccaccacggacgtcgttttatcccgaagccgactcccggtccatcaccgcgaatactctcccgagacatcgagtcacctacacatgaaataaacaaagaaaccatattccgagaccaagctatctccaacttgactcattagtagcaaacaaccgtattacatacgtatagtatcaatctagaagtcataatcatgaaataatcacggatatccaaacaaacaacccgaaaccgaaaccgacacagcgccggccggtcagaccgcgggctggccgatccgaccgcgcgcataccgccggtctgaccggcatacacaacccagtctgaccggtcacataaaatgatagaatccagcgatcacctgtaaatccaatttatctccaaaaccacttcgtgaataaattccaaataacaaaccaataatctccgatgcccaattgttcatcacaaaataataatcaaaaacacctttgattttacacttccgggagcttactcgtgccaaagtagatggattcctctgtgtcgcgccacgccgccgtcgttgcgcccactgacttcaacaaccaggccgagtaggagcgcgggagcgggtcgactccgtcgtgtctgacgtgacgaaggggcttatccatgatgtcctcctccctcccggctccatcgacggctccatggtggtggtcgttctcgccagcgcggtctacttctcggattcatttgttctgttgtgtgaaggctccgattttttcatgcgatgctgctctgattttggggcgcggtttggtcttccatgcttattggtagcgctcggatttggatgctttcaaggacaacaagggactggcatggagccttccaatgacggcagatcatgctgttttaaaatttggatatatagtatgtcaatttggttaacggtgtggtctagtgaaattttaggaccatgatatctgtggttatgtggtatgtgcttaaacaaatgtgtttcgtgcaacatgaaacataatagattttgtgaaatttactattcggcttattttctcggtttataagcccatagcttaaccaaccaaacagcttccatcgatggtagcgatccaattctaaggtaagctaaaggatattttacttcaagagggttttcttacacagaacacccacttccagctcttgatttagatgtctcctgattgctcaacatataaaatataaaggacatgatcaagtagtacgtagtacagattgaggaagacatgaaaaagattacatggagattgttcgccctaatggcttgctattgacatagtagatagctcggcttgggaggcaccaggaactgttctactatcatgaagaaccagttgactagtacatttgatggtacgaactcttgaccatttgatgctagcaaacccgcttctgcatcttgcgtgcttcttcaggttacattaggtagagggtggtttgatgaggcgatctgatcagctaaatgtcgaaggcacaagctccatggcagcttgctagatctgttcgtaaagccatcgatagatcaaacgcaagcactacatatggtggtggtggtgtggagatgtgatgtgcgatagtgagattattcactagaagggatatcctcatctcaatcgggtggtaagcccccatctcaatcgggcacagcgtccgttacaggctagaagtcactgatgtgaagagttatctcaatcgggcaaacggccgtcacgaatgaatatatcttaatcgggccctaagtaaagcctgtcaccgatagctttgacccagacgaccagtcaaactgtagcccgtcacagatgacctatctctatcgggccacaactagcgcccgtcacagatgactactaacctttatcgggcctaaactagagcccatcacatatgatactcatctcaatcgggcctaaactatagcccgtcacagatgactgatgacctcaatcgggcctaaaatagagcccgtcacagatgactactcacctcaatcgggcctaaactagagcccgtcacagatgactactgacctcaatcgggccttcctgttcttcttcatcggtgggggttcatgaatcgccttgctgtcggcctccgtttggtcctccccaaaatccgtgtcgtactgcaactgcacatcgtaagattgtacatgacgatcttgagcaagaggggctaaaggagcagaggtgggtctctttggtggacgaccgcctggtgcagtggttggcctcgctgtaaccctgatctcaatgaggtccatgggccattggatgaaggtaccacgggcatttcctagtgagaggacctcgtcgttcggtggatacttcagagggaatagctcgtatcgggcttcaccgagtcgacttgaacttttgcatagtcggccctgagttgcgctccatgcactcttgtctctggggttggcttgtacgcaagtccctcggctgctggaaccgtgaaggtcgtcatcaccctaactgtgagggtgcagctcgttggttcctgcgatagattaatcaattttttttagaatattatatatcatatggattcgttaagtctttcatgtattgagtaagttcacggttaccgttatgtggtcgacggcgctgtcgaccgatgttggattttccaccaactcagttgatgcgcaactgctgcgtttttgggtgggacttcctaactctttgtgcgcagcagcagcggcggcctgggggttctgttgctctactcggatctcttgcctaatcttagccctcattgactcgagcttttcgtcgaatttagatgtcagctcagctcttatcgacgcccggattttggcttcaaggcgtgcatctttctccgccttgttggaagtccgcttcgtgtatgttccttgcaatcggagcatgccttctttctttttatagtttgtccggaaagattactgagtgcagggtagtcattaatggtgcagaacaatagaactcttagcttgaagttctcctgaccatatgcatcctaagtttccacaccttctttccaaagaatctccagatcgtcgataacaggctccaggaatacatcgatatcattgtcgggttgccttggaccttggattaacaagcacaacataatatatttccgtttaaagcataaccatggcgggaggttatagttcgcaataagaattggccaagtgctgtgagtactactcatgtcaccgaaaggattcatgccatccgtacacagacatattctcatgtttctagggtcggcagcaaagtctttgtgtttcgatcgatattcctccattcaatcgaatccgctgggtgtctaagcatattgtctttccttctctctgtggcgtgccaacgtactaacttcgctttgttcgggttggcaaagattctcttgaaacgatcaatgataggtagataccacacaacctttgccggaccacccctctttgacttatttccttcgtcagcacttttctttcgcttatatcgagaagccttgcagacaggacaagcatccaagtccgcatattgcttgtggtataatatgcagtcattgggacaagcgtgaattctacggacctctaaccccagtggacacagaacctgctttgcttcgtatgtcgtctcgggcaatgtgttctcaacaggaagcatagccttcaaaattcctaaaagatatgtgaaactcttgtctgtccatccactacttgccttcagcttcattaggtccaaggtaactgacaacttagtgtgttttgctttgcatccaacgtacagaggcgtctcggaatcacttaccaccctgctgaacttcattccatctctctcattctgggctgggtcctcaacgtcacgtaacatgtcttgcagcagatcatgatccacatcaaccatttcaccgcccaatggagaaggtataaatatgtcatgttcatcttcatcttcctgattatgcgcaccacttctgtctgctgctgccccacttcctgattcttgctctccatgcttcacccaacatgtatagccctccatgaatcctcgttgtatcagatgactgtgtatgtcctctccgctatcaaacatattctcattcttgcaatctgcacatggacaacacatataatcactgtttcttcttttccgatcctcctccgcggcgttcataaaatttattacaccctttctgtactccgtagaatgatgtttcaaattttttgcatacatccaacttcgatcaattgctacaaaataaaaaaaacaaattagaggcacatattgtaagatcagtattgcaaaagtaagacatgatgaaattgctcaattaatgaataatattactcacttgattgattcattttgatcacttttgggaatttaatttctgttttccttggaaaaaggacaaaaaatcgccccctacagcctcccaccaaaatagtgaacagtgggatacagttacactaggtggtggggggtatttatactgtgcaacaaatatctgtaacggccctaaaacaatcaaccgtgacgggcatacaagtaatctctatcgggccttaataaaagcccgtaaaaaaagagtgtcatctgtgacgggcattaaacttatctcaatcgggcctctagttggagcccatcacagatgaccctcatctgtgacgggcttcttttagggcccgattgagatatggaaccctcatctcaatcgggcctcaactatagcccgtcacggataagtgtcatccgtaacgggctttagttttatgccgatataccatggttgtgcggccatatcggcccgattgagattacttccttgtgacggcccgcaaattctagtcttgttatgggccgtcacagatgaaaggatctgtactagtgattggaaaatccgtcatagggactggcttataggtgccattttatttaaaaccagcacctattgatattttcctaccttcagcgggataaacaatagagaatcgacacctttgaacaactataggtcactactataaaaatcctcattgggaccggcttattggtgccggttcatttaaaactggcacatatagaacttttcccaactggggggaaatatagaaccggcacctttaaccatgctagagccagcacctataatataggtgccagttttttaaaagaactggcacctataatatattataggtgttggttctgtatcggttaattaaagaacggacaggaaccggttgtttttaaaaaccggcacctatagctttgagccaagccgacgagccgagaccatccatgcgtgcactgcgtaccgcacccaccgcgtccttatctactccatccccttctctctctcgcgcatatcgcgtctctctccccctctctctcgcagcggctgcctggcgtaggtagggtggtggcgggcgggctcccgcagccagtggcggaggcagggtggcgacgggctggctcccgcagccagtgtgggaggcagagtggcggtgggctcctctcctccgcctcccctccggcccccctgctccttcacattatcctccacgccctcccctccccctcccccttccaccacaaagatgggcagcgtccccatccccctccgctcccccgatgggcggcgtccgcacgggaggcgcgtggacaggcggtggatcctgtgcttctttggccggatctagcctcccatggccggctctggccggtgtggtctgtgcctggtgaaggggaggcggcaagctcccgcggccacgccctcccctccaccagatccggtggccggcctcccgcggccggctcctgtgggcgacggcgctggggtcggttcgagtgctgatctagggttggtgtgttttttttatctctttcatgttctctcgtttaatttgtctcatatgtgtaccgagaatgaattgttgttattgacgtgattttgattttggatgtggggatattgatgtgtaccgagaaggaattgttgttattgacgtgattttgattctggatgtggggatattgttctcgatctgaggatgtggaggggatcatgggatgtggggatggtttctggattcggctcgattcgagccggagtattttttggctcgtgcagacataaaaggtgccagctcaatttaacctatgggtgccggtaccatgtataagtgttgaccaattggtgtcggccggaaaaccggcacctattgccagttgccaaccggcgctaattgggctttctgtactagtgggtgctggttctaaattattagagtgccacgtggtgatttagcagtgtttgtaggagaccacgtggcagcataggagtgtttatagggtgtttcatcaacttttaagtatactaggaaggtagcccatgcattcgcacgggcatgcatcgtagactatgtttgagaacttataacgatgaaatattaatctgaaatttcattttatatatttagattatttgagcacatttagaaaaaaaattaagtaattggactattttctctaattaaaggaactcgatgttttatgcagtggctcagactattcatatttcagtttgttattttttttacaaagtgtacgtttaatttagctatacatgtttcaaaacatagcatggtgcgactctatgttgttgagttatttctttttcttttggcaaattaaatatgaaaattttattctggtactatttatttaatttatctatgcatgtttgtagaatttttcataatgacatattatttattgtcaaaattttaaggtatttagatgtggtgcaaagtgcatgggtggactgtgcccaaatgctataattcttatacagcaaaatatatgcatatataaatattacattgttagtttaattataaatagagaataattagatataaatcagacacgtatagcttataaaaaaattgtagttgtttcaacattggttgtttctcgtctagtttagtagctacaaaaataaggaatgggagggcactgttctctacatgtgagacggaggaggaggtggaaggattttagtgaaaaccgatgtgagatgtttcttttttctcagcatttcttttgttgtttctataacttgtaagacatgacacgtgttgtcttatgtttttttttctaaaaatagatgacatgtgtacttatggttcattcaaaaatagatctaattgatgaaaataatgaaatccatcgtgttaagttggatcgttttctattttttgagacatgatacgtggttacttacaagtgtaatatgggacatttaatcaaattttatcaagtagactgatttaatataacataatgcatatagtcaaccttttagaaatgtctcattcgtatttgctttccatgcaaaacataggtgccaatgttcaaatgatgtatttaaatttataataagaatatggataacatggtacttaaattatttatttagttataaataaaacaacaattgaaacaaactaaaaataagagaggatttgaagggagagaagcagagataatgtacgtatggagacgtcacttgaacacatacatgacgtgtgaagggatgggaagtgggtcttttccgtttttatattgttaagataccaatagaaaataataggtacaccatgtttaagttaaaataatcgatggttaggtgtatgatgtaatttctttagaatttctaggatttattgtacactattagagaaaccatctttggttagtcgcccaaaaaccataatagtcctagttcgaatagaaaccgggactaaaggttatttttagtcccggttaaaaactttttgatctttagtcccagttgatgttatcaatcgggactaaagatcatttttagtcccggttcaaagaagttattggttcgagttaggccccaattatcttagatcttcagttccggttctttataccaaccgggaccaaaaatcctcccgagcgcacgtcgagtcctctctatcggtcttatcgataagaccgataaaaaccatctgcacttcctctctcattaaaaaacatctccactctccagcctcctctgtctgatccccctctcctctccccttcctcccacttcccctctcctccccctccccgcctcctcctcctaccacggcctctctggtttagcggcggctggtcgaggtcggcggcagcggcggccggctggccgggctggggaggcgcgcacggcggccttcggaattgattttcttttttttgaggatttgtgatgattgtttttgagaatttgttatgtgattaaatgtggggaaaaaaaccaattacacagtttgcgtgtaaattgcgagacaaatcttttaagcctaattgtgccatgatttgacaatatgttaatactgtaaacatttgctaatgatgaattaattaggattaataaattcgtctcgcagtttcctggcggaatctataatttgttttgttattagacaacgtttaatacttcaaatgtgtgtccatatatccgatgtgacaccccaaaacaaaattttttgggaactaaaccaggccttagtagagttctttgtggaggttcagtattcttttatctttattaatttataatcggatgaattcatattgttttaatttacttaatactatcgttctaattttttcgtgatggttttttaaaatttgtgatgtaattttttttagaatttatgatgaatttgatctgtgatttggagatgatttggagatttctctattaggggatgtaatgattagtgaaatcaatttgaaaaaatacaattaaaaaaactgccaaccgccggttctggctctagcagttttagtctcggttagtaacaccaatcgggactaaaaattgattttttttgtcccggttatttcaccagggactaaagattcatactcccagttgcaaaactgggagtacagggggttacaaaccgggaggaaagaccatttctccaccagtgatagtatcacatggtggcttaggtgtgttcgtaggagtcccgcgtggtagtttgagagtattttgtaggaattttagttgacttttatcatataatggatagatatggcatgcaagttgtcgaaatgtgcctaatatatatctacatgtttctttagggaatatatttttacaagtaaaattatactggtgtaaactacatttttctgacattgtagaactattttagttacatgccagtgaagttattatatagcatgaacaatataataatgtcacttttttttcataatttttacaagctaaattatagttaagaggtgtattaaattataatttgtgattttagtcataataatgacacaaatagaacatgtaatttcatccgatagaaaaaaaaacttccttaaaagagaaacggagaggagttatgtaatgcgtatgcacgggaagaggggtgcctctttgtaagaaatagaaaaatcaatctaatccaagtatccaacggcttggagttatggtcctattaattttagtgaaatcaaaagctaggtttttcttctcagattttttctaatttattggaaagccacatggcaatataggagcatttatataagcatcatgtgacagcttagaagtatttataaaaaatttcacggacttaaatagatagatttgatatcatcgatataatttagcgaaacatatttgtgaaattatttaaggtgacgtataatatgccaattagagatgaggggagagagggagtacgtaagtacaggaggaggccaggaggggaatatacaggtagtggggaactgtgtggagaggaggattttatattttatttcatctagtggttaaaaatgttggacccatcaatttaaaggaaaatcaacggttagatttttagactgccacttgacgtcttaggagcgtttgtacgagaacacatggcagcttaggagcgtttctaggaagtttaatggacttttagtatataatagaatagatagaagatagatagatagatagatagaatagaaaaatgcccgtgtgttgcaacaggtaaatgctattttaattttattattgttatacggtttagctagggtaaaatttactgtagaaattcgattggatttattatttcaaaaaaatcatgagctacaataattaggtgtacaattaggtggcggcggctggagtctccgagagcgagtcgcgtggtggcggcgatgagggattggggatttgggggaatgaccgagtggacatccactagacttaacaattttggatccaatatttcttaaacgaagccagatcggtccaaaccaaaacttctaggcaccgaaccactccagcccaattgtggcagcagcccatttccccccatccagagctgctcgaattaaaggaccgaaccgtttggcccatttcgccgcaaacctctagcatgccccaaaccgtctggcgtgaggggaggcaacgggctcccgaggtcaggggcaagttttatagtggaggtgagtgccacatctaatttataccatatcatcttctcattaattaagaggtaacaagtacaacatattacctctagtacacaaaccccaatattagtttactctcacatcatcttatatttttcttggagattgtgtggaggttaccccttgtatgagaggtggctcattctctctctcctaacttctctcctccaactcatcacctaatcctatatgataaatttaggggcaacatgaaggagcttatagtacttgccctcagcggcttgccagcggaggcgacgccccttgcctcttctccctctcccctggctctcctcctctccgccgcggtgtggacggctagatcgacgacgcgacgacggggagaccggtgattcttatcttttttgctgagtttggacgttttttttgtgatactgtagagtaggtccgggagatgtcaggttcgccagtggtctgattttgcctgaccattctgcttagcatgtttcataccgcagtggacatgtttgacataggcgcaacacatgaccgtttgatgctagcaaccagtttctacattttgctttctcgagtggatctgatcttctaccctataattcaccaactgatgtttacatcctcattcctcattgaacggttaggattctctcgctcgaatccaacgtcccaaatcgctcccaccatctcctcacacggtcacaccgcttcgtcacctcaccctagtctcccgtcattcacgcccccaaatcgcgcccctcgatcgaaatcactgcttcccatccgtttcctcacgcacaatctggcgctccctctctcccggagcacagccgtcgtctcaactcgccactggggtcatcgccttcgccttgcctcgcctcctccaatctcctcaccaccgaaaccctcttgcgccgcaaccggcgccctctccacaacaccgccagtcaagtcggcttcgatccctcgtgcgctgccaccggcgccctctccaccgtgccgccatcagttcgtcgatccctcgcgcgccgccaccggattccaccccaccgcgtcgcaagtcaggtagtcatcgatccttgtcgtccactctcagtagcgccacccctaggactcctcgccatcgcaggtcatcgagcccgccggctaacaaggtaattaggtaaccatcgcaattttgcattttactatagaaatgcaaaatcgttatatcagtggatgtgattaataatgcaactttcatgtttcttatgtgtgtatgcatatcccactactaaactatcaatgacgatttcatggtttaatcaactttattagcatctgcatctttttatataatgcaaatggtttaacttgattatgatatgcattgtgacattgtttacttctctcatgattgggatgtttatatctgaaaattcagagaaagcgcttaaattagcagcgttggaatgctgcaacaaatgaattctgatcgaactcataaaatgctttttttttttacttcattgcttggtcagcaacatagcccaggaaaccaattaaattgatagacatgttgtgtgctcttttaagagaacaccatccgaattgacatccaagttaaaagaagacatttaattatctgaataatgatgccaatattcagagcttcttttacttttagttgtatacattattctgtgatgtgtatcgaaggttatatacagaatgagaatttacctcaatcctggaattgtgtagtgataacttccttcaaaaaatgttagatttgtgcactgttatttttttcctctaaaatgtcaaatgtggtttacatttttattcatgacacctaaatatgtacatatcatgcattagtaatgtgcaagcacttatcgatgtattgcctaaactaacactttttcagttaattagcgaacttatgaaaaaaaaatcagatgtttaatatctgaataaattcatattctcttctgatctacttcatgccttcatcaggacgaggtagttagtgttgtactgtagttgacaaagtgattagagtttgttgcattgatctaggactatatttgcataattgtctcacgtatatacagaggaaaatgtgtgtcatttcaagctcttaattcctgtggactgaatttcctgtttcaagtctcttgtttctcactgacagcccgtgatatgccttcttcttagacaatctcccccaaaagtcaagctcaagggtacgcatcctcctccaatttaaagaaatatattttatatttcactcagaaaaataataaaaaaaagagatgacataacagaagatgggccactttgtttcttgagccaactaagcaagctagctaccgtgcatgcagcagcagctcagctgtccttgggcctagcccatggcgactgagcagtgccgagcagcagcagcagttgcaagtttagtcccacctcgcctagctagcttgaggagcatcagcatacaaggatgcaatgctcgagattgactcgggtttattttttcttgtgtgagcgaggatagtgtagatgtagtgcaactgaatgggctggatcgaaaactatgggccctagcttgattgatcgattgaaaatctggctattttttttggtgagatgatcttattcgctgttgggtgagatggttatgatcctgttcgctgtcggtaagatggattgattcgttggtttcttaggaatttgtagcacagtagcagtttcatggagttcatctatgggtgggtggtggacagtaatatgtgtggtgcgtcagtcttaagttatgctaattctttttttaacctgtggttttgctttctgacatgctctttcattgcaaatggtttcagtaattaaccattctctgttcacaaactgtatcttttgttaaggtgtttgcaaacagttatgcttgtaaaatctcttgcccttttcccctatgaatgttaaatttaataatgttatgctctggccttttaggattttcccttgccaatagcattggtggaaataagtggaaggtgcaaaactaatgaccatgggaaaaaagtctgactatctcattatcttctttgacctgtattaaagtatgcattgaggttgccatagaactatttgagcttcttggtattaaatctgggaggtacttgtatgagctagattcgcatttggatattcgtacttgtatgtgcagatgagcgcacgtacgggttggtgtgggtcctcgagaccgggggcgtagctgagagactgatgatgaacgtggtgctttttatgggcgatggtgatctggtggtgctggtgtttgacacagaatttttagataaatagagtagcaaatttttgatagacaaacaattctctgaatatttggtttataggattgcacttgaaaaaattcaggatatatggtatttgttggaatatctgtatagcccatacatctgaagtttaaatttacagcatgttctataaactaattcatatggacaaacagactaacaagttcaaactataaaggacaaatttcaatttttatgatccagagtggggaaaattgctcttgtactctctaacatgctttatgaagacatgaaggctggtccagacagggttcttgttgtttatgatcagacgagttagacaatgacttgtaagtctttagaaaataaactctgcataattgtaactttctatccagctcaaatttgtctcctgtgattaatatagtttataaaataataaaaattcttttgcttgtaatatgaagtttggtttgtattacttctacgcaatatgtttagtttgtattcctaagcgcataaggaattagattgttttcaaacatgaaaaaaaagttgcaatttgagttttctcgttggtatcaaattagcaacagtataataattctttttcatattgccttagtatatcttgattttcattacaaaatataaccgtagcgttagtacgggcatattactagtcacttgaggtgcgacgatgccaaatggagcttgcaaagcagttcaccttatggtgaacttcaactactgtttttgctgagacgcgtgatgcagtttatttagctgctggttcttagctctatgaaattggtgatctgttcgtagtaggtcatctttcacaatcttgtccagatctctgtggttcagccaatgcagattactcgtactacaattttgttaagcattgaagtcagctgtactgaacagagcactcaattttcagatatcatgatatgatcatctcctgtttggtctcatataaaagataagaccatgaagcacaagcttgaggaagagagatcaacaagagtcgatggagagtgttactgctatggtaggcatgggatgcacccggagctgtcttattacatattgcgccctttcttctaaactaggacggaagcccgcgcatctgcgtgggcaatttatttattgtctataaaaccaatactaaaagaagtattatctcaccatattcactataagaaatagcccattgatatatactaaatgattaaaatggctatcattctgaatcaagaatcactttatcccggttatatataaattcagcattcgccataacttattttcattgtcttttttatagatggaattaatggctatcattctgaatcaagaatcactttatcccggttatatataaattcagcattcgccataacttattttcattgtctttttcatagatggaattgcagctctatccaaaactaaaccaaatacatcattaatagcacaaaaagttaatctccatatcatacccaattgcccataactcacagatgtctaaatttatatataaatatttaaaaataccgcttctaccaactaataggctgaaacaattgaacttatatatgaatgctcctctcacaatcgggtgaagctaaggagttttctctaacgccttattcatgggtcccgtgatatagtcgtgcttctcaagatgagcgttgaccataattttattggtaaataggttagttaaactttattgtagatggtggataaaaataatttgtggtatgatttagatgttataggtgttgaattgttcagcacaaaagttttttttctaataaaatatgataataggagaataaatgtgtgtaacaataagaagaaaataagggaataagggggtggaagtacgtacgtacctactatccttaaaaaaatgtacgtatacatacagtaatacgtacatgtcggtggacccggtttggggttaggaaattttctttgataaatctaatggcagtaaataatgggtccactaatttaacgaaaccaatggctagagaattcactaaattatagtgctatgtggcgacttagagcgcgtttgtaggatgccacgtggcggcttaggagagtttgtaggatgtttaatggacttttagtatataactaggacggaagcccaggtgcgcatgcaatttatttattgtctataaaaacaatactaaaagaagtattatctcaccatattcactataagaaatagaccattgatatgtactaaatgatcaaaatggctaccataccaaataagaatcacttttatcccggttatatataaattcagcattcgccacaacttattttcattgtcttttttatagatggaattgcagctctatccaaaactaaaccaaataaatcattaataccacaaaaagttaatctccacatcatacccaaatgcccatatctcatagatgtctaaatttatatataaatatttaaaaatgccgcttctaccaattaatacggtgaaacaattgaacttatatatatgaatgctcctctcacgatcgggtgaagccgactattgccgctaaagagttttctctaatgccttattcatgggtcccatgatatagtcgtgctcctcaagatgagcgtggaccataattttgtcggtaagtaggccagttaaactttattgtcaatggtggattaaaaatttgtggtatgatttagatgttatagttgctgaattgttcagcacaaatgtttttttctaataaagtatgataataggagaataaatgtgtgcaaaaataagaagaaattgagggaagaaggggtgatagtacgtacgtacttaaaaaaatgtacatatatgttgacagtcgttatcgatcagtttcgaccgttaatattaccaaaatagaggagaactagtgatacttgcaatgcataaatatgttagagcaataatattccactagtattagatatactaaccttttgcagagaatgacaataaaatgaaggagaatcgacatcaatttcaacgataaatcaatcggacgatgtcgagagatagacttatgtatgaatggaccaagaactcagaattgacacaacacaatgggccaaaattcaaagtctacggagaagaacaacagaggaggccaccttctgaatatgggccaggttgggccggcccctggttcggccgaaccaggaggttgggccgaacctcccgtggcgccgatgggtgcagggtttggatggacggctgggattgacccccaatggcggttgaagggtattaccgaccattccaactgtcacaaccatcattacctgtctataaaaggagctcctcttctcacttcacacacacacctcaagcaagttctctctcattcctctcaagtttagtttaatagtatctagctggtggaatcgaaatagaataggaaccaggagtccggaagccatcggaagagttcgggcatggctctaatagctttcctttcttcttttataagctgtgtacttttattagaatactcttcgatatacatttatggtattgaaatactttacgagtatatgagtaccaactttacattatgttcttgttatactgaatatacggctagattatctgggagatgctttggtgctggtatagtgtttacttatgcaattactctatgtcatgacgatgatattagaatagtatctggtagtttagacgtgttttctagattacgagatatcattatttgaggttatattaatatacttcccgcggattgggaatgtggtaggggggtggcgcgacgcgaagacgcgcgaccgcatcggtcccgcgcggggtgacgcaccaaggggtgttgccgcatgacaatcaagaggaccgacgcggtcccgcggattggttgcgcggcaccggtgcagacataatattcttgtttcactgcctttgttcaattcgagctgctagtgccaagaagtcaagcatgcatgtgcatgtcagagtagtaaacgctaaagctagctactgtagctgttaatacaatcaaagttctacgagggcatgtttatttcgcgaaaagaaaatatttaggtgtcacatcgaatgtttgaccggatgtcggaaggggttttggacacgaataaaaaaactaattttataacttgcctggaaaccgcaagacgaatcttttgagcctaattaatccgtcattagcacatgtgggttaatatagcaattatggctaatcatggactaattaggctcaaaagatttgtctcgtgatttccccctaactgtacaattagtttttttttaaaatctatatttagtactatatgcatgtgtccaaagattcgatgtggtgtttttagaaaatttttttggaaaactaaatcaggcctatatcctctttttattgcgggatttgtcggtggtggtgcagtcccggacgatgaatccgcgggacattggttccgcgctactgttatgcggcaccgcgcctggtgctgcagggcgcgaaatgaacgccatcgtcgctagtgcctcgagggatcgacgcgatcacgcgtgttggcgtagcgccaccgcccctcccattggtcaactacatggtgctgtgtttccaatccgcgtggtgctgtgtttctaatccgcgggaaaggcgtatttttcgtaaaatttttaaatgcatgtatatttgttcaaaatcgaagaaaataatgcatatttcaaaatttaattagctagatccagacccccacgcaataaaagcggctaggccatcattatatatgacagcgatcgtcaaagtcatccctgttcagcaacaatgacgcggcgactgatttcagaagagtaaccacaacgatggtgatgggcgacattctcgtgataacaatggaaaaaaaaactataagcatctatttgaacttctgaaaaacagaattccagtccatctgtttatatttttttaaatgttctcacaagttcagagtaaaatgcatgagcatgcttctgtttgtacaaataactactaatctcatgcattttcacccttctctgtgaccacgaaaccgatcatttctattctgtgctctcatttttttagtatgggaagtggcattggtgaatgttaattattaacagccatagagacgaaggaaaacaattcaatgattcattgatctgtcatcatgtcgtcgatcaccttccactacatatgtttggggacattgatctgtcagaatgttagacagtctactctcagaaatgcatgaacaagacgtgcctccagtttttccagagcttagttctacactgaactggaatttactgcacttaataatatcaccagatcagatgagatatatagatcggttggcacatgtgagcaagaaatgatatgtcgagagagaaggatgaagagtgttcatggagccaaaggaaaagcgtgttggtgaatttgttttccattgttgtgggcctaggaggcatcaggatctatcatgtcacttatattcatagttgaggtgccgcaaaaattccatataggtggggtgactgcaatttttgttgccactattgatcccactgttctcttcctctacctcttcctgtttttattcagctatggaagtacaagagaattagttagactagccgtcaacccgtgcgttgcacgggttactgtgattaataattaaaatattattactttcaatggataatgataaaatatgttactttgaatgaagctgacagttgccaaaatcttaattagtaatttcatatataatccattctaatatttcttctattactttattttttttcaaaattacataatttaaaatttcaatattagaaatatagatttatactcgttttgttgctcttgttagcatttgctataaaataatttagcaattttcaattaataagtacagaaataaaattagtctggagttaagctttttcatgatttaatgattcctatattcataattattaaatatcaagttgtattttgtgtggagtctcaattataacatcttcataatttgattttaaaattcgtaactaaaaatattatactcggtttgaaatcttatttttttgttttatcatgatttaaaaattgttccaaattttcgaatcaatagtagttctttcatgatttaaaagtatcaaaatttgaaagtaattaatatatatcgctacacttgatcggaagtatcagttatttctataatttaatatttatgaatttaggaattaactggtacctgtttgtccttgtgttggtctcctaatttggtataatacgctagatgcatgaattttagtggcatttttacatcatcggtgtgttgtaaaagtggcccacatcattacagtagacataattcagaccaaatagtccttaaaactgacaaaaggcataactactcctagttagaaatcatgcattcttactccttattagtctgctaaattgaatttttgatgaaatcatacattcactgaaacaaatgtatttggatgaaacatatatggagcagatttgttagtgatatatgtttaacttatcttgtcatcttggttaaaagaatagcccacatcatcgacaattgctaattacacctgacatagataatgcaaattaacacctgtaaatataaaaagagaaacattaaagtaagtgcttgtttgtttcttattcataaatagataggggcagcagctacgttcccttgtttgtaagcatacctgacctagacaaacttgtcaaaatattatgtagctgttttacgcgtggaaccaaataaataattaaatacacagtaaattattcatgttaagaaaaagatacgcagtaaagcctattggttgcttatgaaggatgtgggagaatttaacttataagtaaatgaatatacctgataaactccatccaaatttatggctatcaaattgcgataccttaaaatctgaaatttatacatagtttagaatagatgagaagcatgtaaaaaatacttactgaaaccctaaatagattgaattatatcttgcttgcttgagtatttaaaatagcaatcatagctgcaaagatcaatctgaatagcatctgcatcgataaaatagtgaactggagatcggtcgatggagctcatcggcggcagggtgtgaaggagatcgacgtatagcctgtcgtatcgtcatcttgtcgtgtgtggagtcgagtccggtggctgagatcgacatggacacagtttgtagactttgaaggaagccgatatagattaaatggtggcctagatacatgtttctctcgttgggcctttaattaaaagtccatggttataatatttaatctatggtcatgattttacgatctagttaatcaatggccagattaatctgattaacatggaagctccgagaaagtgcccaattagtatagatatagatagatatagattttattttatttctctctcccatagattaccacgaattccaccagatatatacggtgaaaatgtcttcccccaggcgctcgatgggccagggaaatatcggtcggtcgcccagatggtgggccagggtgccacgtgtcggcgccgaggaaatcgggagctatacctccagcgcgcacttcggcacctccatgcgtctctaccacacacgtcgttgcaacaaatcacccacatattttggaaaccctctattaagcggattcattccattttttgttccactaaaaatttttcacctattgtactcacaatgtttcacttattgtactcataatgtttactatgtatatatctaatgttgcagtgaacgaaacattcttttgcaacaaatcacccacatattttggaaaccctctatcaagggaattcgtttaattttttgttccaccaaaaatgtttcacctagtgtactcgccatgtttcactatgtatagatctaatgttgcagtgaacgaaatattcttttgcaacaaatcacccacatattttggaaaccctctattaagagaattcatttcattttttgttccaccaaaaatgattacctagtgtactcataatgtttcactatgtatagatctaatattgcagtgaactgaaatattctttcgctatttgctgaaacaatgttttttatataaggtgaaacaacacccgatttaaacgattgaaacattttcgatctacttagtgaaacaattccgatatacttggtggaatatcgtgcaacattttaaaataattcaataataagctaaaaaaatcgttggaatatatccatgtgttcttgttttgaagatttaattgcaacgaatttaatggtgcaatcggatcatgatttggataaataatttaagagaaaaattaatttaaagtggttttgcacgtatgcgtggcgctaacgtcagcaatttttgccagtttggattaggcgtctgattctaagtctcctctgatatacggttaagtttaaattaataatta

SEQ ID NO: 80743 - DNA, 651 bp, Oryza sativa
atgctcgccctcgtcttctccaccacacttaaaaatttttgccccgaacgacctctctctgcttctccttcaccgccactgcctaaggcatccccgcgccgacgcctacgtcatatctcgccatcgtctcacgcacttcgtcttcgacaccttcatctactccgcctccaccgaatctctatgttgagagccgactccccatccctttctagctctctctctccgatctcgatctctctctctctctccctctctcccaaaccgccggcggccgccttgccacgacgccgccgcggcaccgcaccgtcacgccgccacgccgctgccgcgcaacgccgccgccgtgccgtgcgcgtcgtcgccgacgtgcgacgccgtcaccgtcccgcgcgccacgctcgcactggcccgcgcaccccgccgccgtcacggagcgccgatgccgcgcgcgccaagccgcagccgcgccgccccgccgccgatccgctgccgccccgtgaacgaacgaacgtgaacgtgaacgtcaacgaatgtgaacgagcaaacgaacgtgaacgagaacgtgaatgaacgaaacgtacatgaacgagaattgaacgtgaacgaacgagcgtgaacgaacgtaacgaacgtgaacgtggacggacgtaa

SEQ ID NO: 80744 - DNA, 3709 bp, Oryza sativa
  unsure (1)..(3709): unsure at all n locations
cccgatggtcggggatggtacaaaacagcatcgcatggaggttgaaatactcttgtgcatatgcgtcccatgtccgtgtgccctcattccatagcctttcgaagtcatcgattatcagttcaaggaacacatcgatatcgttgccaggttgtctcggtccttgaatgagcatggcaagtataatatacattcttttgaagcacaaccagggaggaaggttatagttaacaagcagaactggccatgtactgtgacgactgctcaaatcaccaaatggattaatgccgtccgtacacattgcgaaacgcatatttcttgggtcatttgagaattcctggtaaatcctatcgattgtcctccactgtattgaatctgctgggtgcctcagcatactatcgactttccgttcttcggcatgccagtgcactagcttagcttgttccttattcgcaaacattctcttcatgcgctccgcaattgggagataccacaccacctttgctgggactcccctctttgacttacttccttcaccttcactctttgctcgtttatatcatgatgcccctcagacagggcagacatccaagtcagcgtattccttgtaatacaaaatgcagtcgttcggacatgcatgaattcttctgacctctaggcccaacggatataatacttgcttcgcttcatatgtcgtctgcagtaaattgttcccctctggcaacaggtcctttaacagctcaagaagttctgtaaaactcttgtccgaccagccattactagccttaagcttcatgagttccaacacgcatgacaacttgttgtgcttcgacttgcatccatcatacaagggcatctgacaatcttccaccaacttactaaacttctcaaaatctctgtcgttgtcctctgcgtcttcaatgtcatgcaacattgtagatagacattgagtgtccaaatctatggtctctccacctaaaggagaaggtacgaacatgccttctcgagctgcggcggtgttctctacatcctgatccaacacttcatcacctgcgacatcaggcgcctcttgctctccatgcttgctccagcaggtatatttcttcatgaatccattcattatcaaataagcatgcacttcatcgctatcttcgatcatctgttcattcttacagtccctacatggacacaacatgtgcatgctcatcctactttttctgtcattatccgcaaatgtgataaattcagtgaccccctctctatactcagtagacgaacgatgcgcatagtacatccatctacgatccatctgaaatcaacaacatatgaagaaaaatatatgatgatcaatatattgagaaggaatgaagaataatgtgttttttaccttgaattttagcaaaaaatcgcccccttgccctcccaaccgatttgtgaacaatgaattggtcgggatagaaagcagttggcggtttgggggtatttatagacccaacacacctcaaacgggttagattaaaaaagcccgtcaaatgtgttggtcatacctttgacgggtttcaattgagttgcctgtcaaaggtattgacctacctgtgacgggccgtaaaaaaaatccgtcacaggtggcggaccaccacctgtgacggctcataattccacggcccgtcacaggtgaggggataccagtgacgggttgggagaaaaacccgccacttcctcacctgtgatggcttttccttctggcccgtcacaggtgaggggatacctgtgacgggccacggccggatgccccaccgatgacggcaaacatagcgacccgtcaaaggtgacggtcatctgtgaccaattcataagaggtttccccaggtnccacctttcactggtattccgtcacagatatgggttctggcgtagtgacggatcgagaagagatatcaatgacctattgatcgagatggatgttgcatttgttcatatatagtatggccaatctatacactggcttacttaggttgacactaatatgcgaggtagggcgtacatctagctaggcaggcttcagaggcatcaagaatcgatgatgtgctgcattacgctgttgaggggagttcctatgctcggcagctcgggcactgtctgcagttggctcatacacgcgacagtcttggatcctggaagctctacctagtcctaccggactgaaagaaagctgtcgttcccgtgtcgtgactcgtgagtaaggtttgatccggatcatattatcttccgacaccgatcctatgtctaaaagacgttgacgttatacatttaactttggacgtaactacacaacaagtggtctaaatcagctaccactccatctataagagacaccatccatctatacttcaaatataattttctcttaaactactcatccgatctacgatccgattataccgttgtattcgtaacaattaaatctttacaacaagatctcacgattatattttgataaaaaatcacaaattagttttatgatatatctaaactacttttagatttcgctaagttacttcttatatatataaaagtaaattcagtaaagcctaaaagaaatttacatatattatagaagtaccttagaacaaaacgaaggtaaatttggcatgtcatttgaagtaaatccgttgtagatataaaaatatgactctatctagaaatttaattaatcaacacaacttatgaaattaacttttattaatcacctcagagcattatgaatgtataggaagtattttaatcaaatttaaaggtaacttatatttatatatatgataatttgttcaatgaaaaaaggcattaattaaagttactataatatatgtaaattacttttaggctttactgaatttacttttatatgtctaagcagtaacttagtgaaatctaaaagtaatttagacatatcataaaagtaatttgtgattttttatcaaaatataatcatgtgagatctttgttgtaaagatttaattattacgaacacaacggtgtaatcggatgagtaattaagagaaaattttatttgaaacttagatgataggaatatttctcctagttacttaatggattaggactataataaagtaagattcttcaagttaacacatatctgaataggagtcgctcgttacaactaaatcgagagtgccctcgatttagattttgtgtttaactttatagtatcatggtttgatatagtatcttgcccctttatagtatctttatagtatcttgcccctttgatgtaacacttagattgtgaccaaccgaattgaattcctgccatactggtctgccttgagaatccatctgtcttcagcctctccaatttttcttttttgttgcgatttgatgggcaggaactatggcagcccatattggtgggctcaggcctgtctagttcccaaatttttttcccaaaaacattgcatggaatctttacacatatacatagagcattaaatatagattaaaaaactaattgcacagttatgaggaaaatcacgagacgaatcatttaagcctaattagtccatgattagccataagtgctacagtaacccacatatgctaatgacggattaattaggctcaaatgttttgcctcgcggtttccaggcgagttatgaaattagtttttccatttgtgttcgaaaaccccttt

SEQ ID NO: 80745 - DNA, 22314 bp, Oryza sativa
cgcctggaaacctgttgatggaaaaaacacactgctctaggagatttgcttagctccagtgcaggtccaagacgttgatgcgatgtcggggtgccagttagtttgatcatgcaactgacaagatatgtaaacaatagataaaatagacgatcggctgacaagccgattgagtaattccagctgatagccgatattagcccgatgcccgattctaaaccgattttcgataggagttttcaggcacgatcctgttttattgtccaatgttagataatgatataaaaaccatcggttgatgataattaaatataacaataatataatccaatagaaaccaattggctactaataatatgataggataagtaccgatccgatggttaaagtatacatcggctaaaagtctgatgtccttaaatctacaagattagaaaaacggtgaaactttttattgcgatcggctaaatccaacttgtatataatccttataagccgatacaatgtccagataacttatcggctagcaccccgataaaacagtaacatgaacctattggtttaacaagatttacattatcaacaacaatctggtaggtcgaacctgaccgatgcaacacgagattacatataacaaatactcgatgagccgatagatctgtctaatgtgatgaatataaccaatataattatagcagcattgtgattgtagagatatatcagctaagacagaagatctaaactaaccgagatagtaccaactaagccaatgcgtctctaaacacaatgcaattagagatagaattggaaaatcaggtaggcaaatatatcaacaaaaccagaatgatccaagagatcaaaacgatgcagccttgaacaacatcaatgtagtcgatagatttagcacggccgacggaacgtaggacttaccccttcgtcggagatcgaacttaaccgatgcagccccgcgtcaggtgccaaattccgcccgttgataagtaaaacctcagaaaagagggtagcgatgtgccgagagtagtattgattgagagatcaattacaattacctctagtgtacatatttatacccataggtagatactagtccttgtaggacaagaaagaaaccttcataaagataaaaggaaaacataaattacttaacggacactaaacatactaaactaaaccctgcctaattaatatataaactgccatgtcgcatcctccttgaactcggactcttctagatatgcttcctttaattgatctttacccgaatccataaaaaatacaactgttggcaattgatagtttacatcggttgatctaggaatttgaagctgatactgattctaagccgatgattattccgggcttaccaaattttgtcgttaacaaaacaacgagacgaatttattaagcctaattaatccgttattagcacatgtcggttactatagtacttatggctaatcatggactacttaggctcaaaagattcgtctcacaattttcatacaaactgtgcaatttgtttttttttaaaaaaatctatatttaatgctccatgcatgtgtcaaagattcgatgtgatgtttttgagaaaaaaacattttgggaactaaacaaggccttacctagttgcgggaacaggatcacctacattttgaggtattaatgtggcccatattggtttgtcatatatcactatttgcactccacagtataggcttccggttgtcgctgctatctacccaactaaaaatctatcaaactaatgaccggatgcttgtgattcatgaagttttaagactgacaattctgcagctaatctatgcttcctataaagatacaacccactaattctaaagcttaacatacaaccatgccacatcatcatccactagcaataattacattttcaacctcatacaagtaatatcatctacaatctatttaattctacaaatcaacatgcaaacatattcaatcatcacccctcaaatcatttccacaatatttttacaaatatatgtatcatttttatagtaatatttaacataaacttatcaatatgttccacattaaagcgcgagattcaattgtttgtttcatgataaatactgataagccttgatattttatttgttttccttttacctttagcttgattgtcaaaaaaaaaatattgaaaagtacttagtaatccccgcagcaagacacacagggaatcacctagtatatcaattaaaaactatggatgttcataaatactatatgttggcatgcagaacagggatgtatttagtatagaaaaacagccagcacagtgtaatagaagctacaaacgaaatctccaccgtgaatataattttgaagagaaaggaagtgtatttagtttctagtaagagctagcgtgtagttgtgctgatcagtgtgtatcggtatcccaattacaccatataatgctatagggctttggaggcatggggaatttgacatgcacacctctagcttctttgacatccgcctccttgattgcgagagtacaggcttcccagtgtgttgccggcacagatgctctcacagtcacgtcggtgtcaagctaattttcttctctactccccaaagccaatgcttttgccgggctctatgttttctacggactatatatatatattccttctagacaaggggactcatttgctctgtaggacagctagcttcgagttaatcactaatatgcatgagatagttttttcacgaaaacgacttcgttcattggagggtttttctcgccccttttctttttctgtaagatattgggagagtgatcgtcatcgacaacctagctagcttggcttcataaattattgggcgtgttatatttgtgagtgcaaatgtgtaaaaacaggctagctagttaaatacataaattaaactttgttggatcgtatttgtaaatgcggagaacttaaaatgaacaaaataatttctcaatgaatcatgcttgttgtttttgtagtaaaagaactgaagagtacataggctaaatatataatgctcatgaggacatttgtactggtgtcaagcactatctcggccatctctggtcccacagccagggaagctatctctgctggtagccttcagtgctagttcataaacatattacacaaaggaatatatatagagaggggtgtatcaatggaaaatggacactcaacactacatgcataagttggcaatattaacctgaaacctaaggaaatgtcatctaggagctagttaggcttccgaggcatcaggaaccggtcaggcgtgaaaatatgcaatggagagtagtgcctacgctcaaccgccgtctacagctcgagcgtaagtatgctctgcaactgtcgcataagcaccctctcgattcgacgttcgcaaagtcatgactcatgaccgtctgtgcgttatcactttccgatgagcctatacaagtgacagctatcagcgaagcgtactttctagtatctatatatgcatccatcgtggacctagtctgatgactgatttctagcagtaagtatgaagggttcctcgaaaatttgggtgatttcaatgggaccgaaatttatgaaattccgtattttcggcactttttaaaccgagacatttttgaaattttgacagattttaactgaacttgaataaacttttaccaaatccaacaaaaaatggagaagacccaacaatttcagtcgatatattgatttcctggtggggtccgaaatttcgaaccgaaattgcaataaggtgaccgtattgactagatccatctctatatgaatattattatgtgttaatttgttcctctaaaatattgatggattgctaaacaacaagcgctactgcccctttcaatactacaagaatttttgaacattggttgatggtcatgggatgtgtatttcaacaatctggttgttatctaatattaatattactttaaaaatgacttacactccagcatattaacactattttttaataaagcgagtagtcagatgttattgcaaaagttaacggggtcatctattaaagacggatggtagcactattattaatgtccgacatgttgagtccgatgaacagaaagagattcacctgtggttgatcacctcatctgtaatctacgcaggtaccgctgaatttgcatcttctattgaacacattctcaggtgtattatgccaagcatacatgttctatttggctaatcaagacatccatgaatttgtttttattttgattgaaataataaattgtgctgataatcttatacttattgaatatctcttatctcaaaacacataagtgcattgacggcttaaatctcatgctcactctaaaatttggattatttgatcttaatcttgaaacaaataatatatattgatctattttttttctgaataaaaactaacaactgataactaatttccagatgtgctgttcatattatccatatgcgtactgtatacagtcggtggcatattattgatattcatgtcattggattttttataggtactattaattgcgatggtatattatatagagaattcgtgttagacagaacatggcatggttgataccaaggactgttcattcctataaaactaagaatcaatagatatagagctgtatctattgggactttatcaatttaattttgaatttccaaactgataattgcaaattgtaactgacattatcatcctaaaccctataatttgtaaatgattttgaattcgtaaatatggagtacaaatcttggattcttaatttaactccctagctatattaatttagttctaaaattaatagtcagaaagttgtaaatgacaggaaatcttttttattctaagccactacaaataaccaacatatttaacataaaaactttttatatgtaacgatagcctgtgcaatgcacaggttggcaactagttatctttaatttctaaagtgttgcattggctcatgttcaaatttatacaatcaatagttagattaatctttattaacttgaaccttatattgtctcggattggtccaatatatctatcaagattatttctaataaagaaagatctatatttgtttatatttgttttagttctgatgatagcataattcatctagtttcctaattaatcaattctcaatcggctagtagccattgattccaaccccgtcggcatctgctgggtacacgatctcatattggcccctctatataatctaatacaattgtttttctatcttgttagttataggatcgaagtaacctggcacgctctagacttatttttagaacctgcactagaggggttcagatcccctagagttggggcaaactccaccggtggatttggctcaatcttaactgttcttctgacttctacggctgggatcatggcccctactcttcttctaatcaactatcttaatcatatagatttagaggaaaacatttagttttttaagtgcttcccaccataaccatgattattctccggccaataatatcaataaaacaacgctgtccatcacaaaaccatctaaacaaacattagcattatgttcttgaggtggatacccttgaatcttcagtttgactgtttcaggcaatgaagaacaatatgccaatattaacaccatagctgaactaaagttcgatgacaaagactaagctgtctgctgcagtgctgctttggtacttgtaatttaattaggaaaggaaagaaacacggttacagagattagagaaaatctcagccgtataagtcaaaaggacggttgagattaggccaaatccacccggtggagttggtcccaactccagtggatctggagctgcactagagttaagcaaatgtctcggttttttcgtgtgttggacaaattttgtggcaacaggtgcatgtggattcacggtggcttgtggcacctgacgagtggacgacaaggaatttgttatgggatcgaggaagggaagacatatatcctactacaacttacagaatcgtccccaagcaaataccatataaatataattaattttcgtcctttttaaatttatattgttcgactatatattgatggtgcaaataaaagtgagccggccatgcaatgtgcatgcatgggctgacactaccatgcaagctaaggtaatgcccatcaatatatctagttgggcttgggaggcaccgggaaccgatgagatgtcaaaatacgccatttagaatactgcatgcactcggcatccgcatgctgttttcacagatgctccacaagtaatgaagccagaagctgtactagggatccttgatggagcggcaaatagaggttgtgtacagggtggtatcatttaaccatgagacctgcaggatcatatgcacgtaaccgagcatacgacgcatacaaggtgtcccccgttgcgttgcgcgtacaccagactgctgtgtgttgtgtgatgaaacaccggttttgagctatctgttgtaacgtccaagcagagacgaccatatatatctgtacacgatcagtgtttagattttattaaagaaaaacacattaattgattcatatatatgctgaagaacaggggtcattttttcattgttttctacgggttatagattaattgatggatatgctgaacaacggatgattgtacgttgggtgcgtggtctagcaacccggttgtgatataagctgagcaggtgtactaggataatttaaagtgtacatcatgacagtgtacaaagtcctgtactcctgtttggtgagaatggccggcgtgtgccaacgcgctgcttgtgctcattttgattaattaacggccggttcctgcccaaatactgagcagccgtgctatatagtttcagtttggccatggcgattgattgcggccgcccatatgcttgtttgggaagaaaaatcagataaagagcaaagccggccatctttcttctcaccctatatctacatgttcgtactcgtagtctccagttggggtttgggaggtatcggaaatatatccaactcgatatgcgtgcggaacattattgtttgaatgttcttcagtaaattagcaggaccaaacaggtagtcatgaggacatttctactggtgttaagcaactctgttaggtccgaagaaggccaagagcatgcgacatctacttactggcacttggtgttctccaagtacgtacggtcgtgaagctagtccaatgaccggttttgacctatgtattgtatcatcaaagccgagagtaccatatttcttagattagattttttttaaaaaaagaaaagattaattgatgggctgaatattttctgagttatgggtgcggtctctctgtgtcttcgtcgtacgcgtcgtcggttcaaactatatattcggatactcggattacattcgaggtgtgcttgtgcgatatattgacgggttctggcccaaattaacactgagtagacgagtagtcattccatcgtttgattaatttgccacttaatttcctaaaaaatcatggagtaattaatcatgtatgatgagcttacctacgtatatgcgtgttaaatttatgagtggctagttaaacaaggaaatgaaagtgtggatcgtatttgtaaatgcggagagagaagtaggtatgaaaaatataatttctcaatgagccaagctatagtttttttaatagagaactgaagagtacatatataggctgaataatgttcatcaggatgtttgtactggtgtcaagcacttacgcacggactcagcttcggtgacattggataggcaagtcacaacgtgacattggatagatctgggccatctaaaacacatccaacggagatggcgcttgggcccacctgcaggtcgaaatatcgccgcccgccgcccattcagctttcctgcgtccgaaacggcgccctcccccaatccttcccgcgcgcgctcgcatcgacgtttcgcctcgcccgtatccggccgtcgcctcaagcgcgagccagctaggaggctcaccgccgccgcgcctgcgccaggccgccgtgctcgccgcgagtggggatgggactggacggccgtgacctgtgaagtgccctgccgccgcgaccgggggcgcgtggagcggccggccgtcgggcctgacggcgtggtggtgcaggcgggcgaccgcccagccggagcctgacacgtcgaggggatgtcctggaggaggccgcgctgctccaggctcgctgatgctagatgagaaattggtaccagaaagttcagttcagttacttgaagcaattgcatagctcaattttcacatggttaaatctatttgaaatgccatattgccatggatacaagataagcaaaatatatttctcatttcacacaatcaagagaaaatgtaaaaaaaaaagatgaaattatgcaatatgccctattttttcagatagtgaattatttggaatacaaattcagatatttgtttgatactgtgttgatcagaagtctccttcacttctacacttagaacccctgcacgtagtagacccgcagcgcgtacaccgccgcggccacgagcgtgccggcccaccgccccgccgtgtgcggcgccacccgatccaggtagtgctgtgctggaatgcccgcgacgactctgtgcgccaccgctccactgacccggaggcggacccaccgccgccaacgggggagggctccatggtcgccggccgcgctggttgggggattccgaggcgaggcgaggcgagtcggtggggctaggtttcgtggcgttgccctgggcgatgggagcgctgcgcctgcgctgcgcatgggttggatttggtcaaagcgaaagcggagaagaggaggagaagggatatttcgacctgcaggcgggcccaactgccatctccgttggatgtgttttgaatggcccagatctatcgaatgttacacctgtcaccgaagctgagtcccgcacgcactagctctgcgatgtctgatcatcctggccagcaaaacgagctgctgacttataaatcacattacacccatagcgatacactggtggagaaaccatctttggtcagtcgatcagattttacaatagtcccgattgtgttataaaccgggactaaaaatatctttagtcccggtttaaaagctacagggtactttttcaatctttagtatcggttggtgttaccaaccggaactaaagatctatttatagtctcggttggtaaaaccaatcgggagtaaagattgacgcggagatcagagaagtgtgcgcgatcggatcgaggccggtacctcctcctctcctttaactcctctcctcaaccttatctcctcctctcatctttaactcctctcctcaaccttatctcctcctctcatccttatctctattctcctccttctcctccctactggcaggggcgcgagggccgcggatcgcgagggcggcgggtcgcggagggccagccggcgcggcgcgcggtgaggcggcggctggaggcggggcgcggagggccggcgcggcggctgcgcgcggcgaggcaacgctttctccctttttttttttgaagaatctgagattgttgtgtgatgtgtttgattggatctgagattattgtgtgctgtatttgatttgtgtgtgatgtgaatatgtgatgaattttgtagaagttgtgatgtaattttttttaagattttgtgatgtatttgagtatttgagatgatcgatctgtggatttggaggcaatttgaggatgattgatttaggattttggggacaggatggagtgaaatcaatatatttaaaaataatgaagaaaagaaaataataaaaaggaaccggaaagagcaaccagattagcctctttagtctcggttggtaacaccaaccgggactaaaaatggatttttacccccggtattttcacccgggaccactggtagagaaaccatctttcgtcggtcggccgaattccaaaatagtcccggttgcaataaaaaccggggctaaagatgatctttagtcccggttaaaaagggtaacgggcatatttgatctttagtcccggttcaaatgctgtcaggtcttgtcaggcccccccgggatctttagtcgcggttggtgttaccaaccgggactaaagatcgtaattaccaaccgggactaaagatcccggggatccaaccgggactaaagtgtcacccctatatatatgtcttcttcctcctccagctgcccaagcaagcttcaaaatttcttcaaaaaagaggggaggtcatgccaaaatttcaagtgaatttattttggtgattatatacaaatcagaggtgactaaaaggttagcaacttcatcctccaatgttttttttgtcatattacatttggagctatgttttgcacacttttttgtctccaaaatttagctgtaagttgatgagagagaaaatttgtgtggagaagaaagaatatatagcaatttagttgatttgctaaagaaggttttataaaatagttgagaaggaaaatatagtgaaagttaatcttaaataatagaaaacaaactaaaatgaaaattaaaagaagtaaaacacattaattaatattagtttaaaactttagaaatagtaaataagaattatttggtataatattttatgatttttgtatgaataaagatatgtcattattgtatgactgttgaaagagtttgtaattattttataattattgtatgactgtcattattgtaagaataattttttgtgtacgattttttttcatgtcatgtagatggatcggcaatggatgtacgctgaccggcggtccaaagagtttattgacggcgtgcattattttttgagagtggccgaagctaacaggcataagggttttatttgttgtccatgcaataagtgtaagaatcagaaggagtattctgcatccaggactattcatttccacttgtttgagtcggggttcatgccaagctataattgttggacataccacagagagcaaggtgttgaaatggaagaagatgaagtgtaagacgacaatattctggactttgctcagtacgttggatttaaaggaaatcaaacgggtgaggaggaaagggatgctgatggtaacgacgttgcggatgatcttggtcagatgttgcaggacgccaaggaggactgcgaaagtgaaaaggaggcccataaattggacaagatgttagaggaccacagaacgtcgttgtacccaggttgcgagcaggggcacaaaaagttggataccactatggagttcttgcaatggaaggcaaaaaattgtgttagtgacaaggcatttggcaatttattaaaactcgttaagaacattcttccggagggaaacaaattgcccgagacaacgtacgaggctaagaagatagtctgccatctaggactggaagttcagaagattcacgcatgtccgaaagattgtatcctatatcgcggtgaggagtacgagaacctagaagcatgccatgtttgcaaagcactacgatacaagattagacgagacgatccaggagaagttgatgggcagctagcaaagaagataattcctgctaaggtgatgtggtatttccctataataccacggctaaggcgtttgttcaggaacaaggggaatgctagaatgatgcgatggcacgctgcagagcgtcaacaagacgggatgctgagacaccccgccgatggttcgcagtggcgaaacatcgacagaaaatttaaagactttggaaaggacgcacgaaacatacggtttggtttgagtacggatggcatgaatccttttggagagatgagcagcggccatagcacttggcccgttacgatgtgtatctacaaccgtacgaagcctaaacatcgcagcggaaaaacagtgtttgctatggttaaagatcttaaagtagtgttcagaaaggggcctggaagccagcctatagagagcgaagatggtcacgccgcgatgtggaaaaagaactctatattttgagaattaccctattgggaattcttggacgtccgccacgcaatcgacgtgatgcacctcactaagaacctttgcatagacctttttggcttcctaggtgtatatggaaagtcgaaagatacactggaagcacgtaatgatctgaagcatatggaacaacgcggcgaccttcacctggaaccaaaggagaaaggaagccattacttgagtccagccagctacactcttagcaaggcagagaaggaaaatatgtttgaatgcttggagtgcataaaggtaccgtctggatactccacgaatatcaagcgaataataagcatgaaggagaagaagttcacaaacctaaagtctcatgactgtcacgtgttgatgacacaactgctaccagttgtaataaggggtatccttctagacaatgtccgggcaacaataacaaagctatgtgcattcatgaacgcaatttcgcagaaggtcatcgatccggatagattagaagcccttcagaatgatgtggtgcaatgtctcgtcaattttaagttgatattccaccttcatttttcaatataatgacgcatctgctttgtcaccttgtcaaagagatccgtattctcgggcctgtgtacctacacaacatgtttcctctcgagaggtacatggacgttctgaagaagtatgttcgtaaccgtgctcgtccagaggcaagcatcgccaagggttatggaatagaggaggtcatcgaattttgcgtagaatttatcgaagaccttcgcccaatcggggtacctgaatcactccatgaagggagactacggggaaagggaactctcgaaaggaaagcaataatgagggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccacgtggctacgacaacatctcatgggtaacgagtcgatcaaccaacaacttgccttccaggcgaggggaccgtctgggtcgatcgcgacattccagggatatgagatcaatgggtacacattctacacgagagcccaagacatgaagagcacgaaccaaaacagcgttgttcttgtcgatgccatgggacatgatggaacaactgccacgtattacggtgccatcgaggatatatgggaacttgactatggtcctctcaaggttcctctattccggtaccaatgggttaggttgactggtggaggcgtaatgattgatgacagtggtatgacaactgttgaccttaacaaggttggatactcggacgaaccttttatccttgccaatgatgtaacgcaagtctttttcgtgaaggacatgtctagcaaaggaaagaagggcagagggcctaaagagcctaagcgtcaagtggttctcccaggcaaaagaaaaatcgtcggagttgaggacaagactgacgaggattacgatcagttggatgggcaaccccctttcacggtgatgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttagatgtattggttatccatataaatcaattgatgtatggcataatttactatcattcatatgctacatttaattgaatatcattcatatgctaattataattgactagagaatttttaaaagtattaaatcattcatgtggcatttacagatgttaattagagtttttcacaatttaatttactatctttcatatgctacttatatatgactattcttatttttaaaaggtttaaatcatgcatgtggcatttacatatgttaattagagtttttaacatttaatttaatataattcctacgctaagtatatatgatgattacaatttttattaattttaaatcatgcagtatgtacatacaaatcttaattagagtttttaccaatttaataatatcattcatatgctaagtatatatgattattggaatttttattaattttaagtcatatatttgcttattacgatttatccacttaatttattacagacaaaaataatttttcgaagtaattgtcattaatctttgtactttaaataatgttaatacattaacttctattttagaaacacatatgtaagcgaaaataatatgcagtgctataatctttagtcccggttcttaaccctaaccgggtttaaaaagaatttggaaatagcgggaaaatatctttagtcccggttgatatttactcccggttgttctcatcaaccgggactaaagatcgagggctatatatattcccgatgcgcgccctcgtcttctccaccaacacttaacgttttcggccgatcgatctctctcggcctctctccttcgccgccactgcctagggcaaatccccgcgtcgacgccgccgtatctcgctgtcgtctcgagctcatcgtcctcgccgccgcctccgcctcctccgccgccgccgcctctcccttcatcgcgatctccgatctcgatctctctctccgtcgcgccacccgccacgagaagccgcgcgcgcaacgctgccgccgccacgccacgccgccgccttcgccgccgcgcaacaccgccgccgcatgcaacgccacgccgccgccgctgttgccacgccgccgccgccgccgctgccgccacgccgccgcgccaagcgccggcccgatgctgccacaccgttgttaacgaacacgtgaacgagaacgaacacgtcaacgtacgttgccgtgagaacgtgaacgagaacgagaacgatcgaacgaacgagagcgagaacaagaacgatcgaacgaattaacgtgaacgagaacgacaacgaacgtgaacgagaacgaacgtgaatgagaacgagcgaacgaacgtgaacgtgaaatgcaatatatatatgttacttctcatttatcctaatacatattttttgtatcttgcagaaaagacatgttgtcggagtcgtccctcaagccggagtagaagagctagccctagaaggaattcgtgcaggcaagtgacgtaataatataaatgattgttatatttgtaatgcaattaagaatattagacttgtaattagacttagcatataagattgtgtagtgttctaattttatttgagttttaatataagattattttattgcaaattagacttagtatgtaattattgactacagaattggttcgactcctagcaattgactattgtagtcttaattagacttagcatatacgcacgaaacacttagcatacatgactattttagtcttagcatgtaatattatttgagttttaatataagattattttatttgtaattagacttagtatataattattgactacggaattggtgcgactcctagcaattgacaattttagtcttaattagacttagcatatacgacagttacacttagcatacatgactctttcagtcttagcatgtaatattatttgagttttaatataagattattttattgcaaattagacttagtatgtaattattgactacggaattggtgcgactcctagcagttgactattgtagtcttaattagacttagcatatacgcacgaaacacttagcatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgcggatccaaaccagtacttgaacgaggaagggaacgtggagagggatgcggaggggaaccagcaggggcacgtgaaaagggatgtggaggggaaccaggaggaggaggctagtggtagtcaaccctccgttggacagaagagggcacgcaggcaatgaggtgcagcgaagaagcttgagagtcggcacatcataacggaagtggaagaagatggacgtcctattgccccggccgaagccaccaagaactatttacgtcacagcggttgggttgtgcgggataacgtgcctgttagtacggtgtactggcaaagaacaagggcacgtggagatcatgagagctttgtctcagattcggagaaagagatgctgtggaccacaatgctcgagacattcacccttcccgcgggtacagaggacaaagtgaaaaggtggactctgaagaaaatggcagaacagtttcagagcttcaagggagagctgtacaagaaatatatcctgaagaggcagacaccgaacttcgacacatttccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaaccgccaattggccagaacgatcgaagttctggtactatgctcacggtggaacgctcaacctagctgatggctcactggtcttcggcgatcagatacgagaggctgcgcgacgactaacagatacagtggaagcctcgtctcagggcacgttccgaccaaacagagatagggacgagctgacactcgccctgaagactccagagcttccaggacgaacacgagggaaaggggtgattccttggaagattggtttcaaggtggacatccacacgtacaggagtcggatgaggagtaagagagataccgaggcgaagattgcagatctagagttccgggtatcgagctacgaactcagcatgcaagaggaggtggcaaggaaggttgatgaacgcatggccgcacatcggtcccatgatccccagccgaccattcctcctgcaatggtgagcccgtcaggaaaccgtagcagctgcgcctcaacagggcaggtaggatcatagagcatggacgctatgcaaacacaggacgaatcgacctgtcccgttgatgacatcactcagcggacaccatgtgagctgcatattccttacaagaacttatcaataaagataagctcgtagtttatatattttaaatttagccattccgctagttgctgcttatatatgttgattactaataaataatctctcacaacataaaggtggcgtcgggcatggccatcccaacggacccttcaggtacttaccactgcaggccgattccagcaggatactcgaaggtcaaagttgagttggtcgaaggcgcgtacgaggacctccagctggattaccctggaggagacggtgagacgcatctacgagacacaagccatgccattattctatggcgcaggcggtacatcatcatcccttggcgacaagcggcgtctcgtgcaccatctcctccggctccaccatcaactcctcaggatcctgcaccgtctcctcctcattatccgccagcaccgtctccacctcaggctccagcaccgactcctcctcagtatcctgcaccgactcctcctcgggctcctacacctactcctccgcaagctcctcttttggcaccttcaaagtcaagggccctcccagctccaccgcctgcccccacaagggcaacgaagaaggcgaaagttgacgccgccaagaacaaggacccggggtatgattgcacgcaagaggagcttgacgctcatgtggcatcagaagtcaggagacaattgaagcctcgaagtccagaaaaaaagattcctatagacccgagtgtcaggaacttcttcaggggtatgtctgcacctgccaaggaggccataaagctattgaactatgagcgaaccctcaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccttacccacacaaatgtacaagttccatcagctttacatggagatgagcgccaccggtagagagatgatcgaagcgaggatcagggacacggacttcttgcaaggagatgacattctctggatcaatttcaggggaatctacgaactataccagctggacgccctcgacatctctattatgagttgctggattttgtaagtatgtcgttcagttagatttcttactatacgtctcctttaattagttaggtccttgtatataagtagactatagaaaataatatactcccttttatcattgtagaatggagattcaaagggcccgacggcggagggttttcgatactggattcatcgacactcggagagtaaacgtcgcaatgctcgaccaatatccacaagaaacagtggacaatctcgtccatctcctgaaggtgcagcattccaagacgttcatactgttgccgtacaacacagagttagtttaattttactgtcttcctacataccaaatttcattcccgtatgaacttgctaagtgtttcatatgtaatgcatcccacgcacattgcaaattccactgggtgcttttactcttcgacctgtcggcctgcaccgtcaacgtatatgactcaatggataaaaaagagtctacgtttgacaaggtttatgaacttatagataggtaccgtcataagttcctctgttaattaagaaaatcttgttatgttaattgctactacgaatcatagctttaaactccatgtagtgcttggtatcggttccgtcatttggtccgcggcaaatggagagaaagacttaggcggaagttcaaatttcctgtgagtacacatgctctacttttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgtagaccaaatcatcaccacaagagagctcgatgtacgtacaaataaattcaaaatttcattacgtaacgatttcttgtttaattgctaatcaatttcatacattcatatagtttattcgcatgagggataacctgactacacacaaggaatttatcgcggcggttcaagaacaactcatgggattcatcaacgaagaaatacttgatcccaagggtgaattctactacgacggaaacacaattcaccggtccttagcttctgagctagcagcgagtactactactacgtcgaaatcgtagctagctaggacatataatggattgtaattaatacatgactacatatgtttctatatgcatgtgtacacattttctataatgtaaatatattttggtcatatatatatatatatatatatatatatatatatatatatatatatatatatatatatatatatatatatatatatatacacacacacatatgcatttgcataacatatatattatgcatgtacttatgtacttatgtactgaaccatatatacatatataatatatatatatatatatatatatatatatatatatatatatatatatatatatatattgaatcatatatatgcatggtttatatatatataaaccatgcagcaacagggccatgaaaaaaaaaaaaggtcagctcgatctttagtcccagttggtaataccaaccgggactaaagatggctcagccacgtggatctttagtcccggttatttcacccgggactaaagatagcgatctttagttccggattggtactcccggtttaaaaaccaggactaaagggggttacaaactgggactacaaagggtttctccaccagtggctggttctagctatagattaatcttggttttgagtatcgcatttgttgtctagtctatgatcaatgtcaatctgtgtgttgccgaaaggaattttttttatctgacttgtttatgttagcagatcgagtctactcccaaaaaaacgcgtggtcacaattcgagtagtaggtcagaaggcaagtcttgttcgcttcctaatttcttgcgccaacagaacaggaaagaccgagattttcttcctgtgattttggtttattccaaaaaaaaaaagaaaaaaaaaagagctgctgcgtgcatatccatgcaaggaaatttcattccagtgctagcttgagtcttcttgtaatttaattagccggttgttccatttgatagccgccacttgttcaaagaaaaaaaaagaaaaaaaaggcaggaggtgcaaaaaaaagagagaaaaagagccgcaccaaaaaaaatcagaaaaggaaaaaaaagaaaaaaaatcagaaaaagaaaaaaaaaagagaaaaaaatcagaaaaagaaagtgtggaatttttttgttggaatcttggagagagttgcttactatagcaagttgtggattgttcgactgtgatcatttgcttgcttaagttaggattgagtctagactacggcagcaattttgactagtactttggactagtattcaatttcgcaaatctgtttgatttttgctattccttgtgatatagttaagcctatcaagatccacatactactaacctttacaggtccggctttgcaattgctccactcatcaagcgtgtcattgtgccacgaaccagccacggtgattgacctgttttgcattctttgagaatattataagaatttggtgtatgcttgagtgttgagtgccttcaaaagctccacatatctatagattgttaggaactgatactttcttgtgagtttcttttgcttgctaacgatgtcaggtacaagttccaatgaaccaacactggagaatgtatcgcataaactgaagggcatggaaagttggtatgaagagttgatgcgtaatagtaaatcatacaaggaaagcatagataaacatttaaaaaccttaagtgaaagcctggtgaaagtagtggatcaaattgagcaaatgaatcgatcacataaacaattaactgaaaacattcagaatatgaatattggacatgaaaatattgtgcgacgcattggtttacttgaggctgcaggtgaagaaggtgcaggtgccactgctcatcgacaccaaagatatgacgatgaagacgaagagaaatatgttgctgatgatgagtaggaagacgagagtgttggaaatagaagacgatgtcgagttagggagaaagatgattatttatctaaggtaaaatttactatgccttcttttgatggtaagtttgaaccttctatttatctagactgggagctaactgttgagcaaaaattctcttgctatgattttcctgataataagaaagttaaagctgccagtagtgaatttacctcctttgcatctctatggtggaatgatatatgtggtagaggacttagacctagaacttgggatgatatgaaacgtacaatgaggtctagatttgttccttcttactatgcttgtgacatgttaaataaactgcaacttttaagacaaggtcccaattctgtagaaacatactatcaagagatgatgattgctttgtcatgctgtgatttgcagaaactgaggatgctagaatttctaggttctatggaggtcttaatagagagattcgggatatttttgaatataaagaatacaataccgtgaatagattattccattt

SEQ ID NO: 80746 - DNA, 9229 bp, Oryza sativa
aacaccacgtcaatctactgctgcctttcgtccagcttcttccacaccacctaccttcacgccattccatgttcaagaaacaagcaaaaatgcttcaattcaaactctagccaagagtgaaacttcagtagtttccactggacgtacctgtgatactacatgtcataggggccatggcattggacacattgcatgtgactgtccaaatcggcgagctttatttgtgaacgctgatggtaagtatacttctgctagtgattgtgatgatgaatatgctttagctgccactgaccatgcaggaggacaagataatgatgacatcgaggaagtccatttgcatccagagtcgctagatcagtatcctagcctaattgtcaagctagcacttagtgctaaagagaagtgtaaagagcaaaaccaacgtcacaatttgttccaaagcaaagttcttgtgaaaggccataccgtgaaaatgattattgatagcgagagttgcaacaatttagcaagtgaagagatggtcaagaagcttggcttgactacccatccacatccacatccgtatcatattcagtggtttaatacatgtggtaagatgaaggtaacccgcttggttaaaatacctttttctataggctcctaccatgatcaaattgaatgtgatgttgtgcatatgcaagcttgttctgttattttagggcgaccatggcaatatgatagagaagttgtttttgatggtaggactaatacatataaatttatgttcgatggtaaaagagttgttttgcattttatgactccagccgctgctttgaaagatgatcttgcaagacttgaatgtgaaaagaaagcgaaaagtgaaaatcagattattgctaaacatcctgcttcaactagtaaaatagaaccaagtaccacaaagaatttagttttgtaatttagttggtattagagcttcagttgactagtgaggattttaattttgtaattttttccccatcatccactatacagccacaacacttttccgttcaccaaaccatatatttgtgccttgcgattatcatcctatttgcattattgaattttcgtccctcgtcgtgtcagtgctggtcatagctactgatgacgctctctctcgtggcccgatcttctggtgaggggataactctcgctttgatcgagtgcgacatttgcgacatagctaccaaaaagaacaagtccaggacgccgtgcaatcgctacaccacaaacgatgtcgtaccaaccgtgacgcgcggttgatgatccctgcaatgtaaacgagaaaacactgcaagaacaagataagatgcaatctaaatattgcgaataggtgattaagcacaaggaatagtttcgattgaagtggtagatctaatcgacccggcaaatcaacacaccaactattgggggctctgaatctaaagtcgccgactaatcgaacgagaactagagataaggtaaatggcacttggcaaaattcaactaaacaaaacccaattgtttttgaggatgtacaaagctatttatagaggaaaataaagctagggttaagtgctaattcgtggagctggagggagacacttccgatatgggcctagtctattataaggcccaaggcccaagttcggtttcagcaacaccactgtcttgttttggcgattcctgttgactcgagacgaatttggacatgagactggatgcgtttgaaaggtagtgagataagctatccacgaagtccaagatcacccaaatcggagttggcatgaagacgctaggtccgtttgaagtcagtgctgtctccggaggccgaactggacttggacttggaattatcattggaacatgtgaagttatgagcgtatccgacgaagtgatgtcctcattaatatgtgtgccacatgctatacttgtggtatctatgcttggtgccctctagggaaacaaagagaagattgatatcatgcaaatagctcttcagttcttcccataaaatatagtttttttatgttttgtttagacacaattttgtttatggtgttaatcaaaactgcttatttttttatggtacaaatacaatgtaatctttagaaatgagtgaggttaatcactaaaaatatatgtagctaaacaaacacgtgaccgtgacaactgtagtagcatataatataaaagttacaattttgtgataatttcccacgctattgttgcagcaaactgaaacatgtcgctaattttgcagcaaattgatagttttgttttgcagcaaactgaaacatgtcgctaattttgcagcaaactgatagttttgacgctaaagttgcggttttgtaaaatttactcttgtttatattcaagaaagatctatattttagcatcttgtttgttttcgtcacttgttgtccataattgcatgatacacctttagtaattctaaaattgtattaatttcccaaaattatttataataactaatttgttgaggtgtacttatagttacgtcactatggtatggtttggtttatgattgttatattataattcctcaactataacaaaatatatggtgaatagttttatactcatgctataggattgttcatttgttaccaaacctatttgacaaagaaaaaacgtatatgctcataattcttgtgatggattaaggagtcatattatagcaagatcattgccggagcataccaatccaatagttatgaaaaatttaaaaactttgagaatctcaatctcacacaaactaaaattaaatcagatattgtcacgcccggaaattcactaataatttccgaactaatttgtgcataaaatcctcgtccaggaatcagccgaggtacacaaactgacaatttaatatacaaatccatcataataacgttacatacttacaaaagaaaagaaaatagcagtggaataacggtctagcgatggcttcagctctactcccacaggcagctcaactggggtataagccaaacgccttctccttctggatcctttttcttcaactgaggttgattaattattgcaagaatgagcatatgacatactcaacaagccacacagcaaatatgcaaatgcacaaggataccaaaggatggcataatatagtcttatttgcgaaagcagcatttagcaaagagctaagagtagtaaaatagtagagtaattaatcagaaattttaatcaacactgaacagcacacccatgctgcacaggcccaaccatcctgaacaaccatacccggctatacagatctaactccaaaccaggagctaaacaaattattaccagttatagcatcaataattattgtgagaggtgtgagactaatcacgaaaaacattgctcaacccgcccataaccgcgggcacgactattcgaatagttttactctggccagaggtgtaccactgtacccacaagacacagccccacagcatgtcaccatgcgcctcaataccaccacggtaccttggaaaggagctgtgacagtacccctcgcagaacacaatccaccacagcgcacctttcctggatcataatcaccctcttataaaacaagacatggactctccagcgacccccgtgggcttatctccgccacttctcagtctggtgctctgcaatgaaccatgctatacaaaaggtaaagccattgcccacgctggcttgtggttggcacggttaatgtttcacaaaagtagctcgcgaaccggtccttaattgtcatgagcatgactctcaaaaccatgtgctcacaacctaccattatcaagttttagttggcaagtaattaattaaccaatcacgattgaccatcgtgaactatcattaagccatcattaaataatagtaagtcataagttatcccaatagtgtgctaatgtttctaagcatggctaagaatcatatataatatctagctgaaccaatatatacaaagctcaactagtcaaattataatatcccaaggtatcaaggaatagagtaatcaatgcaaacaggccataacaaaggaatagatttacaccacccagtgacattcgaaaataaatgcacagttgaaataaatagagaatttaaatataggatcaacatgctcaaaggattgtttgggatctgtgtgacttgccttgcaataatcggtcttcaattaatcttctgaacacttccgacgcactgacgaaccttcgcaataacggaaacgacaagctaacacgcaaaacgaagaaaaagactaataaaaaccaaataaacagtacaaaaacaagcataaacagtacatgtggatatttttaacatgttgatctcaattttagaaaaatttagagacttgaaccaactaaatccgagctaagatgaattagttatgaattttcaaagattaaatcggattaaaacacttatatggattttaattgaattatgacgcaataatgaattatttttgaaaaggaaaaggcaattattacgtcagcggctagggtttgcggtggaccgggtgcacggcggcggctcacggaaacaaatggccgagattcatccatccaaaacggacggccaagatccaacggtccacggccagaccacgagagacgatgacgatgacgtcaccaccggcggtggctcgggcgcgcaaactcgccggcaaacgacggcgcgacgacgcgaacggaggacaccaacacgtagagggcgatgcggcgaactcaccggtgaccaaaacaacggcggaagatcaacggacggcaacggcgtcgaggaagaagcggcggcgaccttcggcttgacgacgacggcgatgctccggcgacctacggcgatggcggataggcggacgaggtcggcgatggcttggtgatcacgacagcagccttcccgagcgacgacgacgacgggagcggcggcggcgcacggctagacgaacggcgatgacggcggcgctagactacacggtgctagggctctaccggcgacgagaggcgaaagcgagggtggcggcgggtagcggcgggcttgggggtccttttataggggcaaggaggcggcggcaaaggcccacggcgaccagcaacgcgaaggaaagtgtagggttcggaggagagagatcgatccgaatcgaactcgaatccacggatttccaaacgattttagccgatgattccaaaagagaaaaaggtagaggagatcccgaagatcatttcccctctatagatttctccggagaaggaaaggcgcgagcgaatttggaaggagacggcggcggcgcagctcggctagggttccggccgggcgacggcgcgatgaggacgacgagtccgacaggtgggacccacctgtcagcggccgagcgcgcgcgcgggcggctgcgggctgactgggccgaagaggagagagagggaaggttttgggccgactttcggcccaaagccaaaagaggacttctagaaccttttccaattaaaataatcacttaaattatatttgaattgttaaaaatacttccaatgctcaaataatttcaagaaaaatcctgaaaatacttggacactcgaagtacttaacaaaattataattagaccatctaatgattaatttaatatgtgggtaattactgaaaagctctttgtatgattaaaaaaaattaggaattgagctccgaaaaaatccgagaatattccagagagtataattaaccatggagaatttaataaaaattaaatccatctatgctttatatttaggaagttttatttcccacctttaacttcacttgtaaattaatgaacatttaatataaattctaataataatttattaaataatttataaatcctgaaagaaaaatcaggatgtgacagatataattaaaaaacataacgttgcttcatttttcatgcatttagattccagtttgtgttatataattgtcaagtgatatttgaccataaaatataatgttaaattatttcgaagattatcatgacattatttattatattctgcctaaattattttaaaaagtattatgatactccctccgtccgataatataagggattttgagtttttgtttgtgttgtttgactacttgtctgattaaaaaattacttattatatgtcagctccaggtgttgtaatgtatttagcactataatataactatgatatgttatcaagatttgaatgcacctgattataagttgactataaaatttaaaaataatctaaaaaatcgctgtttaaacacatttaatttgtttttatatcgacatagtttaacttgcatatttatatttggagtaataaattttattttatcgtatataaaatcctattttgaagtccgtctatatattttttcgatggttctaccaacttatattagtatttttcgggctttatagttttattatcgcgcgttcgtatgtttctttgctttttttcaatcgaacatccagtaaatggtttctctggtatacggtatacacaggagattaaaaggaagtgggctaatcttatgatccaaaataatgggtccatcattttgaatgaaatttgacaacgaaattatatagtaccacgtggcattctaatagtgcttgctgaaacaccacatgaccatatttgtggagtgataaattttatttttatagtatagcaaatcctattttaaaatgaccgtatattatgtaccttttttaacggaacagtactatatagccttatttttactcgtgcatacgtaagtaattttttttcaagtgaacagtatctttttaatagctgctccctccatcccaaaaataagtgcagttttgcactattcatctccaacgtttgaccgtttgtcttatttgaaaaatttttataattactatttttattgttattagatgataaaacatgaatagtcatttatgtgtgactaattttttttataaatttttcaaataagacggacggtcaaacgttggacatggattttcatggttgcacttattttgggacagaggtagtattacataggtaattttttttcaaatgaacagtactgtacgtacgattacacgatgccatcgtacgtgcgtgtgcgtacctatgttgaagggctagtttctttccatagtacgtacgcaagtttttatggtgtaaacggtttcactcatatctataaaatattaagagcgagcaatatatgtattctaatggtcttaaataacggacccattaatttaaatgaaaattgatggtgagattttaaactaccacgtggcaacctagaaacaacatttgtaggagcgccacgtggtggcttagaagcgtttgtagaaaatttaatggacttttagtatataatagaatagatatccacatgatgatgttgtgtcaacttcttcatcgacgatggtaatcagtgggcacgaaatttaaatctcttgggtggctttcgaataatgtcaaggttcttggagattaatcaatcccagtacgctttgtttgatctttcaagtggtgatgtcaaagtgagcaggcaacctacccgttggaatgcggggtatgaaaagaaagaataatatttacgagacgagctgagttgcattggtttgattaagattccagaattcttgaaattttggcaaagagaaatgggattccatcgagctagaggagcaattaacactggtagagaaatcgtttttagtcccggttcgtaacccccctatagtcccggtatttaaatcgagactacgaatccgggactaaagatccctctctttagtcccggttcaaatacccgggattaaagatcgatatttagcaccaaccgggactaaaaataggagtggcagtcacggttagttttttttttcatttattgctacttactatctctaatttattttctcccaaattaggtgggatgcatatccccaaatcaaaccccaaatcaaagtcaaaccccaaatcaaagaaacatcccaaatacacaaatcatgtacatctcagatccatgcaataaatcacagattctaaaaaagaaattatacatctcaatccatacaatgaatcacaaattcttcatctcaatctatacatggatcacaaattcttcaaaaaaaaaaaggaagcaaagccgccggccggctgagccggctgctgcctcccctcctccccggccgccgccgcgccgccctctgccggccggcccgccctccccctcctgctgcacacacgggaagggataacaaagaaaagagataaggaggaagcgaagaagggaaaatattaggattagagatgcagagagagagtagtttgtgtggacgggaaaagagaataaataatagggattatatagtgcgctttgatctttaatctcggttagtaacatcatccgggactaaaggtcatcgtgatctttaatcccagttagattaaagatccgatctttactcccggttggtaactccaaccaggactaaagatcctaaaggggcctgacaacacgactaaagattctctggaggggcctgccaacacctgatagtatgtgaatcaggactaaagatgatctattaaaaatcatgtagtctcgttctgcttataaaccgggactaaaaaccatctttagtcccgatttttattgcaaccgggactattatggttttggtcgaccgggcaaagataatttctccactagtgtaagtagcaatggtacttgaagcatatagctaacaatctcttgctgcatccattctcatctgacgaaggacgatgaaaatgctgagcacggacgagctaggagattgtcctactggccgtttgttggtaagaagaagcagcatgaatggccagcatgcggacgtgtatatgcacttgtggctccagctctcatggcggatgtttggtcgattcatcacatagaggcatgaccaccaacaagcatcaaaagcgtctccaagccatatcgatccatgacattgtccgactgctcatcaatggctcctagtgccttccatgcctatggggatagaggacacagagcctgcgaagagcatgtatcgagccacgatgttgcatgggctgaaagtatgcttcagtcatttctctgttttttatgcgtaggagtatttataaggattcctgtaaaaaaaattataagtacgtacttgcgcacttgcag

SEQ ID NO: 80747 - DNA, 9361 bp, Oryza sativa
aattacaaaagataattctataccaatatgttctcataccttctcctatcttagtaaataaattacaaaagataattctataccaatctgttctcataccttctcctagtaaatgaattatgtggtgatgttacaacaaaatttttcttttaaaataaattaatattaaccaatggttctcgacataaaattattatgccgatagttgtcaacatattaatcttgctacaaaataatatttgcacgttattggccttctcttagtaaataaattacaaacgcatacccataacatttctcttagtaatacattgacggatacctaaacgatttcggtattcaaagtccttcgacgaacaaatggtagtattttttttcctcaacgatatacacagctgttattctggcagtaaaaaagttcctaattgtcatgcctggaatttctatccaaaattccaaacgcttacatgtatgtaaaccctcgtccagtaatcagccgaggcacacaataacaaattgataatagagtacaattattactctaattaataagcgaataaaatgtcattacaggggtagatagttcccctcaaacaataaagttctaagcagtggaaaataaagaaacagcgcaggcgactcctctccacatgcagcttgatcagggctacgcctaatcatccacaccatcagcatcactgtagaactcctcctctgatgaatgattgcaaggtgagtatatgacatactcagcaagtcacgcagcaaatatgcaagtgcacaggataacaaagaatatcatagtatagtctcatttgcataaatagcatttaataaatattttagaatttaataaaacagttaaataataattaaacaatattaatccaacgctatacaacataccctgttgcataggcccaaccattctgatcaaccaatcctggctgcacagttctatctccaaaccaggaattaaccattccaaaccaggagctaaataagttattaacatcaatatggtgagaaatgtgagactaatcacgaaagacattgttagaccagcccataaccgcgggcacggctattcgaatagtttgaactctggccagaggtgtaccactgtacccacaagacacaacctcaacatcatgtcaaccatgcgtcgcgatacttgacaagtacccgaatagagattgtgacaataccctctatataatacaattcaaagcagtgcaccgttcccggatcataatcacccccttataaataatgtatggactccccagctacccccgtgggcttatctccgccacttcacagtctggtgctctactatgaaccatactatacagaaagtaaagccgttgcccacgctggcttgtggctggcatggtaaatgtttcacaaccgaaaatcgtgaaccggtacttaattgtcaagagcacaaccatcaaaaccatatgctcacaacccaccattatcaggttttagttggcaaattaattaattaaccaatcatgattaaccatcatgagctatcattaagccatcattaaataatagtgaagcataagttatcccaacagtgtgctaatgtttctaagcatggctaagcaattatatctagtatccagctgaacccatatataaagctcaactagtcaagttataataacccaaggtatcaaggaatagagtaatcaagaacaaaaagggctataacaaaacaataggttaattccacccaatgatattcgaaaataaatgcaatagttgaatagaaacaatagctttaaacaggattaacatgctcaaagagttgtttgggatctgtgtgacttgccttgctggccttgaaattcctcaaaatcttctcctgcaaattcggactctccgggaacgtcagaatctaaagagaaaagaacaaaattgtcacgtcccaaaacgactctaaaatacatcctctaaattatgcctagaataattaaaatccgtgtgaaagcctccaaccattaaaaggtgcaaagttaaaagtcaaataaggcttgggggatttttgtatatttcctaaaagcctaaaatgcgtaaataaattttagtggaattttcagagcacaaataataattattaagaaataaacaaagttaaaatgattttataaaaagaaaaactctaaaaagtcccctttccctccctctccctcttgggccggctcggcccatctccctccccctccctctcctgtccccgcggcccatccggcctctccccgcgcgcgcgccgctgacgggcgggcccgcccgccaccctcgctgatgggtggggcccacccatcatccccttcctcccgctgcctcgcccgcgccctagcgccgccgccgccgcgaatcccgccacctcccgccgtctccgcgtgcaataaagagggggaaatcactccccgtgatcccctctccctttaaccccatttttccctctctctctcgcgttcaaacgggcggatttgcccccgcatatctcgccggcgccattgatggcggccggacctcccgcgccggtttcctcccttccccggccaccctctcccgacccagctctatttaaaccctccccgcacctcctccgtccgtttccgcctctcgccgcccttcctcctcgccggaatcgagctcgcgccgtcgctctctctctccgccgtcgctgtcgagctccggtccgccgccgtcgtcgccccggaccacctcccaccttggcgccgcctccttcggcttcgccgcatcctcgccgacctcgtccacccctccgtttcgctcgccgaccgccagaacgccgtcgacccgagccgcgccgccgccttcctccgctccggccgcctttttcgtcgtcgccgtcgacctagggtgagccgtggaccgccgcttcttttcccccttcccttcccctctctcggccgccgctccgccgtgcctatggccaccgccggcgaccataggggcgcgggcgctgcctcccgccggctgcgccggcttggccgccctcgggcgcgccgagtggctgccgcgtggggcctggccgtcagccgcccgcgcccttaggtgcggctgacgcgtgggacccacggcgccggccgatgtaagcccgggtgcacccggtccaccgtggaccgtgaggctgccgcgtggaccccactctcgtggacccggtccgcgcgccccctcccctcggctgacgcaataaacccttttaaaattaaaatttaaatgaagaaattcgcaaatattcatttaaagagcatataaacttcaaatgaccataacttggccatttgaactcggaattggaccgtttaagtctctaatttttccttaagaagtcaagaacccatttttgtgctttgttccagcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattatcgctttttttaaattcccgcgttatcattgttttatctagccatgcctatgtacctttgttatgaccttattatccttgttcaccctagaataaacaaaaccccaactagtggacactctactcatggtaccactagtatgattttagttagatgcttcgctggttaattaggtaacattaggtggtttacaactctagaccttgggaatactcttattacctggacactatggaattgttggattattgtggaattggattcacacctccccctctattcaaaatcctcaaaatggttttaggctgggctcggggtgcatggttttgatagtagcacctcggccatataaggaccggtcttcgggcctctgttgcaaagaactaccgtacttccacatgtctagtgggtaaggcttagtttgtggctcagtctggttataaacaaaagtacacggatggagatagacgaagtcgggggtcgatggacatctctagggcaaatgaaggctacacgagctgcggcccggtagtcgagatgtcatggcacagggccggtgtcctgctgctaggggctcagtcctgcctacctgtcccgggggttccggccgtaggtggggttgggtcagtactcttgtctatggcaaggatgggttggaaactatgtcacgtcttccgtccgtataccgtggtggtatggggcacgtggttacacgtgaggaagatgtgtcttgcgggtaaagatgtacacctctgatcagagtataatctattcgaatagccgcgccctcggttatgggcaagccgagcaatgtacccaagttagtgttttaattcttaaaacctgcttaacaactaaaatgtgaaatggttggcctgggttggcttgggacgagctgggacccagggtcaggttgctagttcggtctaaatcatcgtaggccttgggttaaggcaggttcgtgtgggttcacggccttgtttaataatcttgtatagctctaggatcgtatttacaaaatagctttgagcaactaagtgtcttttaatgctgtttgctgcaaaccctaaccctttatattataacccccttgtactcccttgcatttatcctgcacttgtgggtgtgtcttgttgaatacggtggttgtactcagtcttgctcaatttttccgaaacccagaagaggagcccctggaagatgaaggctttggtgtctagctcgcgcctgccatcaagcgcctgtggtcgtcgccctagccttccgctgtttcccatttgtctttgtgtgtgctgggccttcgccgcccatgtaataaattaattaattacgcttcagcttgtaaactctgaattgtatcaacttttggtgtaccttgcctcctgggacaaggaataatgcacgcacgtaaggaacgcccgttgggttatttccggtcgtgacaaaaatcaccaaaacagcacataaacaagcatgaacagtacatgtggatatttttaacatgttgatctcaattttagaaaaatttatagacttgaaccaagtaaatccgagctaagatgaattagttatgaatttttaaagattaaatcggattaaatcatttatatagattttaattgaattatgacgcaataatgaattatttttgaaaaggaaaaagagattattgcgtcagcggactcggctcacggtggaccgggtgcacggcagcggttcacagaaacgaacggccgagatcgatctatccaaaacggacggccaagatttaatggtctacgaccggtctacggcggacggtgtcgatgacgtcagcggtgacgtcatcaccggcgacggctcggacggcgcatcctcgccggcgaacaacggcacggcgacgcgaacggaggacacctacgggttgcgggcaacacggcgaactcactagtgaccaaagcagcggcggaaggtcaacagacggcgacggcgtcgaggaagaagcggcggtgaccttcagcttgacgacgacggtggggctccggcgatctacagcgacgacggaggggcagacgaggatggcgacgagatgacgatcacgacgtcggccttccctagtgacgacgacgaccggagcgatggcggcgcacggctggacgaacgacggcgacggcggcgctaggctacatgacgctagggctctaccggcgacaagagacgaaagcgagggtggcggcgggtagaggagacaccgggggtccttttatagcggctagggggcggcggcgaaggcccacggtgaccggcggcggcgatggaaaggttagggttcggagagagacaaatccgattcgagatcgaatccacggatttccaaacgattttagccgatgattccaaaagagaaaaggtagaggggatctcggggatcatttcccctctatcaatatgaccggagatggaaagatgcgatcgaatttggaagagcggcggcggcgcagctcggctacggttcggccgggcgacggcgcgaggaagacgacgagtccgacaggtgggccccacctgtcagcgggcgagggcgcgcgcacgcgggcggcgctcggctgcgggccgacctgggccgggaaggagagagagagaggtttgggtcgactttcggcccaaagccaaaagaagactttttaaaacttttccaatttaaatttttcatgaaatgcaattccatttattaaaaatacttccttggctcaataaatcccagaaaaatctaggaactatagaatcaagcaaagtatttaataaaattttatctggcccaattttatattggaatttattatttaaaattagatcttctcttctaggcttttaaaattatttctaataattccaattaaacaataatttatatatttgagatttttagggtgtgacactaatacattttttttagataatggaagtattattaatctcagtaaaattctatcaagtgatacaattattctgagagcacctccggcttctgcacccaaagagtgcacacagccaacaagaaagaaacgaaagataaactcatcatccaaatagcagggacaaaaagaacttcaggagccctctaaccgtagcctagaatgccacccatgcgccggggtagaaaactccatggccactagctccaattgttgacaagccggaatgatagttccctgcaaattgaccttctgaaggatagcccatgagcggagccaatgtgtaataaaaaagataacctgcaaaggagaagatatgtttttttctttcaaaaaccacatcatttctgcaaagccaaatagaccaaatagttgttgttgccctaacaagaccaaaaatctcaaattgcgtggttgtcttcttatccaatgcccaaacatatgagttgtactattaggtaaactaatattcgaagcaaactggattaaataccaaactgcgcgggtaaaacgacaatcaaagaacaaatgattaatagtttcatctttatggcagaaagaacaagacttgtttcctctccaattcctttaaataagattatcttttgttaagactactccacgacgtaagtaccataagaagatcttaatctttaggggggctttgatctttcagattcttttgtttatattgggaacattggtctccaccaacgcaagataaagagatttaaccgagaatctgccatcagtggttagattccatttaaactcatcttggtcgtgagataatataatattagcgatgcgtgagagaaggtgattccgcgctactaacttagagccagtaaggtccctacgccaagaaaagcttagaggactggtttggaaaatttctgaaatagttgcatgtttatgcctaacaacgttatagagacaaggatattgttctcttaaacaggcattctccaaccatttatcttcccaaaaccgaacttgagagccatctttgatgttgaaggagccaaacctgagaaaatcaggcttagccttcattagactagctcaaaagtgtgagtctcctgctttccactaagcttgagacaaaggctgtgaccccaaatatttgttccttagcatttgttgccacacaccatctgtagtgagtagtttatgcaaccacttgctaaggagagccttgttcttaatttcaagatcttgaattcccaacccccttggtctttaggacgacatatgatgtcccaccttgctagtctatatttccttttgtgtccatccccttgccaaaagaaccttgatcggaaataatcaatcttcttgatcactcctttaggtatttccaaaaaggacatcatgtacattggtaggttggtaagcactaaattgattagtgttagttgccctccaagtgataaaagtttgcctttccaacttgccaaccatttttcaagccgttcaatcacttccttccactccaaattacgaagtctcctatgatgtataggaatgccaaggtaacggaatggaaaagaaccaacctcacatttaaaaaggttagtatattgatcctgaactgtttgggcttcaccaaagcagtaaagctcgctcttatggaaattaatctttaagccagataattcttcgaaaacattcaacaacattttcagattacaacctttctctagatcatgttccataagagtacagtatcatcagcatattggaggatggacaatccaccatcaatgagatgaggcaccactccaacaagctgtcctgcattaattgctctctggatcataaccgctaccatgtccgctataatattgaataaaatgggagatagcgggtcaccttgtcgaaggcctttctttgtttgaaagaaccgtccaacgtcatcattaactttgattgctatacttcctcctgaaatgaaggactcaatccaagaaatccatcttggcgagaaacctttcatgcgaagagtttgtagtaggaaaggcaattttactttgtcataagccttctcaaagtcaatcttaaggatgaccccactcaattttctgcgatgcaactcatgaacagtttcgtgtatgacgacaaccccatctaggatgttgcaacctctcatgaaagctgtttgagttggactcactatacggtcagccaccgagtttattctattagtggccaccttagtgaaaattttgaagctagcatttaggaggcaaattggtctgtattgttggatacggttagcttccttgactttgggtatcaaagtgatcaccccaaagttgaggctgaagattggcaactccccagcatgaaattcattgaacatggtcaacaaatcgtgcttgataacatgccaaaacttctgataaaattcagctagaattccatcaggacccggtgccttatttgtctccatgtcaaagattgcctcccgcacctcctcctcggagaaaggggcaatgaggtggtcattttcagcctctgtaacttgggggatatcatcaattctatttgcatcaaaagagagagtacttgcatcaggtggtccaaagagtttcttataaaactcagtgatataattcttaatagcttcattccactcaatcttaccttcctcttgatctagactgaaaatacgtttcttccgatgtttgccatttgcaatcagatgataatattttgtattattatctcccaaacgaacatcatcagtctttgctctttgataccacttgatttcttcctcccgaaggagttgtgctacaaga

SEQ ID NO: 80748 - DNA, 3904 bp, Oryza sativa
cccgaaggagttgtgctacaagatccttaattaacatatgaacttatgacagtacctatctataagttcaaaaaccttgtcaaacgtagactcttttttatccattgagccatatacgttgacggtgcaggcctccaggtcgaagagtaaaagcacccagtggaatctgcaatgtgcgtgggatgcattacatatgaaacacttagcatgttcgtacgggaatgaaatttggtataggaagacagtaaaatgaaactaactctgtgttgtacggcaacagtatgaacgtcttataatgctgcaccttcaggagttggacgagattgtcctctgtttcttgcggataccggtcaagcattgcgacgtttacttttcgagggtcgatgaatccagtatcgaaaaccccccgccgtcgggccctttgaatctccattctacaacgataaaaggaagtatatattatatatagtctacttatatataaggacctaattaattaaaggaaacgtaataagaaatctaactgaacgatacttacaaaatccagtaactcataatagaaacgtcgagggcgtccagctggtatagttcgtagataccctggaaattgatccagagaatgtcatctccttgcaagaagtccgtgtccctgatcctcgctccgatcatctctctaccggtggcgctcatctcaatgtacagtttatggaacttatacatttgtgtgggtagggactacagctgctcaggcttgacaagcggtttaccgagttcgtacatgtatttcacttccgccttttcagttagtgcgcctcgtagctattgatccgtagttagcccggtgtcattaataaagtcttgtattccaaaatcttcaccggtcaccaacggctcgatctcctggtttggttgctctccaagctgagggactggtttggactttccaaaagatgctttcttgagtgttcgctcatagttcgatagctttatggccaccttggcaggtgcagacatacccctaaagaagttcctgacacttgagtctataggaatcttcttttctggacttcgaggcttcaattgtctcctgacttctgatgccacataagcgtcaagctcctcttgcgtgcaatcgtaccccgggtccttgttcttggcggcgtcaactttcgccttcttcgttgcccttgtgggggcaggcggtggagcttggggggctcttgacttggaaggtgccagacgaggagcttgcggaggagtcggtgcaggagcctgaggaggagtcggtgcaggaacctgaggtggagacggtgctggatcatgaggaggagacgatgaaggagcctgaggaggagatggcggagccagaggagatggtgcatcagacgccgcttgtcgcccagggaagatgatataccgcttgcgccatagaataatggcgtggcttgtgtctcgtagatgcgtctcaccgtctcctctagggtaatccagctcgaggtcctcgtacgcgccttcgaccaactcaacttcgaccttcgagtatcctgctggaatcggcctgcagtggtaagtacctgaagggtctgttgggatggccatgcccgacgccaccttcacgtggtgagaggttatttattagtaatcaacatatataagcagcaactagcggaatggccaaatctaaaatctataaactacgagcttaccattattgataagttcttgaagggaatatgcagctcacatggtgtccgctgagtgatgtcatcaacggggcaggtggtttcgtcctgggtttgcatggcgtccatgctctgtgatcctacctgcctcgttgaggcgcatttgctacgatttcctgaagggctcaccatagcaggaggaatggtcggctggggatcatgggaccgatgtgcggctatgcgttcatcaaccttccttgccacctcctcttgcatgctgagctcgtagctcgataccctgaactcaagatctgcaatcttcgcctcggtatctctcttgctcctcatccgactcctgtacgtgtggatgtcctccttcaacccaatcttccaaggaatcactcctttccctcgtgttcatcctggatgctctggagtctgcagggcgagtgacagctcgtccttctctctgtcgggtcggaacgtgccctgagaagaggcttccactgcgtccgttagtcgacgcgcagcctcgcgtatctgatcgccgaagaccagggagccatcaactgggttgagcgttccaccgtgagcacagtaccagaactttgatcgttccggccaattggtggtggccagttcgaaacccctctcaatcaagctagcctccatctcctcccacttcggcatcgcgattctatagccgcctgaccccaagtggtgatggtacttcttctttgcagcattttctttgtttctttccatcatcgcctgcccttgttgatctgtcttatatgcaacgaactcgtcccagtgatcccttagctttgggaatgtgtcgaagttcggtgtctgccccttcaggatatatttctggtacagatctcccttgaagctccgaaactattctgccattttctatagagtccacattttcactttgtcctctgtacccgcgggaagggtgaatgtctcgagcattgtggtccacagcatctctttctccgaatctgggacaaagctctcatgatctccgcgtgcccttgttctgcgccagtacacagtactaacaggcacgttatcccgcacaacccaaccgctgtgacgtacgtagttcttggcggcttccgccggggcactaggtcggccgtcttcgtccacttccgttatgatgtgccgaccctcaagcttcttcgcggcacctcgttgcccgcgtgccctcttccgtccagcggagggttgacttccactagcctcctcctcctggttcccctccacatccctctccacgtgcccctcctggttcccctccgcatccctctctatgttcccttcctcgttcaaatactggtttggatcctcgttcccctcttcttcgttccagtactggctacttccctccgcgattgtatagtacaatatctgttcctcatcgcgatcagccatctgttcatacaggaaacagttgctaagtcatgagacatttttgatttaacaatcttatgtgctaacaatcatatatgctaagtcatatatgctaagtctaactgtcgtatatgcgaagccatatatgctaagtctaattacaaatctaataatcgtatattaaaactataataatcttatacgaaaactcaaataatcttatattaaaactcaaataatcttatgctaagtctaactgtcgtatattagaaccctacacaaccttatatgctaagtctaattacaaatctaataatcttatattaaaactcaaatagtcatatatgctaagtctaggaaacgtatattaggaccctagctactcaataattatatactaagtctaattacaaatataataatcttatattaaaactataataatcttatattaaaactcaaataatattgtattaaaactctaactataatgctaagtctaagtgtcatatattaaatctaatagtcttaattgcattaaaaatataacaatcatatatatatttacgtcacttgcctacgcgaattccttcgagggctagctaccactccggcttgagggacgacgacgataacgtcttttctgcaacatacaaaaagatgtattaggataaacacgaagtaacatatattgtatttcacgttcacgtttcgttcacgatcgttcacgttcgcgttctcgttaaggtcacgtttcattcacctacgttcgttcgttcacgtgcgtccacgttaac

SEQ ID NO: 80749 - DNA, 1445 bp, Oryza sativa
tagaaaataatgcattaaaattatttagagtcaaaaaattaatgacaattacttcaaaaaattattgttgtctgtagtaaattaagtggataaaacgtagtaaacaaatatatgatttaagattaataaaaattctaataatcatatatactctaattaaacatatgtatatacatacgccatgcatgatttaaaattaataaaaattctaataatcttatataattagcatatgaatgatattaaattaattcataaaaactctaattaacatatgtaaatacatacgacatgcatgatttaaaacttttaacaattctaataatcatatataattagcatatgaatgatattaaattaattgttaaaaactctaattaacatatgtaaatgccacatgcatgatttaaaacttttaaaaatttgaatagtcatatataattagcatatgaatgatattaattaattgttaagaactctaattaacatatgtaaatgccacaagcatgatttaaaacttttaaaaatcctaattatcgcatgtaactagcatatgcatgatttataattgttaaaaactctaagtaacatatgtaaatgccacatgcatgacttaaaacttttaaaaattctaattatcgcacataactagcatatacatgatttaaaattgttaaaaactctaagtaacatatgtaaatgccacatgcatgatttaaaacttttaaaaattctaattatcgcatataactagcatatacatgatttaaaattgttaaaacctctaataatcgtgcgtaattagcatatgccatacaacaattgatttatatggataatcaatacatccaaaatagtttacatcatgtacacaataattacggcaatacatcggcggtgacggttgaccgcacgtactttctcctcactattgttccctccttgtgatcgctacatgagtaaggtgtgtcttcatttgataggaggatgctagggtcaatcgtcaccgtgaaagggggttgcccatccaactgatcgtaatcctcgtcagtcttgtcctcaactccgacgatttttcttttgcctgggagaaccacgtgacgcttaggctcgtcaggccctctgcccttcttttctttgctagacatgtccttcacgtaaaagacttgcgttacatcattggaaaggacaaaatgttcgtccgagtatccaaccttgttaaggtcaaccgttgtcatcccactgtcatcaatcattatgcctccaccagtcaacctaacccattggcaccggaacataggaccttgagaggaccatagtcaagttcccatatgtcctcgatggcaccgtaatacgtgccagttgttccatcgtgtcccatggcatcgatacgaacaacgctgttttggttcgtgctcttcatgtcttgggctctcgtgtagaat

SEQ ID NO: 80750 - DNA, 530 bp, Oryza sativa
taaattccccccaccacctagtgtaactgtatcccactgttcactattttggtgggaggctgtaggggcgattttttgtcctttttccaaggaaaacagaaattaaattcccaaaagtgatcaaaatgaatcaatcaagtgagtaatattattcattaattgagcaatttcatcatgtcttacttttgcaatactgatcttacaatatgtgcctctaatttgttttttttattttgtagcaattgatcgaagttggatgtatgcaaaaaatttgaaacatcattctacggagtacagaaagggtgtaataaattttatgaacgccgcggaggaggatcggaaaagaagaaacagtgattatatgtgttgtccatgtgcagattgcaagaatgagaatatgtttgatagcggagaggacatacacagtcatctgatacaacgaggattcatggagggctatacatgttgggtgaagcatggagagcaaaaatcaggaagtggggcagcagcagacagaagtggtgcgcata

SEQ ID NO: 80751 - DNA, 742 bp, Oryza sativa
atcaccggtgatggagatcggccggtggtactaatggccggacatgggagagaaagagagaaagagagcttgaggactcggtttatgtgaaggggaagaggggacctcctcatccttttataagccggcaaaagccgtggcgtaaggcggttccgaggaaaaaaataagagaaccccgcgaccggggcgtggaaaaatggaacaccgcgcccgctctattcgttgattccgcgggtccaatccgcggctgacctccgcggcgtgatgtctcaactgacgtttgtgacagatcctttccggtcaaaggaaaaacacagcggcggcgcaaaaccgcgggcggcatccggaagtggccaaaccgcggcgaaagcggcgccctgtgcgtgcgccaagtgcacccaaaagaagagggagcggctctgccatgggcccaatttggccggctcggctcggctctgctgacaccccaagaggggggaaggagacatgtaaacttgtgctgattgggttaattgaagggaattcggcccaaaatgaatatggggtttaggaattttgtgtggagggatttgaaatggaatttcccaggagatgaaaactaatggaaaatttgaatggaggggtttaattaaattaaaaaaagaaatatttgggggttcttttgaataaagagtttaaaagcaaaaggagtttgaaatattttttaaaaaaaaaatcaaagatatttattttaagaaataaa

SEQ ID NO: 80752 - DNA, 727 bp, Oryza sativa
cctgaaaaaatttatcccaaaaatggtcctttatagcgcgccagagtggctggcgccgtcatccaacgggacggcgccagcatgccaccgtggcgcatgcgaaccgacgtggcatgaggagggcgccagccatactggcgccgccccagggaggagggcgctagcatggctggcgccgtcgcctccattcctgtttctctgtatggagttgcaacggtgtcatttttattttatttttttggatttttttttcacactcaagatcacgatacaaccaaccacaaaaaaaattaaactcgaactaccacttagctaagtctgaaaatagttagcataccacttagtctactttgcaccttcactaaaattagaccataattcatttagtaaaaccctttgattagcatgttaaatataatgcactttaccactatatgaaattacttaatctaattcaaaatataaccacatgaaatgacatatataagttaaacagtacatagagatgcaatttttttatttttatttcatttttttgatatttttttcacacttaggagaacataggaaccaaccgtataaaaaataaactcaaacggacaaaatatgtgacttgtagaattttccaaaactctaccgaaacggacaaaatatgtcatctattaaaataggcgtaactttctcatacggactcggaatcaggcaaataatatatgcacgaacatct

SEQ ID NO: 80753 - DNA, 1621 bp, Oryza sativa
ggaaatagcttgacctaaagtttaaacaatgagtgcacaagtctgtataaaaagacaagaaccttttgttatttgttagatcatcaaactaaaatgcgattgaaaagtgcagcttgataattggtaacagacctaggagaatgggaactgttaagaatcagagaaaagcaaaccgttttcaacatgcttttaggacattttctctagaggaaatgaagacttttttgggtataggtgagtaaagtgtatcttgtgatgttcagtgtactgtacttatgtttggtgcattggctgttgagatattacacaattctgctatatgcatgcctgcaatgtgcacaggacacccttgtactttttttgataaaggtagctatttactgaaaaaaaaaagacctatttggttagggtcatgtcacagtagagtgcctagctggcgcataattatgtctgataaaaaaaagggtttcatatatgtcttttggtaacacttgattttttttttctttttgctcactttgttttaatacagaactctctctgaaggttgacacattttccttggtgtgatcaggagatactggtatttgttcactagccaaggacatactttatcaagaatacactccaagggatgattaattatttaatcaagggaaaaggatactgcagcgtcaaggtaatttccaggattccaccagtcatatgttagttttcttttattttctgcttctctgaagttcttttcaacctcacccccagacaacatttttttctaatatagttctgaacaaacagcaataacttggtgcaaggtttgatctccaatctgttaatgactctgaaagtaatactacctccgtcctattttaagtgtagccatgagtttccgtgtccaacgtttgaccatccgtcttattttaaattttttattattattagatgataaaacatgaatagtactttatgcatgattcatttttgttaaaattttcaaataagacagacggtcaaacatttgacacggaaaatcacaactgcacttaaaataggacagagggagtaccgagttattcatgttggacatgctacaaagatttggcttattgtggatcagttcacctgttgccatcatatacagcaacacttcgcaatcaatggataccaaaagcagaaagagaactaaaagtagagtcagtaaagcatctagatttcacagctgatgcatcagatgcaatacacaagggcaatttaatcaattaaatcattaagctagaacaagacagtgggctcacggcatgtatacatcatatagtggataatggagatatcctgcctatcctacatgttgctgctatctgaagtatgtgcagaagacaacgtggcctacattcttacagcttttcttggaccaaatatgtttcctagaattgacaattcgacaagataagaatctgcagactgtaacaaggctgtacgcgtaccgatgatgattcaagtaaatctgatttggtaggcttaaattcccatccgcggctatagaaacatcgttacttttccatttaaagcagaaacataattacttgatggatattatcaaatataactggggcattgagtt

SEQ ID NO: 80754 - DNA, 18156 bp, Oryza sativa
  unsure (1)..(18156): unsure at all n locations
atagattcactttcaagcttgaagaaagcaaaggaagaagggcatccttatctaatgcgggtcacatctgttcgacagctctgaagatccggtgtcatttggaccacctgccctgctgcagtggtaactttcttcatccacacactttgaaattctttagcaattactagcttctaaaccatattaattccaatagatccgcagaccaataattagctccacttaagttcacatgttgctacagcttcatgtagccgttactcgggcggtcggccgttggccagctgcagcctgcagataccggagcatacaatgtaccctgcacatgtggagccttgctctatacatctcacaatccaaaattttgacaacaattcctagttaatactttgactccacctgttactagctgcctgacgcagaaaattggcaaatgcctgtaccactgtgcaaggctttggagttcggagcttaaatggcacacctctccatgtgggcagataaggtcgtcctgagaatgagctaccgacccacgccctctcttcatgctgcagccaccgacactgtttgaatttctgcactaatgaattgctttgctactagtaccacccaccagggattattagttgctgtaagagacagttttggaggtttgcttgatctcatgattcatcagctcgatcgttttgtaggctactgcacagcacagtgttgtccgagagctcagtttcagcaaggaggggggggggggggggttctgtccaatcatgggcatgccgatgatgggcaatttcattgtaaagggtaccgacacatatggtgagtaccatagcattaaaacgtctagcgagatatactttgtatacgttaattgctcctttatttgttgatttttttaggaagattttatttgttgatttgatcctactggttaaattgtctggtcagtcatgctaaactgatcatggtaacgggccagaacttacctgcaaatcatcagatatataaatgtcagtcgtcacacctaaacaatatagaatgatgccgacaattaagagcaacattctttaatcctgatatcgtacattttgaggtcgtagaacatgtaaaaagaatcaacaaatggaaggcaaatgttgttccaggtgtgcatttcttttactttagtcatccaaccgtcctctagatccacaagaacattgctaaagtctccgggcaaatggatcgaataaaaagccttttttagatcgcttagttgtttcaattccatcagatcggaacctcgccataatgcaagctttacttgtcatgattctctagaagaaaggcatcaaaggagataggtaagaagaatcggttcggtacgcctctttaatcaggctcacgtacggttgatccattcagatcattcaagaagccaagggggtcctacttgatcgcactaagcacataaataaggcctaatgcaaccaaaaggttgtgcccccaacaaccaaatcagaagatactgcagcagtctgcagctaggattagtataaccatcctagcatttgtacattactagtcgtaatattttgtttctccattaggtgcttgatgatatcccctactatggttactctcttcaaaagcgaactgaaaatgattgtttttccagcaaactgaaaatgattgtttttccagcagggtttgaaggatcgcctagctggcttatcctgctactaataagttgacttccccagggcatccagtatttggtggatctgcttccacgtagcactgaactgggtcagtactttactaatcagctatcagggccgtagtttatgggaaatgcagttatattttccaaggcaaacacaactctactatatccccaaatgcactgttttccaagacaagcatatcaattctgttacaagcacaagtatacatcccaaaatggtgaggttttcatcagaaagggaattgcatgtgaatgcagctaacggatcggggtataattcaagctggattattcgatcctaaccttcatcttcaagcaatcaaattaacagccctgtttaacaaaagtttgagagattttgaatgaggatccgtgcatgcagcaggaaagtcggcacggaagctggagatgaaaagctgaaacatgatttcttttcaaagaaaaatgaaaaaaaaaaaacagcagcactgcgctggcagccggagccaatgggcgaggggcacgtgtccccggattcctcgaccgaccagggagactccgcacgagcagggcacgtgacggacgatccgctcgtctttatatacggctaatgcgtcgctggtgagtttacctgcatcgcatcagctctcttgactcctctctcttcgtctcagcttggagctcagtctttgatttttcttcttcttcttgtttgtgcaattgtgcatcgttgttagctgggaacaagcagaagaatggcggacagcacggcgacctgcatcgacnnnnnnnnnnnnnnnnnnnnnnnnnnnnnnnnnnncttcttcaagttcggctgcggggtaagccgccgttatctacagtttttgcactgggactactttgatctttccatgcagcatgtctcctcctcctgtcactatgtgtagttaatcgtctgtggtgattgatttgcagattgagttctggatctgcttgctgctcaccttcttcggctacctccccggcatcatctacgctgtctgggtcatcaccaagtaggaggagaattactacccttccaaggtaagcatggctctgcatgcatcttcaagaacttggagagtttgagtacacaaaattttgtgtcggtgtttcaggaaaaaaaaagataaaaattgctgaacaagtgtccgtggagtagtagatattaggttactactagtaccattaacaacagaaagaaggaaaggaacatctcgcctactgttctctgatctgtttttgctgaggtgtttcaacaatttagctaataattaagtcgcctgatcgaggttcagaaagtgactgactaacttatctttttctgattttcttattatcaggtgatggtgaattggtgatccggagcctgtgattggttgtgcctggtgtaagcggcagttgtcaaagctgtgattttctggttctttggacggatggtgctcgctgtggtgttgtgtatgctgtacatctgttttggtgttgtgcttaggtccctcttctgttacaacaattgttttctccctgttcttccggggtaccttctccagtttatcttctgcaccttctcgtccctgtactttgaatattaattaattaattaattaattgctccttgttagccatctgctcaaagagtaatttaagaatcgtttgacaaatgaattcaatgtcctgtgaatgtggtcgagggttgcgaatttcaagcggatgtgaccaatcaaatggtggccatttttcatgtttctagtgggtgggcagtcactatctagatttttttgtatgtaatatttatccatttacatttcactgtattattgcttctctattctttcatcaatttgaagaggcgatgaattgaattgatgatgacagcggctgacaggtccccccacactgccacacagcatgccatgccagcttacacactggcaccgtgccatgtgctgtgtactggtagctactacgttgcatagcaccgtagcaactgtggaaatccaagactactgcccgtttcaaaatataagtatttctactcgttttagcataaactaaagttaagatgagaagttgttttgaatagtagagaagttgttttgaatagtaggtgaagaaattaattaagagatgattgtgactagatgagataatgaagtaggcgaagaaaatgttgtcttacaaattttgaatctaaaaatccttatattttaaaacagacggagtgagagacagtcattgcaggcttgcagaatgggccgcagggccggtgcgcgcgtcctgggctggagatgggctccgtccgtccactagctcgagacaaccatggtccatggacctgaactcatgtgaggccttttgtgctgtcaaattttgtcagtctcctgaaaaaagagactacaccaacctacatgtagaacgtgcatgcacaaatctacaacgaggcgatagtagcggtatcagaaacatgcaattcatccatcacattcagatatgcagcaaaaaaaaatcgtaatttcagatatgcagtatattgtagaaaagcggttcatttggcaagaaagaggaacagaacctccagcactagaataacaagagaaataaactaacaaaagaactgagcatcaatccgatgcttttactgttccccgatgcaactgaggaaaaaaaatactccctccgtcctacaatataaggtattttgagtttttgtttgtaacgtttgtccactcgtcttattcaaattttttttgcaaatataaaaaacgaaaagttgtgcttaaagtaccgtggataataaagttagttacaaataaaataaataataattttaaaaaaaattgaataagacgagcggtcaaacgttgcaagcaacaactcaaaatcccttatattatgagacagagggagtagaggagtaggagccaaggatttgaggcttgtaagtttcatagattttgccaaaagtacggaataacggcagccagcatatacaaataacaccataataaggtcatctagtcttccagcagaaaaaatacacaagacactttggaccaatggcctgcgttgttcatccagacttaagagcatcattatctcagaaataaaactcccgcttgcaaggaaatagaaatataccaatttaactaagaatcgctacctaggagtattcaagtgtcaagaacattggctgattgaatgattgatagtcatttggtcaccaatatcaaacagtagaccaatgtaaggtgtaagcaaaactcactgcactaactgaattatgtgtcgggtgtttcaggggaagaaagatatagcattcagagagttgtggcttgtcaacaaataccacaataccatgatcagatcatctaagacttctagcaaagaaaaacacaagacgctatggaccaattgtttgccttgggttttaaggcaaagtatgtgttaagtttattcagagcatcaggggtctaagaagtaaactcctgcctacagggaaacagaaatttaacaatttcaactaagaattgctacccactacctactattaaacagtcaagaacatcaacgaatggatcacataatggtatggccgcctatatcataaagatacagtaaacatgacccattgcattactgtgaggtgtaagcaaaactcattgcattaactgaaaacaggaacagcaatacatggctcattgttcaacaagttcaatggaaatatcgctacttaccacagtacttcacagcagtaaaatggtagtaattcaaggatgggcattaggcctttgaaaccattaatggttgaaaagggatcacagcaaggaaagataggcatctcaaactccctacaaccgcagcaaaaggatacattcagccaatgcgtactataattctacctattatgcctcctctgtatctcgactcttcttctttttcttctcctttttcttttcgcttttctcagcttccacgccatctccattggctgcgctctctggatccacaacatcacctccttccttgctcttcttctttttctttttcttctcactgccaaccttctccccatcagatatatcagccttctcttccttcacctctgcatcacctgatccttgttcacccttgtctttcttcttcttcttcttcttctcactcttctccccttctacctcctcagcactctcttcaaccttgatcttctttacaggcacagaagcagacgcgtcatcatcctcaatcttcctcttgcggccttcgtcggcagcatcctcctcatccttgtgcttcttcttctttttcttctccttgacctcttcagtcgcaaccacatcctgttccgccttcaccttggcctcttcaggagcagctgcaatgctagcgatcatcgcatcaccaccagtaggaagtgccacattccggatccactcagctggggtcttctcatttggcttcccatgcttatccagtaaaccctctgcgaccatctttttcttcttgagcgcaaccggaccaagcccccacttcctcggatacgtgtctctatccatcaccaccctcttaatctttgcgactgcaccatggtcacaagtcgccataacagcggtggtcatctcggcaataccaatagcaatggcctctcctttagtggtcatgagaaccacctcctccccgacatcgatatcattttcaaaccggagcaacccgggtatcataagcttagcaccatagcatatagcattgacagcagagtccttaacaacaagcctcttgtagctagtaagcaatacctcgagaggcatcacgatgcgccgcaagtaagtctcatcgttgtagttgtccatcgcccacctcgcgtccatgacatcgtgcatcgtgaccatgttatcctgctccccgaggatccccgatcgcacgcggcgcagctcctgcatatgcgcgccgacgccgagcagcaggccaaggtggacgcagagcgtcctgacataggtcccggcctcgcaggagatccagaacacggcgaggtgccggtcggcgtcgtgctcgagcagcttgctctcgtagatggtcctcaccctgagctggcgcttgacggcggagatgagcgggggccgctggaacacggcgccggtgagagcctcgagcgcgcgggcgacgcgggcggtgtcggggactgcggcgtggaagcgcgcgacgcagacgtactccttgccggcgccctgctgcgacttgacgaggcgggtggcgcggtcgacgcagacgatgaggttgccggtgaccttggggtcgagcgtgccgctgtggccggtcttgtcgacgcggaggaggcgcttgatccaggcgacgacctcgtgcgaggaggggttggagggcttgtcgaggttgatgacgccgtagcggaggtactcggcgatggggcgcttgagcggcgagtggccggaggggagcggggtgtagtggccggtgcggacgttgaggcggtcgtagttcttgaggaggagcggccatgtcgaggtgtcgagggaggggaccagcgactgcggcttgatgaggtagccgtcggtcttcgcctccgcctcggcgagggacggcgggtcgacggcggcggcggtggcggcgtccttggacttgatcttcttcttcttggacttggttagctcggaggagggggaggcggcggcggccggcggcggggaggacatggcggcgggttggggggaggggattttagggtttttgcggcggcgaggggaagaagaagaggcgttttaagggggaagggtttagtgggtgcgagatggtgcgatgggggaggtggtgattgagttgggctgagccgtgggcccatgagagttatgctgtaggacggagactgtaggacttgggctgggccctgggctaatgaggccggagactgtagacctttataatataatttcaccgttttaataatttgtaaaaaaaaaggagtaaattgctctttttaccgctcttccgccttggacatgggtaaaccaactttttcactctaaatcaggcctttttcttcaaaaacatttcactttataactatgtttatcttcggtttatcccctctctcttcatctctaccagagaaagcacgtcaaaatctcaaccctccccaccttacaacaaatacgctcgtagcaatggaggagactaagctcaactgctctcggtgttgtccatgcttgagatctacatgcattggtgtcgatgctgggatgtggatattggattttcttagcaaacaggctcgaccacgtagtggcgggtgctacgaagctcaagaaaatgcaacaaaggatgtggaaacgacagagacaaagctaatgcgatagatgtcaagttgactattgggcactttgtagatgtatctctattgtatgtcataagcttcaacttgcttaagtatgccatccgcgcaataccgctctcgaaggcctcctcaagtccaatggtgctatcggcgtacgctcgattgggttgggatgtcaatacctgattgctagacctactcaagcaatgagaggaaaggtgggagctaaataaaagaaatatgccaaattgaaacattttggaaaagaaagtaaaacaagacctgtcagggttatggataccacatacccaatagtaatcggctaagcacggcgggacctaccacatactaagtcttatacggaattatacctcgtatatagaatgtgttttggataaggaaggataaatagagttctatataaaaacgacaatgactacttggattgcatccatattgatctccctagttctacttagataaggggcacctatgggtataaatacaagccccctaggaggagaggggacaagttacaagaccaacaagacacacgccgccaaatatcgacattagatattagcctagacataccccatctagtgcctacggaagccggcaagagatatctagcgcaatctctgatctcgacgagttcatattcaaggaggaagactacccctgtcgtcgactacgaggtagttatctatgccgccaagtcgatgatagctagataggttatcccaaatattgtatttgtgtgtttcagatgaataatagcaacaccggtttcggccaacaggatgtagggctattacctgtcagataaggggcaacctatataaaaatcactgtctccatctcttttacctcaatctcgcatacctcaatctcacatataccctggtaccgatgatccctataccatctaaataccgtggtcgtgatctcaaacgtcgataagacccgaagtaagggaaaaagtgacccaaagtgcaattcatattttttgcatgaaaaatgttctgtatagaagaacagatcgattattcgattcctaaaacaatgtacgaagacactaaacgtctatattgaccattaaaaaaaagatgcttagacagtactaataatgttgaaatattagagccgttattatatcaacgcaaaaatgtttatcaactccacatgtaaaaaactgtattgcatgtttagtctatattatcgtgaacttaaggaaaaatctaaaaatatcactggataatgttgcagcccgggcgtccaacgggggtggagccgatcgggctctcccccccccccacccacgcgcccctctccccacgcgcttgcatgcaggtgcctgaccccaccacattgatctgctcccacctaccattgcaataaatcacccacatattttggaaactctctattataggaatttggtttatttttgttccacaaaaaatgtttcactagtgcattcacaatgtttcactatgtagatctaatgttgcagtgaactaaaatactccattgcaataaatcacccacatattttggaaaccctctattaaggaattcgttttatttttttaccacaaaaaatgtttcacctagtgtacttataatgtttcactatatatggatcaaatgttgcagtgaactgaaacattctttcgctatttgctgaaacattgtttttatataaggtgaaacaacgcccgatttaaacaactgaaacatttttgatctacttagtgattccgatatacatggtggaacatcgtgcaatattttttttaaaaaaatcaataataagctaattttttttcgtcggaatatatctatgtgtggtcttattttgaagatttaattgcaacgaatttaatggtgtaatcggatcatgatttggataaataatttaagagaaaaattagtttaaaatggttttgcacatatcctccatatcactgacaagcactcgattgtaataaatgctatcgcaaatgtgagtttcatgaaatattatcatatatttaattttggtttagaaataacattatcattacagttctgttagcagccttctcttaagtataggataaatagtgcattttaacgatacaggatggacggaaccctaacgacaattatattttggacaaaatcacctatacaatagcatttattcaaattggatgcttgccaacggtataaaacaaagataatgaaagtatcaaaagtataacgaaacttattggcacactaccacaccaagttttcaacaatagcccataaccctattgtaaagctactaaaagtctaatgaggaatgcctctatcttttgagaacccaaaaaatgacttgaacttcattcacaacccaaacagcgacatagtgagggcgtgagaacaatgagaggatcgcgctgggaatttttcacacacacacacaaaaagagatgcggttgggtgtagagctcctacggttggaggctggggagatgatttgtgttgtcttcctactgaacctcgattttctcccttcacctcaataactattcgggggcttagttaggtactctattggagatgctccgagcattctatacctgcttatatatccctatatttaacatttccccttataattttaccaaatcactatgtttaacatatttcaatttagtactagtagagcaataaaatcagctcaatccaatttaacgtgctacaaagctacttcctccgttcaaaatatttgacaccgttgactttttagtacgtgtttgatcattcgtcttattcaaaaaattcaagtaattatttattcttttcatatcatttaattcattgttaaatatactttcatgtacacatatagttttgcatatttcacaaatttttttaataagacgaacggtcaaacatatgctaaaaagtcaatggtatcaaacattttgaaacggaggaagtataattttttttccaatcaacgatgaaggaaaaaggtggacgacgctgaaatagaaaacaaacgaatttcggaacgggaaggccatgtcggactttaaacagtaggacaaacataccactggacccacatgtcatagacacatgtggacccacatgtcattgagataggggtggcaaatagttatttgtcaaatctaaaagtggcaaatagttaaaagcccctgcaaataatactccctccgtttcaaaatgtttgataccgttgactttttagcacatatttgaccgttcgtcttattaaaataaaattgtgaaatatgtaaaattatatgtgtacatcaaagtttatttaacaatgaatcaaatgatatgaaaataataaataattacttaaatttttttaataagacgaatggtcgaacacactaaaaaagttaatggtgtcaaacattttaaaatgtagggagtagctctgaaccgaaccgaactgaactgaagatttgcgacgaccccccaaaatggcgaaacgcgagcaaattcaattcaattccccctcctcaaatcccgcaagcgaggaaccctaatcccatttccgcctcgatccaattccaaatgctccccgccggcggctacccgtcggccgccgccatctccttccccgacgccgacgtggatgacgactccgacgacggcgacttcaccgacgcccccctcatcgacccctccgaccccaccttccccaacccggcctcctcctccgccgccgccgccgccatggctactccagcctctgcggggggcgggagcgggagcgtgggaggcgtcggctcctcctccggcggcggcgagaggaggccgctgttccagcggctgtggacggaggaggacgagatcgtgatcctccgcgggttcgcggagttcaccgcggcgcgcggcacggcgttcgcgtcgcaccagtacgacaccgaccccttctacgaggacatgcgcggccgcctccagctcggcttctccaagagccagctcgtcgagaagctccgccgcctcaagcgcaagtaccgcaactgcgtctcccgcctccggggatccggcagcgccttctccttccgctcgccgcacgagcaggccatcttcgagatcgcgcgcaacatctggcgccccaccaacaagcacggccgggacggcgactccgacgacgaggacgccacgcaggtcaccccagcgcccgttcccgtgaacaccagccccaatggtgaggtcaagtccccaacctcagggcggcagcggcgtcgcaggcgtggcggagattttgccgccaccgcgcctgccgctgctccggccaccaccaacatggtgcagcccattcagccggtgcaggtgccggtttcggtgcccgtcaagatggatgacacgcttcctgcgttgtcgcagaccacaatgccaattacagtgacaatggagggctcggaacccctcagattgccggtcatgccacctcagccggctgttttagatgccgacaagagttgcttgacgcctctgtttaaggagatggtacgtgcagtgataaatatcgaatcaaacccgttcggtgcacaactgtccgagccgccacatggtttgcccatggaaggggagaaatggaggaagcagcgtatattggagctggaggtatacttgaaacggatcgagctgctgcaggaccaggtgaaggctacgcttgaggagctcaagtcctccgcgcctgggacttgaatgaccgagcgtgaaggcctgtcttgatgctcatttaggattcttggtatgattcgtagtggtagatgtttaggtgtttttgcagattttcgtccataaaagaatactgttgacttgtttgggcttggaactagcttattttatgtttctaattgtttacatgattatttagctttcacttcttgcctcctttcctataagataggtatatggttgtctctaagtggtatatttggggcggccagtaaggcatcctgatagaagggttggacacttcaaattaatttatgaggattacagattattgtaatttcaccttgtttcttgttcttcattctgtgtgtttttaaatatttagttataaatgaattagattaggtttgaagattttactatgaatggtcatattggctagaggtcatagtgttatggcacacaaaaaaagtgtatttgtctatctgcatgagaaagcaagagtggaattatcggaaacaggtgataattggacttgcgtttgaccataaccaagtctttttgggggtaaagaactaagaacagcaccacagaaacttaccatgctccacagtaatttcccacttatgaaccaaataatattttattgataataatagtgaacatattggctccacattctgcattgcattcattatatgttggcattcttgatctgtatttgataattacaatgattccttctattgctttgcaaataaaatcaatgcactcattagtcaatgacctggattagcatggtagaaactaagatgctctgtgcatcaaatctggaggcaaggaaagcatattcacaaaaaattgcatacagtttcttcatagacaacgcaatgttgtggacagcactgctgattaaagtactacatgttctactgtctatggtggtcctacatgctgcatatggttatttggttttaaagttctattgcattatcggtatatctaaatttactaattgtggaatcggattgcttcttgagacaaattgccagattatttattttgataattcactcttattggtgctggatgcaattaaaaatcgttagatgcaatttaattcatgattgtgtaggctgtctaccatgaagctacaaaagttctgctactcaatttctcacatgttctttgaaggtgtctacatatttgagaatcacagttcctttctgttagttaggtacgtccctttattttgtggatatgagttagttacagctggtttggctaaattctacattgttgctttgattctctattgtgttttacctctttggttcatttatacatatacagtaacaaattgagttccattgtgaaatcaagatgtgagctatgatgctaatcccctgcctgtagcttctcataagcatctttatttttattttgctgatgtttttgcaaactgtgatcatcattcatggtgtaacataggttctgagaattatcccatcttactggtgaagtagcgataacctttcttttcttcagagaggtgtgtgtaatcgggaatcctgacatcctgagataattgatgtagcagctaacctctctttcgtgctttagctgatttgtatcttttgtttgtatgcccttgtgtgtaatatttggagccagatttgagagtcgaatgtacatgctaatgcattgatgcaccggcgacggccagcaagatcggctgtttcagcagtggctgttcaaaagaatttatcttttatttcaaatgttggatgaaattaatcagccgagtgcaatttcttttgctaaagaacattatatgcaatttctggaagcagtaacaccatttcttttcccaatttgatccgttctatgacaagtaggtatactgctaagaagacgatgaattgcagaacaacaaaactattactccctttgttccaaaatatttactcccttcgttccaaaatatttgttccctccctttgttccaaaatatttactcccttcgttccaaaatatttgttccctcttgagtcttgaccggcactgtatataaatgaacgaaaactcaatgcttcttatatttaggatatttgataagtataacatcttttcaagtatttataatttctgttgtaaaagagacgagtggttaaagtttaaatatgaatagcgttcgatgataagtatttaagaatttataattttcttttgtagatgacagtagggttaaagttcaaatgtgaatagtgtcccatgataagtggattactctctccgtcccattttaatcgcaatcataagttttcgtgtttaactttgattgctcattttatttaattttttattgtgatttaatgataaaacatgaatagtactttatgcttgatttatattttttagtttttttaaataaaacgggtgattaaagttagacattaaaactttgtgcttacaatgggacggaaggagtattttagaagagaggagcaataatcattaatcaaccgtaatttttttttgaaatttgagactatggtatgcgatgaaaattttcatgcgtacaaaaagagagaaattttaggttctgtctgacaagtgctcgattctactatgaattacaacctgacgaaaatgtcatcgtagtttccgtcaaataacattcattagccccttttaaaataacatttattctgtggacgtttgcggatgtctaaattgtggacatttattcttttttctttttactttcgcagtatatgaaatacaaaagtaaaaaaaaagaaaaaaaaagaaaaaccttcttcttttttcacctttttgcaggctttgcacctgaatcccatgatccgttgggtacaaggaagaagaggatactactctccaagtagcgaaaatccacaaattccctctccggctcgcgcgcgcgctctcaattttttgggggaagagaagatctccccttggagggaaccccgcccaagaatggcgggtctcggcggcggatggggcggcgggtacgacgacgacgacgactgggggctgagcgcggagcagctcgaccagctcgagcgggacgcctaccgcaagctcgccgagcgcaaggcctcctcctccgccgcctccaccgccacctcgccgctcccctccgcggcctactcgccggtcaagaacagccaccaccacccggcatccagggtttcccaggagtcttgcttcggcaaggttagggtctcatctcctctctctcttcttattcttttcttttctttcttttttttccttcttttgttaaaaaaaaaacttgggtcagtgagggttgcatcttcttgcgaattggcatattttcatcttaatacatttcgtgaaaaatgtgtagtgttcgttctggcaatttccttatatttcttttacctaattcgtcatagtgaattttcgttcaaacaaatggatggggctcttgtccaagaatttagccagtgaataaaattcttattgacaaccatagccagtgtgaattgcagtacgaccttagctcagagtttgtataccgtggtaattttacgaattttcttgtgctctgcagttgagttctttgcgttaccggctatctgtttcaactttcaagaatagtttttttctctgcgttgctgtttcattgagttctttatatgtcctgcattgcagtatgaaaaccaaaagccaaaacttttttgcacctgacaaacccaaaaaaaaatttggtggtttctggcagaagaattaatcatggattttgtgccaagataataagtgatggggcctgttctgtttcctagcgatctgttaaacttagtgggccgtgtgttaaattgcagctgcacaatattagcaccatcaggggtttcttgttaactcatgagaatacgaccaggcagagcgtgtattttagtatttactgttacaagaccatgatcctggccattttctaaggctgtgttcgtttggacgttttcccagcgcgctacagtaacacggaaaacggaacggttcattaacacgtgattaattaagtattcgctaatttttttttcaaaaatggattaatttgatttttaagcaacttttgtatagaaactttttgcaaaaaagtacaccgtgtagtagtttgaaaagcgtgcgcgggggcaaaacactgtagcgcgctgggaaaacgtccaaacgaacacagccttattgcagattaattttgaaaaatttaaggcatttgattccatcatcatcatttgatgtacttgaaaactatctagcatttgatgtattacgggtgtgtggccactttaaagtttgggatcatatggttgacagggcttgctttggtgatctctagctaaattcactggctatggctgtcaataagaattattctcttactcactgtgttgtgtggattttttattcattcttgagtagtgttgtttagcgcaacttcaatatgtttatgcctttccaaagagttgatttttacttacccatgtactcatagattggtaaacacagactctaaaagaggcacccaatttatccggagtaaggacagcagttgagaagggttttcatatctccaaattggcttaatctttcagttttaaaccaactgcccttctaattattctaatgtaattgtgcaaatctccagcacttgaaatcggtacgaatatatgataccatagtgcaagagcatccctgtatatgtctgtgttattcactttattttatttaccatcatttattatagagtttgcataattgtttgacaaaactgatatttactcatctctttttatatcactaactgccattatgctaatgaataatatttcttaggtagaatcactttctccttctcggcttagtcaaccaaatgcatcgggaaatgcaggtataagacattcttggtgctttatttttattctaattggacatgtggcttatctccttttttgtttgtcatttaagttaataatagtcagggcaatatgtctaaggtatcagtacatcttttccttcattctactggtgtgatcgcagcgaagttccagtaccaccaggtacaattctccccaatgaaatctttaatcagttgttactgtattatattgtgatccatatatttgactcctctgttcctttcccagaaacttgtggatgcagttcacaagatccccaaagccagctggaacgggaaggagaggttttcattaatcttctacctgacaaatttacaagatttttctatggcctatcaaagctcaacttgtagtgcttttatgctctcaaaaaaaaatgcaactctgtaaacacatcgggagcctgatatgcaact

SEQ ID NO: 80755 - DNA, 11796 bp, Oryza sativa
attcctgattctattttacctttttcttgaaaactatagggtatggatgttcccacactcatcattatcagtagcagaggaagttcttagtacagtacctggaatagctgttgaggtaacagttattttgtacttcataaaaccgacttactgtttgttgtaatgacctctcacctcctgttgttttgattaatttattttacttcctcctgttttagttggttgacctgggctgcttctagttagcttagcattattagtaggattgttttttagttttctattttgaaaattttcaaatattagaaattcttatatgactgttaacaaatcctctgtaatgcttaaacaattcagaacatagatgatgaagttggacagtgacttttatgacttttctgttcattgcgtacatggctactatttttatttttctttccacaaggaagtttgaaagcttgcattttcagtttatgcaaacaagaagtaaacagactcaaggcataggctttaatgtgcggtccactatatcatcgaaacctttctaatctttcagggaatgcctatctgacagtctatagatggttcagcaataccctgtattcctgttgacccatggttactctatattttgcagttgatggtcactaataacggtgaccaaaaaagtttaatatgactgaagtaaatttgctagtttgctacctttcctttactttattattgttgttgatatggagcaaaatctagttttgaacttctaaagatattcattctggccataccttgtactttcctagcaggtccaaaaactggatccgctggttaagcgcgcactaactgcttctttatatgccggagatcttcgaggtgaataaaattgaaatagctttggaaattccaaatcatgcttataaaattgttcttcactttgtactaatactgttggaaaacaacccaattgtgcatgtgcctaatacaaaagtgttggttatgcactgtttctttctgttctctccactaatctacttggagtttatattaaatgtgttggagaacctaaataattctgtatgcaatactatagtgtaaactatgcaattgagtgcaaactttactttatattttccttggtgttaggctttgaaacttcaatgccttgccttttcctagtattttctttagatgctaacttcactttttttggaagatttgtatggcaagattccaactgatgttgagtcaaagcttatgccgtttcagcgtgaaggtgtcaggtatgactatatgatgatgcaatgttcagtggacttttttctcacatgacagtgtaaaaatcatttttgtagatatgtgctgcatgttgaacttaattgtccagagatatcaaacatggcagatgaccattaataaatatgagaattttgtctagtctctagcattatacttaatgttgttagtctagtcatactaggaatgttatgttgcagatacttatggctcaaactgggtatggggccagaggactaaggtagggcacttgccctcaactagccattggcaggggctattccttcatgtggtagagggttaaagaaaaggggggaaattgtaaacttcatttactagctaaatgcccgtgctttgctacggataaaaggaaaaaaacatcatagtattgccaaataataaaaacatattttccattgaatatgtacccaccttaagttaattttatatgtggctaaccatttagatttagttgttatgtactattaagaagttcaaggggtgatatgtaaaagctacaatgggagcaggtaggtggcggattcactgtcactacaattggagtctttttaaagtaagtatagattcgttgcttaataataagagataaaaccccattgtcgtttagatgggataacttggagccttaataagcttatctctaaaataaagaaaaactcaagctaatcttatctctaaaatatgccctagaaggtatgcttcactgcctacagggcccaaaccccataacacaaagcttgaactttgtaagtaccaaaacccaggaccaggagcataagtaccattcaatatttgaaaagtgtagtaccataacacaaagcttgaactttgtaagtaccaaaacccaggaccaggagcataagtaccattcaatatttgaaaagtgtagtaccgcatgctttgccattttttgcacttcgaacacgttgctgctttacaagttcaacacatcttaccttttctttgatgtttaaacaggtttgctttacagcatggtgccaggaccctgatagcagatgaaatgggtcttggcaagacattacaggtatactttttctctggaacattgtaaatctctagtggctttatatcctttctatatttataaatagcagtatttttctttgcaatatgacccaagcttcatttagcatgacatatctgggcactcttccactcttcctccatcattaggacatggtgatatggcactactagatagtagtgtcatagtgtggtatgcaggggtatgattactgtgagttgatgccaattctcaatctgcatgtggaccagtctataattccttcaaatagcttgaaagaaaatcgataaatgtaccatcagtgtgtgcttgcacagtagagattgatcagcaatggcctattcacagttttataagtctggagtttatgtgttctttcaggcattatttatggtcccctcattttctttatgcaggcaattgctgttgcttcttgccttcatgatgcctggccagttcttgtaatctctccatcatccttgcgattacattgggcttctgtgagcacctgtgttaaacttcctatctttcatttcaacagtaactctatgcatgagggaagtttaacctttctgctttgcggttgtaacagatgattcagcattggcttaacatccccacggaagatatcttggtacatccctttagttttcttaatgtagcaatggatatatatatatccatgtttgcacattacttattcacaaaacctatccacagtaatcccttaatcactaattatgataaatctccctgtgattggagcagagcacttgattttcctcccttgaatgtttgctctccatatatgctgtattatccttattatgctgtacagtatttttttggttgtgtttttcctgcttcccttgtcatatttcaccaaaataataaactgccatccctaaattttgtggcaatttatgatccttaactccatttgctgaatgtgtttcttcaatttcctagtgtatgtaactttcgtccatttcctagagcatagtaacccgttatcttattcaggactatcattgaggtggtcacatgctatactgagaatatgtattttatgaaaagggtctctaaagatgcactgcttgcaggatctaagatgctgtcacctcccatatatagtctaatgcttcataattgctttgcaaattcttgtttgaacatatgagatgtagcagtgcactcgatatataaagaaaggaaccattaaaaatatttgcagttcccaactaagctaagttcatatagaactttagaagtcatattttgactggaagaacttgatatggagattaaattacatagtttgacaagtccaaagcatataaacggatatggataatttgcatctatgggctgtgaataatgcttacagatacagattttttttccaggtggtgctaccacaaactggaggatcaaataaagcaggatacagattggtatattcaaatactaaaggggattttaatctggatggggtgttcaatgtgatatcttatgatgttgttcccaagataaaggacatgcttctggacttggattttaaggtaggattttgtctgacatgttatcgtgccgtaattatattacaagcatgggctatgggcttgggtgagttcgcagtagaacatataggatgtgtgcctcgtttcacaggctgttcttttactgcttagatattgaacagttcaatattgtagtgaccccctgatatctcctaaagctcttgctgaatcatttgaaatacaacttgttcaaaggcctcctttgatcctatacatcaatcaaacatggtagcactattttatagaagttagcttgggtgtagctttacttgtaatttttgcggaacttgatttggacttctgttggatatcgagaatattgttgtgttacgagcactattgtgtcttggctggatcaatcaatctaccaacttgataaagtcagaactactttagggatcattagtgtttagtaactagtaacattacctgctgatgcatttgttgaccaatttttttgttgcttcttttggtaactgaagtaattaggtgtcattgtagttcaaggtaaaaaaaagttgactcttgttgtgtatcgttttctcaatagttccttctgctctgtaccgtaaattatgtacaatgatgatgttgcatatttacaccatttgcatatatggaactagtgaccccctgatatctcctaattactatgaatttatctggagtattgctgtgtataatctgtttatactcactttaaatggttttcattcagattgttatagctgatgaatcacactttctgaagaatgcccaagcaaagagaacaatgcattcacttcctgttctgcaggtttggtgtttcttatgcagagttgattggaacaaattatactttggttctttagtgagcttatatagcaattgatcgaattgggagatttgctcttttgccccatagttgagtggtgtttggtcacttgccacaccccctgtgaatgacaactgggcccaggtgccacatgtcatacacggtacacgcatatgtggaaaaagagcaaatgccatccatgtatgtgtggcaaaattgcaaatcgcccttccaaccatagcatctctacgttaattgtttgacacaaagcgggatgaaagtgtaagtggggtgctatatgtacacgagtctgcggattttggaagctgggggtgacaccaaacttccataaaattctgaatgctgttgtcttagataatgttcagttaatatcatcagttccttaggacatttctgctttcttagactgaattccagatatcaaacttggttttaaatccatttatcatttctctttagagattagagtgaagtatatcttggctgattgcagttacatgaaagaatctctatccaatggcatggatgattttaagaaaactaactgtgtattttttaatcgcagaaagctaaatatgtggttttgctaagtggcacccctgcgttatctcgccctatcgagctgtttactcaggtacaagattcaatagttaaatgcacattttcactactagcaatttttctagtgtagacaaacaatttatttttctacgtgcagctccaggcattgtatccaactgtatacaagaatgttaatgagtatggtaatagatattgcaaaggtgtaagtactagctcaatcgaattgctttattcactttctgcaaaccaattatgatagagtttactatatgaactttatcagggcttttttgggctttatcaaggtgctagcaatcatgaggagcttcataatttgatgaaagcaactgtcatgatccgcaggttgaagaaagatgtcctttcacagttgcctgttaaacgcagacaacaggtaaccttgttggatttgtcggaaatatggattgacttcatcctataattggataaacacccaatttttctcttatccagaaaattcatgacaaattcatgacaaagttatcatttaaattcaacagctcattgtatcttctgattgctagcatgaccttctgaataagttcctgcttgaacaattatttccattccttctgttgacttgaccttttattctaaatgcttaaaaccaaaaaagctcatttatatgcagaaatattaggaatacttggttactacctccatcccaaaacaagttcatttttcaccatcccgcacataccaatacaaaaccaaaaaactagaatacctctactttatcaaatcccaatgcaactattcctcactttatctactcccaatacaattattccctgctttcacaaactccgatgcaatgataactctaaaaatgaacttactacgggacggggaaagtatcttccacatgaaacaaacttgtaggatgtagcttatctctgatatgttggttcctattaatctattttactgttgtgattattacctgtctaccctaatacttttacttacattggaacctactcaggcctttctggatttaagtgagaaagagatgagacatattcgtgctctatttcatgaggtattccatttctgtttcatttgacctacttcatagtgcacaagaaacagggaatcatttctaggtagctcaatgcatatgcatttcatatagctcattttatatttatatctttgcatcagtgaagaaccttagaatgatatgctgatatggctttttgctgtccctgcgcagctagccattcaatccgtatatatcacatatttcaaagctagtccatatatttcttcttaagttgagctgaaaaacagaattacgttgctcttatctttacatttgttatcaacaaactatgctcttttgaagtggttaagcttcatttttatccaagagaagaggtgcagcatgaattagtcatttgttttgttgtgcctgtagcatccttgaatgctatttaaatttttgtacggaagagctatgatgcagtgtgtgcttttgtagttggagactgtgaagatcaaaatccagtcctgtgactcccaggagacgatggactctctcaaatttgctcaaaagaatcttattaacaaggtgatctgaattatgtcttcatgctcctctatttctggtgattattactgcaaactagagtatgcttccaactataaactaagctgcatcaattatatagaaataaaaatggatattccctaaaattgcaacttttgtattttatccaaatattatgtaaatgactaaatgtatcatcgaatgaaatgtgcaaatacttggatttgatcaaaccttttgcccttcatttattttccatctttagagtttagattcaaattcaatctctgttatatgcgctcgacattaagatttgtgttctttggaagtggttttattcttgcatcggtgctcatttgtcattcctaatcacagatctacaatgattcagctgaagccaaaattccagcagtgctagattacctgggtactataattgaggtaattgtgcgaaatattatgatttgtcctctattcctgtcttgtggtatcagatgtgagtaacatttcacacactggctaacctttgctagtttctggattaccaaaaaggaacaagctcattaatttgaacaaaattacactgtgctatttgtgattcacagaatcctggccatgcttcatgtgctttgacaggacctacattggtagatgatattacttgatatttagaatcaataacattcattttcaattggttttcaaactggctctcaaatggccttcctagcctgttttgtgacaacactcttttggtccatttatttacttcaaataacagtacaaataactatcctgtcgtcgcaagcattactaaatacttccttcatctttcaggccgagtgcaaatttttaatatttgcacatcatcaatccatgcttgaagctattcaccaacatctcttggtaagcactgaaaatgtatttcaattggattattaatatactgacccacttaccatcatgtttcagaaaaagaaagttaagtgcataagaattgatggtcaaacacctgtacctgtaagacagactctagtcacagatttccagaataaggatgacatcaaggcagcagtggtatgtgttagaatttgtatgctttatatctattagaattttgatcaaatcctacttagcaaacatcttcttacagccagattttctgaggttgctgattgcatgtaaaatatttttttttctgtaaaggctgatttttgaaaccccaacaattggtcagtttttaaaatctgtgtccttccctgccaaatgatctgcagttgtggcaacttgactgaacctaccactgggttatgtagctaacattcagagcgcagtatgcgtggttgcgttatgcaatgtgccactgtttcaccatactggctagttgaaaacatttatagtccttcattggctccaatctcatgatatcctaacactatgcagttatccataaaagctggaggtgttgggttaactttgacagcagcaagtacagtaatctttgctgagttatcatggactccaggtgaccttattcaagccgaagaccgtgcccatcgtattggtcaggtgaatactgcatcccgtatctgtaaatttcgtaattgattaatgtggctaccctgcaaccttttcctcaaaaatttaaaatctcagtgttgtttgaatatttgataggctttcaatggattcacttacataggtaatttgtggattcactcacttggctgttcttattttctgtaattattttcaggtttcttcggtgaacatatattaccttcttgcaaatgacactgtggatgacattatatggtacatcccattctttgttttcacttcataagtgttctactttagatcttgtacttaagtggccatttttaccatctgctttccagggacgttgttcaaggcaaacttgagaatttgggacaggttctttatctctctaccctccccccacaatggactattattttcctgttagaataactgacaccttttgcggtgaactatagctgatccttggatttgttgggtgatgaatgatgatagctaaaattagcgaaaactgttctacagttccttttggttatatcagacttaagttcccttacacgctttgctcagttacacgttaacatgaaataatatgtaacaagaacaataacatttgctcatgtttccacctgttcatattatttttggaaggagtcatctctagtgtacctgcatttgttaatctctgacatgcatatgtctacttcaaaaagacacagctaaactatacggttaactctgaacataataacctgcatgtttgcatgttgcatcatcatcatctccaaactccaatgatacaaagcttgaatgaagcttgtgcatgagaatgattctgaagagagcaaactttgccttgtttttttgtgtttccagatgctggatgggcaggagaaaacgctggatgtgtcccagagcgacactaggcccagcccttccaagcagaagacgctcgacgcctacctcaagcgatgcagcaattccacagaagctgatcagcccaagctcaagaaccctaggttctgacatttctcagggtttttagctctactatgtttttgtttggcaattggcatgaccctcttgccttaaacgaaggaatgctgcagtgtcaggtagctgtgtgttggtgttatgatcacagccatgctgtattttgtattacccagctaaatgcccgtgcgttgcaatgaaaattaagaataactttgatcacaatatcttttaaagccccaagagaaagtaaatcattcatgcaggctaatcatcggcccgtatttgcacacatgttgagctaaacattaaactacactgttgcttttaataatagaaaatgaatctaaattattgttattcttctattcgattaatgtagaatttttctcaccatttaattcaataaacgcttcacctttttttggccccatatgacaccacaactaatcttaaatgtaatatgaatactagtctttgtatttacaaaagagaatcacggagcaggtacgaaaaagaacaaaaaaaaaaaaaagagcgcagaaccccatctcctcccaaaacccatcgccgccgcctagccattgccgtcgcctcctccgcctccatatgaccatatccacgtcgccggcgcagccccaccgcctcagatccctccccctaccatccggcgaagtttctcatctgcctttgttgacgtaaaaatcgaacacggcggcctgggagatctgcttagcccctgtgcaggtccaaatatgatgagatgcgggcgtgccagtcagtttgatcctgccactgacaagatatgcaaacagtagatcaaacagccgatcggctgataagccgatggagtagttccagccgatagccgataatagccaatgccgataccagccgatagcgatagggtttaagcgatcggctatatgtccaatgtagataatgatataaaggcggctgatgataatataatatagcaatataatccagtagaaaaccaatcggctaataatatgatatagtagaacaagtattgatccaaaggttaaagcatacatcggctggggatccgatgtcaggaaattcacaagattagattaaacagtgaaacctttgttgtcatcggctaaatctaacttatatgtatatgcgatccttatgagccgatgcaacgtccagataactcaccggctgaaaccccgatgaaacccttattggcaatcaagaagcaggctagaaattatggttctaagcacgacttagtagatcaaacttaactgatgcagcactaagtatgaaaagaaacataatatctagacaatcaagccgttgactgattttcagggtggtagatatctaagctaatctaatctagcaatacgatttagccgataccggcagaaaccctaaagcgagaagcagccgatagagctaaattgatatgctaagactagattaacagagacatatgataaataggtaggtaaatatatcatccaaaccgtagcaatccaagagattgaatatactaatgcagccttgagcgatgccgacgtagatgacaaattcaccagggcccgacggaacgtaggacttaccccttcgccggagatcgaactgaaccgatgcagccctgcgtcaggtgcccaaattccgccggaagataagtaaagacctcaggaaagagggtggcgatgcgccgagagtagttgtattgatcgtgattgatagattacatagaccccgggtgtacatatttatacccatatgttgatacgagtggttggccgaccaaaaaaaaactattctaaaaataaaaggaaaaaataaagtccttatcggacattaaacacactttcctaaagataaaaggaaactaacaaactatgcctaattaatagataaactgccatgccgcatccttcttgaactcggactcttctagataagcttcctttgattgatccgattccatcgagaacacaacatcgtggcaatttgacgactcccatcgactgattcccccaatcggctgattccagccgatattaactctaagccgatgatgactttgggctttaccaaatttcgctgttaacagccttcccatccaccccgagtcccacgccgtcgccttctcctttccgcccccggcggcgtttcccttcctctctgcacccggcatctcgatcttctcacacagtcccccattgccgccacctcctcgcctcctactcactttctcatccccatccccatcccaatcgcagctcaaaaaagcatcggatcacagcta

SEQ ID NO: 80756 - DNA, 19259 bp, Oryza sativa
aggagtttaggacacaatttaatgctaagcaaatagaaaatctattattacctgttccctttaatatttttgccttcggagttttgaagctaaaaaccaagcaaacagctcatggtcactatgttattggttctctggtgtgttcatgaggcctgatggcaccttaaccttaacctgttaattaacaacaaaatttagattctacttgatatatcttaaaagccaacatcgatggcacctttttagttgtacaccaatcacctgaatactgtaattcctgactttgcatttagcctatgtaattagtaaatgtcaatcatatctactttctcaggtctacagagaagagttgagaaatcctctttggctttgggctaaagggtttttgggtggcaacaatgcacaaacagacaaactacactaattgtgatgactctggatttttttactacacttcataacaaaattgtgcatttttattttgggatgtttattatgttatcttcttgagatactccgaggtcaaatgatctttgagcaatctgtgttggtttcaaaatatggactagattgccgtttagtttgctactatgtattgcgttaggtttgactattttatgccttgtagcttgagctacagttcaaatatagcttgagctgaatctatagttctaactaatagtttatcaagctgtatgattttgtaaaagaaaaaaaaaatcaaaattaagtatgattgtgcattacgggcacctaaagttgtgcaacgcactattaagtggctagttatcagagaagcccagatggataggccgaagatggaccatccaaatgggccgttcataataaaaggcccaggccaacgacggccctcttatgagcctcagcccggttaagtattgggcttaacggcccatttatcttgtctctctggcccacctgcagagaaacaattggtttgggccgttgaagagaggaaaacctaggctagttggcgagctcgccccactccgtcggcggccgcgccttccctgtgctggaatccagcggccgccggagacggcgagttcgacgccgcggctgcgcgcggagacgttaaccctgcggcggctcctacctaggaggtaatctccggccgcagtgtccgatttttgcagattaagtagtgttcaggttcgcgcgcctcgatgattgagcatcagtagtgtttggatttagatttgggctatcgattcctcgctaactggttgagtagatgggtgctcaatgtacggatgttcgttgaaattatctagtgtgctataatctgaaggcggaaataatggcttggttgtattctcctgctgtttataggtgttcttactggttgttatagcgattctctgtttggtgcccatgagcaagaagaagaacaagtctcaattgccaataaaggcgccgttgaaagatgctgaacaagggtatatataaataaatataatcattgctctactgtattcttggttgtaattctagttgtttgagtgacttttagaagaataatttcaagggattgattcacaatgtgttttcttcctgggaagaataacttcggattacattggaggagacgctcttgatgacctattatcgaagcttattaagtcagtagcaaattgtctctccctcgacctttctttagggtgttgcttgcttctaattccggtgaaatgtactgtttaggagcgtggaggttgcaaaggcttcaagggaagggttgccggaaaagatatggatgaaggtagttccatatcctaacttcaatttcacagactcttattgtctgtagatctcttataatgactatgttcagaagatttttatgttcatttgcatgtatgacttttgtccatgtagcgacaatttgccgttggggtcaatgatgtcacaagggttcttgagcgaatgcctgctgctactgctgccacccattctggtcactcttctactgaagcaataactgacaaagctctgtgtagagctcctccggtgcttcttcaggtcgatttcttttcttgctattgcttagtctttagagtttgacagccttcttatgaagtttgagtttagcttgcatatatctattagttcgaaggaaactattttttaattaaagcacaaatatgctttgatgcataataacacaccatttttttctctcttttagtccagaaaaggacatgagtccattgcccccttcaaagaacgagtgctttacagcttgccagtaaaatgttactgaatgtagttttcaacgtatttcagtcatggttacgtactacaatctcagaactatcaattcattattcacgtgtgatgtatcaaactctggtcttctgcagagtgctaagtctaaacattgtctacatatggaaacacgctgcattcatgagttgctcgtgggactgtccctattttctgtcatatgtttagccaataaaaaaagagagattcagttaatatctggttaaggttcagccaagagcaacaaaagggtgattaggtgttgcacatgcccttagctacaatgtctacatgcagaatgttaatgctgacaaatatttctcatcttgtaacatggtattgtaggttgtccttgtagctgctgattgcaaccctaaatggttaacaaaacacataccaaccctggcatctacaaggcaggttcctgtgttgtgcctcaaggacaacaaagaaagctcactgaggttaggtcaagtggtgaatgtcagaacagcactggccattggagtaaaggtcggcttttgatttcttgttctacaattctttcattgtttcttgaagcatctcatgatgatttcatattctggtgcatactgcaggccagagatagcataatcaataaggctattgatgaagtcctgaagactgctaatctggttgccaaggaaccgtaactgagcttctggtccaatctcagtgacataatgggcgaatttatttttaaacaaggcagaagctctgcctcattccactaataaagaatagatattgacccaagaaaatgtttgcaccaaaaactgataggtgaattttggacctctgggtgctcagcattgcagtagcatcttgacaggaagtcatgaggatgaatgggcatgcagttgagaatttcgcgaaggaaatcaaggatgctgctgaactgtggcgtttacatctgaagaactttttctgcctgtattcatgaagatcaggccagaccaggcttgtttgttaggtaggttcattctgtttagttgaatttgtggatcatagagctagcaaagttgctcgcctagactgtaggctatattatgagcaatttagtgcgtatgtgtccactatgtataatgccatttgcagccttgtggatatctgccttatgttgtttgtgttcaaccttaatttggacgatataaatcattatcataacaaacatccttaatacataaaccaggatagatgtactaacgttattaagaaatgtcttgcattttgcattactttctcatcatgtcaagagtaacatatatctatgcggtcaacaatagcgtgataaattaaactacagctagttaacgtatatttatagtcaaatttgtttttttgttgcgagacgtagaaattgaatttaaacttgcatgtttgtggagtgatatatcacatattaatatatcttctcaaattttttcataactatttgagtgacatgcaaacaataagggaacatcccctcgagggatcaaaatccactcccatgagaaagggaataatgcatgcatgcgagatgccccaaattacacgcaaaggccaatgaaaaggatgcagcgactgttactcagtcctctgccactgttcactcagtcttcgagtttgtttgtggagtttaaaattctaaaaaacaactagctggtagtcagtttatgagaatatggagaagctagatttttcagcttctgacttctactccctccgtttcacaatataagtcattctaatattttccacattaatattgatgttaatgaatctagacatacatatctatctagattcattaacaacaatataaatatgaaaaatactaaaataacttacattgtgaaatagaggaagtagtttattttctcaattctataacttcagctcactgtggttcggtcaaggtgtgtcaatctgaacagggctgctgacagactattggagtaaagctcggctaagcttccatttcctttaggttgcaatgtccatcttaagaatccaccataccatgtttatacatcctgtattaaaatcatatttagtggcatatttattgagattagttattatgtgagcatcaaccttggtaggtgaagctatccatccacaagggctccaagaaggttttacattttcgttttggtttgctaaaaactgatgagttttgatcagtgcctatgaaaaccgactaagactgatcaattttgttaacctagctagccacaactacattatatcttcaatgtagctatgcccataattaaacaatgtggtggatataggcatcggactccatctgttagagcaactccaccaacctatttaagccaggctctacaagcatcagtatagccagttctccaactaatttggtaagccagacccattgctcaagccatttacacaggaacccatatgtcagtctctcactccttcctcctctacaccttcctccaactactacctccaatcatccatcctccagttctccaccaccaactggcggcaatagtggcggcgaaaggggaagcggccgcgatagcagggtggagagaggggaagaagtggatggtggtaggagctgcactcaggtggtggcagcaccagcaccctaatggggtggaggtggtggtagggactagggacaaccacatcgggaaggtggggacggcgatgcagagaggaggggtggcacgacgacgagcgaacgtggtgggcttgcgcggtggagaggcataggcgtgacagccggtgacgacatgcccttgcgcggtggggaaggcggaggcacaatgtccagtgacaacatgtacttgcacggtgaggaggtagaggcacgacatgagagggattagggaggggagagagaaggtagggtggtgggatccatgctacaagtggttccaatttgctagatttggtcagccaagtgagaaatctgaccagccacttggcttggtaagttggatgacaagtttgttggagggcgttctcttgcccaagtttaccaaaattttgcttggagagtaagatggaaagactattgaagatgcttttaagatacatgtgattccaagaaaattactgtagcaaagtttcttactactttgagtatgtatatgcttttctaattaaaacaaggtattggtgatggtattaaatctgtcactccacctactcccattaaaaatttacaaaatttaccccccttaaacttcttagaattaaaaaaagttacgacatataaaatgattatgcgctataggaaaaaaacacatttcataaaaagaaaattgtatttttttgtatccggtgcaaagtaggggcactcagctagtactaaagaaaggcactctcggaggtgtatgcttgtagtgtacgtatctgtgtgcacacgtgtattaaggaaataagaaaaattcagggcgaggcatgctgctagtcgggtggcgtcgacgcgagcactcgttgtcaagatgtttgtagcccacgagcgcggtggcgaagtagcagagcacagtgatcgtcaggtaggccacgatggttgcccttccacggccgggcttggttatgagatgttttaactttgatcaaaattaaactacttcaaatttaattaaatttatagaaaaactaataatattttttattcaagataaatttaaaaaatacatttaatttttaatttaataaaactaatctggtaatataaatattactatatttgtttataaattagttaaacttgaagcagttgattttttactaaagttaaaacatcttataacctgaaacggagagagtagctggctagcaagtaaatttgctcgcctagactgtagtccatattataagcaatttagtgcgtatgtgtccactatgtataatgccatttgcagcctttgtggatatctgccttatgttgtttgtgttcaaccttaatttggacgatataaatcattatcatagcaaacatccttaatacgtaaaccaggatatagatgtactaacgttattaagaaatgtcttgcattttgcattattttctcatgtcaagagtaacatatatctatgtggtctttaaaatacaatattgaccatcaatatctaattcctctgtccctaaaagggcgtagttttactctaaaaaattatctctaaaggagagtagtttttaagaatttatctctaaaggagtgtagttttagtttggtccactaaattaaacctcttttatacggcttcatcatttttagctatactctgtccttgttttttatctgtattaacgaatgtcatagtattcctttaacctcttgcttataatatctttatgctaaaactacatgccttttgagatggaggaattaattattgcagaagattttttttctaaaaaaactgagagcattataataccatgaaaatattgttttaacgcaaatatatagatagattttattttatgcaatctactattataaaacttgataatgttcctacaagtttttcatctgttgcctccatcgtcgatcgggtcaggctcttgtccggtcacacggcgacggaatttttttcggttttagatttttttttaatatttacagaaataatctatcggccaaaaaaattacaaaaatagaccctgccgcccacctctggggcagcaagctgacgtggcaaacgggggaggaacgggcgatgacggagggagggtttttttgcaggaaaacccggcaaggggcccgaatgcaaaaaagccagacggggccggctattttgcaggcggccccttgccgccctctggccaggcggcaggcctcactgcctataaaaggcctgctgcccagcccccagccctcattcttctctcctcaattccagtgaaaaaaaaaagaagagaggggaggagaagagaagaaggggcgaagccctgccggattcaaacgccgatttcaggtaatattcatagatcctatatatgactattgagttaaatagtgtgtattctttaaaaatttgtttgaataaatgcattatatttttagggttttagttgtactaatctagaagtgcgtattgtagatatcggtaactacatagatctgctagtttggaatcaatacattaccgttgcattggcttacacaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagaggagtgtaccttctataaaaagatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagatgaacatggatgatggcgagggaccaagtgctgaagtaaacgagacttctgtggaggaggtcaacgcacgagaggacgggggcatagtagctccagtaggcattcaaccaggtagagtggctgacgagggggagactgtcggtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagtttagggttgccaagtcgaaccggtcgcaatatgaagttcggtgtattaaggaaaaagatggttgtccctggagagtgcacgcgtataaggggaaatggaaggattattggacagtgtcagtcgttaccaagcatacatgttttctacctggtgttcagaaataccacaggaacattacttgtgcatttgttgcatctgagatgtatgcgcatgtcatcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaattgaagaaattcccctcaattgaacatcctagcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtgtgcctgatacatgataggcacgctagcattctgcgagcgatagaagagttgcagtttgggagtatggaacgaggataccccggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggacctctcccaacggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtagagttcattttatatgggacatgcaggtattttagggatcggttccaggcagttcttccctctatgccgaacaacagcattttgtttggagctttcatgcagaaaaagctaaaggagttgcgtaaaaaggccatgaaacatcgagctctagtgcaaggtacccaacagcacaggtttgagatactatgtcaagataaggcaggcaggggtatataccgcaagagagtgaagcaggagtgtgttctcaaagccgacggcacatgtcattgctcttgtgcaaagccgaagctgctccacaggccatgcacccatgtcattgctgccgcagcggagtgtggcataccagatgcagtatatgtgtcacagtacttcagtaagcaagcaatatatcatacatggagcggcgagatttatgggttcggcatagctagggagttcacagagactaacgatgaagtactcaatattcctgacccatcgaagctccgaggcaaggctggaaggaggaggactcgtcgcatccgcaacgatatggacgagttggaggctggcagggtgaagcgttgcagcaaatgcgatgaacatgggcacacctacaagcattgtcctaaagacaaggagaaaccaagtgtggcggaggcaggactatcaggatcagcagcagatggagctcgccctacgggtgaaggcactacctccactcgaccacgtcctaggcgtcgtcgtgccacgtctggctacgtggtgtagttcttatgttctatgtcggcatgtggatttgcttgtaattcgtttcgaacttatcgatgtgtttatgtttcgtcgtgtaatgtcagacttcggcatgtcatgtctttaggtcttgtgatgtaacgtcggactaaggcgcctaatgtctttaggtatgctgatgtatgtcggacttcgacacgtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacattactattttttgaattgttctaacacgagggagagccacacactgaggagtcgtaccaggcctacctacgctggtaccagccacgcacccgtactagggtcaccttcgctcccttggagcagcagccccacgttgcgagcactagagacctctacgccaggcaccgcgaccaggacttcgctcgtgttgtgagtaccctgcatcgcaccattcctttatgttttcatgtctttctcttcgtcaaattttacgaatatttacgaacaaattaaccatgcaggtcgacgacatcaaccgggtcgtcgttgatggttcaacgacgatccaacgtttaggcgcggggattccggtacccgtagaggagcacctgacaacgtacacgcggatgggaagtcgatgcgctcgattctccgagtgctcacctgtcgtgcagacgacgttgctcgggcagacgcagctgtacagcggccacccgtaccgactggtccccgtccagctgcgcacgttcctaggccgactccccctccgcacggaggtaagtatttttattactatttctgtacatgcctcgcacatataagtgagccgtttacttgccgattgcttcagggtttcgtgcaccgttcagcaccccgccttcctcggataggccttctgttgtgccccccacaggtacttaaaaaaacaacattacttccgcaatcaatttacatacattttatgtcttagcttacaagggtcccgttgtcgatgtgtaggtttcgcccagttcgctatgacgcaggccgcccacttctcccaggctgcagggtcagcgtcacaggcagccggcacgtcgagtcagggtccaccactggaccattcttggaacttctccgacccttgctgcttcaccggcccttcaatccttactccacttccttcagctcaacaaagaacttatcgcccttacacttggagggcaccgcggtgcaaacgcagggaccagcgcaggccactccttccgcggacacttgtgctacccgtgctgtgccaccggatcgtttcacctactcccaggaccacgtgcgagcacaggcccggaggaccaagcgtggtcgcggcgcggggcagggccagtagagcagtcttctctttgtttacttgcttcactttccagtactgtatgcttgtgtaatgactacgttgttgttatatgtgcacgatacctttcggcgcatgcacgatacctttcggcgcatgcacgactactttctgccgcaccgatgcagcctcctttattcgtgtgtgatacgagtatttgcccgccatttggcgcatacgaccaatgtaactttcggcgccgatcatgcatgtatctttcggcgccaatcaggcgtacccaccataccccaccactttcacatgtcaggggtatcactggattttttgcgcctatataagtcgccttaacgagtgaggcctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgtactacggcttgcgcatacatcgagtgggtcgatacagaaaatcccattctcgacctaaccacttgtttacaagaaggtcgctggtatttcgcatccgaaagtactgagcaatacttacagagaaaagcggcttatgaacgacaatgtcgtgaacaacagagcgactggcgggtgctaactacggcaggtgtggtgatcgttgtcaggttcttcgttccataaatcctacaacattgggtcgaaagttctttgtttatccaaatattcttgacgacgatttcatggtaagaatattttgattacatgaatccttattttctcacaacatttactaactttgcttgctttacatctattctttcctcctaggaaccaccaaggagatgtcaatacagagaatggatagacaccagaagggttctaactccacctagccgtgttgtgcagcttgaactaccagagcaatacagggttactaaagcgcggtttgagagaggagaaggatcctcacgtaggggttagctattatcggacaacttagcatattgaaatttctactgtcatgcttccttgtcccattactacatcgtcgttgtgttcaactattgcactacctccctcctagttcgaatctaatatcatctatgtaaccgcaatgcaaatagttgtatcatgttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttatcaataaatacttctttatttattattaacataacatagaaaaatcttttggccgtacttttttcatctgggtcccttaccgccctctacccagatgaaaaagtacggccgcaagctttttatgggcggccaaaattgcaattagccccttgccgccctctgtatgggcggcaatggcctaatcgcaattttggccgacggcggcagacgacgcggtcgacccaccgtctgccacgtcagcttgccgcccaccattagggcggcaggggctatttctgtaatttttttggtcgatagattatttctgtaaatattaaaaaaaaatctaaaaacgaaaaaaattccacggcgacgcgggcgccggcgagagaaagcctcggtcctaaatgggccagatgggccttctgcccattactccttacctgggcttgctcctctgcctgggctgctggctgcttcggtccgccgtgcttcacagatgggcctgtcggcccaagacgagcggctctccaattatcgcatatgtgattgtgagtgacgatgggaacagtaacacaagctataataagtgtaacgtaagaactcatagagcaaacttcatctttattgaatgaaaataaacaaagttgggatacattttgcacattcatcggtgcatataactcgtcaagcaaacaagtatatttcgcgatggaaataaatcacgcatcacaccgtgtatagcagtattatatgttaattaccatctatcagaattcagagcaacgtaatcagacgacgtagcattcgtagagcttgatgtccatctgcagccggaagtaggtgaagccctcgaaggcgtcggtgcggagggtggcgacgccgcgggacatgaagaagtcgccggtgccgcccacgacggagatgtccctcgtcttctcggcgatgatgtcggcgcccatgaggttgagcgtgccgcggcgccccgtggagttgaacacgatggagaaggcgaaccacgcgttgaacgcctccttgctgttgtagaggtagaccccctgcgcgcgcaccgccgtctcctccagcgacggcggcagcgccctcccctccgtcatcgggtcgttgaacaccaccacctgcccgaagaaggtgccgccggtcgacggcacggcggtggccagcgccgtcggcttggtggccgccgccgacgtggagttggaggtgctgttgctgtagtcgtagaggatgtcgtggaggtagagcctcatctccttgcacggcttgtcgtagctactactcctgacgaatctccttccatgggcgacgctcgcagagcagctgaggaagatgcaggccgcggcgacgatcacagacgccatggaccatgtcaccatccggccttgcattgttaattatttgcttattatgaacaagcaggagaagctatatagctacgtacttagctaagtgcctgtcaatgctggctttgatttgctgcagctagagctggagttttgcatgcctatttatggaggtgagaaagggaataatgcatgcatgcggcatgccccaaattacacgcaaaggccaatgaaaaggatgctgcttctggttgtcttccgcaactgctcactctcttctgaggatctgtttgtgagcttaagattttaaaaaaataacttgttggtagtctgtttatgagaatatggagaactagatttttcagtttctaacttctagtttattttctcaattctataactacaacttctaagaatctaaatgaaaaactatattatatgaaagctgcagctcccaccacacagacctctggttgcttgaatgctctgagtctgactatcctcgtgcaaatgcacagtagaacacacttaccagtagtattttatgatagtggagctatccaccagtcaccttcaaagggaacacactttacttgttgtgcttcaaagggaaggataccagaaaaggtacataatatacttagctatagactgctagagtatccgttttctaaaagtttgtaaattaagaaaaactggttattaatgattaacggtaactaaaatgtttggtaactaataattactatcccagcattgtattcttttccaaaaaaaaaagttatgacctacttacgtggaaacatatatctcatctcttcgggacaatgtgtccgactagttaagtgggccaatattaagttacttaaaaagattacgataatatttaccttaaggatgacattttttttattgaaatatccataaggatgattcatcttacccatgacagtttgacaccgtaactcattcatgagatcacaaagtcctcatggtcattgagaaggtatcataaggtaaaataaaatttagtgtaaaatttgatacctcatattactataccaagagataataaatttataatagaaaaattgatacatcatatcatggtacccttcttaaggaccgtaaatttgctcatataacagaggcaaataaacaaaagcatacatatttttttaccaccaaatcaataacgttaaatcctcttaacaaaataggggcagatctgagcttgggttaatttagaaaaacaacgacaaaatcacaaagttaaaacctgaacttccgtgatgaatacatcacttaattaactaggtcttcctgttgatgcatatatatatatatatatatatatatatatatacacacacacacacgctaaaacttgcctattacaacccttaaaatggctacagaatgcatagcaacattggcatctagaaggagattaagattactgtactgtacatgtggtccacggacgagacaattaatagaggtcgcaactgaagctcactgtgtggttcggtcaagttgtgtcagggctgacgcgacagactattggagtgatgcccaactaagggcctgtttggatccctgtcacatcaaatgtttatacactaatttagagtattaaacatacattaattataaaacctattctataaccttggactaattcgcgagacgaatcttttgagtctaattacaccatgatttgacaatgtgatgctacagtaaacttttcataattatggattaattaggcttaaaaaattcgtctcgcagattagctttcatttatgaaattagtttttttattagtctatgtttaatactccaaattagcgtcaaacattcgatgtgacacggactaaaaagttttagccccatctaaacaccccctaagctttccatttcctttaggttgcaatgtcccttttatcgcatcaacgtgcatgaattaatgcaccatttttatgcattcttaaatagacacgggataataataaatccataaaattcttactacaatccatattaaaatcatatttattgagattagttattctgtgagcatcaaaacgttggtaggtgaagctatatatccacccacaagggctccaagcaggttgtacattttcgttttgaaattacaaaccgttcctcaccggtttgccaaaaactgatgactttcaatcagtgtctatgaagaccgactaaaattgattagttttgttaaactggccacaactatattatattgatctttttgtagctatgctcataattaaacaatgtggtggatataggcatctgactccactagttagagcaactccaccaacctacctaaatcaggctctccaaacatccgtatatatacgtatatatatagctagctctccaacttatttggcaagctagacctattgcacactctatttacattgggacccatatgtcaatctctcactccttccactacatcttcctcccaactacaacctccaatcctctatcctccagttctccacgagtactccaccaccaacccacggcaaccactacaccaaatccaagaattaccgtccaattaatgttggttgggaaagaactatatataccaacaaattgttcgtcggcataacttatcaacaaactatcggcgagagggaaagctgtcggtggttgcagggtggcaagaggggaagaagtcgatggtggcagcagctgcacctgggcgacgacggcactagcaccctggcgggatggaggcaggggtagggactagagtcaaccacatcggaaagatggggacgctggaggtggggacgacggttcagggaggagggtggcgcgacaacaagcaaaggtggtgggttcgcgtggtggagaggcgccgtaggcgtgacggccggtgatggcatgctctcacgcggtggggaaggcggaggcacaacgtgcttgcgcgatgaggaggtggaggcaccgcaggagagggattggggaggggagagaaggtagggtggtgggatccatgttacacacaggtggctcaatttgctagatttggctagccaagtgagaaatttgatcagccatttggcttggcaatttggatggtaagtctgttggagggtgttttcttacatgggagacatgacggctgtattgagtgtcatgcatggcagctggggagctatgggtgcaggaactggaagatgcaaatcctatccagactccagtacgactgttgcagcagcgcccacgacgagcccagcttgccggccgccgactcggcaaacttaattctacattcacttgactccggcggctgttgcggcatttcgtcgaacatttgcttggcatgccgaaccttcttttttttttctttattgaatgaaatgaaatggaggtgcgatacattctgcacacagtacacacaggtgcattttgcacacgcgcgcgcgacgtgcatatatacgactcgccgcgcgttaagacggagaaatatcgattgagatggaaattactccaaaacacacacacacacacacacaacgatcatgtttaatactaggattccacacaccgcttatgcatatatctgatcagacgtagcattcgtagagcttgatgtccatctgcacccggaagtatttgaatccctcgatggcgtcggtgcgaagggtggcgacgccgcgcgacatgaggaagtcgccggtgccgcccaccacggagatgtccctcgtcgcggcgttggggtcggcgcccatgaggttgagcgtgccgcggcgcgccgtggagttgaacacgatggagaaggcgaaccacgcgctgaagtcgtccttcttgtcgagaaggtagagcccctgcgccctcaccgccgtctcctccagcgacggcggcagcgccctcccctccgtcatcgggtcgttgaacaccaccaccctgccgaagaagtagccggggctcgacacggcggtgctcagcgccgtcggcttggtggccgccgccgacgtggagttggaggtgctgttgctgaagtcgtagaggatgtcctcatctccatgcatggctcgtcgtcgtagctcctcctgctgctgctccggcggccatgggcgacgctcgccgaggtgaggctgacgaggaagatggcggcgacgatcagagacgccatggaccaagctgtcatcgatcagagacaccagtgtaatgcagctagcaaagtagctaaacttaattaactactccaattgaataacctgtgatcgatcagctcgatcgagagagaattaagctaaactaagctaagctaagctaagcgcgcgcaagtaagacagtacgtgtgttgctgcagcttatattagctgtgatgtggaggtcgagttgtgcacttctgcatgcttatttataggagatggcaggaaaaggaatcctctcctatcttaaaataaactaatatcttagtatatactttctccattttacgatgtaagtcattttaacatttttcacattcatattaatattaatgaatttaaatagatatatatgtctacatttattaacatcaaaataaatgtgaaaaatgctagaatgatttatattgtgaaacggatg

SEQ ID NO: 80757 - DNA, 4705 bp, Oryza sativa
taggacctgcaaaaaaaaaaaattccgagttgttaggatagaaagaggaatcaagtgagacgtacgcaaggatactactgttactcctgttgctttaatttgcttgattctgacgctgataaatgtactgcggtctgtggattatgtaccgtaaggttaggttaaggctgtgttatacagatacatatttaaagtattaaacttagtctaataaaaaaacaaattataaaatctacctataatctgcgagacgaatttattaaacctaattaatctgtcattagcaaatgtttactgcatcaccatattgttaaattatggtgcaattaagcttaaaaaatttgtctcgcaattcataattagttattttttcgtttatatttaatacttcgtacatatgtccaaacattcgatgtgacaatgtataaaattttggcagtggatcttaacaggccctaactagccagatctgaagctggctactgctgattagctagctagtgtttgctggctttattactgcagctgcggtggagactggataccaacgccgcgtccttccccgtatgaacaccgtgcacagggccgtggcaccttgttgccgcaggtttcatgagtgattttcccggtctgcacccgaagccaaagattgttgatcatcctccaccatgcagaaccctactcgatcggcgcaacctccacttatggtttttattttttacattttagaactttttaaaaacttattttacaaataaatctctaaaagaacttattccgggaatagaatttttttgcaacgccaatatcgttggcgcagtgatccaacataacgacactaatttcatcgcataaatggatcagaggcataaatagtgtgccttgccctactactgccctcaagcaagtttgaaaagacacatttggttgagctggtctaaccagagacgtgttccccaccggattgagatcctctgcattgaagagtaaaatgcagaggatctatagtatttttgcattaacacatattttgagccattggatcttcattaaacggtacagatcagtccactacagcacaacgctacagtaaaaacgctcaacggtaaaacggtattactgtttagaacactggtgttaatgcaaattgttgtagtacaagttcaaacaatgttctctgcatttacggcagaggacctgcatccgttccccgccggttcatgataaagttgtcctgtttagccggttcaaagcggtctggtgcatacggtctttgcgctgaaccagaccgggattactgatgagcattagttcgtatttatctggtcgaactgctggtttattcaactatgcttcaaacttcaatcctcttaaatttagaccccaatccaaattcgacttctcttttcgtacacatacaattcctcttataagttatatggatatgtcaccaccagatacattgttctctagccttaatattccgtatgatctttgtcgacgggggatacccgtagaccggatatagagggtatcggggtccgttggaacgatgatctacgtagtacgacatcaagcaaacaaaagacaaggattatacttgttcaggccccttgataggtaatagttctaatccagttggtatgggattatatgatggaaaccacagattacaaagggaatcacaaaactcgatgataccgacgagaccgtagtcgagttggtccgactaaatctcccggcgacttggctcctgtaggctccaactccgtaggctgtggtgggtatgttgacggtaatattcgatgccttaggtcctgcctggggggtcccttatataccgcgggctagttgatctctatgtaggactcggagatatcggacccctcacgatatggtaaagacccaatcttatccgagtaggactccttccatccgtagattctgtttctatcacgtgatagatttccttaacgtatacggaaattatccgtatgcgtgcgggtatatcatattgatacctatcgtatatccaaggatagagggtataccttatccgtaaccctgacaatcttcttgatcatttggatcttagggcctgtttgggtgagttttagattctgagaagcagctgtttggtagccagcttctgagaatctggaaaagctctgaaacccagcttcttcagcttctggcttcttagttcattttttagaatctgtaactacagattctcagaagctgtggactgtttgggacagcttctagcagaagcagcttttcccaaaagctgcagctgggacaagctcccccaaacagggcctttaacttctcccaagtctctcgattccatcataaacattttgtgcaattgataaggttaacccgagattttcgaattgaaaatcatattaagcatctgttggcgatgctcgtgggcatattaacaccaatgttgttgtaaagccatcaaggtggcaaggttaatgagcaaagcacaaattaagaaagcggcttctccgactgactttaacaacagttattacattgttcccatgtgtttttatgctgccagaatattaaaatcatggttggagaaaaataatcgataagtatggtagagtagttgctaaagtacgatatctaattaagaaggacacgttaacacaataacactattggaaacaagtggtcatcctggaaaaggaaagttggagaacaaaaaggagttggagaagaaggaataatgagaggtttcttcttatggaaaaggtaagttgcaatgattgtcatgggaagggattggtcactggtgtattccaccatattctctccgccaaaaaaaaaaatccaatcctagctacgaaactgaacacacacgtgtccaggttcatagctaggattggatttttatgggacggatggtgtatttggcaatggctcgaccaacatgtgactataatgaagtagaaaataaatttacattcgaagcaacagcgagttggagacattaaacatgatatattgaatctataagttaatttaattttaggatataaaaagaaaatacatagaccatatgtgttgataaaaagttggttttaaatgtatcaatgggatgtcttacctttaatagtttaatagtcctattacccaaatattaaggatgtcggtgacatggggccgagggtatcatgcctagaggcttgggcagccgcggtcacccacgtggcctgaccccctcgggggggggggtcgggcccgtgggtgacgtggccaccccttcccctctctccccgaggggtcggaccgctcccgtttcggccccgagggccggggcgccccgaccccctatgggtttggcgccacgtgtatgggttaggtgagcacagcggggctcacctaaccgcatttattgcgggtcggacgagcgcgtcacgccgcatgtaatgcagcgcagcgcgctcgcttatccggtccgtgaccgggcgcagtgtgtgaccggtcagatcgcgggttaggtggtggcaggcggcctgttacacgcctcaccccgtcccgtcggattgatgagagcctccaggcacatgtccctagccggagacggcgtgccagctcctgaagatggcacgtcggtcccggtcagatacatgccaggcttcatcgcaaccattgtaaggaagtcattgtatgaagaagggcagacatgcagcttgctaaactgacggcgtggtggacgagagtgaccggtttgtccaatggttctgacgcctgtcatgtcataggcagacaaccacgctcccgttttgcacctccttccagcggagtggaggtaggtatgacccatcccatcggagggtcattcgaacagcagccattgcaaatctccgcccatttatgaagggatgacagggtgatctccgaggttagacgaaccaggacggctggccacactcaagaacaagctgtgttttagcttccaagagaaggcgagccaagttttggtgaagataggatgggtccccacccaaaagaaaagtaggtagaagtggagcatgtgggatccccttgagttataaaaggaggaccttgccaccaaaagggggagagccgaagaaaaaaggaggagggacgaaggaagacaacggagagaagacctgagctctctagctctccaactctctgtaattccttcacacacagatccaccagaacacaggagtagggtattacgcttctcagcggcccgaacctgtatacatcgcccgtgtcttgcgcgttttcttcctcgcgaacattccacagaccaagggcttagaacctcactcagcgcccccggccgaactggcaaaggggggcctgcgcggtctcccggtgaggagccccacgctccgtcaaaggagtattctaaacggtaaatctaattggagaggcatccacatgctagtactttagaagttttggttgctattaatctattgagcaagtaagggaaatattcctatcatctatgctataaaattttctcttaaattactcatccgatttagaatccgattacaccgatgtgttcgtaataattaaatatttataacaagatctcacatgattatattttgatgaaaaatcacaaattacttttatgatatgtctaaattaattttagattttactaagttactttttagacatataaaagtaaatt

SEQ ID NO: 80758 - DNA, 7020 bp, Oryza sativa
aatttctagatagagtcatgtttttatctctacaacggatttacttcaaatgacatgctaaagttaccttcgttttgtcctaagttacttctgtaatatatatatatatatatattacttttaggttttactgaatttacttttatatatctaagaagtaacttagtgaaatctaaaagtaatttagacatatcataaaagtaatttgtgatttttcatcaaaatataatcatgtgagatcttgttgtaaaaatttaattgttacgaacacaacggtgtaatcggattgtagatcggatgagtagtttaagagaaaattgtatttgaagtataggtggatgatgcctcttatagatggagtgatagctagtttagacaaaccagctaccactagctgtatagttacgtcctattctaaaatatgtacgttataccttttgtgtcataaatctagccaaggcaatacacatgggccgccccggtagtcataaaattattgttagagtcagacttcaaaaaaaaaaatccaaaatggtagttctatcaattcgcctattactgattataaggtaactcaaaagtaatttagaagctcttaacgacttaaaaactaatcatgaaagacaaactatgataaaaaaaattaaaatatactctaaaattaagctccaaaatcaattattttgttacacggctgataaactaatgagcaaatgatagagcaataccataagtatatagtataacgaaagaacgtactacatctttattgaacgaaaataaagcggtgtatacattgttcacacagagagtcggaaaaagataaatgggtttgggttacatttatttgcacactcatcggtgcatacagatactgcaggtactcgtcatcaagtaaatactaatatcgagaaacaaattccttttaaataaacaccacatcatcgattaattagttatcagacgtagcattcatagagtttgatgtccatctgcagccggaagtaggtgaatccctcgaaggcgtcggtgcggagcgtggcgacgccgcgggacatgaagaagtcaccggtgccgcccacgacggagatgtccctcatctcggtgttggggtcggcgcccatgagattgagcgtgccgtggtgcgccgtggagttgaacacgacggtgaaggcgaaccacgcgtcgaacaccaccttgccgtcgtagaggtagagcccctgcgccctcaccaccgtctcctccagcgacggcggcagcgccctcccctccgtcaccgggtcgttgaacaccaccatcctgccgaagaagaagccggggttggacacggcggcgctcagcgccgtcggcttggtggccgccgccgacgtggagttggaggtgctgttgctgtagtcgtagaggatgtcgtggaggtagagcctcatctccttgcacggctcgtcgtagctcctgacgagcctcctgccgccgctgcggccgccattggcgacgctcgccgagctaaggaggctgacgaggaggaagatgaccgcggcgatcagagatggcttggaccaagtagccatctgtgtgcctagcttggcgcgtagcttgcagagtaatgcagctagctaagtagctaacaaacttaacaatttgattagcctgtgatccatcagctcgagagaattaataagctaaacgcatgcaattaagacagtacgtgttgctgtagcttaataattagctgatgtgtggagctcgagtttgcatgcttatttatatatagtgtccttgtgaggagtggcagactccgagctagctagttgttgttaggatagaaaggggaagtaagacgaccgaattgtttattctcaattccgagttgttaggatagaaaggggaatcaagtgagacgtacgcaaagttagcactgatgctgatccgtcaaccgcatacggcgcggctcccctcccctgctatcgagatccggccctccctctccctcctaatccagccggacggggagggcagcgatggtatagatggtcaaatgggccgtccggccagacacggctcaaccaacacgccagaccggtccaggcttgtccacacgctgcacccctagcttagacacgccaataagactcatgccgcatgtcgggtcggtttaaaggcacgatagcccatcgtattttttcataaaataaatctatttttcctcccttatctatttggttgtatcttatatgactagaataagtctattttatatccctcttctctttgggcagtgccttatatagctgagtcaagtctatttgggatccctcaactatttctctttgtcatgccgagccgtgccgagggagcagcccaggccgggccggcacgggcacgaccccagccgtcgggcctcggaccaaatggccatctataggccacgggtggaggtggtggcgtttttttatttgttgagattgtttttgccggcggatggatgttgcgcctatgaaaagattttttttttgaatgccaccgggggggaacttctcacctgaattaaaattaaggaaacatcaaaactgtacaaaccatacaagaagaaaagaggaagcataacagagcgaaagaaaagacgaaagagagagagaaaacaaacaagagagattacataaggtggagaggagaggagaaggatgcaagccaagacggaagaaccgcctggtcagccagcttgaaacggtttgcccaaagcttggcgtcgttgacgcagcagcggagaagacggttgatggatggtgcaaggtgctggaaaacaacttcattacggtggttccataagcgccagcagcacaagaggaagaaggtgctgtttagtcgttctggaaggtctccagaccagtggatggtgtgaatctcactcagggaggttagcatgtgtagcacttgaatcaggccccaggaagcagaagccagggggcaggcaaggaagatgtgatcagtgtcttccgggcaggtattgcatagctgatatgttggggaggggatgattgacttcttgtgcaggttgacagcagtaggtagtctgttcatagaaattaaccaaccaaaaaatttaactatcggaggggctgagctcttccccagatgaattcctagggtggccaaagttgctgactttccatggttttacaataagggcttaagttgatatcaggcaactgcggcagctgattgaactttgtattgtgtcttggtcttgtgagagtgggaagtcttgaagtaggtcttgcagcagatgcagttgttgttgagccactgttgacagccttgggacaaggggtaaattaagcccagcgtggagcgctgaacgaaccgtgagatgagtagttgtgttgtgagagaatagggctgggaactcaatcgagagaggtttatcagtcagccagacatcaagccagaagtttgttcgacagccatcaccgattttcatagtggaatgagctcgaaggaccggcagaagagtgattagagtgtgccagtgttgtcccagatcggctgagccgagagcaggcgcctatgaaaagatgtagaggtcatcttctaaagtgatttttgcaggaggggttagtggcgaaaatcgtctattttcgtaagccttgaagtgcaaacggggtagagctccgcatggaaaaatttttcttacccgtttgcaaaaaaaacagttttctagtaatgatttgtattagttataataattagcacttcactttcactaccaggaagcttaatttagtttctttcagttggagaatatgtttgttactctgtaccccttgatacacatttgttacttatgtatctctggaacaatacgtttgttactctgtacccatgccatcgatcaaaatcctacgttcgccactgctatcgccggttcacaaccaccgcaaatccggcctgcagccttgcgaccgacgagcgcagcaccgttcaaaccggtgaacatagtcgtctacaagtactagttattagagtttaatcagtctcaaaacagcactgaacaatgggataaaggggccggcagtaggggttgtaggcgtttaatttttcaacagcatcattttttgctttacgaatgccacagattctaaaatctactaacatgacaactcagaaagctctgtgcatctttatcggactaattaaaaatgtgagacattttgcagagcctttagggaattaagaaataaattgagttggtgctatatactgcgcaggcattttttttatgggaaaacacaggctttgccatgtgatcctccgacaagtgcgccgtattaggcaacaagctagcttagcagcaaatgcaagctggttaattggttaggtgaccaccaattaggaggagtagtggcattacttgttggcttcaatttataaattcgcctcgattaggtccctttttctctacgcgttgcggacaatctcgagcaacaaaatcgctgaagtattcatgctcgtgtttatttctcgagaacgaaagaagaaaaaaataaagacgaggagattatacaaatctcaccgagaggcggatggcacgtctcaccacgcacacggccacgatccatctttttaatttgtgggctacagttgacacggccccaactagtagttctctatatgaatatctttaacaaatccctaactttacactaataaaagcagatggaatatactatattcacaggagtttagtattagtagtaactgaactgcaatataatctgcactggttgacagagagtggatatgcttcatgaatcgggtgtgtagcagtagtagcgcatgtgtcttgcgtagccacgcacacgtgcatcacgagctccatgtgcgtctgcccgctttctacgccggtactacgtgtttctcgctagacgcctcaacaactcatgttttctagacgcctcaactgaagcagctgatgcacgcgcgagagagatcaccggagatgcaacgcaaccaacaacaacaaaaggggctgtttggatggtgatcgtactttgccacatcaaattttagccgtgccataattttttagttagtgtttagttgagtgctacgattaaatcaaagtggccaataaattattggccatattttgagtagctttaccacagttataataaatggagttatggcaaagttagtctccatccaaactgctcctaacatattaaattcgggcttcgtcatgatctcatcccatccaaccccgtgctcgccaggaaacatgcagtacaaaccacttaaaccgtgaaaagcctgaaaattaccattaaattctgaaaataacttctgagatttgtccacgtcatttagagtaaaaaaatatttctggattcgaccacaagtaaaagttttacttttaattatgtgaaccaatctcatacactcatttctaaatccaactatattttcgggatgttcactattgtacgtggtttgtatcacttccccccatcctaaaatataagtattttttagcatagtgagtcaaatattttttaaaattttttgactattaataacaaataaattaaaaagatcaatcacgtaaaattgatgttactatatttatcattaaacaaactatcataatatgtaaattttttttcatttaaaacatcttgattttatagatattgttgatcaaattagcgtatcgaaaactacgtcgaaattctaaaatacttatattttgtgacggggggagcaacgtagtatattttttccatgctcaccggctgcggagcacggcgcgcgggagcacacttgagtcccgcgtctcgtctcggtgccagaatccccgcgcggacggggcgcgacgcggtctccggtggtgccagccgcggtgaccacataatactatcgcggtcggctcggctcggcctgactagtcgatcaacgaacccaccacaccagcggccggcaggaatctctctctctctctctctctctctctctctctctctgtatgtggtgtggtggtggttaattaactgttcagtcaggggcagcacagccacaggttgctgtagtatctatcacaggatcgccatcacgacacaattaagacactgatcaagtgactgcagatggatcaagtgcatatacaagacgcgagcgatgggatccatccatcgagcccactgtgggcacaggcgacggcgattggttaattgattttctactgctgtcgtccgatccaatgattctggttggagtactaattaattgactgctagtacgttctgtagatgatcatgtggtgtttggagccatctaacagtccacgatccagctgattcttggaagggtgtttcctttgtttatactggttgttgtaccaaatggttttttttaactgcatgctacctcccgcccccgggtaactatcaatcattcgttgatactacaagtgaagtgagtggctagaagtaaaatgaaaaaaaaaagaaaaacagtgcccttttggctatacaatacaagaaaaaacatttttatgcgacttttgaaagagatttgggagcgtgagacgaaatggcctctcgatcggaactgacgagtagaatcggagtcaactcatcgcccataagacttttctaccgggcgatttgaccaggtattgaaaaacttgacaacacgccagtggaaaatcaaacgagctcacacacagagtaaaattcaaagatcaaaatttcaactttcccttaatttccacatccttgataagcccacattaaaaaaaaaggaaaaacataacaagttaaacacgcagttaaccacaaataacgagaaactcaaacacgcaggatttttcacattttggtccttttaaaaaacttatttcgcaaatagacccctgaaaaaatttatcccaaaaatggtcctttttagggcgccagagtggctggcgccgtcatccaacgggacggcgccagcctgccaccgtggcacatgcgaaccgacgtg
